United States Patent 11,882,838 (BACTERIAL INOCULANTS) - sequence listing, part 5

SEQ ID NO: 1202 - DNA, 12134 bp, Unknown
  Kingdom: Bacteria, Phylum: Actinobacteria, Class: Actinobacteria, Order: Streptomycetales, Family: Streptomycetaceae, Genus: Streptomyces
atcgtgtacgggaaccagccgtccccgatccggcccgcccggcgcacggccggggcgctgttcccgcccagcaccacgggtaccgccccgcccgccggccgcggcaggcagtgcaggccggtgaacgagacgtgccgccccgcgtacgaggcgggtccgtcggcccacagcgcgcgcatcgcgcccacgcactcctccagccgccgcccacggtcccggtagggcacgccgacagcggcgtactcctccttctgccagccgatgccgagccccagcatcagccggccaccggagtgccggtcgatcgtcgcggcccgcttggccagcaccaccggactgtgcagcggggcgaccatcatggcggtgccgaagcgcagggtggtggacgcgccggcgaggaaggcgatggtctccagcgggtccggcatgggcacggcccccgaactcccgggtatccggccgtcgtcggagtaggggtacagcggttcgtagccgtcggcgacggcgacgtgctccaccgtccacagcgactcgacaccgcactcctccagcgtgcccgccaggtcgcgcaggaagccgccggaggtgatcagaccgtcgctgaacggcgccatcattcccagacgcagcatgtgatctcccctcacctgaccagccgggcgcggagtcgggccagggtggccccgtccaggccgaggccccgggtcagatagccgtgcagaccgccgtagtcccgctcggcctggtcgagggccgcgccgaggtagtccggacggacctcctgcaacggcacgagcaggtccgggtcctgcatgaccccggactgcttcagcccctcgcgtacgcggaggtcggccgcggcgcggaagtcgttggagagcaggtagtcccgctccgcggtggcggccgggacgcccacggcccgcagcaggacgtaactcagccagcccgtgcggtccttgcccgaggtgcagtggtacagcagcggggtccgcccgtggtgcgcgatgtcccgtatcgtctcggcgaaggcgcggcggtcgcccgcctcggtgacgaaggcgcggtagacggaccgcatcagctgtgccgccttgccgtcgccgagtgcctcctgctgcttcgccgggtccttcgagccgatcacctccgtcgtcgtcgcgtacagaccgaggtcctgcaccggccgcgaggtcacggtcaggcccgccggcagacggtcggcgccgtctccccgcacctcctgcgggacccggaagtccacgacggtgcgcagccccagccgggacagccgcgccgcgtccgcgtcggtcagcttgccgagcgagtcggcgcggaagacctggccgtagcggacgtggcggccctgctcggtgcggtagccgccgaggtcgcggacgttgaccgcgccctgcaggacgatgcggcggacggtggcggtggtgtcgtacgagaccgtggagctgggctgagacgcggtgtcggccgtggcggtggggcgaggggcggtgtgagccacggcgagggtgggcaggcagccgagggccacggcggagaccagcactccggtggaccggctgagacgggcagcacgcatcggatcgactccctggggagaggggacgttttctgggccgagcgggggaggagctgaggggaacggggcgtcagtcggccggaggcagggcccgtagcgcctcccgggcctgcgtcatgatccggtcgacgagttcggcgcaggacggcaggtcgtcgatgactcccgcgacctgcccggcggccatcacgccgaggtcggtgcggccctcgaccatggaggccttgagcagcatgggcgtgttggcggccagcaggacctgaccccacgtcagctcccggccgtgcttcatggcgaggccgtcgcgaaccatccggggccagctcatgccggactcgcgccggaaggccgccgcatggcgcacggcgcgcagcagggcggtggcgcggcccgagccttcgagggagtcgaccagttcggtgcgcagcatccggtgcgggagcccgtcgaccttcgtggtgacggtgacgtccttgacggtggcggccagataccgcgccttgaccgcgtcggggacggtgctgtcggaggtgagcaggaagcgggtgcccatggcgatgccggctgccccgtaggcgagcgcggcgacaaggccccggccgtcgtggaaaccgccggccgcgacgaccgggatgtccaccgcgtccacgacctgggggagcagcacgctggtggcggtgtccccggtgtggccgccgccctcgccgccctgcaccaccacggcgtcggcgccccacgcggccaccttctcggcgtgccgccgggcaccgatcgacgggatgacgaccacaccggcgtccttgagccgggcgatcagctcccgtgagggcgcgagcgcgaacgaggcgacccgcaccccctcctcgatgatgacccgcacgcgctcggccgcgtcggaggcgtccgcgcggagattgacgccgaagggcgcgtcggtacgggacttgacctcgcgcacggccgagcggagccggtccaccggcatcgtggcggaggcgaggatcccgagcgcgccggcgttcgcggaggccgagaccaggcggggcccggccacccagcccatgccggtctgcacgatcgggtgccgtacgccgaccagttcggtgagcgcggtggtgatcgtggcgtcgctcatgagcggacctcgcggtcgcgcagcgccttcgggtcgacgacctcgcggatcaaccgcagctcctcggcggtgggttcgcgggtgtacgggacctcgtccgggatcgtgagggtgaacccggtggcctcgacggcctgctcgaccgtcacaccggggtgcagggagcgcagccgcatcgtgcggtcgggggtctcgaagtcgaacacgcccaggtcgctgacgacttccgggatgcggtggtaccgggtggcggacgggccggcggccgcagcccggtcgtagccgacaccgcagaccatgtcggccttctcgacgaacacccggggcgagtgccgcggtacccagtaactggtcggattgttgagggtgttgacggtcgccccgcgtacgcccagcagctggcgcgtcggccggtcccagtcgccgatgcaggagatgttctggttgccgtaccggtcgatctgtgaggcgcccatcatcacgtgccgtcgccccgtcgccaccagggcgaggtgctggcggtagggaagccagccctccaccacggcgggcgcggcgccgagcgccgggacgtcgccgaccagcagggcctcgccgtcggtcagcagcagatcgggtgagaaggtgagcctggccagccgcgccccgatcgtggggacggtgcccatcggactggccagcacctcgcccgcgccccgccaggcctccgcacaggccaccacgcagtactcggcccgcgtcgccgtcgccgtcgtccgtgtcgttgtcgtctcgctcatcgtgccgcctcttcctggtggaacgccgtcacggcgctctggtacgcgtcctcgtcgccggacaggaactgttcggtgaaggaccgccacgcctgcgggtcggcggcggcacgggcgtaggcgcgctggaagacctcgtcccggtcgtagtcgggggcgcaggaggtgaagtgcgcgccgttcggggtctccacgacaccgttcacgaacgcccgcttgacgagcagcgtctgcgggccggcgtccttgagcagcccggcactgtccacgatccgctcgcacgagacgtacgcggtgtcggcggcctggcagaacaggtcgtcgaagtaagggtcggggccgaggtactgggcgttgccgtggacgtccgcccggttgaggtggaccagggcggcgtccatccgcagagcgggtacggcgacgagctcctcaccgtcctcgtagggcgaacgcaccgtccgcagaccggggttgaccgtcatcacgtccgagccgagcccggcccggaccggcaggaacggcagccgctgcgtggcggcggtcaggccccacatgaccatcgcctcgtccagttccaccagctccagcgcgccgcgctcccgggccgcgcggaagtgcggctccagcgggacggagtcgagggtcgcgaacgcggtgaccagcttgcggatcttcccggcggcggccagcagccccacgtccggaccgccgtaggacaccacggtcaggtcggtgacgtccgagcgcagcagcgcccggaccagcgccatcggcttgcgccgcgaaccccatccgccgatgccgatcgtcatgccgctgctcaggcggccgaccacctcctcggcggtcatcgtcttgtcgctgctcacgactgctgctcctcgtccttgccgaaggtgtcgcggacgcggtcggcgacaccgctgaggttggcctcgaaggtgaagccctgttcgaatcggtagctgcggcggacgtcgaccgggtcgatgccgttgatcgccgccttcgccaggcggatcagcgtcccgtccttggcggcgatctgccgcgccagctccagtgccgcctcggcgagttgcccgcgggggaccacccgccacaccgagccgtgccggtgcagttcctcggcggtgacggtgcgcgaggtgtagtacagcgcccgcatcaggtgctggggcaccagacgggccagatgggtggcggcgccgagcgcgccccggtccagctccggcaggccgaacgtcgcgtcgtcggaggcgacgatcgcgtccgcgttcccggccaggccgatccccccgcccaggcagaacccgtgcacggcggcgaccacggggacctcgcagtcgtacacggccgcgaacgcctcgtagcagccgcggttggcaccgatgagcgcctcgtgcccggaggtgcgctgcatctccttgatgtcgacgcccgcgttgaacccgcggcccgcggcgcagagcaccacgcagcgcaccttcgggtcggcgccggcggcgcgcaccgcggcggccagctcgtaccagcccccgacagggagggcgttgaccggggggaagtccacggtgacgaccgcgatgccgtcttcggggacggaggtggagacacccatgagcagatcagctacctttccaccaaacgtttgttaggcgagaaggtagcagcggagtgcgcgctgcgggaggtgtcctttggcggcgatcatcgatctcagcggatgtgtgacggttgtcaccggcggaacccggggcgtcggagccggcatagcccgggcgttcctggaggccggcgcggacgtcgtgacctgcgcgcgccaccccccggaccggcccgtgcaggcggccggccgcaccgcccgcttcctccccgtcgacctgcgtgacgccgaggcggccggcgcgttcttcgaccgggtgcggcacgagtacggccgcctcgacaccctcgtcaacaacgccgggttcctgcgcgaccgcatgctcgtcaacctcgacgaggacgactgggacgccgtgatgcgcgtccacctcaagggccacttcctgccgctcaagcacgccgccgcacactggcgcgccgaggcgaaggccggccgcacccccgaggcccgcgtggtcaacaccagctccggggcaggcctgctgggcagcgtcggccagggcaactacgccgccgccaaggccgggatcgtgggcctgaccctcgtcgccgccgccgaactgggccgctacggagtccaggtcaacgccgtcgccccggccgcccggacccggatgacggagcagaccttcgccggcaccatggccgcgccggaacagggcgcgttcgacgccatggccccggagaacgtctcccccctcgtcgtctggctcggctccgccgcctgcgccggcgtgaccggccgcgtcttcgaggccgagggcggccggatcaccgtcatggagggctggtgccccggccccaccaccgacaagggcgcccgctggaccccggcggaggcaggcgagacggccctgagactcctcgccgaggcaaagaccccgcagccggtgtacggcgcgcggtaggggcctgcggggcggcgggcgaccgctgatcaccgacgtcagtgctcttcgggccgggcggttccgggtgcgcgcgacctgcgcgtccgtcccctcctgcctttcccggtcagcgggaattcccgctccctgcggggaacgactctcgcctagcctcccggaacagcccgacgccccgcagaggacccacatgctcacggaccccgaaaggcagcaggcggcgcggattctgcgctccgccgagcacagcgtcacaccggtcgccccgctgaccgagaccttccccggcatcgacaccgaggacgcgtacgagatccagctcgtcaacatccgccaccggctcgacgccggggcgcgggtgtgcgggcacaaggtcggcctgtcgtcgccggtcatgcagcagatgatgggcgtggacgaaccggactacggccatctgctcgacgacatggagctgaacgccggctggcccgtgcccgtagcccgctactgctacccgcgcatcgaggtcgaggtcggtttcgtgctcggcgccgacctgccgggcgaggactgcaccacggcggacgtactggccgccaccgaacgcgtcgtccccgccctggaattgatcgacagccgggtcgacgactggcggatctcgatcgccgacaccatcgccgacaacgcctcctccgcaggattcgtcatcggcgagggccgcgacccgcgcgaggtggacctgaagacgatcgacgcacggctgaccagcggcggcgaggtgctggcccagggccgcagcgacgccgtactcggtgatccggccgtctccgtcgcctggctcgcccgcaccgtcgcccgcttcggcgtgcccctgaagaagggacacctggtgctgcccggctcctgcacccgggccgtcgacgtgacggccggagcgaccttcaccgccgacttcaccgggctcggcccggtctccctctccttcacctgaggtgatgcacacaccatgacgcccaccaccaggaccaaggcgaccgcagcgatcgtcgggtccggcaacatcggcaccgacctgctgtacaagctgcagcgctccgaactcctcgaaccgcgctggatgatcggcgtggacccggacagcgagggcctggcccgcgcccgccgggccggcctcacggccagccacgagggcgtcgactggctgctcgcgcaggacgaactccccgacatcgtcttcgaggcgacgtccgcctacgtccaccgggccaacgccccccgctacgccgaactcggcatcaaagcggtcgacctgaccccggccgccgtcggccccgccgtcgtcccgcccgccaacctccgcgcccacctcgacgaacccaacgtcaacatgatcacctgcggcggccaggccaccatccccatggtgtacgcggtctcccgcgtcgtccccgtgccgtacgcggagatcgtcgcgtccgtcgcctccgtctccgccggtcccggcacccgcgccaacatcgacgagttcacccgcaccacctcccgcggcatcgagaccatcggcggcgccgggcgcggcaaggcgatcatcatcctcaacccggccgagccgcccgtcatcatgcgcgacaccgtcttctgcgccatccccgaggacgccgaccgggacgcgatcacccagtcggtgaaggagatcgccgagcaggtcgccgcgtacgtgcccggctaccggctgcgcaacgagccgcagttcgacgacccccgccctacgagcggcggcatggcgcgcgtcgcggtcttcctggaggtcgagggcgcgggcgactacctgccgccgtacgccggaaacctcgacatcatgaccgccgccgccaccaaggtcggcgaggagttcgcccggcggatcgccgccggccggtccgaccgcgagacccacggggagtcctgagatgccctactccgacacgctcgacatccgcgtcaccgactcctcgctgcgcgacggctcgcacgccaaacggcaccagttcaccgccgacgacgtacggtccgtcgtcgccgccctcgacgacgccggcgtcccggtgatcgaggtgacgcacggcgacgggctcggcggctcgtccttcacctatggcttctccaggacgcccgagcaggagctgatcaaggtcgcggtggacaccgcgcggcaggcgaggatcgccttcctgatgctgcccgggctcggcgtgaaggacgacatccgcgccgcccacggcaacggcgcgagcgtctgccgcatcgccacccactgcaccgaggccgacatcgccgtccagcacttcgggctcgcccgcgagatgggcctggagaccgtgggcttcctgatgatggcccactccacgacccccgagacgctggcccggcagggccgcgtcatggcggacgcgggctgccagtgcgtgtacgtggtcgactccgccggggccatggtcatggacgacgtcaccgcccgcgtcgaggccctggtcgccgaactcggcgacgacgcccaggtcggcttccacggccacgagaacctcgccctgggcacgggcaactcgatcgccgccatcaaggccggcgccctgcagatcgacggctccacccgccgcctcggcgcgggcgccggcaacaccgccgtcgaggcgctggtcgccgtctgcgccaagatgggcatccgcaccggcatcgacgtcctgaagatcatcgacgcggccgaggacgtggtccgcccggtcatggacgaggaatgccgactcgaccggctcgccctgctgatgggccacgccggcgtctactccagcttcctcaagcacgcctaccgccaggccgaacgctacggcgtctcgggcgccgagatcctgctgcgcgcgggcgagcgccgcctggtcggcggccaggaggaccagctcatcgacatcgccgtggagctcgccgcgcggaactgagccgcaggaccgcaaggcagcactaccgagccgtaggaccgaaagagatcggaggacgagatgactgcgctcaacgaagaggtccgggtcatcgaggcgggcaggccgccgacccgcttcgcccggggctggcactgcctgggcctcgccgacggcttcaaggacggaaagccgcacgagatcgaggcgttcggcaccaaactggtggtcttccagggcgagaacgacggacagctgcacgtcctgaacgcctactgcccgcacatgggcggcaacctcgcccagggcagcgtcaagggcgacgcggtcgcctgcccgttccacgactggcgctggtcgggcaacggccgctgcgccggcatcccgtacgcccgccgggtcccgccgcgcgccaagacgcgctcctggctcaccctggagcgcaacgggcagctcttcgtctggcacgacccgcagggcaacccgccgccgcccgaggtcaccatccccgagatcgccggggtgcacggccccgaatccggacagtggagcgactggacctggaagtcactcctggtcgagggcgccaactgccgtgagatcgtggacaacatcgtggacatggcgcacttctactacgtccactacgcgtttcccgagtacttcaagaacgtcttcgacgggcacatcgccacccagtacatggagagcagcccccgcggagacatggagctgggcaccctgagcgccggacgcctgcgctccgacgcctcctactacggcccctcctacatgatcgactacctgtacagcgacatcggcggcggcaccgagatggagatcgtcctcatcaactgccactacccggtcaccgccgacagcttcatgctccagtacggggcgatcgtcaagcggctgcccgggatgaccgacgagcaggccgccgagaccgcgcggctcaccgccgagggcgcgaccgtcggcttcgagcaggacgtgcggatctggcagaacaagacccgcatcgacaacccgctgctgaccgaggaggacggcccggtctaccaactgcgccgctggtacgaccagttctacgtcgacgtggacgacgtcaaggacgagatgacccgccgcttcgagttcgaggtcgacaccgaacgggccaaccaggcctggcgcgccgaggtcgccgagaacctggcccgccgcagcgcggcgacgcagccggagacggggaccgaggcctgacatgcagcccgtggagtgcgcgacctgcggcaaccaggtcctgtgcgagaagttcagcatggcccacacctcggtgcagtggacctccgaagcggccgtggtctgcgcggagttccgcgaccgggtgggcgagggccgcaccaccgcccgcatccgcacctgcggggcgctgcgcgacagcatcgaccgcgcggtcgcggacggcaccctggaggtcgccgatgtctgaaccgacgtccggaccggcaccggggccgagccggacccaccggctgcgcgtcaccgaggtgatcgccgagacgccggacgcgcactccttggtgctggaggtcccaccggagagcacggaccgcttcgcctaccgccccgggcagttcctcaccctgaagctgcccgggaccggcgcgggaccggcggcccgctgctactccctcgccagctccccgcacaccggcgaaccgctgaaggtcaccgtcaagcgggtggccggcggatacggctccaactgggtgtgcgacgaggtgcggccgggggacgaactggaggtgctgcccccggccggcaccttcacccccggccgcctcgacaccgatctgctgctcgtcgccggaggcagcggcatcacccccgtcctgtccatcgccaagtcggccctggcgagcgggcagggcaggctcgtcctcctctacgccaaccgcgacgaagcctccgtcatcttccgcggcgaactgcgccggctggccgaggaccacccggaccggttcgtcctcatccactggctggagtcgctccagggcctgcccaccgcggaccgcctgagcgccgtgctggcgccgtacgccgaccgcgagggctacgtctgcggccccgcgccgatgatggacgccgtcgagcagagcctgcgcgccctcggcgccccgggcgaccggatccaccgggagcggttcttctccctcggcgcggacgtcttcgacgtaccggccgtccccgcggccacacccgcagagggtgcgagcaccgcggaggtggaactcgacggcgagacgcacacggtcgcctggccgcagggaacacccctcctcgacgtcctcctggccgccggcgtcgacgcaccgtactcctgccgggaaggcggctgcagcgcctgcacctgccgggtcgtctccggcgaggtgaagatggcccgcaacgacgtcctggacgacgaggacctcgcggagggctacgtcctggcctgccaggcgctgccgctgaccgagcggatcgagatcagctactcctgacccgcctcctagcgcgtcccacgcccaccgccgaccgccccggccacccgtggccgccttcaagggagcagaccatgccccgtacccacctcgtcaccggatcggcctccggcatcggccgggccaccgcggcgctgctgcgcgcgcggggacacaccgtcatcggcgccgacctcaaggacagcgacatctgcgccgacctgtccaccccgaagggccgcaaggaactcgtctcccggacacgggagctgaccggcggcagcctcgacaccgtcatcgcctgcgccggcatcgcccagttcgacccgctcaccgtcaaggtcaaccacttcggcgccgtggccacgctggaggggctgcgcccgctgctggccgccggcaccgacccgcgcgccgtggtcatcggctcgatcgactccgtacacccggccgacccggcgatcgtggaggcggcactcgccggtgacgaggaggcggcggtggccgcggcccaggcggccgtcgaccgcggcgagggtcacctcgtctactcctcctccaaggccgccgtctcccgctgggtgcgccgcgcggcgcccaccgc

SEQ ID NO: 1203 - DNA, 1680 bp, Unknown
  Kingdom: Bacteria, Phylum: Actinobacteria, Class: Actinobacteria, Order: Streptomycetales, Family: Streptomycetaceae, Genus: Streptomyces
gggcggggcggcgagcgcggctccggtgaggggtccgcagacggcggtgaccgtcatgccgagggtgacggcccagcgcgcggtgttccgcattgtgtgcttccttccgcaggattcgagggtggtgccggcgacgccgcggtcggcggcggaccggcgagcgggagtctgccgagtccgccgccgaaactcacatcggacccaccggtttcggtaaccttgcgtattgaatcagtggcgcgaagtcacggaatccacgggggacgaccctcgtaccacggggttgacgatcaacggacccggccggatggcctgatcaccacggctccgcaatcgtccggaaacactccggcgcaccgcgccgatgacgccgtccgttcacctcccgctcaccccgcccgggcggtcgaccccgcacctactcgccagtatggtcggcgggtgcacacagagccgcacaccggcgccgcacaccggggccgcgtacggcggagcgtgcggcgacgagaggcgggaggtacgggtggcgaagcactgggcggatttccagtacgagatctatctgcacggcatgacgggcgcggtaccccggctgcccaccgacctgggccggctcgaggagctgaccgagcggcggctcggtccgggcccggtgggctatgtggccggcagcgcgggcgacggcagtacggcgcgcgccaaccgggcggcgctggaccggcgccggatcgttccgcgcatgctgcgtgacgtgagcgaacgcgatctgtcggtggaggtgctgggccgcgccctgcccgccccggtggcgctggcgccggtcggcgtgctgtcgatcatgcatccggacgcggagacggcggcggcccgggcggcagcggcgcagggcgtgccgttcgtcctgtcgtcggcctccagcacgcccatggagcaggtcgccgaggcgatgggcgaggccgagcggtggttccagctgtactgggccaaggaccgcgaggtgacccgcagtttcctgcaccgcgcgaaggcgtgcggcttcggtgtcctcgtcgtcaccctggacaccccgctcctcgcgtggcgtccccgcgacctcgaccaggcgtacctgccgttcctgcgcggtgtgggcaccgcgaactacttcaccgacccggcgttcctgtccggcctggccaggccggtgcaggaggatctggacgcggcggtgctgcggttcgtcggcatgttcgccgatcccggcaagacctggccggacctggcgttcctgcgggagaactgggacggtccgatcgtcctgaagggcgtcctgcacccggacgacgcccgcctggcagcggaggccgggatggacggcgtggtggtgtccaaccacggcggccgccaggtggccggttcggtcgccgccgccgacgcactgccccgggtcgccgaggcggtcggcgaccggctgacggtgctgttcgacagcggtgtgcgctccggcgacgacgtcttcaaggcgctcgcgctcggcgcgcgggcggtcctgctggggcggccgtacgtctacgggctcggtctggacggccagagcggcgtggagcatgtcatccgctgcctgctggccgagttcgacctgaccctcgccctgtcgggacacgccacaccgggcagcgtcggaccgggcgacctggtgac

SEQ ID NO: 1204 - DNA, 4362 bp, Unknown
  Kingdom: Bacteria, Phylum: Actinobacteria, Class: Actinobacteria, Order: Streptomycetales, Family: Streptomycetaceae, Genus: Streptomyces
ggcgctctcgcaggccgcggcggcgaccgccgagcggaccggcggcgagtcgctggagcgcagcggcctgaccgactggacgatcggctcgctcacccgggtcttcgagacccgcagggccggtcagccggtgaaggcgtacccggcgctggtggacgacggtccggcggccggcaccgtctcggtacggctcttcgacaccgaagccgagcaggccgaggccatgtggaggggcacgcgccggctgatcctgcgcaacatcccggtgagccctgccaagttcgcgtccgagaagctgacgaaccagcagaagctcggtctgtcggccaatccgcacggttcgatccaggccctgttcgacgactgcgcgacggcggcggccgaccggctgatcgcggacttcggcggaccggcctgggacgaggagtcgtaccggaagctctacgacaaagtacggtccgagatcgtggacctgaccgtacggaccgtgggccaggtgcagcaggtgctggccgcctggcaggcctgcgaacgccgtctgaaggccgtccgcagccccgcgctgctggcgaacctgacggacgtacggcagcagttggacgcgctggtgaagccgggcttcgtcacggaggcggggatacggcggctgcccgacctgatgcgctatctggtcgcggcggaccggcggctccagcagatgccgacgaacgtccagcgggacaccacgcggatggagaaggtccaggagatgcgcgacgagtacgcgtggctgctggagcagatgccgcagggccgcccggtgccgcagcaggtgcgggacatccgctggatgctggaggagctgcgggtcagctacttcgcccacgcgctgggcacggcgtacccggtctcggacaagcggatcgtgaaggcgatcgacgcggcggcgccgtgacggcaccggcacactaagtgagttcgacccggcgccccatctcctgtacagtctcttctcgcagcgcaacgcaacataagcgccgcgaaaccaggtcctgtggagcagtttggagtgctcgccaccctgtcaaggtggaggccgcgggttcaaatcccgtcaggaccgctgaggtttcacgtgaaacctcgtggctgggtagctcagttggtacgagcgatcgcctgaaaagcgataggtcgccggttcgaccccggccccagccacaaccgccctcaccagggcatcgagcccctctccgagtctcatcggaggggggctctgtcgtgcccgaggccgacgcccgccgaccgcctccggacaaatcattcgcgcgagatttccccgaggtgagatcctgggatgcgtatgtctacgcatcccgcccccgccctgggctctctcgccgcccgtctgaccgagctgtcgctgcgtgacgcgcaccgactcggacgcagactcgaaggcgcgcgcaagatccgcaagcccgaggcgcgtgccgccgttctcgccgagatcgaggccgagaccgacaaggccgcgcagcggatggccgagcggcgctcgcgtgtgcccgcggtcacctatcccgagcagttgccggtcagccagaagaaggacgagatcgcggcggccatccgcgatcaccaggtcgtcatcgtcgccggtgagaccgggtccggtaagaccacgcagatcccgaagatctgtatggagctgggccggggcgtgcgcggcatgatcgggcacacccagccccgccggatcgcggcccgtacggtcgccgagcgcgtggccgacgagctggacacgccgctcggtgaggccgtcggctggaaggtgcgcttcaccgaccaggtgaacccggacgccaccttcgtgaagctgatgacggacggcatcctgctcgccgagatccagacggaccgggagctgcgcgcctacgacacgatcatcatcgacgaggcccacgagcggtccctcaacatcgacttcctgctcggctacctggcccagctgctgccgaagcgcccggacctgaaggtcgtcatcacgtcggcgacgatcgaccccgagcggttctcgcggcacttcggcgacgcgccgatcgtcgaggtcagcgggcggacgtatcccgtggaggtgcgctaccggccgctgctcgaagaggagtccgaggacgccgaccgggaccagatcaccgcgatcaccgacgccgtcgaggaactgatgggcgagggccggggcgacatcctggtcttcctctccggtgagcgggagatccgcgacaccgccgacgcgctgatcaagaagcagtaccgcttcaccgaggtgctgccgctatacgcgcggctctcgcacgccgagcagcaccgcgtcttccagccgcacaccggccgccggatcgtgctggcgaccaacgtggccgagacgtccctgaccgtcccgggcatcaagtacgtcatcgacccgggtttcgccaggatctcccgctacagccatcgcacgaaggtgcagcggctgcccatcgagccggtctcgcaggccagcgccaaccagcgcaagggccgctgcggccgtacgtcggacggtgtctgcatccggctgtacagcgaggacgacttcctggcccggccggagttcaccgacgcggagatcctgcgcaccaacctcgcctcggtgatcctgcagatgaccgcggccggcctcggcgacatcgagaagttcccgttcatcgatccgccggaccaccgcaacatccgcgacggtgtgcagctgctccaggagctgggcgcgctggacccggagcagaaggacccgcgcaagcggctcacggagaccggccgcaagctcgcccagctgcccgtggacccccggctggcccggatggtcctggaggccgacaagaacggctgtgcgcgcgaggtcatggtgatcgccgccgcgctgtccatccaggacccgcgcgagcgccccgccgacaagcaggcccaggccgaccagcagcacgcccgtttccgggacgagaccagcgacttcctcgccttcctcaacctgtggcgctatctgcgcgagcagcagaaggagcgcggctcgtcgtcgttccgtcgcatgtgcaagcaggagtacctgaacttcctgcggatccgtgagtggcaggacatctactcccagctgcgcacggtcgccaagcagatgggcatccacctcaacgaggaggacgccccgggcgaccgcgtccacgtctcgctgctggccggtctgctctcgcacatcggcatgaaggacgtgaaggacggcaacaagaacgagtacctgggcgcccgcaacgccaagttcgcgatcttcccgggctcggcgctgttcaagaagacgccccggttcgtgatgtccgccgaactcgtcgagacctcccgcctgtgggcgcgggtcaacgcgaagatcgaacccgagtgggtcgagccgctggccgggcacctgctgaagcggacgtacagcgaaccgcactgggagaaggaccaggccgcggtgatggcgtacgagaaggtcacgctgtacggcgtgccgatcgtcgcgcagcggaaggtgaactacggccggatcgacccggaggccagccgggagctgttcatccgcaacgccctggtggagggcgactggcggacgcaccacaagttcttcgccgacaaccgccggctgctgagcgaggtcgaggaactggagcaccgggcgcggcgccgggacatcgtcgtggacgacgagacgctgttcgacttctacgaccagcgggtacccgaacacgtcgtctcgggcgcgcacttcgactcctggtggaagcacaagcggcacgagcagccggacttcctggacttcgagcgggagatgctggtccgggagtcggcgcaggcggtcaccaaggccgactatccggactcctggcggcagggcaacctgaagttccgggtgacgtaccagttcgagccgggtgcggacgcggacggtgtgaccgtccacatcccgctccaggtgctcaaccaggtcaccgacgagggtttcgactggcagatcccgggcctgcgcgaggaggtcgtcacggagctgatccgttcgctgcccaagccggtccgccgccactacgtgcccgcgccgaactatgcgaaggcgttcctggagcgggcggtgcccctccaggagccgctgacggtcacgatggcgcgtgagctgaagcgcatggtcggtgtgccgttcgaggccgaggacttcgactgggccaaggtccccgaccacttgaagatcaccttccggatcgtcgacgagcggcgccgcaagctggccgaggacaaggacctcgacacgttgaagctgcggctgaagccgaaagcgcgcaa

SEQ ID NO: 1205 - DNA, 3322 bp, Unknown
  Kingdom: Bacteria, Phylum: Actinobacteria, Class: Actinobacteria, Order: Streptomycetales, Family: Streptomycetaceae, Genus: Streptomyces
tactccaacgccctggtcgtctgcgtcggccgggacgaccaggaggtcgcccgccgtgccgccgcgatcggccgcgaggccgacgagctgaaggccaacggcctcgcgggttccccggccgaggtggtcgacaagctcggccgctacgccgcgatcggctccggccgcgtctacctccaggtcctcgacctgtccgacctggaccacctggagctgatctcctcccaggtgcagtcgcagctgtcgtagccgaacaggccgtggagccgtagagcggcctcacagccggagagataaaggcaggcgcaggtccttccccctgtgccaaggtgaggacgtcgtcctgccgggcccccgggaccaccgtcccgggggcccgcgtgcacgcacggcaccctacccacccgtccggcccgagaggccctccgcatgttcctgaccatcaccaccaccggcacacccgagcgccccgcgaccgacctgggctacctgctgcacaagcaccccggcaaggcgcaggcgttctccacgtccctcggcacggcgcacgtcctctaccccgaggccgacaccgatcgctgcacggcggcgctgctgctggaggtcgacgcggtggcactggtgcggcggggcaagggcaagggccgcggcggcgcacccgacgcggcgctcgcgcagtacgtcaacgaccggccctacgccgcgtcctcgctgctcgccgtggcactgagcgcggtgttctccagcgcgatgcgcggtgtgtgccgagccaagcccgaactgcccggtcaggcacgtccgttgcgcatcgagataccgtccctgcccgcccgcggcggcccggccctcgtacagcggctgttcgcaccgctcggctggacggtcaccgccgacgccgtaccgctggacaccgagttcccgcagtggggcgactcccgctacgtgcggctggtcctggagtcggacaccgtcaccgtggccgaggccctgcgccacctctacgtcctgctgcccgtcctcgacgacgccaagcactactgggtctcctccgacgaggtcgacaaactgctgcgggccggcgagggctggctgcccgtgcacccggagcagaagctgatcaccagccgctacctgagccgccgctggtcgctgacccgggaggcgatggagcgcctggaactggtgcggctggccgagacggacgacagcgacgtcgaggagatcgacaacgcggtggcgtccgggaccgagaccgacacggacaccggcacggacaccggcacggacaccggcaccgaggagcggcccacgcccctcgccgttcagcgccgcgaggcgatcctcgcggaactggaggcggccggtgccgcccgcgtcctcgacctcggctgcggccagggccagttggtgcaggcgctgctcaaggacgcgcggttcaccgagatcgtcggcgtcgacgtgtcggtgcgggcgctcaccatcgccgcgcggcgcctgaaggtggaccggatgggggagcggcaggcagcgcgcgtcacgctgcggcagggctcgctcgtctacaccgacaagcagctcaaggggtacgacgccgccgtgctcagcgaggtgatcgaacacctcgacctgccccggctgcccgccctggagtacgcggtgttcggcgcggccggcccccgtaccgtcgtcgtcaccacaccgaacgtcgagtacaacgtccgctgggagaccctgcccgccgggcacgtgaggcacggcgaccaccgcttcgagtggacccgcgagcagttccgctcctgggcggacgcggtggccgaacggcacggctacacggtcgccttccggcccgtcggccccgacgaccccgaggtgggcccgcccacccagctggccgtgttcacccgcacgtccccggacgagcagacccgcgagaccccggcacacgagccgggcacccaccagccgaccacccgtgagaaggaggcgaaggcagcatgaccggcacacccgagacgaccaccaccaccccgcagggacgcgtcctgcccgtcaccgacctctcgctcgtggtgctcgtcggcgccaccgggtcgggcaagtccaccttcgcccggcgccacttcaagcccaccgaggtcatctcctcggacttctgccgcggcctggtcagcgacgacgagaacgaccagagcgccagccgcgacgccttcgacgtcctgcactacatcgccggcaagcggctcgcggccggccgccgtaccgtcatcgacgccaccagcgtccagcaggacgcccgcaggcagctgatcgacctggccaggaagtacgacgtgctgcccatcgccatcgtcctcgacgtgcccgaggaggtgtgcgccgagcgcaacgcggcccgcaccgaccgggccggcctgccccgccgggtcatcgggcggcacgtccgcgaactgcgccgctcgctgcgccacctggagcgcgagggcttccgcaaggtgcacgtgctgcgcggcgccgaggaggccgagcacgcgaccgtcgtcaccgagaagcgcttcaacgacctcactcacctcaccggccccttcgacatcatcggcgacatccacggctgctccgccgaactggagtccctgctcggcaagttgggctacaccgacggcgtccaccccgggggccgcacggcggtcttcgtcggcgacctcgtcgaccgcggcccggacagccctggcgtactgcgccgcgtgatggccatggtgaagtcgggcaacgccctgtgcgtgcccggcaaccacgagaacaagtacggccgccacctcaagggccgcaaggtccagcccacgcacggactggccgagacgatcgcgcagatggcgggggagagcgaggagttccgctccgaggtacgggagttcatcgacggactcgtcagccactacgtcctcgacggcggccggctggtggtctgccacgccggtctgcccgagaagtaccacggccgcacctccggccgggtccgctcgcacgcgctgtacggcgacaccaccggcgagaccgacgagttcggcctgccggtgcgctacccgtgggcggaggactaccggggccgggcggcggtggtctacggccacacccccgtcccggaggccacgtggctcaacaacactctttgcctggacaccggcgccgtgttcggcggcaagctgaccgcgctgcgctggccggagcgtgagctggtcgacgtaccggccgagcgggtctggtacgagccggtgaagcccctgcgctccggggcgcccggcgggcacgacgggcgccccggagc

SEQ ID NO: 1206 - DNA, 2118 bp, Unknown
  Kingdom: Bacteria, Phylum: Actinobacteria, Class: Actinobacteria, Order: Streptomycetales, Family: Streptomycetaceae, Genus: Streptomyces
gccggcggcggtcaccaacgacgcgctcgcccggcagttggacacctccgacgagtggatccgcagccgtaccgggatcgcgtgccggcatgtggtggaccccggcacggccaccggtgatctggcggtcgaggccggccgccgggcactgaagtccgccgggacggacgtcgccgacgcggtggtgctcgccaccagcaccccggaccggccctgcccggcgaccgcccccgaagtggcgagcaggctgggactgaccggcgtgtgcgccttcgacatcgccgcggtgtgcaccggcttcgtctacgccctcggtgtgtccgccgggctggtggcgtccggggccgcccggaccgtgctggtcatcggcgcggacacgttctccaccatcctcgacccggcggaccgcaccacacgtgccatcttcggcgacggggccggcgccatggtgctgcgcgccggggatcacgacgagccgggcgccctgcggggactgcacctgggcagcgacggcagccgcagcgacctcatccaggtcgccgcgggcggctcccggcagcggtccaccggtctgcccgccgagaaggcggccacctacttcaccatggagggccgtcccgtcttcgccgaggccgtacggcacatggcggcgtccgtggaggcgacggccgccgtgctgggcgggacgcccgccgacgtcgaccggatcgtcctgcaccaggccaacgcccggatcctcgcggcggtcgcggagcgcgtcggggtaccgctcgagcgcttcccgtccaacatcgagcgggtcggcaacacggttgccgcatccgtcccgctggccctcgccgacgcggtcgccgacggcaccctgcaccccgggcagcgggtcgtgctggggggcttcggcggcgggctgacctggggctcggtgggcctggtgtggccggacgtggccccggcctgacacccccccgcggggcgccgtgcacggtgccccgggccgatccccgcacgaacctcgacgcccgtccgggtccacccacgacacgcccgcgcgctttccggccgggcgccctctcatcctcaggagcacaccatgcaggacatccaggagcacaccaccatgcagcccgccgtgcagcgcgtcgcggcacttctgtcgggccacttcaaggtcaagcccgaggcgatcacgcctggcgtgaccctgggcaaactgtctttcgactcactggtcctgatcgagctcgcactcgtcctggacaaggagttcggcgtccgcatcgaggacggcgaactcaccgaggagcacacgctcgacgacgtcgtcgacctcctcgccgccaagggagcctctctgtgacggcgggcggcaccgacgccatagccgtcaccggcctgggcctggtgaccccggccgggatcggcgtcgaggagaactgggagcgcatcctcaccggccgctcctgcgccacccgcgacgacagtctcggcgacctgtcggccgacttctcctgccgcgtgcccggtttcgacgcgcaggagctgctgggcggcttcgcctcctggcagctggagcggttcgtgcagctcgcgctcgtcgcctcccgcatggccgtgcgggacgccgggctggaccccgggcgctgggacggcacccgcgtcggggtggtgctcggcaactcgctgggcggcgcggcgacgctggaggagcagcatcgcgcgctcgcacaggacggcccggcccgggtctctccgttgctggtgacccggtacatgccgaacatgctcgccggatacgtggcgatcgactgcggtgcccgcggccccagcctggtcaccgccaccgcctgcgcgtcgggcgccacggccgtcggcacggcccgggacctgctgcgcgcgggtgcctgcgacatcgtgctggccggtgccagtgagtcggccctcaccccgacggtgatggccggactgtgccggatgggcgccctgtccaagtcccgcgcggaacccgagcacgcgggcaagccgttcgacgcggagcgcgacggcttcgtggccgccgaggcggcgggcatcctggtgctggagcgggccgccgacgcgcgggcccgcagtgcccggatc

SEQ ID NO: 1207 - DNA, 5069 bp, Unknown
  Kingdom: Bacteria, Phylum: Actinobacteria, Class: Actinobacteria, Order: Streptomycetales, Family: Streptomycetaceae, Genus: Streptomyces
ctgtcggcgcgggacgtgaccgggcgcgtcccgtccacaccgctgccgtccgaaacgggggcgtcgcctcgtacgcggcgccgtcggccggacgtcacgcccttcaccgccggcgagcgaccggtgtcggccacggtccccaagcgccccgccgaaccgccttctccttctggcccttccgcacctcccccattcctcacgtcgtccgccttcctcgcggctttcgcgttcacggcgacttccgtctcatcctcctcttcggcctcgagcaccccttcggctcctccgtccgcgacctctacgcccttcgcgtccacgacatccgctgcctccacgtccgcgacacctaccgccgccatatccgtgtcctgccccgcgccctcgtttccgccgaccggttctccgtccgtcgaccactcgcgtcccgcccgttccgcgcgcaggcagcggcggaccgactccgggtccagtccctcgttgcaggcctggtgcagcaggcgggcgaagagatagtcggggtccgcgcccagcgccatggccagggcttcgcgggcctcgaggccatcacccatcgaccaggcgacccagccggcgagtgtcagcggcgcggcggcatgctccccgtaggagcccacgcagcgacgagccagagcccgccagagccggagggccggagctgcctcctctccttccatccactccgccgcacgatcgcgcgtcgtgcggtcctgcaggccgaggatcaggaaggccgcttcgtcgtcctcgagcagtcggtcgtcgcgaaggtcggcgggcagcgcaccgccgatacccggggcctcggcgaaccgccgcaggactcgcccggccaggtcgagagtctcgtccgccaccgccgcacggctcgcctcgtcgaggatcctgggcaccagggccctgcccgccttgtccagcgcggcctcctgcgtacgtgcggccgaggcttcccagggaagcagcctggcccgcagctcgcgcaggctgccgcgcacctggatgcccgcgtacgtcgccgccgcggccaggaccgaggtgccgggcagtcccatgggccatccctcgtcggggcagcacccgtcggtcggacaacagtaggaccagaagcggcccccggagatgcacagggcctcgatcaccgggacatcgaggcggccgcactccgtacggagcttctgcgccaacggctgcaaccgccgtaccacctcgcgcggcgactcaccgctcgcgggttcctggcagaggaaggcgaccatctgctccggcttggctccccggcgctcgctgcccgtgatcaggccctgcgccagttgtcgtgccgccgacggccagtcgctccggttcaggggaataccgagcctggcccggccgccgaaccggccccggccgtccttgtcgtgcagggcgaccaggacgatgctgtcgtccggccggtagccgagcaggtacggcagggcatcggccagctcggccggggtgcgcagggtgatctgatgttcagggccgggtccgtcgtaggcgatgtcgccgtttccgaagggcccggtcgtttcgctgtggttcgtcatgccccgacgatctcgcggaattgaatcttccgctttgccctgtggataactgcccctgtggacaactccggccagggacacgtcaagccatgaggcccgaagcccaggcccgaagcccaggcccgaagcccggacccgacgcctggaccaggccgccatcccgccctcttccaggcatcgggcggcgccgcccttcggtgatcggagccgtcctgttgtctccgattgtcagtgccgtcctgttgtatgggacgcatggagcacacgagcaacgcggaactccgagcggcggccgatgcggtcctcgcccgcctcgtcggcgacggcacgagcacggcccggttgcgcgaggaccagtggcgggcgatcgaggcgctggtcgccgaggggcgtcgggccctggtcgtccagcgcaccggctggggcaagtccgcggtgtacttcgtggccacctccttgctccgggcccgagggagcggccccacggtgatcgtctccccgctgttggcgctgatgcgcaaccaggtcgaggccgccgcccgtgccggcatccacgcccgcacgatcaactcggcgaacacggaggaatgggacaccgtccaggcggaggtcgcggagggctcagtggacgtgctgctggtcagtccagagcggctcaacaaccccgacttccgggaccaggtcctgcccgagctcgccgccgccaccggtctgctcgtggtggacgaggcccactgcatctcggactgggggcacgacttccgcccggactaccggcggcttcggaccatgctcggcgaactccccacgggagtcccggtccttgccaccaccgccaccgccaacgcccgcgtgaccgccgacgtcgccgagcagttggggacgggtgacgcctcgggcacgctggtgctccgtggccccctcgaccgggagagcctcagcatgggcgtgctgcggctgccggacgccgcacaccggatggcctggctggccgaccacctcgatgagctgcccggctcagggatcatctacacactcaccgtggccgccgccgaggaggtcaccgccttcctgcggcaccgcgggcacgccgtcgcgtcgtacaccggcaagacggagaacgccgaccggcagcaggccgaggacgacctgctcgggaacaaggtcaaggccctggtcgccacctccgccctcggcatgggcttcgacaagcccgacctgggcttcgtcgtacacctcggttcgccctcgtcccccatcgcctattaccagcaggtgggccgagccggccgtggtgtggagcatgccgaggtgctccttctgcccggcaaggaggacgaggcgatctgggagtacttcgcgtcgctcgccttcccgtccgaggagctggtgcgcaggacgctcgacgtactcgcccatgcgccgggaccgttgtcgctgcccgctctggaacccctggtcgagctgcgccgttcccgcctcgaggccatgctcaaggtgctcgacgtggacggggcggtcaagcgggtcaagggcggctggatctcgaccggccggccctggacgtatgacgcggagcgctacgactgggtcgcgcggcaacgggcggcggagcagcagtcgatgcgcgagtacgcggcgacgacgggctgccgcatggagttcctgcagcgccggctggacgacgagaccgccaagccgtgcggccggtgcgacaactgtgcgggggcccggttcaccgccgacacctccacgtccgcgctggacgccgcgcgcgtggacctcggccgagccggggtggaggtggagccgcgtcgcatgtggccgaccggcctcccggcgatcggcgtcgctctcaaggggcgcattccggcggccgaacaagcttctgagggccgcgccctgggacgtctgtcggacatcggctggggcaacaggctgcgccccatgctcgcgccccacgcaccggacggtcccgtgccggaggacgtggcccgggccgtggtggcggtactggccgactgggcgaaggcaccgggcggctgggccacgggcgccgcggacgggcagccgcgtccggtcggtgtcgtcaccatcgcctcgcgcacccgcccccgactcgtccagtcgctgggcgcgcacatctctcaggtcggccggctgccgctgctgggcaccgtcgaatacgccacggacgcacgcccgatgtcccgcagcaacagcgcacagcggctcaaggcccttgacggagcactcatcgtgccgcccgcgctcgcctcggagctcgtcgaccggcagggaccggtgctcctcgtggacgactgcaccgagaccggctggaccctcgcggtcgccgcccggctgctgagaaaggcgggggcccaaggtgtgttgcccctggtcctcgccgtccagggctgagcgggccccggctgcggccaccaagggaccgccgcgcaccatgggactaccgcgcagcacgggcctgccgcgcaccatgagctgccgcgcgccaaagaacggccgtgcaccatgcggccgcagacgacgggacagccgcacccgtccggccgcctggtccaggaccacggccggctggcccagggcatggccaactggtccaggaccacaaccggctggcccaggggcatggccgaccggcccaagggggattggccggcttcctcacggtccgtggcgagtgggtctcgtgggcagtccgggtctcgttgcgcgcggatcgcgggaccgtgatcgactgcgcacctcaggcgttgtgcggtcggccgctgggtagggatataaggcgcgggaccgccgataacggtcggtgaccccaattgctcgttgccgctagccagttcgacaggaagaattgaagtccgctcgccgcgcggcccggccctgatccggaagggctctgctgcggtgtgcgctccctcgaatccgaccccgcccgcagtatgggcgcgtagccgaagggaggaacgtgaccttcggattcgctccgtcctcggcggcctcgttgtcgacgaccgccgcctccgcccatcgtgtgctcgaacccgcggagtgggccgccgcgggcattcctctgctgcgcaacccccgggaagtcgtcagcggactccactcccggcaccgccccggtccggccaccgctgtggtagcggtgctcgatccggacgagcggctgcgggcgagtgcctcgttcatccgccgtcccgcgcccgccgacggctggatgttccgcaacgcgctgctcgcccagctgcgccgcgtcataccgcacgatctgcggcgccgtacgccggtgcgcaccgcggtgctgctctactgccgtgaaggcgacgcacgttggacggaggaggacggagcgtggatgtggggactgcgtgacgcgtgcaccctgcacggactgcgctgcggggcgtacatcacgctgaccagggacgggtggcaggtcctcggtgaggggcgcgg

SEQ ID NO: 1208 - DNA, 1160 bp, Unknown
  Kingdom: Bacteria, Phylum: Actinobacteria, Class: Actinobacteria, Order: Streptomycetales, Family: Streptomycetaceae, Genus: Streptomyces
gcccttgggttcgccggtggagcccgaggtgtagaggaggtatcccagccgctgcgggtccccgggatcggccggggcggtagccggggacccgcagcggctgggatacctcctctacacctcgggctccaccggcgaacccaagggcgtcgccgtcgccgaggacgcggtcgtccggctcctgaaggcggcgggccgccacctgtccgtggaacccggtgacgccgtcctgttcagctcgtcgcccgccttcgacatctccaccgtggagatcttcctcccgctggtcagcggcgcccacgtcgtgatcgccgaccgcgaccagacccgggaccccgccgagctggtccgcctgatcgaccaccacgaggtacgtctcgtccaggccaccccgtcggcgtggtggcaactcgccgaggccctcgcggcgggcggccgccgcgaccggctccaagccgtcaccgcgggcgagccgctcgcccccgacctctgcggccgtctgctcgccgtggcgggaagcgtcgtcaacggctatggccctaccgagacgaccatctactccacgatcgccaccgtcaccgcaccggacgacgtgaccgtggggacgccggtggacggcacgtcgctgtacgtcgtcgacgcgcacgaccgccccgtgcccgcgggcgtgccgggagagctgctgatcggcggccgcaacgtcgcccgcggctacctcaaccggccggagctgacggccgagcggttcgtgcccgacacctggcgggacccggccgtgccggagccgtctgcggtgtaccggaccggagacctggcctggtgggcaccggacgggcggctgcgggtgacgggccgcatcgactcccaggtgaaggtccggggtcaccgcatcgagcccggcgaggtcgaggcccggctgaacggccacccggacatcacggcgtccgtggtccgggcccgcgccttcggcccgggcgacaccaggctggtcgcctatctggtgaccgcgggcgagcggcccttcaccctcgccgcgctgcgcgactggtgcgctctcgtcctgcccgaccacctcgtccccacggtgtgcctgaccctgccgcgactgccgctgaccggcagcgcggcgtcgtccagcttgccgctgccggtcagcggca

SEQ ID NO: 1209 - DNA, 3324 bp, Unknown
  Kingdom: Bacteria, Phylum: Actinobacteria, Class: Actinobacteria, Order: Streptomycetales, Family: Streptomycetaceae, Genus: Streptomyces
ccccgacccgccccggtagccttgccgcccgtgaccgcaacgctcatctggatccttgtcgtactcgtcgccgtcgggctgtacctgagctggacggcgggacggctggaccggctgcacgcccggatcgacgccgcccgggccgcgctcgacgcccagttgctgcgccgggcctccgtggcccaggaactggccacctccggagtcctcgacccggccgcctcgatcgtgctctacgaggccgcgcacgctgcccggcagtccgaggaggagcagcgggaggtcgccgagagcgagctgagccaggcgctgcgggtggtgttcgccgagacgcagcaggtggaggcggtccgcgccgtgcccggcggtgaggcggcggcacgtgagctggccgaggcggtgcgccgggtgccgatggcccgccgcttccacaacgacgccgtgggcgcggcccgcagactgcgcgagcaccgcaaggtccgctggttccggctggccggccacgcccccttcccgctggccttcgagatggacgacgagcccccgaaggcactggtggagcgggcggcgtagggagtacgcgcccggggcacgccccgccgaggcgtgcccgaaaaggatccacccgctcgtcattggcccttgccgtggactggtccattcacgtttcctcggggtgcagcaacgcatcaaccccctctttccaccccgagtgaggtcacccgtgtccaccacgattcccgactccgcccagacccccgagaccggcaccgcgcgcgtgaagcgcggcatggccgagcagctcaagggcggcgtgatcatggacgtcgtcacgccggagcaggcgaagatcgccgaggacgcgggcgccgtcgccgtcatggccctggagcgggtcccggccgacatccgcaaggacggcggcgtggcccgtatgtccgacccggacatgatcgagggcatcatcgaggccgtctccatcccggtcatggccaagtcccgcatcggccacttcgtcgaggcgcaggtcctgcagtcgctcggcgtggactacatcgacgagtccgaggtcctcaccccggccgacgaggtcaaccactccgacaagtgggccttcaccacccccttcgtctgcggcgccaccaacctcggtgaggccctgcgccgcatcgccgagggcgcggcgatgatccgctccaagggcgaggccggcaccggcaacgtcgtcgaggcggtccgccacctgcgtcagatcaagggcgagatcgccaagctgcgcggctgcgacaacaacgagctgtacgccgccgccaaggagctgcgcgccccctacgagctggtcaaggaggtcgccgagctgggcaagctcccggtcgtgctgttctccgccggcggtgtggccaccccggccgacgccgcgctgatgcgccagctcggcgccgagggcgtcttcgtcggctccggcatcttcaagtccggcgacccggccaagcgcgccgcggccatcgtgaaggccaccaccttctacgacgacccgaagatcatcgcggacgcgtcccgcaacctgggcgaggccatggtcggcatcaactgcgacaccctccccgaggccgagcgctacgccaaccgcggctggtaaccactccatgagcagcgaagcccctgtcatcggcgtcctggccctccagggcgacgtacgggagcacctcatcgccctggccgcggccgacgccgtggccaggccggtcaggcgccccgaagaactcgccgaggtcgacggcctggtcctgcccggcggcgagtccaccaccatctccaagctcgccgtcctcttcggcgtgatggagccccttcgcgcgcgcgtgcgcgccgggatgcccgtctacggcacctgcgccggcatgatcatgctcgcggacaagatcctcgacccgcgctcgggccaggagaccgtcggcggcatcgacatgatcgtgcgccgcaacgccttcggcaggcagaacgagtccttcgaggccgccgtggacgtcaagggcgtcgcgggcgatcctgtggagggcgtcttcatccgcgccccctgggtcgagtccgtcggcgccggggccgaggtgctcgccgagcacggcggccacatcgtcgcggtccgccagggcaacgcgctggccacgtcgttccacccggagctgaccggcgaccaccgcgtgcacgccctgttcgtcgacatggtgctcgcgatacgggcggcggagtccttgtaggatctccgggggtacctcccggctgcttcaggcccgggggcgttcgtacaggatgggtttacgcgaaggagacaggcagatgtccggccactctaaatgggccacgacgaagcacaagaaggccgtcatcgatgccaagcgcggcaagctcttcgcgaagctgatcaagaacatcgaggtcgcggcgcggatgggcggcgtcgacctggacggcaacccgacgctctacgacgccgtacagaaggccaagaagcagtcggtcccgaacaagaacatcgactccgcgatcaagcgcggtggcggtctcgaggccggcggcgccgactacgagacgatcatgtacgagggctacggtccgaacggtgtcgcggtgctcatcgagtgcctcaccgacaaccgcaaccgcgccgcctccgacgtccgcgtcgccatgactcgcaacggcggctccatggccgaccccggctcggtgtcgtacctgttcaaccgcaagggcgtcgtgatcgtccccaagggcgagctgagcgaggacgacgtcctgggcgcggtcctggacgcgggcgccgaggaggtcaacgacctcggtgagagcttcgaggtcctcagcgaggccaccgacctggtcgcggtccgcaccgccctccaggacgccggcatcgactacgactccgccgacgccaacttcgtcccgaccatgcaggtcgagctggacgaggaaggcgccaagaagatcttcaagctgatcgacgccctggaggacagcgacgacgtgcagaacgtcttcgccaacttcgacgtcagcgacgaggtcatggagaaggtcgacgcctgacaccccgcacgcacggcggtcccggcgggccggagggacatgtccccccggcccgccgccgttgtcagtggcacccgatagcctgcgcggacaggagatcgaagggaaagatcgcgtgcgcgtactgggggtggacccggggctgacccgctgcggggtcggtgtcgtggaaggcgtcgcgggccggccgctgaccatggtcggcgtcggcgtcgtccgcacgcccgcggacgc

SEQ ID NO: 1210 - DNA, 1308 bp, Unknown
  Kingdom: Bacteria, Phylum: Actinobacteria, Class: Actinobacteria, Order: Streptomycetales, Family: Streptomycetaceae, Genus: Streptomyces
cgagccgccgggccggccggtcatcgtcgcctcgaccgaccgcgaggtggccgacggggtcgccagggcgggcgcgcggccggtggcgtcggcgatgctgctgaagcggctgtcgcgcggctgaagtcagctcgccgtgcgggccgattcgggcataaagcgatcttcttctcgtatgcaacgttggggcttgatgcccgaattgacggaaccgtcacgcgacgtagcgtcaaccggatctcacccctggtgagttgcgggcaaagaatgcggtgcgtgacggaatttatggccgggaggatttgaattcatcacgatgaggtcactagggtctggcatcgaacctccgagcgggtggtcactcacaagaaggagctcgcttccgtggcgtcccaccgtcgacccaaacagcccagtcgcgcacgcgtgacgatgctcaccaccgcggccgccgccgccgtcgcgatcagcgcgcaggcggccaacgcggcgccgagtgagaagccgagcaaggacgaggtcaagtccaaggtcgacaagctctacgagcaggcggagcaggccaccgagaagtacaacggcgccaaggagaagcaggagaagctccagaaggagatctccaccatccaggacaacgtcgcccgcggccagcaggacctcaacaagctgcgcgacggcctcggttcgatggcggccggccagtaccgcagcggcggcatcgacccctccctccagctcttcctctcctcccacccggacgactacctggacaaggccgcgaccctcgaccaggtcagcggccagcaggcggacgcgctgaagaagatccaggacaagcagcgccagctcgcccagcagcgcgccgaggccaccgccaagctcaaggacctcgccgccacccgcaccgaactgggcagcaagaagaaggaagtccagggcaagctcgccgaggcgcagaagctgctcaacacgctcaccgccaaggagaagcagcagctcgccgccgcggagcagacccgtgccacccgtggcaccgagcgggtcgacatgggcaagatcaccccgggcagcggtcacgcgggcgccgcgttctccgccgcccagagcaggatcggcagcccgtacgtctacggcgccaccggcccgtcctccttcgactgctcgggcctgacgtcctgggcgtacgcgcaggccggcgtcaccatcccgcgcacctccgaggcgcaggccaacgccgggcagcgcatctactcgcagagccagctccaggtcggcgacctggtcctgttctacggcgacctgcaccac

SEQ ID NO: 1211 - DNA, 5560 bp, Unknown
  Kingdom: Bacteria, Phylum: Actinobacteria, Class: Actinobacteria, Order: Streptomycetales, Family: Streptomycetaceae, Genus: Streptomyces
ggcagggagcatcgggcgggcggcccgggtcccgcggctccgggccgcccgcccgatgctccctgcccggcgctgcccgcctggcggagccgttacgctggaggcgtggcagtcgtcgatgtatccgaagagctgaagtccctctcctcgaccatggagtcgatcgaggccgtcctggacctcgacaggatgagggcagacatcgccgtgctcgaggagcaggcggccgcgccgtccctgtgggacaacccggacgaggcgcagaagatcaccagccggctctcccacctccaggcggaggtcaggaaggccgaggcgctgcgcggccggatcgacgatctcgccgtgctgttcgagatggccgaggaggaggacgacccggacacccgcgccgaggccgagtccgagctgacctcggtgcgcaaggcgctggacgagatggaggtccgcaccctcctgtccggcgagtacgacgcccgtgaggccctcgtcaacatccgcgccgaggccggtggcgtcgacgccgccgacttcgccgagaagctgcagcgcatgtacctgcgctgggccgagcagcacggttacaagaccgaggtctacgagacgtcgtacgccgaagaggccggcatcaagtcgaccaccttcgccgtccaggtgccctacgcctacggcaccctctcggtggagcagggcacgcaccggctggtgcgcatctcgccctacgataaccagggccggcggcagacgtccttcgcgggcgtcgagatccttcccgtggtcgagcagaccgaccacgtcgagatcgacgagaccgagctgcgcgtggacgtctaccggtcctccggtcccggcggccagggcgtgaacaccacggactccgcggtccgcctcacccacctgcccaccggcatcgtcgtctcctgccagaacgagcgctcgcagatccagaacaaggccacggcgatgaacgtcctgcaggccaagctgctggagcggcgccgccaggaggagcaggccaagatggacgccctcaagggcgacggcggcaactcctggggcaaccagatgcgttcgtacgtcctgcacccgtaccagatggtcaaggacctgcgcaccgagttcgaggtcggcaatcccgaggccgtgttcaacggcgagatcgacggattcctggaggccggcattcgctggcgcaagcagcaggaacagcagagcaagtaaagatcggacgctttgtcgacaaggcaactgccgctcttgggtcggcagttgccttttccgtgcccgatgtctgggttttgggtcacactcacatcgctcttcctccggcaaagagcgcgtacccggacatcgcggtcgcaacggccttgacgttgctttgaaatatgggaagggtgaggcgcggcatgcgatgtaacggggcgcatgtgaaccggggggcttgacctttcagctacctccgtcgatcacggccccgagcgcggcctcattgacgatcggctactgggggtagcgaacatatgacgaagaagacgcgggtccgggtcgcgcgcatagccgcgggcgccgtgatcgccgcgggtgcctcgctgaccgccgcgggcgcggcctccgcgctggacgcgaacgtgcaggtgggtccggtcagcatcggcgtgcagacggccggtggaccggacgacggcgacccggggtgcggcatcatcggcacttgcccgacggaggacccgacggacccgggtacggagcccacggacccgggcaccgagcccacggatccgggtacggagccgacggaccccggtacggagccgaccgacccgggtacggagcccacggacccgggcaccgagcccacggatccgggtacggagccgaccgacccgggcacggagcccacggacccgggcaccgagcccacggatccgggcacggaacctaccgaccccggtacggagccgacggacccgggcaccagtcagccgggtggcggtgacaacaaccagaccggcggctcgggcaacgagggcgggagcgacaacggcggcggcaccacccccgacggtggcagcagcaacaacaccgtcccgcaggagcagggctcctcggccctgaccgacaccggcacggacaacggcacgtccaacaccgcgccccagggcagcgacaagcagctggccgagaccggtgcgggccagaccgcgttcctgctgatcggcgccgcgacgatgatcgccggcggtatcggcttccgcgtactgccgcgcgtgatggcgggccgcggcggcgccgccgcctgaacgtgtccacggccccacggggcgtgacccacacaagctgaggggcccggagcgaacgcaggttcgctccgggccccttcgccctgtccgccaggacccctgtctcccgggatccctctctgtcagtaccccgcggctacgccgtctggtgcgccagcagcgccactgaggcgatcagcaccgccagcagcgcgatcagcgccatcgggttcagacccgcgaggaagttgttctcctgctgcagccgctcgcggttcgcgcggcacaccgggcaccggccctcgctcacgggcgccgcgcagttcgcgcacaccaaccggtcgtacgtcatgcgctcgccctccttgcaccggttcccatccgagacaacgcccgcggccccgcgaacgttcccctctccaccatgccaggttcccccgttttcagcgcggggtccgaccggatcccttagcaggcgaagacaaaacgtacaactgtcaccaaccccgaccggtgactgcgctcgcacacccgactcgcgtatggtcacgctcatctacccccggcgacccgtggtgcatccgtgatccgattcgacaatgtctccaaggtctaccccaagcagacccgcccagccctcagggatgtctccctggaggtcgagaagggcgagttcgtgttcctcgtggggtcctccggctccggaaagtccaccttcctgcggctgatcctccgcgaggagcggtgcagtcacggtcaggtgcacgtcctgggcaaggacctcgcgcggctctccaactggaaggtgccgcagatgcgccgccagttgggcaccgtgttccaggacttccgcctgctgccgaacaagacggtggcggagaacgtggccttcgcgcaggaggtcatcggcaagtcgaagggcgagatccgcaagtccgtaccgcaggtgctggacctcgtcgggctcggcggcaaggaggaccgcaggccgggcgagttgtccggcggtgagcagcagcgcgtcgccatcgcgcgggcgttcgtgaaccggcccaagctgctgatcgccgacgagcccaccggcaacctcgacccgcagacctccgtcggcatcatgaagctgctcgaccggatcaaccggacgggcaccaccgtggtgatggcgacccacgaccagaacatcgtggaccagatgcgcaagcgcgtcatcgagctggagaagggccgcctcgtccgcgaccaggcgcgcggcgtctacggctaccagcactgagaagtccacgacggaaaggcttgaccagacgccatgcgcgcccagttcgtcctgtcggagatcggtgtcggtctccgccgcaacctgacgatgacgttcgccgtcatcgtctccgtggccctgtccctggccctgttcggcggctcgctgctgctgagcgaccaggtgaccaagatgaagggctactggtacgacaaagtcaacgtatcgatcttcctctgcaacaagagcaacgcggagtcggacgccaactgcgccaagggcgcggtcaccgaggaccagaagaaggcgatcctcgccgacctgcagaagatgccggtcgtggagaaggtcacgtacgagtcccaggacgaggcgtacaagcactacaaggagcagttcggacactccccgctggccgcctcgatcacgccggaccagatgcaggagtcgtaccggatcaagctgaagaaccccgagcagtaccaggtcatcgcgagcgccttcaacggccgcgacggcgtgcagtccgtgcaggaccagaagagcatcctggacaacctcttcaccctgctcggctatctgaacctggccgcgcggggcgtgatgctggtgatgctgacggtggcgatgctgctgatcgtcaacaccgtgcgggtctcggcgttcagccggcgccgggagaccggcatcatgcgcctggtcggcgcgtccggcttctacatccaggcgccgttcatcatggaggcggcggtcgccggcctcatcggcggcatgctcgcctcctccttcctggtggtggtgcagtacttcgtgatcgacaacggagtggcgctgtcgtcgaagctccagctgatcaacttcgtgggctgggacgcggtgatcaccaagatcccgctcatcctcgccgtgagcttcctgatccccgccctggccggattcctcgcgctgcgcaagtatctgaaggtgtgacacacgccaacggggccgcaccgccgagcgcgcgtgcggccccgtcgcgttgtcctagactcaccgccatgtcaggccgagaccccttctgccagccccgccgcagccgctccggggccggtctgacgttggtgttcgtgggcgtcctcgtggccggcgcggcgacgggttcgctgccgggccacgagcgcaagtccgcggcgacggcgggccgttcggcgccgtccgcgtacgcctccgagccgtcctccgtgtctccctcctccgcgtccccttcctcttcctcctccggtccgtcggccgccgccagccgccacgagcaggtcgcgcgggccgccgccgaggccatggccgcgggcaagtcgccgatggaggccgccgagcacgccgtcagccgcagcggcgaccgctggggcgcggtctactccccgggcgacttcgccgagttccaggaggcgctggccggccggtacaccggcgtcggcctgtgggcgcggcgcgagcgggacggccggatcgacgtgatgaaggtgcagtccggctcgcccgccgccgacgccgggatccgcgcgggcgaccggctgcgcagcgtggacggcgagaaggtggacgggctgcccgtcaccgacgtcgtctccctgctgcgcggcgacgccgccgacgcgcccgccggcacctccgtcaccctgggccttgagcgcggcacgcgcgcgtggacgcagacgctgcgccgggcccggctgtccacggactccgtcacggtgcggcgcctttccgacggtacgacggtcatcaggatcagcgccttcacgaagggcgtgggagacaaggtccgtgcggccgtacgcgacgcggcacccggctccgggatcgtcctggacctgcgcggcaactccggcggtctggtctccgaggcggtcaccaccgcctccgccttcctcgacggcggtctggtcgccacctacgacgtcgacggcaagcagcgcgccctgcacgccgagcccggcggcgacaccgccaggcccctggtcgcgctcgtcgacggcggcacgatgag

SEQ ID NO: 1212 - DNA, 2360 bp, Unknown
  Kingdom: Bacteria, Phylum: Actinobacteria, Class: Actinobacteria, Order: Streptomycetales, Family: Streptomycetaceae, Genus: Streptomyces
acgcgccgccggagcgcgcgcaactgacgcgcccctcccgcgctccggggcgccccggacccgcccggaggacgcgctgtcctgagacacagccgttgcggccacaatggggggatgagcgacagtccagcccctctcgccgatccgcatctcgtcttcgaccccgccaccggggacgggcccaaggacgtggtcgtcctcgggtccaccgggtccgtcggcacccaggccatcgatctcgtactgcgccacccggaccgcttccgggtcaccgctctgtccgccaacggcggccgggtcggtctcctcgccgagcaggcgtaccggctgcgggtgcggaccgtggccgtggcccgcgaggacgccgtaccggccctgcgcgaggcgctggccgcgcagtacggcggcggcgaaccgcttcccgagatcctcgccggaggcgacgcggccacccgcctcgccgcctccgactgccacaccgtgctcaacggcatcaccggctccatcggcctcgccccgaccctcgccgccctggaggcgggccgcaccctcgcgctcgccaacaaggagtcgctcatcgtcggcggcccgctggtcaaggcgctcgcgaagccgggtcagatcatcccggtggactccgagcacgccgcgctcttccaggccctcgccgccggcaccagggccgatgtgcgcaaactcgtcgtcaccgcgtccggcggccccttccgcggccgcagcaaggacgacctggcggacgtcaccgtcgaggacgccctcgcccaccccacctgggcgatgggcccggtgatcaccgtgaactccgccaccctcgtcaacaagggcctggaggtcatcgaggcccacctgctgtacgacatccccttcgaccacatcgaggtcgtcgtccacccgcagtcgtacgtccactcgatggtcgagttctccgacggctccaccatcgcccaggcgacgccccccgacatgagcggtcccatcgccatcggcctcggctggcccgaacgggtgcccgacgccgcacccgccttcgactggagcaaggcgtccacctgggagttcttcccgctcgacaccgaggcgttcccctccgtcgggctcgcccggcacgtcggccggctcgcgggcaccgccccggccgtgttcaatgcggccaacgaggagtgcgtcgacgcgttcctgcggggggcactgcccttcaacgggatcatggagaccgtgacacaggtggtcgaggagcacggcacgccccgcacgggaactacgctgaccctgccggacgtcctcgaagcggagacctgggcccgctcccgcgcccgggaactgacagcgcagacggcgaccgcggaggcgcgtgcatgacgtccctgatgatgatcctcggcatagtcgtcttcgtgatcggcctgctggtctccatcgcgtggcacgagctgggacatctctccaccgccaagctcttcggcatccgcgtgccgcagtacatggtcggcttcggcccgacgatcttctcgcgcaagaagggcgagacggagtacggcatcaaggccatcccgttcggcggctacatccgcatgatcggcatgttcccgccgggcgacgacggccggatcaccgcccgctccacctcgccctggcgcggcatgatcgaggacgcccgctcggccgcgtacgaggagctggagcccggcgacgagaagcgcatgttctacacgcgcgccccgtggaagcgggtcatcgtcatgttcgccggccccttcatgaacctcgtcctcgcggtcgccctgttcctcatcgtgctgatgggcttcggcatctcgcagcagacgacctccgtcagctccgtctcgcagtgcgtcatcgcacagagcgagaaccgcgacacgtgcgccaagaaggacgccccctccccggccgccgccgccggcctgcgcgccggtgacaagatcgtcgctttcgacggcgtgaagaccgccgactgggaccgcctgtccgacctcatccgcgccaaccccggcaagcaggtgccgatcgtcgtcgagcggggcggcaaggacgtcaccctgcacgcgaagatcgccaccaaccaggtcgccaagaaggactcccacggccagatcgtccagggccagtacgtcaacgccggcttcctcggcttcagcgccgccaccggcatcgtccgccaggacttcggccagtccgtgacctggatgggcgaccggctcggcgaggccgtcgactccatcgcgagcctgcccggcaagatccccgcgctgtgggacgcggccttcgacggcgccccccgccagcccgactccccgatgggcttggtcggcgcggcccgc

SEQ ID NO: 1213 - DNA, 2871 bp, Unknown
  Kingdom: Bacteria, Phylum: Actinobacteria, Class: Actinobacteria, Order: Streptomycetales, Family: Streptomycetaceae, Genus: Streptomyces
ggtggcctcgtgcagggcgaactgccggccgatgcaggcgcgttcgccggtgccgaagggcttgaaggcgtgcggggagcgggccgcctcggcctccggggagaagcgggaggggtcgaacagttcggggttgtcgccccaggccgggtcccggtgcagcatcggggtcaccaccgacgcccactgccctgccttgagcgggatgccgcccaggacggtgtcgtggcgggcctggcgggagaacgccggggccgccgggtacagccgcagcgtctcgttgagcacctggcgggtgtacggcaggcggccgatgtcctcgtaggtcggctcggggtcgggctggtcaccccacagctcgtccgcctcacgctgcaccaggcgcagcgcggcggggtgcttgaccaggttgtacagggcgaaggacagggtgccggaggtggtctcgtgcccggcgatcaggaaggtgatgacctggttgcggatgttctccaggtcgagggtggtgccgtccgaggggtggcgggcgtggagcatcagatccagcaggtcctcgttctgcggggccggtgcgcccggcgcggtgcgtgcggcgatgacctcgtccaccaccgaggccaggaaggccgcgtcggcgcggaacgcctcgtcggcccgcgtgtggtcgcggtccgggtcgcggctgagcttggtcatcgaccagtgcaggcagcgcaccagggcatcgacgaacgggtgcggctcgtcccgctcgaaggaggcgaagtcgaatccgaatccggccaggccgatggtgtccagggtcatccgggtcatgtcgccgggcacgtcgaccgggcttttctgagcgctgcggcggtcccacgcctcgatcaggcggcgggcgacgcgcagcatcaccgggtgataggtgcgcatggacccgagggcgaaggcgggcatcaggatgtcgtgcgccttggcccagttgggctcgtcgttgtacgcggtgaacaggccgtcgtgggcgaattcacggacgttcaccagcgccgggcccacggccttgcggaatcgctgctcgtcggagagttcggcgaccaggtccaggctgctgacgaggagggtgtcctggccgtgcaggcgctggacgaaggccggtccgtgctgccgggccagcttcatggtcctgaggacgggggtggcggtcggggcgtcggagacgtcgacgacgggaatgccgccgtggctttccggctgggtcgggagcagagtcgcggacatcggggcgaaccgccttccgtgatcaggagataccggaaccgcctgtgcggaacggttccggtggttgcctcaaccgtcgtcctccgcgcacgtaccgggcccccctcgcactacacaatcgtgtagtaacgtgaggcaggtcgggcttgcacatccggccgggccgtgcatgcggccgatggcgcgcagggaaaaggagcctcctgtggatctcgacgccggcagtccggtgggtgattcgccgaccgcgctcgcctggcgtcagcaggcgatcacctggcgcaaccgggtcttccttctcctggaccgcctcccgctgccggtcgcgctctgcgaccccgcgggcgtcatcgtcctggccaatccggcgatggccgcggaatggggcatgctctcgggacagatgcgcgggcgcaacgccctggagttcttccggccgcgcacccgcacccggctccatccgatcgcggaagccgtccggctgggccgcaggtcccgttatccggtcgaggtgacctggtccgccgtgggcggggtggagcggtacggggagatggacgtcgacccggtcagtgacaccccggacgcgccgccgatgctgatgctgctggtccgggttctggaggaacggacggaaagtcccgccgggacggaggccgagcagccggccgtgagcgaggtcgaaggacggatcctcgcgctggcggcgaatggcgacacgaccgcgcggatcgccaaggcggtcgacctgacagtggacggggtcaactaccacctggcgcggctgtcccagcgctggggcgtgcgcggcagaacggcactggtggcccgcgcctacaccctgggcgtgctcgcccccgaagcctggccgccggccgccgtgcaacccggatgacgggccggcgcgggggtgtggtgccggtcttgtccccgacccggggggtcgagcagttgcctgagggccgacccggggcggcgagcagttgcctgcgcgccctgaggccgcggtgctccgccagatccgagaggaggcgccggctcgcaccgcccggccggaggtgggcgggcggtccggcgaggaagccgcggagcatggtgctgtcggccgctgatcacgatccccggctcggggcgtaccgggccagctgctcggcgcaggcgttccacgcgggcgcggacagcagatcgcgtgagcgggcgaacaggaggtacaaggccgggccgtgctgttcggccagcccgacgttgtgggccagcacgtcgagctcgttggcggccgtgatctccgcgacggcgcgtacgtccgcctcggccggagtgtgttcccggcccgtgaagcggtcatggaagaccaccggaagtcccttgcccaggcgcggatagacggccgcccggtcgcagctcgcgtacaggtacaccagggcctccgcgcgatcgccgatcagttcggcgagcaccccgcgctcggtggtgcgcagaagcgaccggtcgaatccgtccgttccgtaggcggcgtggcacagccccgcgagctggacgtcggggtcggcgccccaggcggagagcaggcgggcgacgcgttgcaggtggtccaggagcgtcccgcccgga

SEQ ID NO: 1214 - DNA, 989 bp, Unknown
  Kingdom: Bacteria, Phylum: Actinobacteria, Class: Actinobacteria, Order: Streptomycetales, Family: Streptomycetaceae, Genus: Streptomyces
  misc_feature (361)..(362): n is a, c, g, or t
ctccggggccgcgggaggcggtggccctcgcgcccgtacggagccggaccgtcccgctgtccggtccgcgcgtgaagcggacgctgctgctgaccgtccggcccgggacgcccggcggtctcgtggcccgcctggagcgggacctgctcgccatgccggaccacatccacgccatccgctcctgggcgctgagccgcgtggaccgttctctcacgccgtgccggtggacccacgtctgggagcaggagttcgcggacgtcgccggtctgaccggggactacctgggccatccctaccactggacctgcgtggaccggtggttcgacggcgaggtgccgggcggcgggatcgtcgagccggnncccgccgcactgaactgcgtacgcactgacctgcgttcgtactgaccggcgttcgcatcgaccggcgttcgcccgcttgatgtgcgggcacgccgggtatcccctcttcagtatttcgattagtcatattgctcttcggaatagccttcacactccgggaggacctgatccatgccgaccctcaccccgcacagcgaccccaccacggccgccccgtcccccgtcccttccgccgctccgttcgacgacgccgccctgcgtgaggtgatgagcagcttctgcaccggtgtcgcggtggtcaccgcgctccagccggacgggcggcccgccgggatggccgtccagtccttcacctcggtgtcactggacccgccgctggtgtgcttctgcccggctcacacctcgtcgacgtggccgaagatccgggccgccggacggttcgccgtcagtatcctcacggacgaacagcaggcgctgtcccggcagttggcggtgaccggcggggacaagttcgccggggtggcctggcaccccggcgcgaacggcgcgccgctgctcgacggcgcgctcgcgaccgtcgagtgcgagctggccggcacgctccccggcggcgaccacacgatcgtc

SEQ ID NO: 1215 - DNA, 2192 bp, Unknown
  Kingdom: Bacteria, Phylum: Actinobacteria, Class: Actinobacteria, Order: Streptomycetales, Family: Streptomycetaceae, Genus: Streptomyces
gcgcgccggtcgggaccggcggccacggcggtcaccgcgagcgagacggcggcggccaagatccggcgggtgctgcccgagcgtctcgcccgccggctcgacacggtgctcggatccctcgccttcacggagtcgggcgccgagatctccgtacccgatccctcggtcctgctgaccgtcgccgacgcggtacgccaccggcggcccgtctcgatcaggtacaccgaccgccggggccggcgcagcgaccgcacgctgcatccgtacgggctcgtgtcccactcgggccgctggtacgtcaccggcgctgacccgggtatcggcgaggaccggaccttccgtctcgacggcatcaccgacgcgaggaccctgcccggctcgttcgaggcgcccgacggccccgatccggcccagcgcgtcctgaccgggttcgcgaccgccgcgtaccggcacgaggtgaccctgcggatccacgggacggccgagcagatccgcacccggctccccgcctccctcgccaccctgaaggagctgccggagacagcgcccgagccgggtgcggagcccgcggccgggcgctggttccttgtcgagatgcgggtcgagcggctcgactggctgcccgcgctgctggcctcgctcgaccggccgttcgtcatcgaacgtcccggcgaactgcgcgacctcgtcaccgcgctcgccgaccgcctggcgcgccacgcccgccggacctgacgggcgtggcgcgttctccgcacctgacgggccggtcgaatcgcgttcgcctcgcccccgggccacgctgctatcgacgctcggagtggtggagtctgcgggcggcctcgtggcgggtgtggacgccgagtttgttcagcacggcgcccacgtgatgtccggccgtcttgggcgtgatgtagaggcgggcggcgatctcggcatccgacaggccctcgttcagcagcttcaggacgtccagctcccggttggtcagcccgtacggattggcccgggtggccgcccgtggaccacgccgtaccgggcggacgccgcgcttacgcatcagggcgcgcgtgtacgcgacggccggccgggccccgaggccctcgaaggcggccagggcctggtgcagggcgggtgcgtccccggacaggcgcgccagcgcggcgtcgtgcgggcagccgaggctctcccatcgtgccgcggcgcccgcccagtcgccggccagctccagtgcgtagggttcggccgccggaacctgcgggggagtgcccccggcgcgacggatccagcaggccagcggcccggacagccaggggtggctgcgttcttccaacgcggccagcccgcggcgcgcctccgcctgcacccgctcctgatcaccggccagccaggccgcctcgacacgggcctcccaccccaggcccgtgtccagcaggcagtccgaatcgaccagatccgccgcctgctccagcagcggccacacctgccccttgccccggcgggcccgcaccagccccagcacggtcaacgccagggcccggacgaccggcggtgagctgggatggcagaggaccttctgggcagcaccggcggcctgcggccacaagccgcggttcagcagtccccagctgtcccaggcctgcgtccacagcaggtaggtcagcaggtcacggtcgaggcagtaggcctccgcgcgccggacggccgcggtggtccgggcggcatcgcgccgcagcgcggtgaaccaggccatgatgaccgtcagaagggccgcgtccaccggcagatcctgcgcgatcgcgctcgacaccgcctgttcgcagtcctcccagccacccccctggcacagcagccgtgccgccgccgcgtggaagcgcgcctggacgaccacgccggcgtcgccgaagcgctcacccagcgcgatcgccttctcggcgtacgcggcggccaccggcaccggagcgtgctcgtagcaggacagctgacacagattcaggtacgcccaggccagctcccggctgggccgcagcttttcgagcacccgcaccgcgttcatgccgatccgtccggcctcggcggtccgcccggccggccacagccagcacgacagccagcgaaggtcctcgccctcgcccagccggtcgcccagcgcatggcgcagccgcaccgctgtgcggctgcgccatgcgctg

SEQ ID NO: 1216 - DNA, 2467 bp, Unknown
  Kingdom: Bacteria, Phylum: Actinobacteria, Class: Actinobacteria, Order: Streptomycetales, Family: Streptomycetaceae, Genus: Streptomyces
gtcggcccgggccgaccgcacaccgtgcgcccccgtgccggcggtcagcaggacaccgcccagagcgagcgcgccgagaacggtggccaggaatctacgggtactgctgtgcattgcttcgccccctgtggaaaagttcgtccagtcgtcgccgcgcttccggcgccggcgacaggaagaacgttatggatcacaactgtcgacccgatgttgtttcgatttcaccccgggagaaatcaagcggaaaacccaccaaaaacggccctcgctaacctcttgagtgcgttcactacagaactcaccagggggatctcatggaattccggctgctcggcccggtcgaggcgagacggggcggcgtcccggccgcactctcgggctcgaagatccacaccgtgctcgcggcgctgctgctcgcgcgcggccgagtcgtctcggacgcccgcctcagctacctgttgtggggctggtcgccaccggcgacactgaacgcgcagatctacacctacgtctcgcggctgcgcaagcagctcggccccggaatcgagatcgcccgccgacagcccggctacgtactgcggcccggggacagccgtatcgacttcctcgaattcgagcgtctcgacaagctcggccgggacgcactgcggcagcgggactatgccgcggcccgctccctgctgacggaggcactcgacctctggcaggggcccgcgctcgcgaatgtcacggaattcctttcggaaacccagattccgcagtgggaggacgcccgcgcgacgacgctggagaaccggatcgaggcggacctctcgctcggccggcaccaggagatcaccgccgagctgaccggcctggtcacccgtcaccccgagcgcgagcggctccgcgcccagctgatgctggccctgtaccgctccggccggcagtccgacgccctgcacgtctaccaccacggccgccgcgtcctcgccgacgaactgggcgtggacccgggccccgagctggaggccgcctaccaggtcgtgctgcgcggcgagcgggccccggtgcccgccgctcccgcccccgcgatgctgcccgccgacaccctcgccttcaccggacgcgacagcgaactggccgccctgcgggccctgttgtcccccggcgcccggaccgatccctggcggccgcggagattcctgatcaccggcatggccggtgccggcaagaccgcgctcgccgtgcgggccgcccacgcctgcgccgagcacttccccgacggcctgctccacgccgacctgcgcggccccgacggcacccccaaggacccctgcgacgtcctgctgcggctgctgcgcgcgctcggtgagaccgggctcgacggagacagccggatcgccgacgacctcgacgaactgacccgcctctaccgcacccgcacctccggcaagcggatgctgctcgtcctggacaacgcctgcagcgacctccagctcggcccgctgctgcccggcagccccgacatcccggtcctgatcaccgcgcagaccccgctggcggagacggccggggcgcacaccaccgcgctcgccccgctggacgaggacaccgcgtaccggctgctctgcgcggtcgccgggcccggccggatcgccgccgcgccggaagcggcccgggagatcgtgcggcactgcgcgggcctgccgctcgcgctgcggatcgccggtgcccggctcgccgcgcggccgcactggtcgcccggccggctcgcggaccggctcgcggacccgcggacccggctgcgtgaactgtccctgggcgacctcgacgtgcggaacgcgctgcgtcagccggtgcgccgtctcgaacccgccacccgggcgctgctcgggcggctgccgctggtcggccccgggccgtttcgcgcggccgccgccgcgaccgtgttcgggctgaccgagacggcggccgaggaggtcctggaacagctggtggacgcctcactgctcgacctgtgcggcatcggcctgcggggcgtgccgatctaccggctgcacccgctggtgcggctgctgttccagggctccctggaggacaccttcgaggagcccgccgcccggcagggcctcgccaaggccggctgaccgccatggccttcccggtcccggggtcccggcggtcagacggcggccggggccggggccgccaggcgcgccacccggggccgggccagcgcccggtacgcggggacgggcacggccaccgacaggtccaggcgggccgcgttgaagaagacctcctcatgggtcagcaggtcctcgtccaccacgagttcgaggtcggggcggaacgtgaacgggatgatcgagccgctgacgcagccggtgaggccctcggcgatgtcacgggaggcgaaggcggagtcgctgcctccgtacaggtcccgtaccgcgtccatgtcgacgcggtacgggacctgtac

SEQ ID NO: 1217 - DNA, 834 bp, Unknown
  Kingdom: Bacteria, Phylum: Actinobacteria, Class: Actinobacteria, Order: Streptomycetales, Family: Streptomycetaceae, Genus: Streptomyces
gcgggatcctgacccggtcgggcaccgactccggcagggacggctcggcggccgcggtcgcggccgtggtcggcgcggcgctgggcggacggctgacatccggcgccgccgccttcgcgggctgcggcggaccgacgtcgaactctcccgaaccgttgcggatgagggcgagcccggcgagcaggaccagcgctatcacgccccacggagcacgctttcgtcgcggctgcggctcctcctcttccgtgattccggacagcccgctcgcagacattcgccatcccctctcgatgcggccggcaccgtgtcattcgcgcacagcagcacgctaagtcccacgctggaaaccggcgacgggacgggagcgaacgggtggcgggccggttttccgtgcgccatccgagtcgagccgtacgggggctttatgacaacctgtgacctgcggcgatatccaacagagtgaattcggcgggggaatgcctcaccgggtcggacgagcgccgaaatgcgcccctgaactgggcatccgagggtttttccgaaggtgctttctcgccgatcgaccgggtacgggcccccggggcgccttccgcggaggaacacatgtccatcattcgcacccctctggcggtcctggtggccgccgtcgccgccgtagggctcgccgccccggtggctgtcgccaagggcggcgacgcccccggcggctgggacgtcggaccgggcaacggccagatcggcggcctgggcaacggacaggtcggcggcccggggaacggtcagatcggtgggttcggcaacggtcaggtcggcggcccgggggccgggcaggtg

SEQ ID NO: 1218 - DNA, 1278 bp, Unknown
  Kingdom: Bacteria, Phylum: Actinobacteria, Class: Actinobacteria, Order: Streptomycetales, Family: Streptomycetaceae, Genus: Streptomyces
cccggtgccaccgccgggcggggaaccgagcgcgccgggtgccgccgccgggggcggtgcgtcacgcgcggcggtgtcacatccactcgctgaaccgcagccacatcagcatgctgtccatcgcgggcggcggcacagcgggcgcgggcggcgccgtccgctcggggcgcgtacgggtcttcgtccgccggccaggaccgaacatgtcctgccacaccgagcccgcgcagccgcgtacggagggagcgatccgctccagctcccggtgggcgccgttgccgcacaccgagatcgcggcgacggcacggccggcgccacgcagcggtgccgccacgcaggacacgcccctgaacccctcctcgcggtcgaaggcgaccccgcgctcgcgcaccgtcgccagttccctgcggagcgagtccgggcggacgatggtgcggggcgtgcgcgcccgcaacccgccgtggatcacctgctccaccagcgcggcgtcggcgaaggccaggatcgccttgcccgccgccgtgcagtacgccggctgccgaccgcccacccgcgacggcacgccaccgtcgtccgagccgccgatccgctccaggtacaccacctccgtgccgtcgagcacggtcaggtgcaccaggtggccggtggactcgtgcagcgcgtgcagatggggcagcgccgcccgccgcagccggttgtgatgggacgccagagcgcccagctccagcatgcccatgcccagccggtagtcgtggccctcacgctccagccagcgcaactgcaccagttggtccaggatgcggtgcgcggaggacctggggatcccggaacgctgcacgacctgcgtcagggtgagccggggttcggcggtctggaaggtgctcagcaccttcgccgccttctccagcagggacagtggcggaaacccggtcgcggcggcggcctgagtcgtcatcgacacctcacctcacacacggacggccggcagcccggggccacggccgtaatctccggtattgcggggagattgccagccgatcccacctgctgggaagagggtgtttcgtttcggaacagtaacgcgtactttccctcgcgtcagcccccgcacgtcggaggccgacccccggccgcccgggcgaccgacccggacgacccgcccgtacgaggcacgagcagtccgtaagacccgtaccacccgccaccggctgacgaccccgcccgtgcacccacgcccggaacggccgccgccccgccacaagccccccccggcaccac

SEQ ID NO: 1219 - DNA, 5434 bp, Unknown
  Kingdom: Bacteria, Phylum: Actinobacteria, Class: Actinobacteria, Order: Streptomycetales, Family: Streptomycetaceae, Genus: Streptomyces
ggccgggtcggcgagcaggcgtacggccgcgtcggcgagcgcctccgcgtcctcgttggcgaacagctcaccggccttgccctggtcgaggacctgggcgaaggcgtcgaggtcggaggcgagcaccggcgcaccggcggacatcgcctcgacgaggatgatgccgaagctctctccgccggtgttgggggccacgtacaggtcgacgctgcgcaggaagcgcgccttgtcctcgtcgctgatcatgccgaggaactgcacgcgcgcgcgcagctcgcgcggcaggctcgccacggcttcttcctcgtcgccgcgtcctgccaccagcagccgggctcccgggtgggcggcgaggatcttcggcagggcccgcatcagcacgggcaggcccttgcggggctcgtcgatgcggcccatgaagccgatcgtctccccctgccactcgggccggggcgcggcccgcgcgaagaagtctacgtcgacgccgttggggatgaccacggcatccccgcccaggtgttcgacgagggtgcgccgggcgtactcgctcacggcgatgcgggcgctgatcttctccagggcggcctggaggatggcgtacgcggcgaccatcgcccgggagcgggggttggaggtgtggaacgtcgccacgatcgggccctgcgccgcccagcaggtcagcaggcccagggacggcgaggtcggctcgtggatgtggatgacgtcgaagcggccctcgtgcagccagcgccgtacccgggccgccgagaggaagccgaagttcaggcgggccaccgagccgttgtacggcaccgggaccgcgcggccggccgagacgacgtagggcggcagcggggtgtcgtcgtcggcgggggcgaggacggacacctcgtggccgaggcggatgaagtactcggcgaggtcgcggatgtggaactgcacgcccccggggacgtcccaggagtacgggcagacgatgccgatcctcacgccgcttccccctgtgtccgcgcgcggcggggttccaggtcagcgagccacaagcgctgcagcatgtgccagtcctccggatggtcggcgatccccgaggcgaaggcgtcggccagcgcctgtgtcatgacagacgtcttctcgggccgcgtacctgtccggggtacctcgatcgggggatggacgcggcccttcatgacgggcgagtcgtcgtaccagagggtgacgggcagcagcagggcgccggtctgctgggcgagcagggcggggccggccggcatgcgggcgctctcgccgaagaactcgacctcgacgccggaggcggacaggtcgcggtcggcgacgaggcagaccaggccgccgtcgcgcagccgccgcgcgagcgtgccgaaggcggagccgccgctgtgcggcaggacttccatgccgaggccctggcggtaggcgacgaaccggtcgtagagcgtctcgggcttgaggcgttcggcgacggtcgtgaacggcgtgttcagctcggtggtgacccaggcgccggccaggtcccagttggccaggtgcggcagggcgaggacgacgcccttgccggaggcgaggccgtcggtgaggtggtgcacgtccttgggcgcgaagccgccgcgcacccgctcggggctccaggccggcagccggaaggactccatccagtagcgcaggtaggagcgcatgcccgcgcgggacagctccgcgagccgctcgggggacgcgtcgggcaccacgcgggcgtagttgctctccagccgcaggacgcccttgccacgccgcttccaggcgaggtccgccatggcgcggccgaggcggacggcggcgggctcgggaagcttcttgacggtgctccagcccaggccgtacagggagtcggtgagccggtcccgggcgctcatgccgacgccccgctcccctggttctcctgccgggccgcttcggcgtccgcctcggccgactcgcggcgcacggtgacgacgcgttgcaccagggtgaccaggctgccggcggcgacgatccacagggcgatgggcagcaggtactggatgccgggcacgccgaacttgtgcaggcccgcgaaaccggccgcgaccagggagatcaccagccgttcggcgcgctcgacgagcccgttgacggcgacgggcagcccgatcgactcgccgcgcgccttggtgtacgacaccacctggccgctggccaggcagaagatcgacaccgcgcacagcatgttgtcgtcgccgttcccggcgtaccacagggcgaagccgccgaagatggcgccgtcggccacccggtccagggtggagtccaggaaggccccccagcggctggagcggccgagctggcgggccatgttgccgtcgacgaggtcggagaagacgaagagcgtgatcacgaccgtgccccagaagaactcgccccgggggtagaagaccagcgcgcccgcgatcaccccggcggtgcccaggagcgtgaccgtgtcggggctcacgccccggcggatgagaaacgcggcgaacggtgtgaggacacgcgtgaagaatgcacgcgcgtacttgttcagcatggccttcccgagggtcgctgtcggcgggcggcccctgctggccaccggcgggcccatcgtagtcacgcgcgcgcacaggcggcgtccgggcacccgcgggcccctggcgggcgcctgcctcagggcaccggggcacgtgcgggaggcgggatcgggtccttcgtatggacgcggcatgacgggagtgcaaagctcgaatgaccgcgggcgtcgcaggagccgccggtgacgcggtgccgcgtgtccgcgcccacagtgacctcaccgtgcacgggaggcaggaccatgggcgacaaggcgcacacacatcccggagccgccggcagggcagtggcggccgaccgacccgcgtccctacggaacgtggtgctggtcggccactccggagcgggcaagacgaccctggtggaagctctcgcgctgacagcgggagcggtgaaccgggcaggccgcgtcgaggacggcggctgtgtctcggacttcgacgacatcgagcaccggcagcagcgctcggtgcagctctccctggtgcccgtcgagtgggacggcatcaagatcaaccttctggacacgcccggctacgccgacttcgtcggggagctgcgggccggtctgcgggccgcggacgcggcgctcttcgtcgtctcggcctccgacggcgtggacggctcgacccgcatggtgtgggaggagtgcgcggccgtgggcatgccgcgggccatcgtgatcacgcatctggaggccgcccgcgcggacttcgaggagatgacccgggtgtgcgccgaggcgttcggcgcggacgaccccgacgcggtgctgcccctgtacctgccgctgcacggccccgagggccccgacgggcacgcgccggtcaccggcctggtcgggctgctgacgcagaagctgttcgactactcgaccggagagcgcaaggagtccgagccgggcgaggacgaactgccgcggatggacgaggcgcgcggccggctcatcgaggggatcatctccgagagcgaggacgagaccctcatggaccgctatctcggcggcgagcaggtcgacgtcgagaccctgatcaaggacctggagcgggccgtcgcacgcggcgtgttcttccccgtgctcgccgccgccccggccgccgagggcgcccggcagggcatcggcacggtcgagctgctggagctgatcgtccgcggcttcccgacgcccctggagcgcgaggcacccggcgtgaccagcgtagacggccgcccgcgcgagccgctgccgtgcaccccggacgggccgctggtcgcggaggtcgtgaagacctcctccgacccgtacgtcggccgcgtctccctggtgcgcgtcttctccggcaccctgcgcccggacgagacggtgcacgtctccgggcacgggctggccgaccggggccacgaggaccatgacgtcgacgagcggatcggcgccctgtcgacgccgttcggcaaacagcagcggccggtgacgcacgcggtcgccggcgatctggtctccgtggccaagctgagccgcgccgagaccggcgacacgctctccgccaaggacgacccgctgctgatggccccgtgggagatgcccgacccgctgctgccgctcgccatccaggcgcacagcaaggcggacgaggacaagctctcccagggccttgcccggctggtcgccgaggatccgacgatgcgcctggaacagaaccaggacacccaccaggtggtgctgtggtgcctgggcgaggcccacgcggacgtggccctggaacggctgcgcagccgctacggcgtccaggtcgacgtcgtcccgcaccgggtctccctgcgggagacgttcgcgaaccgggcggcgggccggggccggcacgtcaagcagtccggcgggcacggacagtacgcgatctgcgagatcgaggtggagccgctgccgggcggctcgggcatcgagttcgtcgacaaggtcgtcggcggggccgtcccgcgccagttcatcccctccgtggagaagggcgtacgggcccaggccgcgaagggggtggccgccgggcatccgctgatcgacgtccgggtcacgctcctggacggaaaggcgcactcggtggactcctcggacgccgcgttccagacggcgggcgcgctggcgctgcgggaggccgcggccgacgcgaagatccacctgctcgaaccggtggccgaggtgagcgtcctggtcggcgacgactacgtgggcgccgtgatgagcgacctgtccgggcggcgcggccgggtactgggcaccgagcaggtcaccggcgggcgcacgctggtgcgggccgaggtgccggagatcgagatcggccggtacgcgatcgacctgcggtccctgtcgcacggcacggcccgcttcgaccgccgctatgcccggcacgagccgatgccgccgcaggtcgccgaccggctgcgccaacaggagcgcgaggcctcctagtcggcgcgccgggcgcacaacggagcagtgtcgtaggggcgtacggaacggttcgccccggacaggtgggcggcttcggccgtccacctccgtgtgacggcgggtgccgatacgctgatgacctgatcaacaggtgtgcggggcaggcaagtcgggaaggccgcaggtgcagaggcggcggcagtgggggcggcggtgacggacggattcgatttcagtccaggggctcagattcccctgtcgggtgcggcggggcagacggcggcgaccttcgcgctggccgccgccgcctaccgggacgacgaagtggacaagatcaaggaagccgacaacgagtggcaccagtccacggtcaagccgccccggccg

SEQ ID NO: 1220 - DNA, 2694 bp, Unknown
  Kingdom: Bacteria, Phylum: Actinobacteria, Class: Actinobacteria, Order: Streptomycetales, Family: Streptomycetaceae, Genus: Streptomyces
ggacgaggtcgctgagcagccgcgccgcgcgctcgtggtgcgggccgccgggcagggacagctcccgccggtggccgcccgccgcgcggtcgagcgcggtggtgaaggcggtgacgagttccgcgggcgggtggaccttcacggtcagcagcggtgtcgcggacagctcgtccgggatcgtcgtgcgcggcggcgggccgagcgggtcggcgtcggccgggtcgaggtcggtgacgacgggctggagctgttcctggtgctgttcgtcgtccgggccgccggtcttgagcggtacgtcgggcagcagttgctcggagaccgcgatggccgcggtgaacgggatccgcaggggcgcagggccgcccagcggccgggcgggcgtcgcgggatggacgaggccgagggtgagcgcgtgcgggacggaggtcagctgggtgtacccggcgagtgtggcgtggatgacaccgaagagggcgaagtggtgggcgccgccctgggtggcgatcagctgttcacggctggcggtgccgccggagcgggtggtgcggacgccgccccggtcgtgccggtaggccagggacagcgacaggtcgtgggagccggccttgaacccgaggcgtccttccccgccgacgctgaaaccccgcgccaggtcctgcccgccgtcgtggcggacggtgccgggccggctgtggcgcagcatgtgctcgtggttggtgccgaggtactgcggaccggcggtcaggtcggcgtgcagggtgagcacgaacatcttctcgcgcagggcgccgcgtccgaacaacgggatgcgcagtccgcggttgtgcagctcgtccaggacggatgccagccggtcggggcgcagcgccctgatgatgttccgggtgttctcggcggcgcgttcgagggcgtgtccgggcttgtaccagggcgtcgtcgggttctgcgcgaggtgttcgcgcgagaggaccatgacgaacggggagagttccttggtgaccaggtcgaggacgtggtcggtgagggtatggaggccgtcctggccggttcctagggtgagggtctgcaccttggcgagggacaggtcgacgtgcttgtggtcgggtgagaggagcgggtcgagggcgggctcgttgcggccgatccgcaggccttcccgtctgtcgtagccgcggatcgcccacaggtcccggacgggacggcgcacgagtgcgaaggtgtgcacgtcgcgtgtgcggccgttcggaagttccacctggaaggtgaggtcctgtacgcccaggacggtgagggtgttcttggtgcggttgacgtgcttgctgccggacgtgccgcccaggttggtgaggtgggaggtggacttgtccaggccgccggtgacgccgagttgcccgtagaagagggggccgccggcgcgggctccgaggaagccgctcgcggcggcggtgttctgcgtggtcgcgccgatctcgttcttcatcgtgaactggtcggtgatgcggatctcgtgcgtggtggacacgccgaccaggtggaaggcgcccagcgtgccgcggccgacctggatgccgtgctgggggtcgagtccgccggtgagcagttcgcccgcgtgctcggtgaagtggcgtacggacagatggtcgaggacgctctggaagtcggggtgggccggtgtgagaccgaggttctgggcggcccagaggccgaggtcgcccagaccgccgaggccctccacgtggacgtcgcccagcggggcgtccggcagtggcgtgaaggagtgcggaaccctttgggccagggtgggttgctgctccgaggagtgcggggcgcggatcagcaggccgttctccacgccgaggcccaccgtgagcggctgctgcggggtgtggtccgggccgggcccgcctgcgggcggcgccggaggcttccccggcgccaggggttcgccgtgcacctccaccttgaagtggacgtggctgacgaagaagtacgcgtcgtccgcggagcgtgtctcgcgctggttgaggtactggtcggtggtggtgtgcttgcgtccgtcggtcgtgcggtaggtgccggtgacctgggcggcggggccgatcggggagcccgtgaggccgagcgggacggcggccgaacggttcgcgctctccgaggtggtgagtccgccggtgtgctgggtgcggtgcacggtgtcgaacttgtacggggactgcccgccgatgtcgggcaggagtttccagtggcccgcctccggcgacagggtcgcgctcaccgtcaccgcgcgcgacgcgcccgcaccactgaagtgggcgaccatcttcttcccctcgccgatgaagctctgcggctcggtgagcagggcttcggccagtcccggtatgtgggtgcccggcgtggacagaccggtctgccgggcgagttccgtgtccagggccgtgtggatcgcggcggcgatggttccgccggattcggggtcgacgaagcgcagccacacgtgtcccgcggtcgccccgccgccggtgagggcggcggacggaccgccggtggcggtgacggtcgtcgcggcaccggtgctggtgacgttcgtggtggtgttcgaggcgccggtgacggtgtccgtggtcggggtctggtacgcggacacgtcgtagagccaggcgggcggtttgggcgcgtccttctccggtgccg

SEQ ID NO: 1221 - DNA, 4062 bp, Unknown
  Kingdom: Bacteria, Phylum: Actinobacteria, Class: Actinobacteria, Order: Streptomycetales, Family: Streptomycetaceae, Genus: Streptomyces
ggcgccggcgccaagctcatcgacgtctaccgcgctctcgcggccaggggcgtgaccatacccgcgggctcctgcccgaccgtgggcgtctccggcctggtcctgggcggcggccacggcgtcgtctcccgcgcctacggcctgacctgcgacagcctgacccaggccaccctcgtcacggccgacggccgcctgctcaccgcgaacgccaccgagaacgccgacctgttctgggcgctgcgcggcgccggcaacggcaacttcggcgtcgtcaccgaactccgcttccgcacccgcccggcaccccaggcggtctcggcctacctgacctggccgtgggcccgggcggcggcggtgctgcgggcctggcaggagtggggtcccgaccagccggacgaaatctggtcctccctgcacctggagaacaccccgggcggcaccccccgtatctccgtggccgtcttctccctcggcacctacggcgagctgcagaacgcggtggcccggctggccgcgcaggccggcgcccgcgcgtcgagcgtctccctcaaacgccactcctacgaaggcgcgatggaggcgtacgcgggctgctcgtcgttcccggccgaaccccagtgccacctgccgggttccacacccggccgctccgcgcagggcacactcggccgcgagacctacgcggcccgctcggacttcttcgaccgctcgctctccccgtccggcgtccagacgctgctggcgcagatgcgggcggtgcgcggcggcgccggcagcatcgcgttcaccgcgctcggcggcgcgatcaaccgggtctccccgacggcgaccgccttcgtccaccgccgctcgcgcatgctcgcccagtacatcgcctcctggacccccggcaccccgggcacggcggcccagtcctggctcaccgcggcacacggcgcgctgcggccgtacgcgtccggagcggcgtaccagaactacacggacgccaccctcacggactggcgcacggcctactacggcgacgcggcgggccgcctggcgaaggtgaagcagcagtacgacccggaacggttcttctcgtccccgcagggcctgtgagcgcggggcccctgggccgagccgtctcccggtccccctcaggccgccaggtcacgctcctccgccgaggcccgctcctcgccccgcgcgtccgacagcacccggcgcacccgggcgtcccgccggtcacggaccagccagccgccccaccgcgtgccctcgaccgcccggagcacgggcgtgagcagcgcgctcgcgaccggcgacagcagcagcgcgaccgccgtgccgagcgcgaacccgccgaccacgtcggtcggatagtgcacgcccatgtacacccggcagaacccctccagcagcgccagcccgatccccgcgagaccgaaccgccggtcggccacgaacagcgccgccgccaccgccatggtgagcgtcgcgtggtcgctcacgaacgagaagtcggtcttgccctgcaccaggacgtccagaccctgatggtcgaggaagggccggcgccgctccacgaacccccggatcggcacgttcaccaggaccgcgagcccggccgccagcggcgcccacaccagcgcggccacggacgaggcggcgtcctccccgccccgccgccgcaccgaccaccagcaccacaccaccagcagcaccatggcgagcagcagcccgtactcaccgacgaactccatgagccggtcgaaccagtgcggtgcgtccttggccaggccgttgatgtcgtacagcagatcgacgtcggggttcgacccggattcggcgagtccagccatcgtgctgaggccccttcgtcgtgtccttccgggcgcaccctgcgtgccccgctcctgccacccccgtggtcgtaggtccgcttccgctgccggcacgcgtgtgcgacgcgcgctccgtccgacgtccgcttggctacgtcaacaggaacgcacggccccgtttcatacgttccacactccaccgaaagatcacgcagacgttaccgaagagagactcatcaccgcagctcagggggcaggttcacgctcggttcacgccttggcggggagcgctttcgcgccatcttcggtgacccgggtggcaccgaagtagtccgccgcgtcgatcgggtcgaaccggatcacggccccggtccgcggcgcgtcgatcatgtagccgccgccgacgtagatgcccacgtggtggatggcccgcgaattgccgggatcgtgggagaagaagaccaggtcgcccgggagcagttcgtcgcgctggggatgcggcccggcgttgtactggtcgttggcgacccgcggcagggtgatccccacgctccggtacgcggcctgcgtcagccccgagcagtcgaaccgtccgccctgctcggcggtgccctcgccgccccacagatacggcgtgccgagcttgctctgggcgtaggagatggcccccgccgcctgcttggacggatcgagccgggtgacgggggcggcgaagctctccgccagcgtcgtgatcgtcttcacgtagttctgcgtctcggcgtacggcggcacgcccccgtacctgatgaccgcgtccgcgcccgcgttgtaggcggcgagcatgttgtccgtggcgctgccgggcacgctgcgcacgtacttggcgagttcgcagtcgtaggacgcggccgacggaatcgcgtcgttcgggtcccagacgtcgcgcttgccgtcaccgttgccgtcgacaccgtgggtggcccaggtgccggggatgaactgcgctattccctcggccgccgccacgctccgcgcgttcgggttgaagccgctctcctggtacaactgggcagccagcagcgccgggttgatcgccgggcagaggttgccccacttctgcacgagcgtgctgtaggcggccggcacggcgcccttggccagcccgaccgcgcccctgccgacaccgcccgccaggttcccggcgacgaggtacacgccgacgacgagcagcgccacgaaggcgagagccgagccgacggcggcgatccccacgacccatgccctgcgcaccgtcaaccacccctcgccgcccggcagtccacctcggacagtttagagtcgcaccccgcgcttgcggagtgatcacacgcgccggaatcaggccgaaaacagaccgcgcccgcgccccgccacgacagccaccgctcccccttctccccccgctacctgggccgtcccagcggccacgggccgcggcgcagcgttcacggatccgcggcggcgtccttgtacaactcggcggcctcggcacggaaggtgacgctgtacgacgtgtccggcgtggacccgcccatctcgtgaccgccgagcaccccgacgatctcccgttccccgttgatccacgggctgccgctggtgccgctggtgaactcggggcagtcgatgcgctgctgcgtacggctgtgcgggctgggcctgttggtgcagctgatggaccgctcccgggagtcggggtacccggtgaccgtcacggcggtcgcgccggtcgccgcgcccgcgacgaagcggttggcgccgacgacgtcctcgatgttcttcccgccaccgccgcccgtgccgcccgtgccgtcgcgcggggcgaccacggcgaaggccaggtcgctgtcctcgtcctcgttcttggaccatccgtccggcaggaagcgcttcttgaccgtccacgtcccgtacggcgccttgccgtcccggtaccccggcacgaagacgtcgtcggcgtcgtcggccaggcagtgggccgcggtgaggatgaggttccgctgggggctgtgcaccaccgaggcggtgcagaagtgatggccgctgagactgtccgccttgtcggcaccgaacaacgcgccgacccgcgcgctcaacggggtcacggtggtgacagcggtcacccccagtggaccggggccgtcgtcggcggccgccacggaggcagaggtcacggcgatcagcatcaggccgacgaacagcgcctggtgccgggcgcggg

SEQ ID NO: 1222 - DNA, 1431 bp, Unknown
  Kingdom: Bacteria, Phylum: Actinobacteria, Class: Actinobacteria, Order: Streptomycetales, Family: Streptomycetaceae, Genus: Streptomyces
actggaacaggtcggcctgcccgccatcatcaagccggtgtggggagcatccagccgcaacacgagcgccgtgcacaccgcggccgaggcccacgcgttcgtcgcggacgtgctgtccggcgccgggcccggtccgcgcgagagcgccctgatcgtggaggagatgctgatcggccgccccacaccggccccttggggcgactacatggcggtcgactgcgccgtgcggcagggccgggccgaagcgctgttcaccagtagcaagttcacgctcgcggaaccatttcgcgagcgcggggccttcggcagccgcccggtcgaggacgccgcgctcgtcgccgaggtcgaggccctcgcctgccgcgcggtcgaggctgtcggtgtcacggtcggcatcgccgacgtcgaggtcaaactgaccgccgacggcccccgggtcatcgaggtgaacggccggctcggcgcctgggtcgacgacctcgccgtacggtccgagtgctcggtcccggcgcgggtggccgtccgggccgcgctcggcctgccgttcgaggggcgcaacgcgccgatgccggacagcccgatcgcgttccactacttgctcgtgccgcccgtcggcgtcacccgggtccgtgacatccacgccgtaccggccctgcgtcgcgtcccgcacgccgaccgggtcacggtgctgaccagcccgggcagccccgccggatgggagatcggggcagcggccaacgccgccgcgatctccgggacggtcgccacgcacacggagctcgccgacaccgtggccgccctggaggaggtgcgatggatcacctacgagtgagcacgccctggctgcgtccccttgtcacaccgtcgctgccgacgctccagctgatcctgctgccccacgcgggcgggagcgcgcacgtctacggcgactgggcgtcgttcctgcccggcgacgtcgcgctggcggccgtcgagtatcccggccacggcgcccgcctcaccgagcccgcgatcgatgatcccgccgtcatggtcgccgaggtgaccgacgtgctgagggaggtgcgggagcggctcgacggggggcccctgatcatcggcgggcacagcctgggcgcgttgctggcccacgaggttgccaccgtgctccaggcggccgaccggcccgtggacgggctgctgctgtcgggcgcgctgcccgcgcaccgggggaccatgatcgcggacctcagcaccctgacggacgacgcgctggccgtcgcgctcggcgccgacggcgacatccccgccgagatcctggaggacgccgaggcccgcgccttctacctgccgctggtgcggcaggggctcgtcttcgcccgcgaactgtgccgggccgtcgcgaaggacccgtcggggcgggagccggtgcacgccccgaccgtcgtcatc

SEQ ID NO: 1223 - DNA, 1870 bp, Unknown
  Kingdom: Bacteria, Phylum: Actinobacteria, Class: Actinobacteria, Order: Streptomycetales, Family: Streptomycetaceae, Genus: Streptomyces
tgccgctcaccgaggcccgcgaccacttcgaggcgcagggcgcgcgggacggcatcgtggagaccagcgggcagctgcggaccatcgccgtcggcctgacgaagatcgccaacgatctgcgctggatgtcctccgggccgcgcaccggcctcgccgagatctccctgcccgacctccagcccggttcctcgatcatgcccggcaaggtcaacccggtcgttcccgaggccgtcctgatggtcgccgcgcaggtcgtcggcaacgacgccaccgtcgccaccgccggcgccgcgggcaacttcgagctgaacgtcatgctgccggtcatcgccaagaacgtcctggagtcggtgcggctgctggccaacgtctcccggctgctcgccgaccgcaccgtcgacggcatcaccgcccaccgggagcgggcccgcgagtacgccgagtcctcgccctccgtcgtcaccccgctgaacaagtacatcgggtacgaggaggccgcgaaggtcgccaagaaggcgctcgccgagcagaagacgatccggcaggtcgtggtggagagcgggtacgtggagcgcggcgacctgacggccgaccagttggacgaggcgctggacgtcctgcggatgacgcgcccgtgacgacaggcgcgtgcgcacgggtgtgaaccgtgacgccgaccaccccgtcccatggccatgacacctaatatctgtgcatggcagacgacggagcggtgagagacgtgaaggcggacggcgcgacggcccattgggctcccgggagtcagatcctgtggcgctaccgggcgaacggcgggccgggcttccacatcgcgcggcccgtgaccgtcgtgcgcgacgacgccgaactgctcgcggtgtggatggcgcccggcaccgagtgcgtcaggcccgtcctcgccgacgggacgcccgtgcacctggaaccgctggcgtcccgctacaccaagccccgggcggtgcagcgggaccgctggttcggcacgggcgtgctgaagctggcccggcccggtgagccctggtcggtgtggctgttctgggagccgggctggcggttcaagaactggtacgtgaacctcgaggagccgctggcccgttgggcgggcggcgtcgactccgaggaccacttcctggacatcaccgtgcagccggaccgcagctgggactggcgcgacgaggacgagttcgcccaggcgcagcgggacggtctgatggacgacgcgctggccgggcgggtgcgggcggcgggccgttcggcggtggaggtgatccgcgcctgggggcggccgttctgcgacgactggcagcactggcgcccggatccgtcctgggcggtaccgtcactgccacgggactgggaccgtacgcccgcgcatgtgtcctcatgagacccttgatgcgcccccggacaggaaccgtaggatcgtcctccgcaagggcgcagggaggcacgtgaccggcgcaacttccgcggccggtagagagtctgaccgtatgtcaccgaggggcggcaggacgtgagcgaggggtacgagggcaggacccgagcggggcgcatacggcccgccggtggcacaggaacagcctctgaccacgccggaaatccgttcctggggcaggtattccgggtatcgggtcttcggcgggacgaaccgcgcgcccgtcgcgcggccccggacggatggatgcgacacgcgtgacggagcagccgacctccttcgaacgcccccagccgggcgccgaccccacggactcccgtggggcccttctgcgtaccccgcagccgccccaggcggccttaccgctgcagtcgcgcacggagggcgcgactccgtgcgcgactgcagcgg

SEQ ID NO: 1224 - DNA, 1743 bp, Unknown
  Kingdom: Bacteria, Phylum: Actinobacteria, Class: Actinobacteria, Order: Streptomycetales, Family: Streptomycetaceae, Genus: Streptomyces
gcagcttccccgcagccaccctggggagcgggtggctgcggggaagctgcgggagtctccaccggcacgggaggtgcggacggggccgggggtacctcggtgccctcgttctcggtgctcacagctcttctcctcggtccacggctgttgttgtcggtcgcactcggtcacactcgtcctggccgccgacgaccggcgtgctccagctgtgcacgtgcatctgtatgtcgtcagcttttcccacgagccgtcagagcaccataagccgtggctgtgggtcggacgccatctcttacatgggtcatctcgccttaaacggacacattatcgacacccgtccgtcgccacgccaccccccggcggtggcaccatgacgcggtgacccacgcacggcagcatcacatccaggtcgtcgcacaccgcggagcgtccgaggccgctccggagcacaccctggccgcctaccggacggcgatcgaggacggcgcggacgccctcgagtgcgacgtacggctgaccgcggacggtcacctggtgtgcgtgcacgaccgccgcgtcaaccgtacgtccaacggccgcggtgcggtgtccgccctggaactcgccgatctcgccgcgctggacttcggttccggacggtcccgcgcctcctggcggggccgtgacgaggaacccgactgggtcgtacggcccgaggaccccgaggacaccgccgtcctcactctggagcggctgctggaactcgtcgccgacgcgggccggcgggtggagctggccatcgagacgaagcatcccacccgatgggccgggcaggtcgaggagcggctgctggccctgctgaagcggttcggcctggacgcccccgcctcccccgccgagtcgccggtgcgcgtgatgagcttctcggcgcgctccctgcaccgggtgcgggcggcctccccgatgctgccgacggtctacctgatgcagttcgtctccccccggctgcgggacgggcggcttccggcgggcgtccggatcgcgggcccgtcgatccgcatcgtgcgcagtcatccggcctacgtggagcggctgaaaagagtcggtcaccaggtgcacgtgtggacggtgaacgaacccgaggacgtcgccctctgcgtcgatctgggtgtcgacgccatcatcaccaaccgtccgggcgcggtcctgcgccagctcggtcgctgaccgccgctcgcctgcccgcgcggggcgggcggccacggtcccgcacctcgccttcattcccgcgcgggcaggcgaccgcggttccgcacctcgccttcacatcccacgcggacctgcgagatcccgccacgcggtgacagggagtgctccggcgcgttcggtgggtgttcgagcgttgcgaatgcgtcgccgggcggcgcatggccggtttccggttcaggccaatggggcatccacaccgtggcgtggggcgaaggaggtctcgggggtggcgttggtggtggcacaggaggtgcccacgtcgtcgagcatggccgtaccccatggccctgcgggcgtgggggaagcaaggcaccggatgcgcgcacagctgcgcggaggtggcgtggcggaatcggtcatcgacgatgccgtattgatcctgtccgaacttttgagcaatgcctgcaaacacgggaggccactggacggcgccctgaccggcgacggtgacgtccgggccgcctggcgcgtcgacgccggtcagggcgccgtcca

SEQ ID NO: 1225 - DNA, 1345 bp, Unknown
  Kingdom: Bacteria, Phylum: Actinobacteria, Class: Actinobacteria, Order: Streptomycetales, Family: Streptomycetaceae, Genus: Streptomyces
ccctgcccgccctcctcgccgaactcgaccgccgcggtctgcacgcggtcaccaccacggagctgctgagctgatgcgtcccagtcctacgtccgcctcctgcgtcccacctgtctcacgggtctcgtccgtctcccgcctcacccggctcctcgccgccggtgccgcctgcgccgcgctggccgccctgtccgcgtgcagcagcgggggctccgcgcagcaccacaccgacgaagccctcggcagcaaggcgccggcgcagccgcagcagccccggcagcaggcttccgacgccctgcccggcatgccgcccgtgctcgacccgaaggacgtctacgccgccgaccgtccgggccggctctccgagaccgtcaaggacttcccgtcccgggtctacgtccccaacaccctctccaacacggtcacggtcatcgacccgcggacgtacaaggtgatggagaccatcccggtcggccgccagccccagcacgtcgtgccgtcctgggacctgaagacgctgtgggtcaacaacgacctcggcaactcgctgacccccatcgacccgaagaccggcaaggcgggcaaggcggtcgacgtgcacgacccgtacaacctgtacttcacgccggacggcaagtacgccatcgtgatggcctccaaggaccgccagctcgtcttccgcgacgcgcacaccatggagcgggtgaagaccgtcccggtcacctgcggcggggtcaaccacgcggacttctccgtcaacggccgctacttcatcgtctcctgcgagttcagcggcgaactcctcaaggtcgacaccgcggccatgaaggtcgtcgggcagcagaagctggccttccgcggcgccatgccgcaggacgtgaagatgtcaccggacggaagcaggttctacatcgccgacatggtggcgaacgggctgtggatcctggacggcgacaccttcggcaaaccggagttcctgtacaccggcaagggcgcgcacggcctctacgtcagccgcgactcgcgcgagatgtacatctccaaccgcggcgagggcaccatctcggtctacgacttcgcccagcacaagctgaccaagaagtggcgcctgccgcacggcggcagccccgacatgggcggcgtctccgccgacggcacggtgctgtggctgtcgggacgctacaactccgaggtgtacgccatcgacacccgcaccggcaagcagctcgcccgcatcaaggtcggcagcggcccgcacggactcgccgtctacccgcagccgggccgctactcgctcggccacaccggcgtcttccgctgaccggggccgtccccggtcagcgga

SEQ ID NO: 1226 - DNA, 2368 bp, Unknown
  Kingdom: Bacteria, Phylum: Actinobacteria, Class: Actinobacteria, Order: Streptomycetales, Family: Streptomycetaceae, Genus: Streptomyces
agcaggtcgagggcggcgggcggggccgtggcccggcggagcacggggtgcacgtcgctcgccgggccggtcagtgagggggcagggccggtggcgcggcgccgacgggcggcggctgcggacgagttggccatgacgaacctcctgtcgtctgggtgacggcacgggtgccgtatgtgcccatcgtgcggtatgccactgacaatccgttctgacctggtcttttgcttcgctcgtacattcggttccgcgggaggcgcagcaccgtccccctgcgcccgcgccgcgcgcgcaccgccgcccgcggcaccgtccccgttcgccacggccggtggcgccgctcggcggccggaccgctcctgtgacaatcagggccatggaaagcagcagcgccacgtcgggcggccgtacccgccgcgaggccacccggcagaagctctacgaggcggccgtcacgctcatcgccgaacagggcttctccgcgaccacggtggacgagatcgccgagcgggcgggggtcgccaagggcacggtctactacaacttcgccagcaagtccgtcctcttcgaggagctgctgcggcacggcgtggggctgctcaccgcgtccctgcgggaggcggccgaggcggcggcgcgggagggcggcggccgggtcgacgccctggacgccatgatccgggccgggctggtgttcatcgaccgctatcccgccttcacccagctgtacgtggcggaactgtggcgcacgaaccgggcttggcagtccacgctcatggtggtccggcagcaggcggtggcggtcgtcgagggcgtactgcgcgacggcgtggcgagcggcgagttcagcgaggagatcgatgtgccgctgaccgccgccgcgctggtcggcatggtgctggtggcggccctggactggaaggcgttccagccggaacgctccctggacgacgtccacgccgcgctgtccaggctcctgcagggcagggtgagcggcccctgctgaggcccgcacgcgcgagcggcgcaaacgggggaagcggcgaaagcgccggtgcgtggtgaccacgtcccccgtgggccaccccgcaccggcgcttccccgtactcccccgttgtcccccgtcggaccccgttcggtcggttccgggctcccccgtgcctcgctcccgccgacgtgcgccggcggaaggagcggtccagggcggcgccgttccgccgccccgtgtcggcggtaccggcgccgtgccccttcccgtgcctccactctctcgtccgcgcaggtcggggcccatccgcgtacgtactcatctcggcgtctaggtacaggtactcagccctgcgcacagttccctgggccctgcccgccaccatctgcgagacgaccggaaagccgctggtcacagcccccagggccgggattgtcagtggtggtcgctaaagtcgcgggcatggcagggattgcggtgatcggcgccgggacgggcgcgctggcggcggctgcccggctggccgtcgcgggccaccgggtgacggtgtacgagcggacggagacgtacggcggagcggtgcgccgcttcgagcgcgacggtttcgccttcgacaccggccccggtctgctgccgctgcccgccgtctaccgcgacctgttcgtgaagaccggcaaggagcccctggaggacctggtcgagttggtccaggtcgatcccgcggcccggcacgtcttcgcggacggcaccgaggtctccctgccgaacgcgtcccgcgcgggtgtcgtcactgccctggacgaggcgctgggtgcgggcgccggacagcgctggggcgacttcctggtgcgggcacgcgaggcgtgggaccgcacccgccgtccgctcctggaagagccgctgtggcccaactggcaagtgctggccgaacgtgagccctatccggcggtcccgcacaagcgtctgctgcgcacccggcgggccactacgctcgccgaggtcggcgcctgggagctgcgcgatccgcgtctcgccgcgctgctggagagccacgcgctcgcgtacggcctcgatccgcggaccgctccggcgagcgccgccgtgctgccgtacatggagcacgccttcggcatctggtacgtccgcggcggtctgcgcgaactggcgcgggcggtgtacgagcggtgtgtggcgcgccgggtcgagttcgtcttcggcaccgaggtcaccgggatcgtcgagaaggaagggcgcgtggcgggcgtggagttcgccgagggtggcgtggcggacgcggagtacgtggtcgccggtgtggcgcccgggacgctgcgcggcctcaccgccgggacggcgccgcggggcgcggcggcggtgcc

SEQ ID NO: 1227 - DNA, 5157 bp, Unknown
  Kingdom: Bacteria, Phylum: Actinobacteria, Class: Actinobacteria, Order: Streptomycetales, Family: Streptomycetaceae, Genus: Streptomyces
cgaccggccatcaccggcgcgtagaaccgggagaccgcgccggagcgctccagcagccggaacgcggtgtcccgcacccggaccgccgcggggtgcccgaccatccaggcccgggtctgcaggtccgtgtcccggacgatccgtccggtcgcctccatgcgttcgggtccgtagcccagcagcagcgaggccggggagcgcccgtggacgacggcggcgagcttccagcccaggttgtgggcgtcctggaggccgttgttcatgccctggccgccggccgggctgtgcacatgggcggcgtcgcccatgaggaagacgcgtcctcgctggaactcggtggcacgccgggcgtggacgcggaacaccgtctgccacaccggctgcgtgatccgcaccccgcgcgggccgcgttcgtccacgatcccctgcatcgtcggcacgtcgatcccgtcgcggccgccgggcaggacggccagcagccggaacaccccgccgggcatcggcacgatcaccaacgtccccgccggcgactggtagtaccggatctcgtccgccgggagcgcgccgtcgacgtgcgtgtcgatcagcgcgaacgccatttcgtacgtcgatccctcgaacccggtgccgagttggccgcgtacggcgctgcgcgccccgtccgcgccgatcacgaacggcgtgcgcacgcgctccaccccgccgtcggcgtgctccaggaccgaggtgaccccgtccgtcgcctcgatcggaccggcgaggtcggcttcgtcgaaaccgaggagccggacgccccgttcgacctttccgcccagggcgtgcaggcgttcggtgagcagtcgttccgtctcgtgctggggcagcgtgcgtgaggccagatcctcggcgaagccgaaggaggccaccggacggccgtcggagaagtagctgaacgcgtcgatccgttgcgaggcgtcgcggatcccgtccaggatgcccacgtcctcgaggatgtcgagggcacgcggccacagggacaaggccttgggggcgtgcaccggctgcggggagcggtcgacgacacgcacgcgcacgcctcgcctgagcagttcgcaggcggccagcagcccggtcggtccggcgccgacgacgagcacgtcgacgtcccggccggccccgccggcgcggtcagcagccccctgcgccctgtttgtcctgctgttccgttcgtccgtcacgacgtccgctccctgtgctcgcgcaggcgctgcgccagctcgatgcgcctgatcttcatggtggccgtgcggggcagttccgccagcggcagctggaccgggtcggccatcggctccaggccggccacggcctcggaccagcgcgcggcgtccaggggccggtcgtccctggtgcacacgacgggcaccggctcctgccgcgggcccggcaccagcacgagttcggccagttccgccaggcggcccaggaccacgtcctcgaccgcgagggtgctgtggatgccgctgatgacgtcgacctcccggtccagcaggtgcaggcacccccacttcgtgcggtagccgacgtcgccgccgcgccaccacttgccgtggacctgctgctcgaagcgttccttctcgccgaagtacgtcaacgcccgccctggcgtgctgacttcgatgtacccgggtgtctcccgggaaggccgggcgccgtcgcgggggacgagacggaaacgggtgacccccggcatggcgtaccccaggcagcggccgtcggccttgtgcgcgcccttgcgggtgtatccgcggcccacgagcggtccgcactcgctctggccgtagatctggaagaagaccggagagcggcgttcggaggcccgcagcagccggtccatggtgcccgggtggatggcgtcgaaggtgctgctgaagcagcggaccgacgagaacggcctgcgcgggtcgtcggcgagcggctcccactccatgaacgagttcggatgggtctcgatgaagccgggccgggtggcggcgaacagctccgcgaccgcctccggctccgaccggtccatgaccaccagcggcatcgcgcgcggcagcagcacggcgagcgccaggtacatccgggagtgcacgaaggagacatggacagcggcggtctcccgggaccccacgagcgaggccagccggtgctgcggccggtaccgtccgtgcagggtgcgcgccgagtgcacgaccagtttcggcaggcccgtcgtgccggaggtgtgcgtcatcagggccggctggtcggggtgcagcagcaccggccggcgccggggcgaaccggcaagctccgccagcgacacggccccgggcgcactgcccgccgtgaggaagaggcggtcggtgaggccggccggatgcgcggcggacaacggcccgccgagcttggccgcatcggtcaccaggtggggacgtttcagccgctcgatgagcgtgacgacgctgtcgccgtccagcgcgggggagagcatgaccggtacggcgccgatccgcgcggtcgcggtggccagtacgtagatgtcgaagttcgaggtcttgtggatcaccacgggctcgctcgggcggaccccgcccgcccacagccgggccgccacgtcgtccacccggtcggccagctcggcgacggtcaactgccgtccgctgccggggaacaggtccatttcgtggtcgagggtgatcggtgtgccgccgttccgcgcggcggccaactggggaaccagtccgagatggagaccgccacgacgggcggagctgcgagacatcagttacttcctcggctctcgtcaggaaaggcggacccgcgcacccagcacgtcggacatcagccggccgacgatgcgcgtcccgtcctcggtgagcagcgactcggcgtggaactgcatcgaggcgaaatgagggccccgcagcgcgtgcacctcaccgctcccggactcccggctcacctccaccacaccgacgtccgggcagtccacccggtcgccgtcgcagatcgcggcgaaggtgttgtagaagccgacccgctcccgggaaccgaacaggtcgatctcacgctgcaccccctggttcgggaccttgcgccgggtcagggcgaagcccagctccgcgctgagcacctggtggctcaggcacacggcgaggaacggccgccgctcgcgcagcagcgtgcgcaccgcggagcgcatgtggccgatccggggatcgtccgtctcccacggcgagcccggaccgggccccagcaccacgaggtcgtgatcctccaccgcgtagggctcgtcgaagcggcgcaccgtcacggacaggtccagcgcccgcagttggtgggcgatcatcgcggtgaaggtgtcctcggcgtcgacgaccagcacccggcgcccggccagttccggatccggccgcgccgctccctcccgccccgccagccagaacccggccagtgtctcgttgcgccgctccagtgcggcccgcacgcgcgggtgctgcgcgaaccgccgtggctcgtcggcctccagcgcggccagcagcccggccgccttggcccgtgtctcggccacctcggaggccgggtcggagtgccgtacgagggtggctccgacgccgatgcgcacacggccgccgggatcgatgtcggcggtgcggatgaggatggaggagtccagcgtgcggcggccgtgcgcatcgcgcccgatcagcgccacggccccgctgtagtagccgcggccgtgcggctcgtaccggcggatgacacggcaggcactctccagcgggctgccggtgaccgtcggcgcgaacatcgtctcgtgcagcacgcgccgcgggtcgcggtcgctgcggccctcgatgacgtactcggtgtgggcgaggcgggccatctccttgaggtgggggcccagcacgcgtccgcccgtgtcgcagatccgggccatcatcttcagctcctcgtcgacgaccatgtacagctcgtcggcctccttggtgtcggcgaggaactccagcacctcgggcagggtcgggccggacggcggatagcggtaggtgccgctgaccgggttcatcacggcgacgccgtcgcgcaggctgatgtgccgttccggcgtggccccgacgaacgtgcgcgtccccgtgtggacgacgaacgtccagtacgtccccgactcccgctccagcagccgccggaagaacgccaaagcgctgccggccgtgtagccggcgatgtcggcgacgtacgagcgcttgatgacgaagttcgccccggcaccctggccgatctcgtcggccagcaccgtgcgcacggtgtccgcgtacgtctcgtcgtccatgtcgaagtgcccgccggtcagcttgatcggcacatcgggcacccgggccagcacctccgtgaccggcagttcggcctgcgcggtgacggtcatcgcgatcagcggtgcgccgtcgtcggcacagtcgaagccgcgttccgagatctgccggtacggcacgacggtcagcacctcgtgccgcgcacccggtcccccgggagccgtgtccggcagcggtatcccggccagcgtggcggggtgggacacgtcgcccacgaggacctccaccactcccggtccggtggactccgggcggtgcagcagcgcgaaggcgggcgggctcggcgccagcacccggtcgagcaggtcctgctcctgcggtgccgcaccggagcgcgggtcctgtccggccggcttcacgcgaagacctcctcggtggtcacggtcatcgcgcagcgctccgccgcgtactcgagggctctgcggtggtgggccgccgagaagtccgcgacggcgtcggcgaccaggaaggtccggatgtcgttgctgaacgcctccaccgcggtcatgaggacgccgacatgggcgtacacaccgcacaggacgagctggtcgcgcccggcggcgcgcatccgctccagcagatcggagcggaagaaggcgctgtaacgccacttggtgaggacccagtcccgctcggccggcgccagggcgtcgacgatccggcggtcggcgggcgccgccgtcatcccgggcccccagaagtcccgcagcagcccccgctgcgcttcggacatgtcgcccggctgcgcggtgtacgcgaccgggacgccgag

SEQ ID NO: 1228 - DNA, 4667 bp, Unknown
  Kingdom: Bacteria, Phylum: Actinobacteria, Class: Actinobacteria, Order: Streptomycetales, Family: Streptomycetaceae, Genus: Streptomyces
ccctacgaccccagccccttcgcccgcgaacgccacgtctggctgggcctgcacgcggcggcgacgcggagcctggcgcaggggtcgatgatcgtcttcagctgaccgggagcgcgggaaacgcggacggccgggaagccgggcgactgggaagccggacggccggcacggtgggtcaccgtgccggccgtcgtgtcgtgactccggggcttccggctcagatgaacgagttgatctcgatcgtctcgtcccggcccgggccgacgccgatcgcggagatcggggcgccggacatctcctccagggccttgacgtaggcctgggcgttcttcggcaggtcggcgaaggtcttcgccttggtgatgtcctcctgccagccggggaggtactcgtacaccggcttcgcgtggtggaagtcggtctgggagtacggcagctcctcgacgcgcttgccgtcgatctcgtaggcgacgcagaccgggatgcgctcccagccggtgaggacgtcgagcttggtgaggaagaagtcggtgaggccgttgacgcgggtggcgtagcgggcgatcaccgcgtcgaaccagccgcagcggcggtcacggccggtggtgacgccgcgttcgccgccgatgcggcgcagcgcctcgccgtcctcgtcaagcagctcggtcgggaacgggccggagccgacgcgggtcgtgtaggccttgaggatgccgatgacccggctgatcttcgtcggcccgacaccggcgccggtgcaggcaccgccggcggtggggttggacgaggtgacgaaggggtacgtgccgtggtcgatgtccagcagcgtgccctggccgccctcgaacagcacgaccttgtcctgctccagcgcctggttgaggaccaggaccgtgtcggcgacgtacggcttgatctgctcggcgtagcccagcagctcctcgaccacctggtccacggcgatcgcgcgccggttgtacagcttggtgaggatctggttcttgacgtcgagggccgcctcgaccttctgcgtcaggatcgactggtcgtacaggtcctggacgcggatgccgacgcggttgatcttgtcggcgtaggtcgggccgatgccgcggccggtggtgccgatcttgcgcttgccgaggaagcgttccgtcaccttgtcgacggtcacgttgaacggcgtgatgatgtgcgcgtttccgctgatcaggagcttcgacgtgtcgacgccgcgctcgttcagaccgctcagctcggagagcaggaccgacgggtcgacgacgacgccgtttccgatgaccggcgtacagccgggcgacaggattccggaagggaggaggtgcagtgcatacttctggtcgccgacgacgaccgtgtggccggcattgttgccgccctggtaacgcaccacatagtccacggagccaccgagcaggtcggtggcctttcccttgccttcgtcaccccactgagcaccgagcagcacaagtgcgggcacgcgcgtacaccccttccgggcggggcatgtccaaggtcaggggcgtacgcgggttcaccgccgcgtgcaccgtgcgaccctcgtcggccgcacaaccgtcggaccggatgccccggaatagacgaagcccctggcgcaatagcgcaaggggctcttgcacaaagatgctacccgaggaagcgaggcaggaccgaggtggcgacctatccgacgtccgatccgctgctggtggtcatcgacccggtcgcccggcggaccgacggggagtccgtacggatcgcgaaagacgtgctcagcgcgggtgcggccacgaaggtgtgcctgccggacggaccggaggagttcgcccgcgcgctggcgcggcgcggctccaggcggccggtggtgatcggtgacgaccgtgcgttgctgcgggcggtgacggtgttgcaccagcggcgggagctggctggatctgtactgtccgtcgtgccggtcgggagtgtcatgcacctggcccgttcgctgggcgtgccgacggggccggtggcggcggcgcgagcggtgctcgacggcgccgtacgccgcctcgacctgctcgccgacgacagcgacggggtggtgctgggcgccctgcacatcccgcccgtcgacctacgggagactccggcggacgcgacggcactcgccgaggacaccggggcgggcgcgggccgtgactggctgcggacctgccagtcgctcgtacggacgctggtgacccgcccgccccggacggcggccgacaccgcgcccgcgccgtcccggctgcgcgtggaggtcgacggggtggccgtggtggacctggaccagccggtggaggcggtctcggtcgtccccggcgcccgcggcctcgccgaggtcgaggtccggcccctgtcgggccccggcgcgcagacctcaccgctgctcgccgaggggcgcacggtcactgtctcgggggcgcacttccgctaccgcgcggacgcggtggtctccggcccggtgcggacccggacgtggacggtacgggagggggcctgggggctggtggtgccggctcgggcctgagtctgcggcggcctggtactcgtctcccgccggagagccgcgcccgggatcacccgaacagttgttcccggtgggtgcgccagcgggtcatcattgcggcgatctcgccgtcgatgaactcgaagaaggcgagggtctcggccagtcggcggccggcgggagtgccgggacccaggctgtcgacgccctcgcgcagcgcgtgctcccagcgtttgatgaccgcctcgcgactggtgagcgcctcgtaccactggtcggcgtggacgcggtagcgctcgcggcgcgaaccgggctcgcgttcgcgcgagaccatgtgcacctgcgacagatagcgcaccgccccggagacggcggccgggctgatccgcagccgctcgcccagctcggcggaggtgagggtgccgctgtcggaggccagcagggcgacgaagacgcgggccggcatccggggcagccccgcctcgaccagctgcgccgcgaagctctccacgaacttcgagaccgcctcggagtcacggtccgtcaccggcgttccgtccgtcatgtccgcaccatcttccctgactcccccgaccggtccctgcaccacagccgctccaagtttatacgcttccttaacttcacaaatttctgaaagaagcgtacgttccgaagcatgacgaaagcccacggtgcgcaccgcccggcggccggccccgccgtcgaggtgtccgcactgcacaagacgttcggccggacccccgccctgaacggcctcgacctgaccgtggccgcaggtgaggtgcacggcttcctcgggcccaacggcgccggcaagtccaccgccatccgcgtcctgctcggcctgctgcgggcggacgcgggcaccgcgcgcgtcctgggccgcgacccgtgggccgacgcggtcgaggcgcaccgccggatcgcgtacgtccccggggacgtgaccctgtggcgcaacctctccggcggcgaggtcatcgacctgtacggcaggctgcgcggaggcctcgacgcgcggcgccgcgccgaactcgtcgagcgcttcgaactggaccccacgaaaaagggccgcacctactccaagggaaaccgccagaaggtcgccctcgtcgccgccttcgcctccgacgccgacctgctgatccttgacgagccgacctccggcctcgacccgctgatggaggaggtcttccagcgctgcgtcgccgaggaacgcgaccggggccgcacggtcctgctctcctcccacattctcagcgaggtcgaacagctgtgtgaccgggtgagcatcatccgggccggccgtacggtcgagagcggctcgctcgccgacctgcgccacctgacccgcaccaccgtctccgccgaactcgccggcccgccgaacggcctggcccacctgcccggcgtccacgacctcgacgtccacgacctcggcgcccagggcagccgggtccgcctccaggtggacaccgacaagctgaacgcggtgctgcgctcactgagcgagtcgggcgtccggtcgctgacgtcgacgccgccgaccctggaggagctgttcctgcggcactacgccaccgagcctgccgaggccgcacgatgagcgccccggccggcacacgacggacagacacccgacgggcgggcgtgccgggcggcgtgcgcgccgtgcgcgcgggtggctcccgctcactgaccggcaccgcacctctgctgcggctggcactgcgccgcgaccgcgtgctgatccccgtctggaccgccgtgaacgcgctgatggtcctctccatgccgcacaccctcaagagcctgtacgccacccccgccgaccgggccggtctggtccggcagatggccacgaacagctcgctgcacgctctggtcggacccgtgttcgacgattcgctgggcgcgctgacggcctggcgggtcggcgtgtacgccggggttctggccgccgtcaccagcctgctcgtcgtcgtccggcacacccgggacgaggaggagagcggacggcaggaactggtgtcgtccggcatggtcggccgccgcgcgccgctcaccgccgcgctgctgacggccgccgtcgcgaacg

SEQ ID NO: 1229 - DNA, 5016 bp, Unknown
  Kingdom: Bacteria, Phylum: Actinobacteria, Class: Actinobacteria, Order: Streptomycetales, Family: Streptomycetaceae, Genus: Streptomyces
ggcggcagcggcagcggcagccccggcagcccgtccaggctcgtcgcgatgtgctccttcttggtgaagtactcgctcagcgacgcgtcgtcctcgcgggcgaagcgcctgccgtgcaggtcgcggtcctcgtcgtacgtcatgaagggcaccgcgtagccgcaggtgtcccggatcagcgaggcgtgcacgacgacgaccgcgcgcagcccgtgcgacgacgcctcgatgtcggggaaacgggcgagcagctccgggaaccgcgggtcgtcacggaagaccggctcgccccggccgtgcacccggacgatgttgggcgggccctggaaggcgcaccacatcagggtgatgcggccgttctcccgcaggtgcgcgatggtctccgcgttggatccggcgaagtccaggtaggccacggtgtgctcgtcgagcaccgccaggcagcccttgaggcccttgggggagaggttgaccgtgccgtcgccggccagcggcgcggtcgcggtgaagaagaggggctgttcctcgatgaacgtgcggagcctgccgtctatgcgctcatacgtctttcccatgaccagcgattatccgcgcaactcattcgtctgtctaaggaattgcggccccggcgtgccgcgcccgcccgcggcacgcgcaccgcatacacccgcaccacgcgcaccgcacacacccgcaccactcgcaccgcgcacgcccgcaccacgagcaccgcgcccacccgcaccgcacccgcccccgattgacgatccatgcagagttctgcatactcatgcatgccagctcgccgcgcggcgcgatccgcggccacggcacggcaacggacccggcgcggacccggcacgagtacggttcgtacacccacacctccctaggagcagagcgagtgagcagcaacagcggtgacgtacggctctggggcggccgtttcgccgacggacccgccgaggccctggcgaaactgtccgcgtccgtccacttcgactggcggctcgcgccctacgacatcgccggatcgcgtgcccacgcgcgcgtgctgcacacggccggcctgctcaccgaggacgagctgacccgcatgctcgccggtctcgataggctcgaagccgacgtggcggacggctccttcaccggcaccatcgccgacgaggacgtccacaccgccctggaacgcggactgctggagcgcgtcggtgccgacctgggcggcaagctgcgcgccggccggtcccgcaacgaccaggtcgccaccctcttccgcatgtacctgcgcgaccacgcccggaccatcggcgcgctgatcgccgacctccaggacgcgctggtctccctcgccgaggcacacccggacgtggcgatgcccggccgcacgcacctccagcacgcccagccggtgctcttcgcccaccacgtcctcgcgcacgcgcagtcgctgtcccgggacgccgagcggctgcgccagtgggacgagcggaccgccgtgtctccctacggctcgggcgccctcgcgggctcctccctcggcctcgacccggaggcggtcgcccgcgacctgggcttcgagcacggcagcgtcggcaactccatcgacggcaccgcctcgcgcgacttcgtcgccgagttcctcttcatcaccgcgatgatcggcgtcaacctctcgcgcatcgccgaggaggtcatcatctggaacacgaaggagttctccttcgtgaccctgcacgacgccttctccaccggctcgtcgatcatgccgcagaagaagaacccggacatcgccgagctggcgcgcggcaagtcgggccgcctcatcggcaacctgacgggactgatggccacgctgaaggccctgccgctggcgtacaaccgcgacctgcaggaggacaaggagccggtcttcgactcctgcgaccagctggaactcctgctgcccgccttcaccggcatgatggcgaccctcaccgtccaccgcgagcgcatggaggaactggcgccggccggcttctccctggccaccgacgtcgccgagtggctggtcaagcagggcgtgccgttccgggtggcgcacgaggtcgccggcgagtgcgtcaaggccgccgaggccgagggcaaggagctggacgagctgaccgacgagcagttcgcgaagatctccgcccacctgacgcccgaggtgcgcacggtgctcaacgtgcccggcgccctcgcctcccgcagcggtcgcggcggcaccgccccgagcgcggtcgccgtccagctcgccgaggtcaaggccgacctggccgcccagcacgcgtgggcgaacgccaggaagtagcgggtgagtgacgcgtggggcgtcgcgggtacgttggtcgcagcacggagccgaccggaacggagcccgcgatgcctttcacgctccgccaagctctcggctccgctcgagcagggagatacccccatggccgcagccaccatccccacctgtcacctcggcctcggtctcgccgccgtcgggcgccccgggtacatcaacctcggccgtgaccgcgacctcggcgccgaccgctccgtcgacgccctgcgcgcccgtacgcacgaactcctggacgccgcctacgcccagggcgtgcgctacttcgacgtggcccgctcctacggccgctccgaggagttcctcgccggctggctgcgcgaccgccccgagatcgacgacgtcgtgatcggcagcaaatggggctacacctacacggccgactggcgcaccgacgccgagcaccacgaggtcaaggaccacggcctcgccacctacgagcggcagcgcgccgagagcgccggactcctcggcgaccggctcgacctctaccagatccactcggtgaccccggacagcccggccctgaccgacaaggaactgcacgcccgcctcgccgaggccgccgcgtccggcctgactatcggcttctccaccagcggccccgcccaggccgacgcgatccgggccgccctcgccgtgaccgtcgacggcgagccgctcttccgtacggtccagtcgacgtacaacgccctggagacctccgccggacccgccctcgccgaggcccatgacgccgggctcaccgtgatcgtcaaggagggcatggccaacgggcggctcgccggtccgcaggcgcccgagcccctgcgggaggtggcccggcagaccggctacggctgcgacgccgtcgccctcgccctcgtcctgcgccggccgtgggcgggcgtcgtgctctccggcgcggccaccctcgaccagctcgtctccaacctgcacgccccggccgtggacctggacgaggaacagacggcacgcctcgacgccctggccgaggatccgcgcgcgtactgggagcggcgcgggcagctgccctggcactgagacccggacttcggtaaggccgagccactgagacgcgtacgcccctggtgagacatgaacgtctcattcggtgtatggttgtctcatggctgtcgatcgtgaccacgtgctgcgcaccgccgcggccctgctgacccgcaagtccaccgcgacgatggacgaggtcgcccgggcggccgggatcagccgggccacgctgcaccggcacttcgccgggcgggacgcactcgtccgggcgctggaggcgctcggcatccaggagtgcgaggccgcgctggacgccgccaggacggatgagggtccggcgcgcgaggccgtgcaccggctggtgcgcgagacggagtccgcggccggcctgctggccttcctctactccgagaaccagctgttcgagggcgaggagcagaacgcgggctgggcgcgcatcgacgaacggatcgaagccctgttccggcgcggccagcacagcggcgagttccgcatcgacctcaccccggcctggctcaccgaggcgctgtacggcctgatggcctccggcgcctgggccgtgaccgagggccgcgtggcccccaaggactacacctacatgatcgtggagctgctgctcggcggcgccctgcgtacggacgaaccaccaagagaggaatcatgaccagcaccctgcagccggcccgtgcggcggaggcggagaagcgcccgggccgctggctcgcgctcggcgtcctcgtcctggccgtgctgctggtggccgtcgacgcgaccgtcctcggtctcgcgaccccctacatcagtgaggacctcaggccctccggcacccagttgctgtggataggcgacgtctactcgttcgtcatcgccggtctgctcgtctccatgggcagcctcggcgaccgcatcggccgcaagcgcatcctgctcggcggtgccaccgcgttcggtctgatctccgtgctcaacgcctacgcgtcctcgccggagatgatgatcctggcccgcgcgctgctcggtgtcgccggtgccaccctgatgccggcgacgctcgccctgatccgcaacctcttccacgacgcgcgcgaacgcagcctcgccgtcggcatctggggcgcggccgcctccgcgggcatggccgtgggccccatcgtcggcggtttcctgctcgaacacttctggtggggctcggtcttcctgatcaacctgcccgtgatggccgtgctcgtcctggtcggcatccggctgctgcccgagtcccgcaacccgcacccgggtccgtgggacctggccagtgtcctgctctccctggtcggcatgatcgccaccgtgtacgccgtcaaggaggcggccgcgcacggattcacctggacggtcctgcgttcgcgcgcgtcgtggaagaggttgcggatcagggcgagcgtcgccggcatcagggtggcaccggcgacaccgagcagcgcgcgggccaggatcatcatctccggcgaggacgcgtaggcgttgagcacggagatcagaccgaacgcggtggcaccgccgagcaggatgcgcttgcggccgatgcggtcgccgaggctgcccatggagacgagcagaccggcgatgacgaa

SEQ ID NO: 1230 - DNA, 1732 bp, Unknown
  Kingdom: Bacteria, Phylum: Actinobacteria, Class: Actinobacteria, Order: Streptomycetales, Family: Streptomycetaceae, Genus: Streptomyces
gcgccaaggagtggaggccggtgccgcagcacgcgaagacgtgcggcggcgccggcctccactccttggcgcacatgggcgcggtaggcgtcgaggtccagtgtgccgtcggggccgtaggcggtgacggggaagaacagcggcccgctggggatgctgaggcgttcggcgaggggggctgacggcacgggctctccctgggacagtcactcacgttcctgagccgcacacgcctgcgagccgctcacgtttctgatctgcatccatattcatgaacatgctcacgctaagcggccccgcgccggccggtcaagcgggcaaaccggcaagcggcagcggatgtcgcccgcgcgcgccacccccgcgcacggcacacttgacggtgcgcgtccgagatctctagcgtgtccacgcatgtgaactcacgccacccatacatccagttcgggcgcctgtccgtggccggtccacatcccgcacaccgctggttgacgcaaggagaccgaggatgcccgctccccgcaccgttctgctcaccggcgccgccggcgggctcggcaccctgatgcgggacctgctgccccggtacggctacacgctccgcctcctcgacatgcggccgatcgaaggcgagccggaggccgtcaccgccgacctcggcgacaaggaggccctgcgggcggcggtccggggcgtcgacgcgatcctccacctcgccggcatctcgctggaagccccgttcgagaagatcctcaaggccaacatcgagggcacgtacaacctgtacgaggccgcgcgcgaggagggcgtcgggcgcgtcgtcttcgcctcctccaaccacgcgatcggccacacgccccgcccgcgcggcgacgacccgctgatcccggtcgacaccccgcgccgccccgacaccttctacggcctgtcgaagtcgttcggcgaggacctcgcccagctctactgggacaagtacggcctggagaccgtctcggtgcgcatcggctcctgcttccccgagccgaccagcgtgcgcatgctctcggtgtggatgagccccgccgacggcgcccgtctcttccacgccgccctcaccgccgagcacgtcggccacaccgtcgtccacggctcctccgccaacacccgcctgtggtgggacctgtccaccgcgcgggcgctgggctacgaaccgcaggacgactccgagccgtacgccgcgaagctcatcgccgagcagggcgaactcgacccggacgacgaggcccaggcctacctgggcggccacttcgtgaccgacccgccgatctggccctactgacagccgccggaccgccccacggctgacagccgtgggaccgccgcacggctgacggccggccggccgccgcacggcggaaaaccatcgctccgcgaggcgggcgggcaccgaacgggcccgcccacctccgcgtccgggcatccgccgtgcccgaaaccacctcactccgcgtagccccgcaggtccgcgacggacacacgacccggtaaacgggcacacccgggcagcatcgagcccgcaacagacctggtcggcgcagcgcacccgctgtacaactgtgccccgagggccccaccgggcccgaacgggcaacgccaggagggcaggtgcagaccatgggcgcgcgaaccgcggaggaacggcagcgggagatcgtgcgggccgcgcgggccaccggccaggtcgacgtcaccg

SEQ ID NO: 1231 - DNA, 878 bp, Unknown
  Kingdom: Bacteria, Phylum: Actinobacteria, Class: Actinobacteria, Order: Streptomycetales, Family: Streptomycetaceae, Genus: Streptomyces
gtggccggcttcctccgccagcgtccagccgttcttccgctgcagcggagcgatcagtccccgcatataggccaatgccgactcacgcggctccgacctgctgaaacggtgcacgaaccgaccatgcaccgcctcgagttcacccgcccacaacctgacaccagcaaggtccccacccataaccacaccaacgaccgacccggccatcagtcacggcaagcaccgttgcagtactagggcctgtccgggcgatctccgtaacgcggtcgacgggcctggccacctcaatccgggacgtcgagcagagcccgacgccaggcagtggcgttgtcagtccccgccgctatcgttcgcgcgttcacgatcatcagggaggggtggctcgattgggtgccagcggatgggattacgtcaccaggtacgacggcgacgtagaggcggctttggcgacactgcaggccagggtgttccaggaggagtacggcagtgatgcccgatacagaagcctggaggatctctacgaggacgaggagttcatggggaccgagggcacccatacgatccttgacatcgacagggttgttgccacggatgacccgccgacgaggtccggtatcgctgactacggcaccctgcgccctctggctctcaaccgcgtgatgcaccacttcggcacaaaccgaccgtcggtcgagcagtatgaggaacttgtcgctgctgccaatgaggctgcgagccatgaggagcacgagcaaagcctgctcggtgagtgtcagatgtggtggaccggtcactacatcgtcctctactccggcgacaggccgactcacctgggaatcttcgggttctcaggagactaaacgacgtcccgtaaaccc

SEQ ID NO: 1232 - DNA, 564 bp, Unknown
  Kingdom: Bacteria, Phylum: Actinobacteria, Class: Actinobacteria, Order: Streptomycetales, Family: Streptomycetaceae, Genus: Streptomyces
ccgcggccggactcgtgcgcgctgccgccggggccctgggcgtccagcctccggccggccgcgcggacttgaaggccgttcaggtcgcggacgggcacttcgtgcaggccgaggcggaacgtacggccgtcgccgccgggccgcggatggccgagcagccggtcgcccgcgtagaactcgacgcgcgcgtcccccatcggcaccgtggtgcccgagcgccactccaactgccgtgcctcgcctgatccggtgacgcgccatccgggcggtagcccggtgtcgctgtcaccggccgccgtgaacggccgcgcggcggacggctgacgggcctgtgccgcctcggccgccgtgggcgcggcccccgccatggcgagcaacgccacggcggtgatccctattcgccggacacggatcaatggtcccctcctcggaacacggacttcctccgctacatgaacacgggcgccccgtcggtcccgggggccacttgcgtcccggaggacggggccgcccggctgtgggttgcctgtggggcgcggtgagagcggcggcagcggcgtgatc

SEQ ID NO: 1233 - DNA, 1002 bp, Unknown
  Kingdom: Bacteria, Phylum: Actinobacteria, Class: Actinobacteria, Order: Streptomycetales, Family: Streptomycetaceae, Genus: Streptomyces
cgttcgcgcaggcgctcctggcccaggccggcgagcgcctgcgcgaacgctggcggcagtccgcgcgccgcggtccgcacgtgcccctgggcaacggcctcaccgccccacggaacccgctcggtttcatcgacggcatcgtgggcccgcacacggccgccgaacaacgacgcgacctgtggctggccggaccacccgcggtcgccggcggcaccatcgccgtactgcggcgcatggaactcgatctgccgcggttcgccgccctgtccgtggccgagcaggaagcggtcttcgggcggcaccgggccagcggcgcccccctctccggcggcactgtcgcctcgggccccgacctcggcgccaagacagcggacggccgctatctcgtgccagcggacgcccacgcgcgcagggccaaccccgccgtggtcggcaccggcctcatgctccgccgctcctacagcaccgacgatcccgcccccggcctgctcttcatcagcttccagaacgagctgcggaccttcaccgccaccctcacccacatggacacctccgacgcactgctgcgcttcaccaccacgacagccggcgcgacgttcctgatcctccccggcttcgaccgccaacgcccgctcggttccaccctgttcggctgatcacgccgctgccgccgctgcgctccgccgcccgtcggcaccgatcaggatcgaccgggggacgcggaacccgtacgcgcgccatggcccgttccggccgtctccgcttcgatgaggatccactgacagccgtccgcttccccggcagcgtgccgcggacatcgctgtcctgctgcgagacgccatgtccggggacggtccggaggccaggtccggatgcctgccttgtgacgtccggcgcgggcccgcgggccgttcagggcggctcgtccgcctccccggccgcgacagcgcgaggctagcggctggcctgcggcgggagggagaatgccgtagccgggggggg

SEQ ID NO: 1234 - DNA, 3117 bp, Unknown
  Kingdom: Bacteria, Phylum: Actinobacteria, Class: Actinobacteria, Order: Streptomycetales, Family: Streptomycetaceae, Genus: Streptomyces
tccgccggggtccagggtgaaccgccagctgcggtcgtcctggatcggatcggccaccgccagcgacagcgcgtcctccaggccgagcagccgccgtgacaccagggcccggctcgcccaggggcatgcccggctgaccaccagccggtaccgtccggccgtcaccggccagccgtcccgcccgtccgcggtgatccggtcggcgaagtggctcttcgagcgtttgaaggccttgtggccgtaggagcggttgccgtcgtccccgtcgctcatgccggtcctccctgcggtcgcggcgcaccggttcgcggcgcgccggtgaggtgcactggtgaacacgttccccgaaatccgccgacggcacggtgtgatccgcgcggacggggggcagtcggcgaacgtggacgggacatccgacgaaacagccgaagagacgccggatacgggcgattccgcggaatcagcggagagaaccgagagaacggagagaaccgagacggcagggagggcagggtcggcagggagggcagagacagggccagggtcggagccggggcccgcggccgaccggaagacccgggtcaccgtgctggtggcgctcgtggccaacctggtcatcgctgtcgccaaggccgtgggtggcctcgtcgcgcactcgcccgccctgctgtccgaggcggcccactccgtcgccgacagcctgaacgagatcttcctgctggccgcgctgcgccgcagccgccgccccgccgaccggcgccaccccttcggctacggcaaggaacggttcttctggtcgctgctcgcggccgtcgggatcttcgtcatgggcggctgcttctccttcttccagggcatccaggccctgcgcgagggagcccacgaggacctctccggctacgtcatcggcctgatcgtgctcggggtcgccctgctggccgagggcacctcgctgctgcgggcggtgcaccaggtgcgcgcgcagggcggcgcggccgggctgcgcgaccccgcgctgcgcacggtcgtcgcagaggacggcaccgcggtgctcggtgtcacgctcgccatcgccggcatggcactgcacatggtcaccggccaggtggtgtgggaggcctcggcctcactcgcgatcggcgcgctgctggtctacgtcgcctaccgcctgggccgtgacgcacgcgaccagctgatcggggaggccgcggaccccgaactcagcgggcggatccgcagtctgctgcgggcacagcccgagatcgacagcgtggaggcactgctcaccatgaaactgggcctcgactccgtgctggttgccgcccgggtcgacctggcgcccggcatggacagcgaacgggtcgaggaagtggcggtgcgcatcaaacggtcgatcacccgcaccgtccccgccgcggaccagatcttcctcgacgtgaccgaccgcccggcgcgacagggggcacgggagagccccgccgcgacgggggaacgcggcggggcctgacagacgggtgcccgctccacggccggtccatgcctcacggtctggatctacccggaacggacgcacccggagccccgatcccgccgtgccgccgccggcgctcagtgcccgtcgggcgccggctccagcacgaagaccgggatctcccgcgaggtcttctcctggtactcggcgtacggcgggaaagcggcgacggcccgctcccaccactcggccttctccgcgccggtgacctcacgggccgtcatgtcctgccggaccggcccgtcctgcagttcgacccgcgggtcggccagcaggttgaagtaccagaacgggtgcttgggcgcgccgccctgggaagccaccacggcgtaacgcccgtcgtgctccacccgcatgagcggcgtcttgcggatccggccactgcgcgcaccgcgcgtggtcagcaggacgacgggcagccccgtctcccgcagcgtggtcccctccctgccgccggacctctcgtacaactccacctgctcccgcacccactcggcggggctgggctcgtactcgccctccagaggcatgacgtccgtcctctcctgatccgtcgatccgtcgatccgtcttcggtcacacacagcgtcgcaacaccggtgcccggacgattcatccctaccgtgttccccttcgctcacgcgtgcggcgcgcgccattacctcaggggtcatcgcgcaggccccgcgagcccggcacagtcgtgggcggaccgcgccgccgagccgaacgggagtaccgcgccatggaccgcacggacgccaccacccctgccgccctctcgggcaccggccccggtccgcagccgacgacccgcgccacggtcgaggaactgctgcgccgcatcgaggcgggggaccccgagcggatcgcggagctgtacgccgccgcggacggcgactggcggctgagctggccggacgaggaacacgggcgtgctgcgacgccgtggatccgccgccgcagcactcgcgccgacgccgccgcgcactaccgggaactggccgcccaccatgtcccgcagcgggcggccaccgtgatcgaggggattctcgtcgacggcgaggacgccgtggtcctcggcgagatccggcaggtggcggcggccaccggacggccgtatcgcgccaggttcgcgctgcacctcaccgtccgggacggtctggtcgtacgccatcacgtgtacgaggacagcctggccgtcgcgcgggccttcgctccgggcaggacgccgtcggcgcccagggcgtccgcaccgccagtgtcatgatcacggtgctcgacaccagcgccgtcaccaggtgcccccgcccgacaggggccgtccgaacagggcgccgccgcaggcgagcagcagtgaccggctcgcggacgcgaggaaggcggccaggacgaacaggccccgctccaggggcggtgtgtcgtgcgcggggcccgtgccgccgatgaccagggccgtgaagcagagcaccgcggcggggttgagcagcgtgaggccgagcagtccgaggaacgcccgcccccgggcccggtggaggcggggtcggccgcgcggcgggccggtgcccgcggtaccggcacagcgc

SEQ ID NO: 1235 - DNA, 4890 bp, Unknown
  Kingdom: Bacteria, Phylum: Actinobacteria, Class: Actinobacteria, Order: Streptomycetales, Family: Streptomycetaceae, Genus: Streptomyces
gcctcccggagcgctgctccgggaggctgcctgagccgggaacccctccagggaggggagcagtcaaacgtcccgcagttcctgccggggcccggggtccttgtcgcgccgtggacggccgagcggcacgcgcgacgcgaaggaccgcagcagcagcccggccaccactccggccgccgcacccggtatcgcccaccaccagtccgtgcctccgtcctcgccgccggtgcggatcgtgaccctggtgaccgtctgctcctcctgtgccgccgggctcggtgggtccgtctgccagggggccgggaagacgccttcgtacccggcgcccgtgtccttgcccagcacgcccagcttccccagcagggcacgcaaccgggcggggtgcgcggcgcggtgccagtgaccgaccagcgagcccggcacgtccgccgccgtgtggatccagacgacgtcctcgccgctcaccgggaagagccggtcgatccgctggggcgtggtgtcgtgcaccatccaggtgacgttgatctgccgggcgcgtgccaggtcggcctgcggcgggtccacacgaagtccctcaccggtcccgccggccgggcccaggagctgctccagctcctcgtacttctcgtcggagaagaacagggcggccgcctctccgctgcgcggcgaggtcacgagcacgctcgtcggcccaccggcttccgcagcggcggccccccacagcatcagcgcgcacagcaccgccaacgccgccacaagcgcgcgcacttcacgcctcccgcgccgagcctgccggcaccgcccgccctcccggctccgcccctgctgcccgtcctgcgcgccctctccgtccttcctcgccttcctgaccatccgaaccccccaccttcaggtcgatccccgagcggcccgtaccggccgcgtgtcactgtggtcctcgtctcagtggccacgatcggcagcaaccacggccggaacacggacccgtccctggacccgtccctggacccgtcccagcgcgccgtacgcgcgcggtcaccgcggcctcatcgacgatgcgacccccctcccgcgtcctcacactcttgttacaccgcggcggacgattcgggtcccacctgtttccggcccgttccggatcgggccccgttacctgagagaatggtgaacatggccaacgaccgacctcgcgtgctatccggaatccagcccaccgcaggctcgttccacctcggcaactacctcggtgccgtccgccagtgggtggccctgcaggagtcccacgacgccttctacatggtcgtcgacctgcacgcgatcacggtcccgcaggacccggccgagctgcgcgccaacacccggctcgccgccgcccagctgctggccgcgggcctcgacccggagcgctgcacgctcttcgtccagagtcacgtccccgagcacgcccagctcgcctgggtcatgaactgcctcaccggcttcggcgaggcgtcccggatgacccagttcaaggacaagtccgccaagcagggcgccgaccgtgcctccgtcggcctgttcacgtacccggtcctccaggtcgccgacatcctcctctaccaggcccacgaggtgccggtcggcgaggaccagcgccagcacatcgagctgacccgcgacctcgccgagcgcttcaacgcccgcttcggcgacaccttcaccgtcccggcggcgtacatcctcaaggagacggcgaagatctacgacctgcaggacccgtcgatcaagatgagcaagtcggcgtccacgccgaagggcctcatcaatctgctggacgacccgaagaccaccgcgaagaaggtcaagagcgcggtcaccgacaccgacacggtgatccgcttcgaccgggagaccaagcccggcgtcagcaacctgctctccatctactcgaccctcaccggcaccgccgtcgacgccctggaacagaagtacgagggcaagggctacggtgcgctcaagacggacctcgccgacgtcatggtcgagttcgtgacgccgttccgggagcagacccagcagtacctggacgacccggagacgctggactccatcctggccaagggcgccgagaaggcgcgcacggtcgccgcggagaccctctcccaggcgtacgacagggtgggcttcctgccggccaagcactgaggcgcaccaccgctcacacgcgtcccgggcagagcgccgcacatcactgtcgctgcgcctgcccatcgcgggtccgtggtcgtacagtcgatagccggacggccgggacgaaacggccgggaacgcacgagaacgccccggacgacgcgagagcacgcgggaacgcaacagaagacgagcctgcccgacagcagacaccggcaccacgactgcagacaccggcacgacgacaggagacgacgtggggaccgtaacgatcggcgtgtcgatcgcggtcccggagccccacggcagcctgctccaggagcggcgcgcgggcttcggcgacgccgcggctcacggtatccccacgcacgtcacgctgctgccgccgaccgaggtggaccgcgccgagctgcctgccgtcgaggcccacctgaccgaggtggcggcggccgggcggcccttcaccatgcggctgtccggcaccgacaccttccggccgctgtcaccggtggtgtacctgagggtcgtcgagggcgccgaggcgtgcgcccggttgcaggagcgcgtccgcgacgcctccgggcccgtaccccgcgaactccagttcccctaccacccgcacgtcacggtggcgcacggcatcgaggaggcggcgatggaccgcgccttcgaggaactcgccggatacgaggcccagtggtcgtgcaccgggttcgcgctgcacgagcagggcgccgacggcgtgtggcgcaagctgcgggagttctccttcggcggccgtgcggtggtgcccccgcaggcggcccccgtggaccgcggcaccctgcccgcccggtagggcctgtccggcggcacctgccgcagacgcggggcgcgggggcggctgcacccccgacagcccccacggagccgctacagcggcagccgccggtacatccctcgtggcaggtgccgcagcgccgtcgtgaccacgcgcaggacaccgggcacccacaccgtctccgagcggcgccgcaggcccagttcgacggcggtggcgacctcctccggtgtgctcgccagcgcgggcacggcgcggcccgcggtggcgcgggaccgtacgaacccggggcgtacgaccatgacgtgcacgcccgtcccgtacagcgcgtcgccgagtccctgggcgaaggtgtccaggcccgccttgctggagccgtagatgaagtcggtgcggcgggcccgttcggcggcgacggaggagaggacgaccagcgagccgtgcccctggttctgcagctcccgagcggccaccaggctcgcggagaccgctccggtgtagttggtctgggcgacgtgcaccgcgttcagcggctcgcgctcgtcgtacgcctggtcgcccaggacgccgaaggccagcagcaccatgtcgatgccgccctcggcgaagaccttgcccagcacggcctcgtgggcgccgcagtcgagtgcttcgaaggcgacggtgcgcacctgcgcgcccagggcgcgcagccgggcggcggcctcctccagcgcgggtgacgggcggccggccagccacaccgtgcgggtgcgccgggcgacgagccggcggacggtggccagcgcgatctctgaggtgccgccgagcacgagcagagagcgggggagccgctcggcctcggcacggccgccgaggtcgccgagcccgccgaggccggcgaagcccgggggcggcataaggcggctcagacggctcagacggttgctcggacgaggcggacggggcagcggacccggggcatccttcacggcagacgactgtatcgcccggttatgggcgttctgtcgtagaaacgcggtgttggcgcggccccggagcgggcacaagtcggatcatggactggctgaagaacctccccgtgatcggcccgtggctggcccgtctgatgcggacgcacgcatggcggtcgtacgagcgcctggaccaggtgaaatggacccggctcgccgccgccatgacgttcgtcagcttcatcgcgctgttcccgctgctgacgctggccgccgcccgcgacccggaggccctgcaccccggtgtcgtcccgctggtcgcccccggcctgccggtgtggcccgcggcggccgtgctgctcggtctggtccccgcgttcgtggcccccgcggacgccgcctcgcacaaggagccgtcgtgatccgtttcgaggacgtctccgtgacgtacgacggcgccgccgaacccaccgtccgcgccgtggacttccaggtgcccgagggcgaactcgtcctcctggtcggcccgtccggggtcggcaagtcgaccgtgctgggcgcggtgagcgggctcgtgccgcacttcaccggcggcaccctgcgcggccgggtcaccgtggccggccgcgacacccgcgcccacaagccgcgcgagctggccgacgtcgtcggcacggtcggacaggacccgctgtcccacttcgtcaccgacaccgtcgaggacgaactcgcctacggcatggagtcgctgggcctcgcccccgccgtcatgcggcgccgcgtggaggagaccctggacctgctgggcctggccgccctgcgggaccgccccatcgccacgctctccggcggccagcagcagcgcgtcgcgatcggctcggtgctcaccccgcaccccaaggtcctcgtcctggacgagccgacctccgccctggacccggccgccgc

SEQ ID NO: 1236 - DNA, 2103 bp, Unknown
  Kingdom: Bacteria, Phylum: Actinobacteria, Class: Actinobacteria, Order: Streptomycetales, Family: Streptomycetaceae, Genus: Streptomyces
ccggccggcgcgtccggcgcccttgtggcgacggctgcggcggcgcccggcaccgggcccgcgggccggaacgcggaaccggccgccgccgcgcacgccgtcaacaccggggccggccgtcacaccaccgcgcaagcgcgcgggacgtctcccggagagcgtccctgaccgcgacggccgccgcgtacggccgccgtcgaggacagccgcagtcgcgtacggctcatgcctcatcgtccgttcgagcaccactcacgaaccgctgtacccatgcaccgcgcacaccaccgcgaacacactggagtcacagacacatgacagcgtcccagccgcgcgcccgccgcgtcctcgccctcccgctcggtatggccatggccaccgccgtcgcgttcctgcccggcgccaccgcgtcggcgaccccggctgcgcccgccgcgcacaccgccaaggcggacgcgacctcgctcagctacgtcgtcaacgtccgccccgggcacgggatatcggcgcaggtgaagaaggcgatcggcaaggccggcggcaccatcgtgacctcgtacgaccagataggcgtcatcgtcgtccactccgccgaccccaacttcgccggcgccatccgcaaggtcaacggggtggaatcggcgggcgccacgcgcaccgcgccgctgcccgcccagtcgaccaccgacgtcggcgccccgcagccgctcaccgccgcccaggtggcgggcgccgggaccagggccgccgccggacaggacccgctggagcccctgcagtgggacctgcccgccatcaaggcggacaaggcgcacctcaagacgctgggcagcccgaacgtcacggtcggcgtcatcgacaccggcgtggacgacacgcaccccgacatcgccccgaacttcgaccgccgcgcctcggtcaactgcgtctccggcaagccggacaccacggacggcgcctggcggccgagcgcctccgagagcccgcacggcacgcacgtggccggggagatcgcgggcgccaagaacggcgtcggcatcaccggtgtggcaccgggcgtgaaggtggccggcatcaaggtcggcaacccggacggcttcttctacacggaggccgtggtgtgcgggttcgtgtgggcggccgaccacggcgtcgacgtgaccaacaacagctattacaccgatccctggaacttcaactgcgttgacgacccggaccagaaggcgctcgtcgacgccgtccggcgggcctcgcagtacgccgaacgcaagggcaccgtcaacgtcgcggcggccggcaacgagaacaacgacctggcgtcccactcgctcacggacccggtctccccgaacgactccactccgggcgaccgggtgatcgacccgcacaagtgcttcgacatccccacccagttgccgggtgtggtcaccgtcgcggcgaccggcgccaaggggatcaagtcgtcgttctccaactacggcctcggcgtcatcgacatcgccgcgccgggcggcgactcgacggcgtaccagaagccggacgcgccggcgcagagcggactcatcctcggcccgctgcccggcggcaagtggggctacatggccggtacgtcgatggcgagcccgcacgtcgccggagtcgccgccctcatcaagtcgacgcacccgcacgccccggccgccctggtgaaggcgctgctgtacgcggaggccgacgccaccccgtgcacggacccctacgacatcaacagcgacggcaaggtcgacgcggtgtgccagggcacgaagaaccgcaacggcttctacggctgggggacggcggacgcgctggcggccgtgaccaggtgaccccggcccggccggcctgacgcggcaggcggccggtgctgcatagtgcggtcatgactgacacctcgttcgcatggtccgcactgggcggcgaccccggcctcctggaccgcatcaccaccgtggcacgggaaggcgcgctcaccgcgcgccttcccgtgcgcgatctggcgcgcgcgtgcgtgggcgcgtgcgcgctggccgccgccgaactggcggcgcggcgggccgccctggccggggtgcccgcggtgcg

SEQ ID NO: 1237 - DNA, 2183 bp, Unknown
  Kingdom: Bacteria, Phylum: Actinobacteria, Class: Actinobacteria, Order: Streptomycetales, Family: Streptomycetaceae, Genus: Streptomyces
cccatgactcccatgactcccatgactcccatgaccaccgacgtcacgatcatcggcgccgggctcggcggcctcgcgctcgcccgtgtcctgcacctgaacggaatacgggccacggtccacgaggccgagtcctccccggacgcgcgtgcgcagggcggactgctcgacatccatgactacaacggtcagctcgccctcggagcggccggcctgatggacgagttccgcagcctcgtcctggagggccgccaggcgctgcgggtcctcgatccggacgggaccgtcctgttcgacaaagccgacgacggcaccggcggacgtcccgaggtgcagcgcggcgagctgcgccggatgctgctcgactcgctcccggccggcaccgtccggtgggggcacaaggtcagcggcgtccgcaccgtcggcgaaggccgccacgaggtgacgttcgccgacggcggcaccgtcgcaaccagcctgctggtcggcgcggacggcgcgtggtccaaggtccggccgctgctctccggcgccacacccgagtacaccggcaagtcggtcgtcgagacctatctgttcgacgccggtacccggtacccggccaccgcgaaagcggtcgggggcggatcgatgatcgcgagcacgccgggccgggagatcttcgcgcaccgggagcgggacgacactctgcacgcttacgtcgggctggccgaaccgcaggagtggttcgccgacatcgatttcacggacaccgccgcggccaccgcgaggatcgcgaaggagttcgacggctgggcgccggagctgaccgcgctgatcaccgacgccgacgtcgcgccggtcctgcgccccctctacgcgctgccggcggatcaccggtgggacagggtgccgggagtgaccctgctcggcgatgccgcccacctcacggccccgaacggcgaaggcgccaacctggccatgctcgacggcgccgaactcggcaaggccctcgccgcgcaccccggcgacacggaggccgcgctcaccgcgtacgagcaggccctgttcccgcgcagcgctgaggcccccaccttcccgggtgccgacggcgacgacgacatgctcgaggaactgctcgccgccctcacccggcacgaacagccccggtaggggcatcgcgggggcacgggcgtgcaccgtcggccggggccggccgcgccgtggaccatactgatcccgaaagccccggggacgccgtacggccgggtccggggccgggcacaggaaggaggcggacatgcccgaacgcacccaggagttcggcaagtacggcgctcggggcgtcaagggatacgaggccgtcgcccgccggctcgacgcgctcgccggtttcgtcgtcactccggtgaccaccaggcgcggcctgctggcccgtctgcactacctcacccgcaccccgcacgcccgcgaggcggcccgcgcggcgggtctgacggtcaccgaccgcactctgaaggcgtggctcgacggccgccgcagcccgtcgaggaagaacctagaacgcgtcgagaccgcctaccggaccgtgcggcgccacaacgtcgcccgctacctgctgggccgcctcaaccggcagggccggggcacccgcgtggagatccacccgctcaaccagtcccaggtgccccgccccaggcagcgcgtcgtggagttccgcgccctcaacatccgccgctgggaccgcatcgtcgcggcctgggcggccgacgacgcgcaggcgctcgacgacgcctgggtcgaccagatcgtcgacctgggctcgcagtggggccagtacgagtacgtcaccaacgtcggcttcgccgcctgacggctccgctcagccgagcggcgggcggcccgccggctatgcgccatgcgcatggcacatgggcccagggtgctagattctgcggtatgcggatgactctggcggaccgggtccggacagcggtggcggcgctcctgcacgccaccggcgagtcgcagacggacctcgcggcggccctcggagtgagccaggcgcaggtgagccgccgtcagtccgggaacaccgcgtggagcctcgacgactgcgacgcggtcgccgggcacttcggcatcgacgtactggacctgctggccgggccgacccgggcgtcggaggcgctgccggacgcccg

SEQ ID NO: 1238 - DNA, 1714 bp, Unknown
  Kingdom: Bacteria, Phylum: Actinobacteria, Class: Actinobacteria, Order: Streptomycetales, Family: Streptomycetaceae, Genus: Streptomyces
tcggcgacgaccaggtcgccgcgggcatgcaccccggcgacctggtcgtcgccgaggagacccgggacccgcgcgggaccgtcacctgcgtcggcaccgaactgctggtcaaggaactcgcccgcaccctgccgggacgcaccgtccacaccggacccgtcaccggttccgaccacgtcgtgcgcggcccggagcggtccgagctgcgcgccaccggcgcgatcgcggtcgacatggaatcggcggccacgctgctgagcgcggtccgcgcgggcgcgcgcccggtcgcggccgtccgggtcgtcgtggacactccggaacacgaactcgtacgcatcggcacggtgcgcggcggtatatccgccgtccgcgttctccgtgccgtcctccctactttcttcgaatggcaccgtaatgtgctgctccccaggaggtgagccagatggccatgccactgcgccagtccatcaaggtcgctacatatctggccgaacagaagctgcgcaagcgggacaagttcccgctcatcgtggagcttgagccgctcttcgcctgcaacctcaagtgcgagggctgcggcaagatccagcacccggccggggtgctcaagcagcgcatgccggtcgcccaggccgtcggcgccgtgctggagtcgggcgcgccgatggtgtccatcgcgggcggcgagcccctgatgcaccctcagatcgacgagatcgttcgccagttggtggccaagcgcaagtacgtcttcctgtgcaccaacgccatgctgctgcgcaagaagatggacaagttcaagccctcgccctacttcgcgttcgccgtgcacatcgacggcctgcgcgagcggcacgacgagtccgtggcgaaggagggcgtgttcgacgaggccgtggccgccatcaaggaagccaagcggcgcggcttccgggtgaccaccaactccaccttcttcaacaccgacaccccgcagaccatcatcgaggtcctcaacttcctcaacgacgacctcaaggtcgacgagatgatgatctcgcccgcctacgcctacgagaaggcgcccgaccaggagcacttcctcggcgtcgagcagacccgcgagctgttccgcaaggccttctccggcggcaaccggctgcgctggcggctcaaccactccccgctgttcctcgacttcctcgagggcaaggtcgacttcccgtgcaccgcctgggcgatcccgaactactcgctcttcggctggcagcgcccctgctatctgatgagcgacggctacgtcccgacgtaccgcgaactcatcgaggagaccgactgggacaagtacggccgcggcaaggacccgcgctgcgccaactgcatggcgcactgcggctacgagcccaccgccgtcctggccaccatggggtccctgaaggagtccctgcgcgccatgcgcgagaccgtctccggaaaccgggactgacaccatgacggccgtttccttgggccttcccgaggtaccggcccggccgatcgccgagcgacgcgtgtcgcggcggatcgaggtcgggccggtggccgtcgggggcggggccccggtgtcggtgcagtcgatgacgacgacccgtacgtcggacatcggcgccaccttgcagcagatcgccgaactcaccgccaccggctgccagatcgtgcgggtggcgtgtccgacgcaggacgacgcggacgcgct

SEQ ID NO: 1239 - DNA, 553 bp, Unknown
  Kingdom: Bacteria, Phylum: Actinobacteria, Class: Actinobacteria, Order: Streptomycetales, Family: Streptomycetaceae, Genus: Streptomyces
gccccatatccccgcccccaagctgatttaccgtcagtaacatgtctcgtccgggggatactgccacgactgcgcccagaacgacagggcccggttcctgatgtcccacccgtaccgggctcccgcctgtgtgacgtacggctcacggagatcgttcccggtgcccccgggaggctcagcggcgcggcgccaacgcttcccacgccaccgtcacttcaccctgccgccagcgggccggcccgtccgtcaccggccagtcggccgccagggcgcgcaccgcgcggatccagcgctgccgggccccgtaggaggcgtagggcgcggcggccgcccaggcgcggtcgaagtcgcgcaggaacgcgtgcaccggctcgcccgggacattgcggtggatgagcgccttcgggaggcgttcggcgaggtcggaggggtggtgcagggagccgaggcgggtcgcgaaggtgaccgtccggggcccttccgggccgagcgcgacccacacgtgccgacggccgatctcgtcgcaggtgccctccacgagcagccccccgcg

SEQ ID NO: 1240 - DNA, 2615 bp, Unknown
  Kingdom: Bacteria, Phylum: Actinobacteria, Class: Actinobacteria, Order: Streptomycetales, Family: Streptomycetaceae, Genus: Streptomyces
ggtcggcgggttcgagcacgctgccatggtcggcctgctcctcggcggggcgtcgctgcggacgccggtgatcctggacggcgtcagcgccggtgccgccgccctggtggcccgcgcgatcgccccggaggtcctggccgcctgcatcgcgggacaccgcagcgccgaaccgggccacgtcgccgcgctcaacaagctgggcctgcgccccctggtcgacctcgacctgcgcctgggcgagggcacgggcgcgctgctcgccctgccgctggtgcagagcacggcacgcgcgatgcacgaggtggcgacgttcgactcggcgggcgtcaccgagaagtgacccggtatgccgggaccgggcgggtacgcaccccctgcgcaccccccggccccggcatacgctgaacgcacgtctaaaatccgcacgtcagggctgctccggagccgtagcgccccactccgtaccgcttcgacttcttccaccacgtcgcacggcgcaccgtcgcgaccgcccggacgaggagccgcaccaccatggccgaacatcccgcctaccccctcggtctgcgcctgaccggccgtcgcgtggtcgtcctcggcggcggccaggtcgcccagcgccgcctcccggcgctcctcgcggccggcgccgacatcgtcctcgtctcgcccgaggcgaccgcctccgtggaggccatggcggacgccggggagatcgcctgggagcggcggccctaccaggacggcgacctcgccgacgcctggtacgcgctgatcgccaccagcgaccacgaagccaacacccgggcctcagccgagggcgagctccggcgcgtgtggtgcgtgcgcgccgacgacgccgaggcggcgaccgcctggaccccggccaccggccacagcgcgggcgtcaccgtcgccgtgctcagcgagcacgcgagcgatcgcgacccccgccacaccgccgccgtccgcgacgcgctcgtcgagggcctgcgcgacggcaccctgggcgccccgtaccaccgcgcgcgcacccccggcgtcgccctggtcggcggcggccccggtgacccggacctcatcacggtccgtggccgccgcctgctcgccgaggcggacgtcgtcatcgccgaccggctcggcccgcgcgacctgctcgccgaactcccgccgcacgtcgaggtgatcgacgccgccaagatcccctacggccgtttcatggcccaggaggccatcaacaacgcgctcgtcgagcacgccaagcagggcaaggcggtggtgcggctcaagggcggcgacccctacgtcttcggcaggggcatggaggaggtccaggcgctcgccgaggccggcatcccgtgcacggtggtgcccgggatctccagctccatctccgtgccgagcgcggcgggcatcccggtcacccaccgcggggtcgcccacgagttcacggtggtcagcggccatgtggcccccgacgacgagcgctccctggtcgactggcccagcctggcgaagctgaccggcacgctcgtcatcctcatgggcgtcgacaagataggcaggatcgccgagacgctggtggcccacggcaaggcaccggacaccccggtcgccctggtccaggagggcacgacagccgcacagcgccgcgtcgacgccaccctcgcgaccgtcgccgagaccgtacgcgcccaggacgtgaagccgccggccgtcatcgtcatcggcccggtcgtcaccgtgggccccggcccggtctgacgagggccgcccgcagcaggcatcccggccggcatgccgacgcgcacgccggccggacaccaccgcaccaggacaaggcagtttcacccgtggccgatctcatcaccgtcgaggaccccgacgacccgcgtctgcgcgactacacggacctcaccgacgtcgaactgcgccgcaggcgcgaacccgccgagggcctgttcatcgccgagggcgagaaggtcatccgccgggcgcgggacgccgggtacgagatgcgctccatgctgctgtccgccaagtgggccgacgtcatgcgcgatgtcatcgacaccctcgacgcgccggtctacgtcgtcgcacccgaactcgccgaacaggtcaccggctaccacgtgcaccgcggcgccctcgcctccatgcggcgcaagccgctgcccacggcggccggtctgctgagcaccgcccgccgggtcgcggtcatggaggcggtcaacgaccacaccaacatcggcgccatcttccggtcggcggcggcgctcggcatggacgcggtcctgctctcgccggactgcgcggacccgctctaccgccggagcgtcaaggtctcgatgggcgcggtcttctccgtgccgtacgcccgtctcgacacctggccgcagggcctggagtcggtccgcgaggccggcttcaccctgctcgccctcactcccgacgagagcgcccgcaccctcgacgaggccgcaccgcaccggatggaccgggtcgcgctgatgctcggcgcggagggcgacggcctgtcccgccgggcgctcgccgcggccgacgcctgggtgcgcatccccatggcgcacggcgtcgactccctcaacgtc

SEQ ID NO: 1241 - DNA, 2958 bp, Unknown
  Kingdom: Bacteria, Phylum: Actinobacteria, Class: Actinobacteria, Order: Streptomycetales, Family: Streptomycetaceae, Genus: Streptomyces
gccgtacgcgcgggcggccctggcagcggtcgacgcggcgcagcagcccggtgaactccgcgaccgcctgccgcgccccgtcgaccgctgccagggccgcccgcgcgtacggcagcacggcctcgccgacctccgtcgtccgcaccgaacggcccgagcggtccaacagcggctgccccagctcccgttcgagctgccgtatctgcgcgctcacccccggctgcgccacgtgcagcctctccgcggcccgcgtgaagttggcctcctccaccaccgcgacgaagtactgcagctgcctgagttccataaccggcgatgctagtcaccggacgcagccgttcttggacgtgcgcggcgcccgccaagatccttgacgcatggggacgacggacgacatcaccgaggtcatcgccgccgaacgccgggacctggccgacctgttcgacgcgctgacgcccgcccagtgggaggcggacagcctctgcgcgggctggcgggtgcgggaggtcgtggcgcacatgtcgatggggttccgccacccgctcggcagtgtgctgtgggaactcgtgaagtcccgcggcagtctgcaccgtacgacggaccggctggcccgccgcgacgcggcccgccaccgcgacgcccggctcgcggcgttcctgcgggagcacgcccaccacccgtggcgcccgcccgtcggcgggctgcgcgccgccctctcgcacgacgtcgtgcacggcctggacgtcaccgtcgccctcggccacggccgggccgtgcccgaggagcgcctgaagctcgtcctggacggcatcgacccccgggccttccgggtcttcggcaccgacctgcgaggtgtccgcctggtcgccgacgacctcgactggtccttcggcaccggcgccccgctgcgcggcaccgcccaggacctcctcctcgtcgcctacggccgccgcctgcccgccgggcggctgcgcggtgccgagtgtcaccgtttcgtctcgaagtgagccgctttacaaccggaccggcccttcgtgcggtctagctgtccgacacaccacggacacatgaaccaaccgagggggaagcccgccatgaggcacatggcccgacgcggagccgttgcactcggtgtcaccggactggtggcgccgctcgcactcgcgctcggcacggctccggcacaggcggcgacgagttgcaccacgtcgaccgggccgtaccagaagaaggtcgagaagttcctcggccgacccgtcgacggccgccagtcggccgccgactgcaaggcgatcaaagccttccagagcaagcacggcatcacccccaccatcgggtacgcgggcccggtgacctggggcgtgatggatctcatgaacaagcagaaagccgtcgggaagaacccgaacaaggacggcaagtgcccgaccaacaagggccgcatagcctgcgtgaacctcacgctccagctcagctggatccaggacggcaagcggctcgtgtacggtcccgtgccggtgcgcaccggacgcgacaagtacgagacccgcaccggcctgaagaagatctactggcgccacatcgaccacgtctcgacgctgtaccacgtgaagatgccctacagccagttcttcgacggcggccaggcgttccactccgtgggcctgagcatgtggaacccgccgggctcgcacggctgcgtcaacatgacgccgaaggacgccaagaagtactggtcgctgctgaagaagggcgacgacgtcttcgtctacggccgcaagcccggcacctgagaaccggtgcgggacgggcgggttgtctccgatcgacgtgatgagcaacacggtccggtatgtccgaatcagtcccgcttactcacaacgccttcacgtcgagcggcatatgcttcacagcatgtccaccactgttgaagccgcctccgagcgatcggccgcggaggtcaacgaggagatccgtgccctgtggcgccggtcgggcgggacactgaccaccgagcagcgcgaggtgtaccagcgcctcgtcctggagtgggccacggccgctccggactcggaccaggcggcctgacccgccgcccgtcccggccggcgcctccgggccaccaccggggcaccggcccccctccgcggtcttccgtgaccaccctgtcgttccttcccgccccggccgcctgtgccggggcgcactgtcatacccgcggccttccacgtctcccggcaccttccggcgtccggtcagccccaggtcgtggccagataccggcgatacgccttccggtcccgctccgtgcggatccaccgggccgccgccgccagcgtgaccagaccgcccgccacgacgagcagcccgggcccgacgttcctgggatcggtcaaccggtagcgcagcgccacaccgtccgtgcggcccggcagcggagccggcgagcccggtgcggcggtccccgagagcgccgcgccgcccgctccggcctgcaccggtgcccgcgtcggcgccgacacgatcagtttcaccctcagcgcggacagcgcctcggtcaccggctggaagaaggtggtcccgccgctcgtgcagtcgccgctgccgcccgacgtcaccccgagcgcgatcccgtccgagaacagcgggccgccgctgtcacccggctcggcacacaccgtggtccggatcagaccggtcacggtgccctcgggatagttcaccgtcgcgtccagcccggtcaccacgccgtcgtgcagcccgctcgtggagccgctgcggaacacccgccggcccacgaccgcttcccccgcgcccgtgatccgcacgccgtcgccgccgccggtcgccaccacgccggcgccctccccggcgctcccggagtcgtagcgcaccagtgagaaatcactgccgggaaaggcgtcggcgaccgttcggcccaggggtccgccgcccgcg

SEQ ID NO: 1242 - DNA, 2543 bp, Unknown
  Kingdom: Bacteria, Phylum: Actinobacteria, Class: Actinobacteria, Order: Streptomycetales, Family: Streptomycetaceae, Genus: Streptomyces
agccgccgtgttcgccctggtactggccggtgtgcggggcgcagcggcgacttcggtgtccgggctgctccccacggcccagcagctcggcggctcgatcggggtgacggcggccggcctggcctacttcgcgccggccggcggtgcgaacgcggcgttcggccacgccatgacctacgaggccgcggtcttccttctcacggcgttgatctccctccgactacgacggacaggttcggagccggagcaaacccggccacgcctgccttccgcgacgcccaggtaggtcgcctcacgcaacgctgcgtttcggcgtcatatacgggtctgcactcatgtccgccgcctgccggccgctcttgcggccggccgacgggagcgagcggggcccgcccatggtcccgtatcctgcgccgcaggcaggcacggccgaagcggtggccggtgcggtggaagaggccgtcgagttctcgatgcctggcagcgtccgcgtgttcctcgatcacgccgggaggctgtcccccactcgcggacggcacctcaaccagcgggccgggccgccgcgtcaccgcgcagggcccgctcctgcgcgtcggccagccagaagtagaccggaggaaggcccagttcgatcacggtcagcgcgatctggaaccagtgcggccggccgtgcacggcaagcgagagcagccgccccgcgccgcccagcaggaagacgccggccagccatcgcactgcctgcgccgggatcgggcgctgccgtgccgcccagagccacgcgagcccgtagccgacgaagctggaccccatgaaccggccccagctgtcgaccgtcgtaccggccgaaccggccccggggatcgccgcgttgccgagtgccacgtggaacaggccgatcgccacacaggaccagcccatcagctgagtgagcaagcgcagagccctggacacaggtcctccgagtcgtcgcggcgaagcttagttgacatgcgtctactacagtgggcgcactagtggacgtatgtcaactaagctgcgtgcgtgcctcctcgccagcgactcacgcccgccgcccgccgtgcccaactcctcaccgtcggcgcccggctcttcgccgcgcatccctacgccgacgtggcgatggaggaggtcgcggcgcaggccggtgtctcccgggccctgctctaccgtcacttcccgaacaagcacgccctcttcgcggccgtgtaccagcaggcagcggaccggctgctcgccgagacccggttcgaccccgccgactccctggtggaacagctcgtccaggggatggacgtccatctcgactatttcgtggcgaaccgcaacgccgtcctcgccgcgaaccgggttctcgcgggtgacccggtgatccagacgatcatgaccgacgagctggacgcgctgcgcgcacggctgctggccgtccttcccctcacggacgaccacgcccgcgaggcggtgtccggtgtcctgaagagctggctcgtcttcgtccgggtcctctgcgtcgactggctcgcccacgagacctgcccccgcacccaggtgcgggacgtctgcgtcggcgccgtgctcggcgcgctgcgcccgctgctcgcgcaggaccccgcccccgactggccgcgccggtctcgtacacccggacagccgggctgaccctgcccgcgcggtgagccgctgccctggcgaacacctcgggtggatgtccggcccatcctgctccgccgggggaacgccctcttgcctgtggcaagctcaggccgtgtgaagtgcgttttctgccgcctcgtccaggacgacgccgcacgctgggtggcatatgagaccgtggcctgcgcgttcctgccgctggaccctttggcgcccggccacaccctggtcgttcccacacagcactacgcggacgtcttcgacaccccaccagacgtcctcgccgcgaccatgacgctggtccaacgcgtgtccaacgcgatgcggaccgccctgggcgcctcaggcgtgaacatcctgagcgccagcggcccgggttccgagcagtcggtgccgcaccttcacttccatgtcgtcccacggtggacggacgacgggttctcgacatggccgaccggacggtccgggcgtcaagtggccggggacgccggcgccaggcttgccgcgtacctgaaccaaggccggcgccacagaagttgagccagaatccgttctccgttctcgtcgacgtcggtgagtcatggcccggtgattcccgtctcatgccgtcgccatccggaccacggagcggcgggcgggctgtcaggatgccgccgtctgcaccgacgccacgagcgtacggccgaacaccttctcgccttgcttcccacgcccgcaggctgctcgacaagccgcacgaactagggtccgtcttcaaagatcatcaggtcgtggatcatggtggggtggtacgtcgtcatgaactcaccgatcgcgagtgggagttgctcgccccgctgataccgcgggccgcgacaggccggccgcgggtg

SEQ ID NO: 1243 - DNA, 3472 bp, Unknown
  Kingdom: Bacteria, Phylum: Actinobacteria, Class: Actinobacteria, Order: Streptomycetales, Family: Streptomycetaceae, Genus: Streptomyces
agggggctccggggccgtggcggggcttccgtccgtacggcggtacggagcatgatggccgccaggcacaccgccgtccgcccatacctctgcgtgcctcttcgtgtcttttcgctcctcttcctgccctgcccctgacccgtcaccgcgtcccggaggctttcatgcccggtggaaaagccctggtccgccgccccggcccgcgtctcgccgacggtctggtgacgcacatcgcgcggaaaggggtggacgtgccgcgcgcggtgcggcagtgggaggagtacgtcgggacgctgcgggcgcacggctgggagacggtcgaggtcgagccggccgacgactgtcccgacgcggtgttcgtcgaggacacggtggtcgtgttccgcaacgtcgccctgatcacccggcccggcgcaccgtcgcggcggccggagaccgccgcggtggaggaggcggtggcccgtctgggctgctcggtgaaccgggtccgggagccgggcaccctggacggcggtgacgtactgaaggtcggcgacaccgtgtacgtgggccgcggcggacgtaccgacgcggccggggtgcggcaggtgcgggccgccttcgaaccgctcggcgcccgggtcgtgcccgtcccggtgagccgggtgctgcacctgaagtcggcggtgacggcgctgcccgacggcaccgtcatcggatacgccccgaaggtcgagtgcccctcgctgttcccgcgcttcctgcccgtgcccgaggagtccggcggccatgtggtgctgctcggcggggacaggctgctgatggcggcgagcgcgccgaggacggcggagctgctgggcggcctcggtttcgtcccggttgcggtggacatcggcgagttcgagaagctggaaggctgtgtgacatgcctctcggtgcggttgcgggagctgtacgcctgaccgggtgaacgggacgcttctcgggcccccggacctgcggcttgcgagccgtcccacggcccgtcaactccccgggacgagtggcctgatcagtgatctttacggccgccttaacctacggcttcgtaacctacgggttcgtagcctacgatcccgtaggttcatggaaccggaccggtaccgctcaccggtcctcccgtgcgcccgctgctccccgctcacttgccgtcccaccccgctgtcgtcctcctctcatcccatctgttccgctggttccccgccggcacgcgcgtcccctggagttcccttgacgatcacctctcctcacctcggcagttcgtccgcctggaccgacgcgcggctgctgtacgcgctggaagaggtggtcgagaaggaactcgaccggcacctgcggatcgccaaggactggatgccgcacgagtacgtcccctggagcgacggccgcaacttccccggcctcttcgcggacggcgaggcctgggacaaggaacagtcgaaggtgacggagatcggccggatcgccctcgtcgtcaacctgctgaccgaggacaacctgcccagttaccaccacgagatcgccacgctgttcggccgtgacggcgcctggggcacgtgggtgcaccgctggaccgccgaggagggccggcacggcatcgtgatgcgcgactacctgctcgcctcgcgcgcggtcgacccggacaagctggagcggttccggatggcgcacatgagcgagggcttcgagtcggacaacaaccactcgatgctgcactcggtcgcctacgtcgccttccaggaactggccacccgtatctcgcaccgcaacaccggccaccagtcgggcgacccggtctgcgaccgcatgctggcgcgcatcgcgaccgacgagaacctgcacatgatcttctaccgcaatctgctgaaggcggccttcgagatcgctcccgacctcaccatgcaggcggtgcgggacgtcgtggtcaacttccgcatgccgggccacagcatcccgggcttcgagcgggcggcagcccagatggccatcggcgaggtctacaacctgcggatccaccacgacgacgtgctgcagccggtgctgcgcttcctgaagatcatggagatcgacggactgggccccgagggccggcaggcgcaggaggaactgggcctgttcatgggcgggctgaacgcggaggccaccacgttcgacgagaagctggcggcgcgcaaggcgcggatggcggcacgggcgggcgcctgacgggccccgtgaccgcagcccgacggcagaacctgcggtgggccgccctctaatgggccgctcgccgcaggttctgccgttccttttcggacaggccgccccagacgccgaagcgttcgtcgttggccagcgcgtactccaggcaggccgggcgcatctcgcacaggccgcagatgcgcttggcctcgcgcacggagctgcccgggtccgggaagaagaagtctgccccggtctgtgcgcacagggcctgtgcctgccaggccgcatcggccggggtgagcgtctcgatgtgcatgagcgagatcgtgccgggcggcgaaaaacgttcgatcaacgcgccatcaacgccgcgttcgggagcgtccgtcctgcgatgatcgctccgcgggcgggcgcggcgcacggcggcgcgcggaaacggaccgcttcggcggcgattgtcactggtcggtgcgagacagcgtccgtcctgcgatgatcgctccgcgggcgggcgcggcgcacggcggcgcgcggagacggaccgcttcggcggcgattgtcactggtcggtgcgagacagcgtccgtcctgcggcgatcgctccgcgggcgggcgcggcgcacggcggcgcgcggagacggaccgcttcggcggcgattgtcactggtcggtgcgagactcggcagagcaggcgacgggtcccttcgaaggagggcgacgatgctcaccacccgtttcgttgacggcgctccgaactggatcgatgccggcgcccccgacatcgacggcgcccgttccttctacgccgggctcttcggctgggagttccgctcggcgggccccgacgccggcggctacggcttcttcgagctggacggcagggtcgtggccggcgggatgccgctgacggcggagcaggctccgccggcctggaccgtgtatttccagtgcggtgacgcacgggcgagtgcggaggccgccgaggaggcgcacggcagagtgctcgtgcagccggtggacgtgatggaccaggggagcatggcgctcctcgccgaccgggcgggggcgatcttcggtctctggcagccgcggcagcgcaaggggctggacgtcgccggtcagcctggctcgctgtgctgggtcgagctgtacacgccggaccttgcggcggctgccgccttctaccaccggatgctggggctggagacctccgcggtctccttccccggtggcacctacacctgcgtcaaccccgccgccggcggcg

SEQ ID NO: 1244 - DNA, 1374 bp, Unknown
  Kingdom: Bacteria, Phylum: Actinobacteria, Class: Actinobacteria, Order: Streptomycetales, Family: Streptomycetaceae, Genus: Streptomyces
ccctgggcgcccgggtagccgtaaccgccctgcggctgcgcgccgtagggctgaggggcgcccggcttgggcgccgggacgagcgcggcctggagcgccgggaccaggggggtggcgatcaccccgcccgccatgacgagggccgcgatgaagccgaggatcaggccggcacccgcgccgtgcgagtccaccagggtccagaacaggatccacaccacgaacaccgtgaacgccgcgcccgccgtgcccagttccagaccggccaccttgcgcggctggggcaggcagcgctgcacgacgaccagagccccaccgatcaccccgcccatgtagacgccgaggcccaaaccgagattgtcccaggcattcccgctgaggtagctgtcgtacgtgtcgaggaacgacgcgatgaacagcaacaccgctgctccgatcaccacgccgtcgccccgagtgagggagcggatattcacttcaggtccttcaggtcgtctcgtcgtcggtagaggcgtcgctgtcaccaggccgctgttgccgggtcctggtgtgaagcgcgggggtggcccctcatcgtacgggtgacactatcgcccgtacggtcggcctgtccgcccggaccgccgcgccggtcaggactggcgcaggaaactcacgattccctcagacattccctccgccgccttctgccgccaggtcccgctggtcagcagggcggcgtccgtgctgtcgcgcatgttgccgcactcgatgaacaccttcggaaccgttgacagattgagaccgcccaggtccttccgcgtcacgagtccggtgccgccgccgaggtagttggacggcggctcgccggtcgcgcgcaggaagttgcccgcgaggcgctcgcccaggtcacgggaggaggcggcgatcgggcgggtgtcggccgcgccgtcgtggacggccgccgggaggatcacgtggaagccgcggttgcctgccgccgagccgtcggcgtggatggagaccgccgcatccgcgtgcgcggtgttgcccacccgggcgcgctcgtccacgcacgggccccaggcgggggagccgtcgtcgtgggtcagtttcaccgtggcgccctgccgctccagcagagtgcgcagccggtgcgcgacgtccagggtgaactcggcttccgggtaaccggcgttggtggaggtgcccgtcgtgtcgcactccttccagttggtgccgatgtccaccttgcggttgatctcggacgtgtgccggaagttgccggggttgtggcccgggtcgatgacgacgaccttgccgctgagcggaccggtcaccccgccgggctgcttcccgtcgtcaccgggcgcggcggacgacggggacggggacggg

SEQ ID NO: 1245 - DNA, 2094 bp, Unknown
  Kingdom: Bacteria, Phylum: Actinobacteria, Class: Actinobacteria, Order: Streptomycetales, Family: Streptomycetaceae, Genus: Streptomyces
cgccggaccgctcgcgcacccgccgcacgaggtcgacggcggcctccggccactgcgggtggccgaaggcgaagccggcgtcgagcagccggccgggcacgacgcgccggctcttcaggagcagttcggtgtccgagcgcagcacgaacgccccggcctccgccatccacctcgtggccggcaggcccaccgggacgccccacgcggtgcgcagcacccgcatgagggtgcgctgcggcaggggtgcgggcgcggcgaggttcaccggcccctcgatgtcctcccggccggccaggaacagtagggcgcgcacgaagtcctggtcgtggatccaggagacgtactgcgcgccgcccgcgaccggtccgcccaggcccagccgggccagccgcagcagcacgtcgaagacgccgcccgggtcggggctcatcaccatggccgcccggagggcgaccttgcgggtgtgcggggtcgccgcccgctcctgttcccgttcccaggcgcgggcgatgccgacgctgtagccccagtagccggggacgccgggttccgatccgccgatcacgccggtcgcctcgtcgttgggcgcgtcgaagcggtgcgcgtagacggtcgcggtgctcatctgcagccacaggcgcggtggccgtccggcggcggccaccgcctcgcccacgacccgggcggagtccacccgcgagtccctcatggcccgcaggttgtccggcgtgtaacggcagctgacgctgcgtccggccaggttcacgaccaggtcgcagccgtcgatcacctccgcccacggccccagggtccgcccgtcccacaagacctgacccgcgcgccgcgggcgccgggtcagtacgacgacctcgtgcccggccgcggtcagcgcccgctccagcacggtgcccacctgaccggtcccgcccggcagtacgaccttcatcggacctcgccccctctgtccctgtgtcggcgagcgcgatcctacgcctgtcttgaacgcgttcaaaaagctccgccggtcaagggctggtcataacggggggttccgtcaagaacagggcgtacgctgggagcggcatgaacagacacctcgttgtgtcgaaagctctgacgaatcggggtgtgccgggcatcggctccggcgccccttgccgtgtggccgcgccgacgcgcgtccgggaaccggaaggaggcgcgatggacagtagtccgggccacagtcggccccgtcccgtgttgttctcgccgtccttccgcggcccggaacagcccgttctcgctctcggctgaccggcctcgacgtccctgcaggggtccgtggaggcgtacaggtgtgccctcacaggggccgcgcggccggcccggcgggaccagggctgccgtgggccgcccgccacccggccgccgtgccggggagagggtgtgttcacctgtgtccgcgaccaccttcctcatgtcgaccaccgcgcgcctgcgccaccgccgggtgcacctggagcgccgggccaccgccgccgggtccgtccgctcctcactggtgtcgctggccggactgatcggcgggccggtcgtccaccaggcgggccaggaggtcggccgcgtcgtcgacgtcgtcgcccggctctccggaccggaaccgtacccgccggtgaccgggctgatcctgcgcatcgggcggcggcgcgccttcctgcccgcggacgtcctcgaccgggtgtacgccgatcacgtacggctgcgcacggcccgcgtggacctgcgcgacttcgcgcgccgccccggcgaggtgctgctcgcccgggacgtgctcgaccaccaactcgtcgacgtggacggcgtgcaggtcacccgggccgccgacctctacctcgcacccctggtgggccgggtggtgctggtcggggtggacgtctcgctgccgaccctgctgcggcgcatcggaccgcgccgctggcaggcacggcccacacccgagcgcgtactggactggcaggccgtggcgcccttcgccgaacaggccgtcgacgggccgcccgaggtcaggctgcgcgactcccgcgcggccctgcaccggatgcgcccggccga

SEQ ID NO: 1246 - DNA, 660 bp, Unknown
  Kingdom: Bacteria, Phylum: Actinobacteria, Class: Actinobacteria, Order: Streptomycetales, Family: Streptomycetaceae, Genus: Streptomyces
tcaacaccggcaacggcttctacggcggcctgcagttcaccaactccacctgggccgcgtacggcggcaccgcttacgcctcgcgcgccgacctggcgagcaagtcgcagcagatagcggtcgccgagaaggtgctcgcgggtcagggcaagggcgcctggccggtctgcggcaagggcctgtccggcgcctccaccggctccagcagctcctcgtcgtcctcctcgtcctcctcgtcttcttcgtcttcctcctcctcgtcgtcctcgtcgagcagcagctccagcagctccaagagcagcacctcgagccgttcgaccgagcagcgggccgccgaccgttccgcgacgcgtccggccccgaagcagaccgtcaccaccccgaccggcaagaaggtcaagaagggcgacggcgagtacaaggtggtcgccggcgacaccctcagctccatcgccgccgagcacggcgtccacggcggctgggagaagctgttccagctgaacaaggacatcgtcgacaacgccgacctcatctaccccggccagcagctgcacctcaagtgacggtgacagcggcccgctagccggaccccaggccctccccccagacgcggcctccatgtcatgcatgtcatgtcatggaggccgcgtctggggggag

SEQ ID NO: 1247 - DNA, 2018 bp, Unknown
  Kingdom: Bacteria, Phylum: Actinobacteria, Class: Actinobacteria, Order: Streptomycetales, Family: Streptomycetaceae, Genus: Streptomyces
cgccgtcgtcggtgcgggcggccagcaccatgccgtcctggccgacgatctcggtgagcctggcgccgaagtggaagcggacgccgtgctcgcggtgcaggtcggcgaagagctggcccagctcggggccgagcacgccgtgcagcggggtggcggacggctcgacgacggtgacctccgcgccgtactcacgggccgctgcggcgacctccaggccgatccagccggcgcccgcgatcaccaggtggccgttgtcccggcccaggtgggtcaggacgttcttcaggcgctcggcgtgggcgaggcggcgcaggtggtggacgccggccaggccggtgccggggatgtccagacggcgcggttcggcaccggtggccagcagcagcttgtcgtagcgcacgtgggtgccgtcgtcgccgtagtggacggtcttcgcggcgcggtcgatcgcgtcgacggtctggccgaggtgcagctcgatgtcgtggcgcgcgtaccaggcgggttcctgcacgaagacgctgtcgcgttcatccttgccgagcaggtagcccttggacagcggcgggcgctcgtaggggtggtcgcgctcgtcgcagatgaggatcactcggccgctgaagccttccgcgcgcagcgtctcggccgccttcgcgccggccagacctcctccgacgatgacgaatgtctgatccgcgtcgaccacttgatgcctcctgccgggggtctggggggtgtcccccagaggaactgcgggtgccgccacatgcgagcgtcccgcacggagcgtgatgcgggaagagggagtggcccgatcaggccacgcagggtcacctcggggcgttgggccccggcactggggtcaccccggtcccacgggtaacagcggtatcacgggtgtccgtaagcgcgctgtgagtttcatgccgtcatgcctgcccccgacatccgtgcgtgaagcgagcgggccgaggcgtcggtgagcgaggcgatctggtcgacgatcacgcgcttgcgggcgcggtcgtcggcggcccgctcgaacagggcgcggaactgcgggtcgaggccctcgggggcgcgcgcggtgagcgccgcggcgagttcggcgacgacgatccgctggtcggcgcggagccgctcctgctcggtgcgctgcatgacgaaccggtcggcgacggccttgaggacggcgcactccattcgggtgcttctcgggacgaccagctccgcgccgtaccgggtcagccggccgccgccgtacgcctgccgggtggcgccctcggcggccaggcagaagcggccgatgagctggctggtggcgtccttcaggcgggcctgggccatggccgagccgtcgtagccgtgcggccaccattcctggtcgaggaggcggtcgagggcttcggccagctcggcggggtcggtgtccgccgggacgtagcggccgacggcggcggcgaagacggcccggcgctcgggcccggacctgaggctgccggggtcgatgtggccggcgtgcaggccgtcctccacgtcgtgcaccgagtacgccacgtcgtcggaccagtccatgacctgggcttcgaagcacgtgcgcgtgccgggcgcgtcctggcgcagccagtcgaagaccggccggtcgtcctcgtagacgccgaacttgggcgaggccgcctcgctcgggtgggcgccgcgcggccacgggtacttggtggcggcgtccagggcggcccgcgtcaggttgaggccgacgctggccggctcgcccgaggcggggtcggtgacgaaccgcttgggttcgatgcgggtgagcaggcgcagcgactgggcgttgccctcgaagccgccgcagtcgtgcgcgaactcgttcagcgcctgttcgccgttgtggccgaagggcgggtggcccaggtcgtgcgagaggcaggccgcctcgaccaggtcgggatcgcacccgagggcggcgcccagctcgcggccgacctgcgcgcacccggctgacccactccctggag

SEQ ID NO: 1248 - DNA, 1729 bp, Unknown
  Kingdom: Bacteria, Phylum: Actinobacteria, Class: Actinobacteria, Order: Streptomycetales, Family: Streptomycetaceae, Genus: Streptomyces
gggcgagccgtccgccgacgaccccgagcgcaccgtcgtcaaggtccgcgagccgcgcggcaagaaggacgagcggcccggtgacagcatggatgaggtgcagtccatcaagggctcgacccgcctggaggcgaagaagcagcgccgccgggaaggccgtgagcagggccgccgccgcgttccgatcatcaccgaggccgagttcctggcccgccgcgaggccgtcgagcgcgtgatggtcgtccgccagcacggcgaccgtacgcagatcggcgtcctggaggacgacgtgctcgtcgagcactacgtcaacaaggagcaggccgtctcgtacgtcggcaacgtctacctcggcaaggtgcagaacgtcctgccctcgatggaggccgccttcatcgacatcggcaagggccgcaacgccgtgctgtacgcgggcgaggtcaacttcgaggcgctgggcatggccaacgggccgcgccgcatcgagtccgcgctgaagtccgggcagtccgtcctcgtccaggtcaccaaggacccgatcggccataagggtgcccgtctgacgagccaggtctccctgccgggccgctacctcgtgtacgtccccgagggctcgatgaccggcatcagccgcaagctgcccgacaccgagcgggcccggctgaagaccatcctcaagaagatcgtccccgaggacgccggcgtcatcgtgcgcaccgccgccgagggtgcgagcgaggacgagctgcgccgtgacgtcgagcggctgcaggcgcagtgggacgacatccgcaagaaggccaagaacggcagctccagcgccccgtcgctgctgtacggcgagccggacatgaccgtccgcgtggtgcgcgacatcttcaacgaggacttctccaaggtcatcgtcagcggcgacgaggcctgggacaccgtccacggctacgtctcgcacgtcgcgcccgacctcgccccgcgcctgtcgcgctggacgagcgaggtggacgtcttcgccacgtaccggatcgacgagcagctcgccaaggcgctggaccgcaaggtctggctgcccagcggcggttcgctggtgatcgaccggaccgaggcgatggtcgtcatcgacgtcaacaccggcaagttcaccggccagggcggcaacctggaggagacggtcaccaggaacaacctggaggcggccgaggagatcgtgcgtcagctgcggctgcgcgacctcggcggcatcatcgtgatcgacttcatcgacatggtgctggagtccaaccgcgacctggtgctgcggcgcctgctggagtgcctgggccgggaccgtacgaagcaccaggtggccgaggtgacctcgctcggcctggtgcagatgacccgcaagcgggtcggacagggtctgctggagtccttctccgagacctgcgtccactgcaacggccgcggtgtcatcgtccacctggagcagccgtccgcgggcggcggcgcgggtggcggcaagcgccgcaagcgcgcccgtgccggtgccgagcagccgcacgagcacgagcacgagcacgagtacgaggccgtggcggcccaggccgccgcgccgaccgcggaggaggaggcggaggccgaggccgagacggtcgtgggggccgccgaggccgctgaggcccctgtggtctccgagccggtcgcgctgcccgcgttcgagatgtccccggacgaggagctgtacagctcc

SEQ ID NO: 1249 - DNA, 2155 bp, Unknown
  Kingdom: Bacteria, Phylum: Actinobacteria, Class: Actinobacteria, Order: Streptomycetales, Family: Streptomycetaceae, Genus: Streptomyces
gctgacccgctgacccgctgagtccgggccgggcaccggccacggacgaccgccgaaggacgaccgcggaaacaggcagaaacacggacgaccgcgcaaacaggcagaaacaggacgggcgccgtacgtgcataacgtacggcgcccgtcctgtcttgaagtgcgctggttaccggcccgtgccccgcggggactacgcgctcttgcggctgtcccggggatgaacagcgatgttcatcgccccggaccgcagtacggcgagacgctcctcgaggacctcttcgagttcctcgcgggtgcgccgctccatcagcatgtcccagtgcgtacgcgcaggcttggccttcttctcctccgggccgtcgccgtccaccaggagtgcctgggccccgcagaccttgcactcccactccggcgggatctccgcctcgaccgagaagggcatctcgaagcggtgccccttctcgcatgcgtactccacggcctggcgcggggccaggtcgataccgcggtccgtctcgtagctggtcaccacgaggcgcgtgccgcgaagagctcgctcactcatgaatcgtgcctcccgggcttgtcgcccacaggacaggtgtcgctgtcgtcgtcatccggtcaacgtccggtcggcggtaaagattcccgttccgatgtcccgttccgggtcatgtgtcgccgtcgtagccgcagccttgtcaaccagtgcagtacccaccggcgcccggtttgtcacatctgcaaggagatgtcacccagcgtttcggcatctttgacgcgcagtaacggtacgcctggcaggccaaacgcgtacactacagccctttcgcctccagtgctaaatccggtcgggcgccgcattgcccgccgcgtggatcgcccgcaccaccggaacccgcgcgagcagcacgaacccgatcacgaagaacgccaccagcgagacgatcgcgtcccggtagttcccggtcagctggtaggtgagcccgaacagcagcggccccagccagctcatgccgcggtcgctcatctcgtacgccgagaagtactcggcctccttgccgggcgggaccaggtgggagaacagcgaccgggacagcgcctgactgccgccgaggacgagaccgatcccggccgccagcacgaagaaccacaccggggccccggccggcaggaagtacccggcgcccaaggtgagcgtccaggcgaccagcgaggcgaggatcgtccgcttcgccccgtacctgcgggccagccgccccatgcccagcgccccggccaccgccagcacctgcaccatcagcacggccgtgatcagtgtcgactggctcagccccagctcctccgagccgtacaccgacgcctgggagatcaccgtctggatgccgtcgttgtagacgaggtacgccagcaggaaggccagcgtgagcggtttgccccggatgtcccgcacggtggccgccagttgccgccagccgtgccccggcggcgcggcccggtccgtgcgccggtcgcgcagccgcttcagcggtacgagcgtgaagacgccccaccacagccccgccgacgccaggcagatgcgcaccgccatcgcctcggacacgccgaaggagtcgtgggcggtgaacagcaccaggttcgccacgaggacgagagaaccggccgcgtagccgaacgcccagcccctggaggagaccgcgtcccgctccccgggatgcgcgatctgcggcaggtaggagttgtagagcaccatcgagacggccaccgacgcgttggcgacgatcagcaggagaccgccgagcaggtagcggtggccgtccagcaggaacaggcccgtggtcgccgcggcgcccacgtaggcggcggtcgcgagcagcggcttcttgcggccggtgcggtcggccaccgcgcccgcgaccggcatcagcacgatcgccacgatcaccgacagcgagacgcagtacgcgaagaacgagccggcccgcaccgggacccccagcgggtgcacgaacccgtcggcatccgccgccgaccgggccaccgaggtcaggtacgggcccaggaacacggtgagcacgctggtcgagtagaccgaacacgcccagtcatagaagtaccagccgtgctgctcgcgccgccgcgcggcggc

SEQ ID NO: 1250 - DNA, 2072 bp, Unknown
  Kingdom: Bacteria, Phylum: Actinobacteria, Class: Actinobacteria, Order: Streptomycetales, Family: Streptomycetaceae, Genus: Streptomyces
  misc_feature (1362)..(1363): n is a, c, g, or t
  misc_feature (1746)..(1896): n is a, c, g, or t
cagaccccggccggccgcgcctccggcctcggccgccaggtccccggacagggcggcggcgggggcggcgagttcggaccgcccggctcgggcgacaccaccggcttcatctccaccgacggcctgggctacggcgacgacgacttcgtcaagccacgcaggggccgcaggtggctgaaggtgcccctgtacagcgtcctcgcgctcgccgtcatcggcggcggcctctacggcggctaccgctggacgcagacgcagtactacgtcggcaccaacgaggagcacgtcgcgctctaccgcggcatcagccaggacctggcctgggtgaagctctcggaggtggagaaggaccaccccgagatcgaactcaagtacctgccgccctaccagcagaagcaggtcaaggcgacgatcgccgaaggcggtctgcaggaggcgcagaagaaggtcgacgaactgtccgtgcaggcctccgcgtgccgcaaggagtcggagcgccgcaccgccgaggccaagaacggcgccaagacggaccaggacaagacggacaagggcaagggcaagaacggcggcaccacgggaaccacccccgccgccttcacgtccaagacgacatccccgtcgacccccgatccgtcgaggtccaaggcaccgtcacagtcgtccaagtctccgtccacgtccgcgaccgcgtccacctccagccccggccccactctctcggaggaagagcagaaggtcgtctcgctgtgcggtaagcagtaggcaagccgtgagaggccctgtcacacgatgagcagtacaaccaactcgcccacgcaccacacgtccacgatcggcgccatcggagcgcccagccgccgcaacaccgaactggcactgctcgtcttcgcggtcgccatcccggtgttcgcctacgccaacgtgggcctggccatcaacaaccaggtgcccgcgggcctgctgagctacggcctgggcctgggcctgatggcgggcgtcgcccacctcgtcgtccgcaagttcgctccctacgccgacccgctgctgctcccgctggccaccctgctcaacggcctcggcctggtcatcatctggcggctggaccagtcgaaactgctccagtacatcaagcaggccggtgacaaggcgcccacgcagctgctctacacggcgatgggcatcgcgctgttcgccatcgtgctgatcttcctcaaggaccaccgcgtcctgcagcgctacacgtacatctcgatggtcggcgccctggtcctgctgctgctgccgctggtccccggcctcggcctgcccgtctacggcgccaagatctggatccacgtcggcggcttctccatccagccnnagccgccgcttcatgggcctgtacctgccgcgcggccgcgacctcggcccgatcctggtcgtctgggtcatctcgatcctcatcctggtcttcgagacggacctcggcacctcgctgctgttcttcggaatgttcgtcatcatgctgtacgtcgccaccgagcggaccagctggatcgtcttcggtctgctgatgtcggcggtcggcgccttcggcgtggccagcgtcgaaccgcacgtgcaccagcgcgtgcaggcctggctggacccgatgcacgagtacctcctcagccacaagggcgtggcgggccactccgagcagctccagcaggccctgtgggcgttcggctccggcggcaccctcggctcgggcctcggccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtccggcgccttcgcgctccaggtcttcgtggtgtccggcggtgtgatgggcctgatcccgctgaccggtatgacgatgccgttcctggcgtacggcggttcctccgtcatcgccaactgggcgctgatcggcatcctgatcaggatcagcgacaccgcccgccgcccggcccccg

SEQ ID NO: 1251 - DNA, 4846 bp, Unknown
  Kingdom: Bacteria, Phylum: Actinobacteria, Class: Actinobacteria, Order: Streptomycetales, Family: Streptomycetaceae, Genus: Streptomyces
gcccctggccgccgcccaggacggccccgtccccgccgacccggccgtccgctcggcgagcgcgaaactcggcgccgacgacgccgacctgctcgccgcggccaaggccgacggcgccaagaacgtcacgatgatgatcgcgaccgcgccgggacagaccgggcaggtcacccggcagatcgacgcggtcaggggcggctcggtcggcctcacccacgacaagctcggctacgtccgcgccaccgtgccgaccgccgcggccgactcggtgatcaccgcggccgagaagctgtcctcggtgcacgccatcgacctgcgccaggagataccgctcgacgacccggccccggacgcgggcgccgccaagggcacgcagggcaagggcgacaagggcgacagcgcctcctaccccgcgcccggcaagaacacgcccgcgacgaacccgtacaacccctccttcgagacgggcgccgtcgatttcgtgcgcgggaacccgaaggcggacggccggggcgtcaccatcggcatcctcgactccggcgtggacctcggccacccggcgctgcagcggaccaccaccggcgagcgcaagatcgtcgactgggtgaccgcgaccgacccgatcatcgacggcgacgccacctggcgcccgatggtgaacgcggtctccgggcccgccttcggctacggcggccagaactggaaggccccggcgggctcgtaccagatcagcaccttcaaggagtccgcgaccgccggcggcgacgccaagggcgacgcgaaccgcgacggcgacaccaccgactcctggggcgtcctgtacgacccggcggccggcacggtccgcgtcgacctgaacaacaacaacgacttcaccgacgacacgccgatgaagccgtacaaggacggcttccaggtcggctacttcggcaccgacgacccgaagacggacgtcgtcgagcggcagccgttcgtcgtgcagatccgcaaggacgtgccgatggacccctacggcgggtcctggaccggcaagaaggccgacttcgtcaacatcggcgtgatcgagtccgagcacggcacccacgtcgccggcatcaccgccgccaacggcctgttcggcggcaagatgaacggcgcggcgcccggcgcgaagatcgtctcctcgcgcgcctgcacctggagcggcggctgcaccaacgtggcgctcaccgagggcatgatcgacctcgtcgccaaccgcggcgtcgacatcgtcaacatgtccatcggcggcctgcccgcgctcaacgacggcaacaacgcgcgcgccgagctgtacacccgcctgatcgacacctacggcgtccagctcgtcatctccgcgggcaactccggccccggcgccaacaccatcggcgacccgggcctggccgacaaggtgatctcggtcggcgccggcatctccaaggagacctgggccgccaactacggctcggccgtgcggaccccgtacgcgatgatgcccttctcctcgcgcggcccgcgtgaggacggcggtttcacgcccacgctggtcgcgcccggcgccgccatcaactccacccagacctggctgccgggcgccccggtcgccgaggcaggctactccctgcccgccggctactcgatgctccagggcacctcgatggcctcgccgcaggccaccggcgcctcggcgctgctgctgagcgccgccaagcagcagcacctcgacctctccccggcggagctgcgcaccgccctcacctcgaccgcccaccacatcccgggcgtgcaggcctacgaggagggcgccggccgcatcgacgtcgtggacgcctggaaggcgatccgccgcggcgccgccgcccacgagtacacggtccgggccccggtcgacaccgcgatcgactacgccctgaagacccccggcttcggcaccggcctctacgaccgcgagggcggtctgaaggccggccagaagaagacctacgacgtcacgatcacccgcacctccggccccgaccggccggtgtggcacacgctgcgcttcgcgaacaacgccgaggacaccttccggatcgccggctcgccgctcgtgctgctgccgctgaaccggccggtgaccgtcaaggtgcaggcggctccgcgctcggcgggcctcaagagcgcgatcctggaggtcgacgaccccttcaccacgggcgtcgaccggcagatcctcaccaccgtcgtggtcgccgacccggtccgctacacctactccgacacgtcctcggtgcagcgcaacagcacgcgttcctacttcctgaccgtgcccgagggtgcgaagtcgctggaggtggcgatcggcggcctgaaggacaagagccagacccgcttcatctccatccacccctacggcgtcccggtcgacaacacctcgacgccgtactgctacaacaactacctgggcggcaacggctgcaagcccgacgtccgctcctacgccgacccgcagccgggcgtgtgggaggtcgaggtcgaggcgcgccgcacctcgccgctgctggacaacccgtacacgctggacgtctccgtgctcggcgcggccttcgacccgcagaccgtgacggtgcccgaggcgaaggccggcacgccggtcaccgcctcctggaaggtggcgaacacgtacgccgccgtggacggcaagctggtcggcggccccctcggctccgcgaagtcggaccggcccaccgtgcgggccggggagaagcagaccacgacggtgaccgtgcccgagggcgccaagtcgctcgacgtcgcgatcggcggggtctccgacaagtccgccgacctggacctcacggtctacgacgcgagcggcaagcaggtcgcgcagtccgcggacggcgactcggaggagtcggtgtcgatcgcctcgccggccgccggtacgtacaccgtggaggtcgccgcgtactcggtgccgtccggctcgacggcctacgactaccgggacgtgttcttctccgccgcgctcggcacggtcgcggtggacgggtcggctccggtgaagctgggcacgggcgcctcggcgacggtgtccggccaggtcaccgccgcggcccaggcgcccgagggacgcgagttcttcgggcaggtgcagctcgtgaacgcgcgcggcaccgtcgcgggcaccggcagcgtgacgatcggcaaggtcctgccgtagccgctgccggcaccggccggtggctgccgtagccaccggcaccggatcacagggcgggcgtccgtgcgggcgcccgcccttcgccgtccgtccgcggtcgcaccaggccgtgcctgcgtgcggcgagcgggcgccccttgccgttgcgtacgtcacatcgccgtatacgaccgcggcacaggggcaggcacggagcagcacagcttgcggtccgcgcgcccaggtgagcgaatttctgcagctcacccggggtgcgcaccgcagaaccgcaaccgcgcggctgccggactcgtccctttcggcgggacggcgccgggcacgcggcgcaaagaagtggacacctgggccggggtcggccgcatgatggaaaggccgcggccgggcgacacgcacggcacaagcacgtacagcacacgccaagggagacaccgtgagggtcggaatcgtcggagccaccggtcaggtcggcacggtcatgcgcaggatcctcacggaacgcgacttcccggtcaccgagctgcgcctgttcgcctcggcccgctcggcggggacggtcctggacggcgtgacggtggaggacgcgtcgacggccgactacaccggcctggacatcgtgctgttctcggcgggcggcgcgacctccaaggcgctggccgagaaggtcgccgcgcagggcgccgtggtgatcgacaactcctcggcctggcgccgcgacccggacgtgccgctggtggtgtccgaggtgaacccgcacgcgatcgcggaccgtcccaaggggatcatcgccaacccgaactgcacgacgatggccgcgatgcccgtgctgaagccgctgcacgcggaggcggccctcgaagcgctggtcgtcgccacctaccaggcggtgtccggctcgggcctcgcgggcgtcgccgagctgcacggccagacgcagaaggtcgtcgcggacgccgaccagctcacgcacgacggcgcggccgtggacttccccgagccggccgtctacaagcgcccgatcgccttcaacgtgctgcccttcgccggcaacctcgtcgacgacggcctgaacgagacggacgaggagcagaagctccgcaacgagtcacgcaagatcctggagatcccggagctgaaggtctccggcacctgcgtgcgcgtcccggtcttctccgggcactccctgcagatcaacgcccgtttcgcgcgtccgatcagcgtggagcgcgccacggagctgctggccggcgccccgggggtcgccctctccgacatcccgacaccgctgcaggccgccggccaggacccgtcctacgtcggccgcatccgccccgacgagacggtggacaacggcctggcgctgttcgtctccaacgacaacctgcgcaagggcgcggccctgaacgccgtgcagatcgcggagctggtggcggccgagctgaagggctgacccggccgccggcccgcggccggcagcgcgcgtcacggcctgcgcacctcgtagaggaaacagccgtactcgacggcccggacgtggaccagtgccacggccgggtcgtcgaacgcttccgcgagggccgcgtcgaaatgcgcggcgccccgctccaccagccggccgcccaggatgcgcccctgggc

SEQ ID NO: 1252 - DNA, 1826 bp, Unknown
  Kingdom: Bacteria, Phylum: Actinobacteria, Class: Actinobacteria, Order: Streptomycetales, Family: Streptomycetaceae, Genus: Streptomyces
agcccgcccggcccggccttgtcccgcaaggccgggccgggcgggctcaggaggtgacctcggccccctcgggccgcgggatgaagaacgaggcgccgaacgccgccacgacgacgaccagaccggtgaacatcgccgtcacatagcccgcggaggagtcgccgcccgccggactgcccgcgacctgcaccgccgagagcagggcgaagctcagtcccgcgccgagaccgaacgcggccgagatcagtccgggcaggaacccggggttctccttcggggcgaggacgacaccgagcaggttgaggacgatgttggccacacccgcgtacgtcacgccgaggagcacggtgcaggcgatcatcaccggcagcgagtgcactccgaggagcgccatgaccgcgatcaccacggcgctggcggccaggccccagcgcagcacccgccggtagccgaggaccggtgcgaggcgcccggtgaacgggcccaccagccagcccaccagcgcgaacggcgtcaggaagaccaccgaggcgaggctggaacccatgccgaagcccaccgtgtcgttctgcgcgaaggacatcagcacgccgttgacggtggcgaagacgccgatgagggtcagcagggtggtcagcagcggggcccaggtggcccgccggcgcaggtcgtcgatccgtaccagcggctgtgcctcccgcttctccagccgccagaacaccgcgaaggccaccgcggcgacgaccagcaggccgatcgccagcggccagttcgccgcgcccagcttctccgcctcgtccacggcgatcagcagggccacgacgctgaccacgagcggggccacgcccgcccagtccatccgggtgccggccgacgggcgggactcggggcagcccgcacggaccaggaccgccgcgacgacggcgaccaccgcgatcacccagaagatgctgcggaagccgtacgccccggcgagccagccgccggccagcgcgtccaccccggcgatgccgccgttgaccgccgcgaccatgcccatcagcgtgccgaagcgtttggggtcggtgacctcggagcgcagcatcagcagggagatctgcacgacggggccgcaggcgccctgcacggcccgcgcgatgtcgaggaccgcgatgttcggggccagcgcggcgagcaccgtcccggccgccatgagcaccagcatccacgtcagcacgcgcttgcggcccacgatgtcgctgaagcggggcaggaacagcgagaacatcgcggacgcggtgaagaacacggtctgcgacaggccggtgttcgcctcgtcggtgtgcagctcccgggccatggtgaccagggccgggctgagcatgctggcgttcagctggaaggcggtgcacgcggcgagcagcgctgtcatcagcgccgcggttccggccgccgtctttgccggccgggtggtcaggtcagtggtcatcgcgccgtctcacttccggacctggcacagccggtcgacgaggaggtcggggaaggtgccgtcggtctccaaggcgacgacggcgttggctccgggctgctcggggtagccccggtacaggccgcgggtgtccgcgaccagggcgccgcggggacgccggtgagcacgctcgccggggagatcctcgacttctacttcgccttccacgagcagacggcgctgcccttccgcggctccgcctgccacgacccgctcgcggccggcatcgccgtcggcgaggtcgtcccgaagctcgcgccccgcgtgcacgtcaccgtcgacaccgcggacggcgcggcccgcggcgccctggtcgcgg

SEQ ID NO: 1253 - DNA, 2174 bp, Unknown
  Kingdom: Bacteria, Phylum: Actinobacteria, Class: Actinobacteria, Order: Streptomycetales, Family: Streptomycetaceae, Genus: Streptomyces
acttggcctccagcgcctcctgcgcggccacctgcgccgcggccttggccgcctgcgtggccgccgccgccttggccgcctcctccttggccttgtcggtcagctccttggcctgcttctgcgcgtgatcggccaggtcggccaactgggctacggtcagcgtctcctggtcccgggcggaggcgacctgccagccgtcgtccaggaacgcctgcacgtcctccggcgtgccgtccagcgcctgctgggcggcctgcttgacgttcggaccgcccgccgacatcagccgcaggacctggatccggttgtcgtcctcacgaggacggaactggcccttgtcgatgaacgcctgccagtcgtcggccgagccgtccagcgccgtggccgccgcggccttcacacctggaccgccgtacgccatgatctgcgcgacctgcacccgcaggtcctcgtcgtagggcgcctggaagcccgagttcaggaactccgtcagctggtccgcaccgccgctcagcgcggtgccggccgccgcccgcactccgggaccgccgatggccatcacctgggcgacctggacccgcaggtcctcttcccagatgaccggcaggtccttggtcatgaaggtctggacatcctcgtcagaccccgtcagggcggcctcggccgccttgcgcacgccggggccgccgtagcgccacgcctcgaagacgtccgccctgttgtagtccggcacgtcgtcggccgccgccgccggctgtatgtgcacacccagcagcatcgccagggccatcagcgtggccgccagaccacgccgggcccgcacgacccggaatcgggttgccaatgcctcttctccttatcggtacctgtggaccgaacggtccgaagggcagggccgcccgcggacacggtgccggggagagggtgggcagggcagcggtccggcgaacgcacggcccgatgagccgtacgccgtcagtggggcggcgaagccttctagagggggtcggtcacccctgcggaccgtcggtcgtcctcgtgtgaacggacggagcgcgcggcgccgtcagggacggcggccgtcatgcggtacgcccgagcctgccgcgccgttccatgtccgtactccccccatggatggaactccgcccgtccgtttcgacggcgtgtgacaagtgcacgccattaccgggactttaccatcggcacatccggctcacagcgaacgtcacctgcccggacaaccccggtcggtcgccgacgagttcgcggtccagcccgaccagcgcctcacgcgcaccgtgaccaccgccccgtccgggggatggtcggcgtactgcgggtacctgctccgcaggagcgccagggcctccctccgctcccgccgcgactcggggtccgacggctcgtccggtgcgccgggcggcaggatccgggcgacgccgtccgcgcggacccaccacagccgtgcccagtcctcgtcgtaggcgtcggcgagcaggcacaccgacgggtggacggcgatgttgcgcagccgccgcaggccggtggtgctcttcggtttgtggtccaccgccgtcacgatcgtgtggccgtccgggacggcgaacaccacgggcaccaggtgcgggcggccctccgggtccacggtggccagccgggccacgcgggctgccgcgaaccgccgccgggcatcctcggagtccatccgtggcacctcggcgcctccttcccccgcacgtgagcgcgtccgcgggccgggtaccccctctgcgccgtgccggacccacaatgggcggcagggcgggaggacgccgacgaagggagacgcatgccggggctcgcggttccgctgtgggacgtggccaacgggcagggcctgcgccagctcgccgagctggggctcgcgctgctgctgtcgagcctgatcggctgggagcgggaggcgcaccagaagagcgccgggctgcgcacccacacgctggtcggcgtcgccagcgcgctgatgatggaggtgtcgcagcacgggttcaccaacgtgctgggcctggaccacgtgtccttcgatccgtcccgggtggccgcccagatcgtctccggcatcggcttcatcggcggcggtctgatcttcgtacggcgggacgcggtgcgcgggctgaccaccgccgccaccg

SEQ ID NO: 1254 - DNA, 1971 bp, Unknown
  Kingdom: Bacteria, Phylum: Actinobacteria, Class: Actinobacteria, Order: Streptomycetales, Family: Streptomycetaceae, Genus: Streptomyces
gcccacagccgccacggccggggttcgaaggcgtcacggacggcggcggccagctcggcctcgccctcggcgtcggtggcgaagcgggcgaggacgggcgcggccagggcgcgcaggccggcgtcgtcgtcgcgcagtgccagctcgtccagggcccaggcccagttggcgccggtggcggcgtatctgcgcagcagggccagcgcgtcccgcctgccgtaggacgccaggtgcccgaggacggcgagggcgagtccggtgcgggactcgtcggtgtccagggcgtcctcggggtcgaagaggtgtgcctcgacggcgtccagatcggcgtgcaggtcgagcaggagccgggcgtagtagagggagcggttctccacctgccagtcgtggcgggggtcgtgcagcacgcagtggttcagtgccgcgagcgcctcggcgcggggggcggtgagcgcgtgcagagtgccgtcgccgcggccccgctggagcaggccgagcagcgtgccgctgggcgctatgaccggatcgaacatgggaaacagcctcacatcaagcgtcgacgcaaccgggaaccacgcactacctggccgcgtgacaccacgtcggggcgcccgccgtctcttgcttgctgtagaccatcttcctctgcctctcgtcggtggcccctgcggcccggatcacgggccgcgcggtgcggcaacacctgcccagccatcgcgtccgtgaatcacgacgtcatgatgacccggcgcctgcgctgccgcgaccgaaatttccggcggcctcgtaccgcctcccccgttttccgtgtcatggctggtcaacgggccgtttcagaagctcacggcccgtgggttcactgctcgccgaacaggcgcagcagctcggtgcggccgaacatgcgggccgtgtcgagggccgagggcgtgcccgcggacgggtccgctccaccctcgagaagggcctcgatcacgtgctgctcgcccttgaaaaccgctcctgcgaggggtgtctggccgcggtcgttgacgcggtcggcctcggcaccgcgggccagcagggcgcggacggtgtcggcgtggccgtggtaggcggcgagcatgacgagggagtcgccccggtcgttggtgaggccgacggggacgcccgcgtcgacgtacgccacgagcgcctcggtccgcccctgccgggccagatcgaagatcttggtcgccagctccacgacctcggggtcgggggcatcactcatcggccggaccgcctctcactgctacttcggggactgtgggtactgcggggtgctgctgagtactacgggggtggtgcgggggtggtgcggggagccagcgtacggccgtgagcgtaggtcggccgtacgggtgaatcgccagggtactggctcgtccggggcggaagccgacgcgtcggaggtgaagatcgccccggaccgggccgtacgcgacaacagggcccgcccgtcctcccggcggccccgcacctggagggcaatagggagcatttcacccagttgcaccttttgtcatacagatacatgctgtgatcctggaaggactcagggtgaccgtcccccttcgacaccaggagatctcacatgatcctctccatctcaggcgtcgtcctgttcggcgtcatcggcttcatcttcttccgcaaggacggactgaagccgtcccacgcgtgtgtgtcgacactgttcggcttctacctcgcgagcaccgcgatcgcgccgagcatcagagccggcggcgagagcctggccagcctgctcggcggcatgaggttctgacgtcgccccgcccgaggactccgacaagctccgtccagggggcgcccgtgtcgcccctgagcactcccaggaggcagcagtggcccggcgccccctcccccgcatcctgagcaccggcggcgctcagctcgcccggagccgggagctggcccggacggcggccg

SEQ ID NO: 1255 - DNA, 1938 bp, Unknown
  Kingdom: Bacteria, Phylum: Actinobacteria, Class: Actinobacteria, Order: Streptomycetales, Family: Streptomycetaceae, Genus: Streptomyces
tctccacggcacctggcggcgcggcgggctcggccgagctgaccgtccaggcgtccaccaccgtgccggtcggccgcgccttcacctccgacagccgcagccagacgcagatcctggccggctccagcgagtcgacggtctccgcgaccgccgtcgccacctgggccgacaagggcgcgataccggccctgtccgcggcgaaggactgcgccaagggcgccctggacatcagggtgacgaacaagggcgacaagccgtacgccttcgagctgatgggcgccgcccacagcgtccccgcgggcgctacccgtacgaccgcgatcccgctccaggaggaccaggcctacgacttcacgatcacgggcccggacggccggggccagcgcttcaccggcgtcctcgactgcaagacccagggcgccgagatcggcacgaagacccagatgctcgccgaacccgtccccaccccggccagggcgggcgagacccccgacgacacgaacctcgccgagaccggcggctccgacaccaccccgctgatcgccgccatcggcctcagcctcctggtcctcggcgccacggcactgagcatcgtccgcaagaagaagaccacccaggactgacccgaccgccccgagcggccccgaagcggccaggcaccttgccaactccacagagaccgcccgtgtcatcgggaaaccgccggccttcgctgtcagcttccggggcgtcactgactgtcctagtctgatccgcatgacaccgggggagagggtcgtcgggcgcttcgagctgatcgagcggctcggcagcggggggatgggcaccgtatggcgggccagggacacggtgctgcatcgtgaggtggccctcaaggcggtgcgccaggacgcggacgcctcgcacaccgtacgggaacgggtcatgcgggaggccagggcgctggcccggctcagcgacccgcacgtggtgacggtgcacgaagtcatcgaggcggagccgcacccgtggatcgtgatggaactcgtgcccggcacctccctccagcaacgcatcgacgcgggaccaccgctgagcccgcaggagacggcccgcatcggccgccagttgctctccgccctgcgcgccgcgcacgccgccggcatccagcaccgggacgtcaagcccgcgaacatcctgatccgccccgacggcagcgtcgccctcaccgacttcggcatcgccgccctccagggcgcgacggcgctgaccgcgaccggcgacctcgtcggcaccccggagtacatggctcccgaacgcatccggggcagcgacgacgacccggcctccgacctgtggtctctggggctggtcctgtacatgtgcacggagggcgcaagcccgctgcgccgcgcgaccacacccgccaccctggccgcggtcctcgaagaaccggtccccctacccatacactccgggccgctcgctccggtcctgcagtctctcctcgtgcgggacccggcggcccgccccgacgccgggcaactggacgcgatgctcgcacaggtcgaggccggcaccacaccgagttgggcccagcccacgatgacgggggcggcacgaatgcaggccccgttacctgggacgccccccacacagcaggacatccccaggcccggaccgcccactcgccgccgtaccgcggtactcctcgccgcgatcgccgccctggccgtcatcacggcgaccgcggcggcgctgaccttacacacgcgtgacgacgacaatccgaccgccggcccggccggggacacggtcacgtccgcgtcgctcacacccgcccctcacacacggccggcgagccccggtccgacgcgcagctccgcctcgtcgccgagtgcgtcgtcctcacccacaccgagcgcgtcgcggcagcccgcggccccggcggacagcggc

SEQ ID NO: 1256 - DNA, 583 bp, Unknown
  Kingdom: Bacteria, Phylum: Actinobacteria, Class: Actinobacteria, Order: Streptomycetales, Family: Streptomycetaceae, Genus: Streptomyces
cccgcggcgcctcggccgtcgcagccgccccgaccaccccgccccggcgacgcggcccgcgaggcgctgcgggcggcacggcagcaccgaccgcagcccggtacgccgaacgcaccggccgcgccgaccgccgacccctccccgcccgcaccggacgggaccgaggagccggggaacgggatcgaggtgccgaggaacgacaccgctgatccggggaacgggatcgaggagccgggggacaacgggaccgaggagccgagaaaggacccgcagccgaagggggctgcagagccgtcgccggaacaaccgtcgcagcagcagtcgtcgtcgcggccgggcgacgcggcgcgtgcggcccttcggcggacggcacagccgcccctgggcccgcagcggcccgagccgaccgccccctccgcgccggaccgccccgcaccggcgcacaccaccgaagcccgtcccgccgacatcgcacgcgaggccctgcgcgccgcacgtgcccgcagcgcaccggaggaggagcagcccgcgcggagcggggaagccgcgcggccccgggccgcccgcaccgcgcgcaccactc

SEQ ID NO: 1257 - DNA, 3577 bp, Unknown
  Kingdom: Bacteria, Phylum: Actinobacteria, Class: Actinobacteria, Order: Streptomycetales, Family: Streptomycetaceae, Genus: Streptomyces
ctcggcgacccagccggcgccgagccgttcgacgtgctccgcgctcggggcgccctcggcggccaggtcgagtgcctgggtgagggcggcggtggtctcctcgtgaccggtgtggcggccgagcaggcgcagcgcgcgcagcaccgcgccctcgacggagtcgccggcgacgaggcaggcggtcatcgcggcgaaggcgccggccgcgtagtagccggtggggtgaccgtgggtcatctgggcgcagcgggcggcgctgtcgaaggcctcctcgggagtggcgccggtgaggccgaagggcgcggagcgcatcacggcgccgcagcccttggagtcggagttgatgggtccgggcgggccgaggacggcggccgggtcgggcacgaggtcgagggcgagccctgacaggcaggcgttgccgggtgcgcggcgggagtacagccacgcctcggtgaccaggccgccgcgcgggccctcgtaggtgccgccggcgggccgggcgagtgcgcactcctcgggtccgctgtggcgctgggtctcccgccagcgctcgtaggcccagcgcaccagccggaacccgccgctgcccaggcgggtgccgtaaccctgctgctgggcctggcggatgccctcggcggtgaacagggtcatctgggtgtcgtcgctgatcagggcgacggcaccggcgtctgcgggggtggtgagcaggccggtgaggccacgcgggccgtgggtggcgcggatccggtccagggcgttgaactcgatcgggtagccgagggcgtcccctatggctccgcccagcagacagccgcgcaccctggcccggtacacggccgtcgcctccccggacggcttccacagctcgctcatgcgcccactcctccacagctgttcgactacggtcgtacgcatgaccattctcgcgaccggtgacggccgtgttcccaccgcccccgcggcccgcggcgcgggtccgctgctgcgggcctggcgggagcggcggcggatcagtcagctggagctggcgctgcgcgccgactcctcggcccggcacatcagcttcgtggagacgggccggtcccggccgagtgaggagatggtgctgcggctggccgagcacctggacgtgccggtgcgcgagcgcaacgccctgctgctggcggccggttacgcgccgcgctatccggagacgccgctggacgaccccgcgctgggcgcgctgcgggagggcctggagcggctgatccagggctatgagccgtatccggcgctggtggtcgacgcggtgtacgacgtggtgacggccaaccggggcgtggcgatgctcctggagggcgtaccggagaagctgctggcaccgccgctgaacgcgatgcggctgaccctgcatccggagggacttgcgccgcgcatccgcaatctgcgcgagtggcgcgggcatctgctggcgcagatggagcggcacatcgcgttgcaccgctcggacgcgctgcgcaccctgtacgaggaggtggccgcgtatccgctgccggaggcggccgcgagcgccgtcgaggaggaggccgccggtgatgtgccgtacttcgccctgccgatgcggatcgagcacgagggccgggtgctgtcgttcgtgtcgtcgatctcgacgttcaacacgccgatggacgtgacggtggcggagctggcgatcgagacgttcctgccggccgacccggcgaccgcgaaataccttcgttccgtgatgtcttgagcgggtgtgacacactgctgcgcggatgtcggcgcgcgtggggaggcgtggcgtgagtgaacggcggcccgcgcccaccgtggggcaggtggtgctcggcaggaggctgcaggagctgcgggaggcggccggtctcacccgtgaggaggccgcgcgggtgctgcgggtggccgccgcgaccgtacggcgcatggagctggccgaggtctcgctgaagatcccgtacgtgcaggtgctgctgacgacgtacggggtcggcgaggaggaggcggccgccttcgtgcggctggccgaggaggccaacgagccgggctggtggcagcggtaccacgacgtgctgccggagtggttcagcctgtacgtgagcctggagggcgcggcccggctgatccgttcctacgagccgcacttcgtgcccggcctgctgcagacggaggagtacgcgcgggccgtgctggaggccgggacggtcgggcagaccggtccggaggcgatcgagcggcacgtggcgctgcgcatggcccggcaggagctgctggagcggccggacgcgccgcacctgtgggtgatcgtcgaggaaacggtgctgcggcggccggtcagcatccgcggcgaggtgatgcgcgaccagctcgacaagctgctggagtacaccgagcgggaccgggtgacggtgcaggtcgcggagttcgcggacggcccgcatccggggacgtacgcgccgttctcgctgttccgcttcgccgaaccggagctgcccgacctggtctacaccgagtacctgaccggcgcgctgtacctggattcacgcaaggaggtctccgcgcacctggaggtcctcgaccacatgatcgcccgcgccgctccggccgaacgcacccggcagctgctgcgggagtgccgcgagagctactgaccccgaggaccgaggagcagtcaccgcatgaccggatcagagaccgcgcccgtccgtgtcgacaccagccgtccgcacccggcgcgggtgtacgactggtggctgggcggcaaggacaactacccggtggacgaggaactggcccgccggatcctgtccgtggacgacacggccgtccgcggggcgcgcgccaaccgccggttcatgcaccgggcgacccgggtggccgcggaggcgggcgtacggcagttcctggacatcggcacgggcatcccgacggagcccaatctgcaccaggtcgcccagcgggtcgcgcccgaggcgcgggtcgtgtacaccgacaacgacccgatcgtgctgcggcacgccgaggcgctgctgcacggctccgccgagggcagcacccagtacgtgcacgcggatgtccgcgagcccgagacggttctgcgcgcggccgccgagtccctcgacttctcgcgtcccgtcgccctctcgctggtcgcgctcacgcactacctctccgccgacgccgacgacgtgcacggtctgctccgccgctacgtcgacgcgctcgccccgggcagccacctgatcctgtcgcaggtgacgccggacctgaatccgggggcggtcgacagggccgccgcgctgttccgccggggcggcacgcccttcttcccacgttccctggccgagttctcacgcttcttcacggggctgcggctgctggggccggggatcatcccggtgaccgggtggcggccggagccggaggacgtggcggcccaggcggagggcatcgtgccggtgtacgcgggcgtggcggtcaaggactgagccacgcgctgcgggccagggccgaacggcggtcggagactggggcgcagcggtccaggaccagggcgggg

SEQ ID NO: 1258 - DNA, 3036 bp, Unknown
  Kingdom: Bacteria, Phylum: Actinobacteria, Class: Actinobacteria, Order: Streptomycetales, Family: Streptomycetaceae, Genus: Streptomyces
gagctgaacgaggcccgtccgacggaacgcttcagcaccgccatccggctgctgtccggacgggcctcgttcagctcgtcctgcctacggagccacatcggcaccaagtaggcggcccaggccccgacgatgactgcgtagatgaggccgctgctgctcacgcctcacaccgtagaggggtttacgtgaggccatcggccaattgggccggtgtgtcgcacgatctggctgatatttcgaactttttttgcgacggatgcgatcagctgaccaacaaggcggggaattccgcggcatgagccgatcggagagcgatcaaccgccgatcaaattcgaacacttattcaaatttctcgtgcctacggatacggagcgccgccagagggcgggacggcgggggatgacagccgagcggcacaaggagcggggcgccgaagggaggcggccagggaccgggaggatccggaggagtcggacgggaacaggacggcccaggtggttcaggcggggtttcccttgggtgcccggtcggcgcgggtgcgccgccagcggttcagcagtccgtcgggcacctcctccgcggtcagcgcgaagaccaagtgatcccgccaggccccgtcgatgtgcagatatcgcggccgcagcccctcctcgcggaatccgagtttctccacgacgcggcggctcgggccgttctccgggcgaatgcagacctccaggcggtgcaggcccacggtacggaaacagtggtccgtgacgagcgccaccgccgtcggcatcaccccttggccggccaccgcctcgtccacccagtagccgacgtgccccgagcacatcgaaccccaggtgatcccggccaccgtcaactgcccgaccagccgcccccggtactcgatgacgaacggcagcatccggcccgccctggcctccgcgcgcaggtgccgcaccatctggcggtaggtcggccggtgggtgatcgggccgccgggcgtgggcggcgggatggtcgcctcccagggcctgagccaggtccggttgcgccggttcacctcgcgccagtcccgctggtcgcgcagccttatcggccgcaggacgacatcgccctccgcgagcaccacgggccaggatgggctgttcagctcgcacccccggaacctgcagcgggtctgggatggtcaccgccgcgcagctggtcgacggcgtgcgtcaacaggggctccagaacggccagtccgtccttcaccccgccggtggagcccggcaggttgacgatcagggtccgcccggccacgccggccagcccccgcgagagcgccgccgtcggcaccttctgccggccgtacgcccggatggcctccgcgatgcccggcacctcgtggtcgatcactcggcgggtcgcctcaggggtgcggtcggtgggcgagatgccggtaccgccggtggtgaccacgacgtcgtacccggcctcgacggcggcgcgcagcgcggcctgcaccgggtcgccgtcggggacgacccggggcccgtcgacggcgaagccgaaccgcttcaggccgtcggcgatcagcgggccgcccctgtcctcgtagaccccggcggcggcccggttggaggcggtgaccacgagcgcgcggtacggcgcggacggagcaccgcccacctgagtgccggacgtcatgaccggctccagtcgccggacttgccgcccgtcttctcctcgaccctgacgtccgtgatgaccgcccccttgtcgaccgccttgaccatgtcgatcacggtgagcgcggcgacggagaccgcggtgagcgcctccatctcgacgcccgtgcggtccgtcgtcttcacggtggccgtgatctccacggcgtcgtccgcgaccgacaggtccagtttcacacccgacaccgacaacgggtggcacagcgggatgaggtccggggtgcgcttggctcccatgatcccggcgatgcgcgcggtggcgagggcgtcgcccttgggcactccctcgccgcgcagcagttcgacgacgcgcggcgagacgaggacccggccgctggcgcgggcggtgcgcgcggtcacgtccttgccggacacgtcgaccatccgggcggcacccgcgtcgtcgatgtgggtcagccggtgctgcgcgctgtcctgcgcacgctgcgggtcctgcgctcggtcctgcacgggtccgggggtctccccccgggaaggtgtggtcatgctctgtggcgctcccggtccgggcccggcgcggtgcggtgcgcgggcctgttgtgcgcgacacgctaccgccaaccggggccggtcagccgagcaggaccacctcgacctcggtgccgggctcgacggactcggcgtcctcagggaggacgatcagggcgtcggcctgcgcgagcgcggcgatcagatgcgaaccggtgccgccgacgggcctcacctcgccgtcggcgtacgtcccgcgaaggaactgcctgcggccgcgcggcgaggtcagtgccttgtccgccgcgagcttcgcgcgggtcgtcggccggtggacgtccggcaggcccatcagggcgcggatcgcgggccggacgaacagctcgaaggagacgtacgaggagaccgggttgccgggcagcgcgagcagcgggatgtggtcggggccgaccgtgccgaagccctggggcttgccgggctgcatggcgagcttgcggaactccactccgccgcccggctcgtcctcgtccccgacgtgcgacagcgcctccttgaccacgtcgtacgccccgacgctcactccgccggtggtgaccatcaggtcggcgcggacgagctggtcctcgatggtggagcgcagggtgtcggcgtcgtcggcgacggcgcccacccggtagccgatggcgccggcgtcgcgggccgcggcggtcagggcgaagctgttggagtcgtggatctggccgcccgacagctgctcgccgggctggacgagttcactgccggtggacagcaccaccacgcgcgggcgcgggcgcacgcgtaccgtgc

SEQ ID NO: 1259 - DNA, 1860 bp, Unknown
  Kingdom: Bacteria, Phylum: Actinobacteria, Class: Actinobacteria, Order: Streptomycetales, Family: Streptomycetaceae, Genus: Streptomyces
gcgcagcgcgggtgccatgagcccgagcggggccgccgccccgaaccacaccgacgtgcagccgtgctcacgcagcagcccggtcgcgcgccgggtggcgtccggcgtcggcagcagcatcgtcgtacggtcgcgtacgacggtgaagggctgctccgcgtcgaaggcggccgtcgcccggacgccctccgcgctccgcttccacgtggaggcgtagacgacgagccgctcggggtccagccgcagcgccatgttgtgcaggaacgcctggatgccgccggggcggggcgggaagtcgttggtcacgacgagggtcttgtgcatcgccgcagaccctatccaatccgcccacccggcccggaccccgtccgcccgcctggacggccccgtgcggcggtgctcgcctggccggggcgccgggctccgggagagcatgggacgccagggacgccgaggacggcaaccggtgcggacggacggacaggacggggagtggccgacgtggcctacgtggacgaagccggcacggcgctgcgtccggccaggctgctgcttctggccgcctgggcggtgtcccgtggggtgctgctgctcgtcgtgctcgggatgctcggctttccgggcctggacgtgaccggtgacgtgtcggtgatctaccgggactggtgcgaggtgctgcgccagggcgtcttcccgtccggcgacgtggcctggcagtacccgcccggcgccgcgctcgccgtcctcgccccggcggccctgccgttcctcggctacgccccggcgttcttcgtcctggcgtgcgcggccgacctggtggtgctgtgcctgctgctgtacggcgggcggcgggcggggcgtccgctgcgcggggcgtgggtgtggacggcgggcgcgccgctggtgggcccggtcctctacgcccgctacgacgtgatggtgaccgcggtggccgtggccgcgctgatcgcgggcgcccgcaggccccgggtgctgggggcgctggcgggcttcggggcgctgctcaaggtgtggccggtgctgctgctgacgggtgtgtggtcggcggccgggcggcgggcctggtcggccgcggcggtgacggtggccgtgccgctcgcgctgtgcgcgctcttcgtgcccggtgcgctgtccttcctgggcgcgcagggcggccggggcacggaggtggagtcgctgggcgcactcgtcctgcacgtggcccggcacttcggctggcagggcgaggtactgctccactacggctcgatggagttcatcggtcgtcacgtcggtgtggtgagcgcgggtgctcaggcgctgaccgcggcggccttcggctggctgctgtggtggcgcctgcgggcgcggcgacgtgcccggcttgctgccccctttgctgcggggcaccgcgacgggcatctccctgcgcacgttcccccgcccgttctcccgggccttcctccgcacaccgtcgcggacgccgcgttcacggcggtgctgctgttcacggtcaccagccgcgtgatcagtccgcagtacctggtgtggctggtgggactcggtgcggtctgcggatgtttcgccggcagccggatgctgctgccggtcggcctggtcctggccgccgccttcgtgaccgtactggagttcccggtgtacttcgggaacgtcgtcgcgagcgacccgctcggcatgacgctgctgttcctgcgcaacggcctgctgggggccgcgtcggtgagcgcctcccggacgctgtggcgcaccaccgccgcggggacgagcgggcggccggccctgccggaacagaccgccgcccacggcaggagcacctcccccgcctcctgacaccccagc

SEQ ID NO: 1260 - DNA, 1587 bp, Unknown
  Kingdom: Bacteria, Phylum: Actinobacteria, Class: Actinobacteria, Order: Streptomycetales, Family: Streptomycetaceae, Genus: Streptomyces
  misc_feature (487)..(488): n is a, c, g, or t
gtctcggtcgactaccggctggctccggagaccaaggaaccgggcttggtccacgactgctacgccgcactacggtgggtgcacgacaacgccgacgacctcggcgtgaaccgtgaccggatcgccgtgggcggcgcgagcgccggcggcggactcgccgccaccctggcgatcctggcgcgcgaccgcggcgaggtacccgtctccttccaactgctgatctacccgatgctggacgaccgcaccgccagcaccgtgcagccgcacccctacgcaggggagttcatctggaccccgggcgacaaccggttcggctgggcctcgatactcggccgggagcccggcggggacgacgtctccccgtacacggccgcggcccgggtggagtcggtggcgggtctgccccccgccttcatcagcgtcggcgcgctcgacctcttcgccgaggaggacatcgcctacgccacccggctgatccgcgccgggnntccatgggggcgctcggtcggcacatcggcgggtgaaggagctcatcccggaacacctcgtccgtacgacgtgtaagacgtagcgacgggggcccccgagcgcatccgcggttcgaacgacgacccagcctcggatctgtggtcgctgggcatgacgcggtacgtatgcgtcgagggccacaacccgatgcgccggccgacagcactggccaccttggcggccgtcctcgacggagtggtgccgccgcccgtccgagccggggttctggcgcctgtgctgatggagctgctggtaccggatccggcagcgcggccctcggcagagcgactcgacgcgctgctgaccgccgccgcacagagtggtgcaggcccaaccgccaggctccccgaggcgcatcggcccacccagaccacgccgatcccggccacggaacgaggccccctcgtccagcccaccgttgcacccgcgcctcgtcatgggcgcgtttggctgatcgccgtgacgtttggcgtagccgccttgctggtctggggcgtggcctacttctggagtacgacgtggtgatgccgagtccgggtcactttcccgatgccctcctgcagtgctgcggaactcagaagtgtggaccccagtgagcctcagccaacttgaaaccgcagatcaagggctggtgtgaccggccctcggggtggtcgtgctggtcgtgggcgggagtcctcgaagaagatcgtctgtcagcaccgttgggccgaagagaaagccgatgcagcagcgtcggcggagtgcgtccgagcgggtgggcctgatcgtcgccaggccgtcgcgctcggcgcgcggcacatcacgtggtcgagcatctcctgctggatgtcgagcacatcgagccgtccctccggcccgagctgcggggcgacgtgcagtgactgcaggcccgtcccggtccgatctccaggatccgctcccccggccgcggtcgcagtacggcgtccatccggtcggctgtcaggaacggcaacggcacgtcgaggaggccgcgtcgggcgtacggatagggcgccgtgtcgcccagccaccaggcggcggccaacgcggcgccga

SEQ ID NO: 1261 - DNA, 1733 bp, Unknown
  Kingdom: Bacteria, Phylum: Actinobacteria, Class: Actinobacteria, Order: Streptomycetales, Family: Streptomycetaceae, Genus: Streptomyces
cgccgcggttcctcgcgcggcggacgatcgaggaggtggaccttccgggcggctcggcccccaccgccgtggaggagccgcccgtcgtcgaggaactcccggttcccgagatcgaggtcccggagcccaccgccggccgcctgatccggctgcgcgcccgcctctcccggtcgcagaacgccctgggcaagggcctgctcaccctgctgtcccgcgagcacctcgacgaggacacctgggaggagatcgaggacaccctgctgaccgccgacgtcggcgtgcagcccacccaggaactggtcgaccggctgcgcgaacgcgtccgcgtgctcggcacccgcacccccgaggagctgcgcgccctgctgcgcgaggaactgctcaccctggtcggccccgacctggaccgcacggtgaagaccgagcccgccaccagcaagcccggcatcgtgatggtcgtcggcgtcaacggcaccggcaagaccaccaccaccggcaagctcgcccgcgtcctggtcgccgacggccgcagcgtcgtgctcggtgccgccgacaccttccgcgccgccgccgccgaccagctgcagacctggggcgagcgggtcggcgcctacaccgtgcgcgggccggagggcggcgaccccgcctccgtcgccttcgacgcggtgaaggagggcaaggagatgggctccgacgtggtgctcatcgacaccgccggccggctgcacaccaagaccggtctcatggacgagctgggcaaggtcaagcgcgtcgtcgagaagcacgccccgctggacgagatcctgctcgtcctcgacgccaccacgggacagaacggcctcgtccaggcccgtgtcttcgccgaggtcgtcgacatcagcggcatcgtgctgaccaagctcgacggcaccgccaagggcggcatcgtggtcgcggtccagcgcgagctgggcgtcccggtcaagctgatcggcctcggtgagggcgcggacgacctggcgccgttcgagccggaggcgttcgtcgatgccctcatcggggactgacggtccccgaccgcacgacaacagcgcccgccccccggatcgcgcgggggacgggcgctgtgctgtcgcgcgggccgaggggggcgcccgcccgcagcgggagaccgccactggccgggcggacgtgagcggggacgcggcggagcggcccggcgcgacgaccgtccacctcctgtggcacatcggtcaccacaaccgggccggcgacggcggcacgaccctgcacaccgaggacggggagccgcactgcgacgagcgggccggtgacgaccccaagctgctcggcgtctactccagcgccgaccgcgcccggagccggatgcaccgggcccggatgctgccggggttcgccgacgaacccgagtgcttcctcatcgacgagtacaccctggacgcggacgagtggcccgacgggttcacccgcgtcccgcccgggtagtcggcaccgccccgtagcgatcacgccggggcgtggtcacgcccgggaccggtgcgccacgtacgccagcgtgcccagcagcaggcgggcctccgggggctcggccgtgtcgagggcgggggagcggagccagcgggccgggccccggccgccgcggtcggagggcggggccgtgaggtacgtacccgggccgaggccgcgcaggtccagggaggcggggtcgtcccagcccatgcggtagagcagtc

SEQ ID NO: 1262 - DNA, 2665 bp, Unknown
  Kingdom: Bacteria, Phylum: Actinobacteria, Class: Actinobacteria, Order: Streptomycetales, Family: Streptomycetaceae, Genus: Streptomyces
tcccccccccaccggggaacgccctgaccggcgggcccctcaggagtacctcgccgcctcaggccgcgcgacccacgccgttcgcctcctcccgccacgcccgcagcaccgactccaccgcgtcagccgtgcgccgacgcgcctcgggccgtgccactctgtccatgagcagccggtcgtacggggtgtccagatgccgtaccgaagccctcaccgcgcagaccaccgccccctcggacagggcccgccccgccgcgctgcgtccgacacggccgctgccgcgcgccgaggcgtgcgccgcgacggcccgggcgcgctcggccgggcagccgggaaacagccgccgtatctccgccgcgaacgcctccgtgaaccgtacgtcctcctccgcccgccgccgcgcgtccctggcgcgccgccgacgacgtgcctcggcgtccgccaggcaccgcgcctcggcccgtgcgagcgcctcctcctccacgaggacgccctgccgttcgtagcggccgcggcgccggctgaaccgcaccaccaccgccgacagcgtgctctcctcgcgtgacctgcgggtcagcgcggtgtcgccgcgcggcaggaactgcaggtgtccgaggtcggcgcagtccaggcagcagggccgtccctcctcgaggacgagcaaggacaggggcccacggcggcatgcggcacagtgcttcctccgcacgggctgtatgacgacgaggccgtgcggaggcggaggcgggggcgggggcgcggacggagacgggccaggtacggacgggtgcgtggaccggcggggcgggagcgggggcatgggtggttcattcccgtaccggatcccggtcacccgccttcctgacttccggcctgcccggctgcctgtcttcccacctgtcgcatcatgaccatgtgcgactcgaagcgatcacctgggaacgactcggcgacctcctggtcgaacggctgctcgacctggaaccgggcgacggcggtgcctggccgcgcgtcgccttcgacggtgctcccgccgcccgcccgggcgacctggccgaacgcgtcagcgagacgctgcgcgtgcgcggcaggccgtccctggtcgtcggcgccgaggggttcctgcgcccggcctccctccggttcgaacacggccaccgggacgtggactcgtactacgacggctggctggacacgggcgccctctggcgcgaggtcttcggtccgctcgaacccggcggggacggccgcgtgctgcccgatctgtgggacccggacaccgaccgggccacccgcagctcccgtgtccggctcccgcccggcgggctgctgttgctgcacggccccctcctgctgcggcactggttcccgttcgacctgagtgtccatgtgctcctgtccccgggcgccctgcgccgccgcaccccggaggcggaccactggacgctgcccgccttcgaacgctacgaggccgagaccgacccggccgccacggcggacgtgctggtccgtgccgacgacccccgccatccggcctggaacggctgatcccccggctccggtcgtccccttctcttccggtcgtccccttctctcgccgggcgccgccgccgcgcgcccgacgggtcagcggcatgatcggggtatgacacagggcgacggatacctcctcgacaaccggcagaccgaggcgggggagcgtttcgacgccttcgcccacctcttcgaccccacgaccttccggcacctagacgcgctcggcgtgcagcgcgggtggcgctgctgggaagtcggtgcgggcggcacgtccgtcgtctcctggctcgccgaccgggtcggccccagcggccaggtcgtcgccaccgacatcgacaccacccggctcgccgtcgccgcccgcccgccggtcgaggtgcgggtgcacgacgtcggtgccgaacaaccgccgggtacgggtttcgacctggtgcacgcccggctcgtcctggtccatgtgcccgaccgcgaccaggccttgcggtccatgatcgcggcgctgcgccccggcggacggctgctgctggaggacgccgaccccgcgctgcagccgctgacctgtcccgacgaacacggccccgcggaggaactggcgaaccggctgcggcgtggcttccgccggctgctcgccgaccgcggagccgatctgtcgtacgggcgtaccctcccgcgtctgctgcgcgaggcggggctgcgccaggtcgaggccgacgcctacttcccggtcgcctcggcggcctgcgccgccctggaatccgccacggtccgtcaggtccgtgaccggctcgtcgccgcgggcctggccacggacgaggagatcgaccgccacctggccaacgtggccaccggcaccatggatctggccacggccccgatgttctcggcctggggccggaaggaatagcccctgggaaccggaaggagcagtccttcagctcctcagctcctcagttccttcaaccctttcgacttccccagctccctcagctccctcaactccgtcaaattcctcaactccctcaggccttcgaagggaccgccgtgggggcctcccgcccacacgcgccaccgccagcgctcccgcccggcaaccgtccgccgctgcggcctcgggcccggcgcccccgac

SEQ ID NO: 1263 - DNA, 1414 bp, Unknown
  Kingdom: Bacteria, Phylum: Actinobacteria, Class: Actinobacteria, Order: Streptomycetales, Family: Streptomycetaceae, Genus: Streptomyces
ttcggggatccgcggcagcagggctgagaggccggtcatgagtgaagggccgaccacttctcgtggtcggcccttcacacgtggctcagatgccgggaggtgccgccgtactgctgccgcggatccccgaagctagcgcccctgttcgtcgcgacgccgctgccagcgctcttcgatgcggtccatcatggagcgcttcggacggacctggtgtcggacgtgcggaccgcccgcgggctgttcgcccggcttgggggccttgcgccagccggtcacggccagcagcgcgcatcccagcatcaccaggaagcccaccacactcacccaggggtactgggcgatcacacctgccatgaggagcgcgatacctacgaggaagcccgcgaccgcctggtagacccgccgccgggtgtacgtacgcagcccgcttccctcgagcgccgacgcgaacttgggatcttcggcgtacagcgctcgctccatctgctcgagcatgcgctgctcgtgctcagagagcggcacggagtcctcctcatcgtgcagtcgccggggcgacccggggggtcccttcaggataggcagggaatcgcccccgtgaaacccgcccctctgcgccaattggccaaccgaaatccgccacggcggacccggctcgctgaggcttccattccccggcggccgacccgtcatgccggacggtctccttcgatcatacggcgcccagacctggatcggggggcctgtggcacactccatgcccggccaggacgccgatcagcggcccgtcccacaggcccgctcagacccccgccgcaccccgggtctcgccgaggacgtggagctgcgtggccacggagtggaacgccggcagctcggccgccgcagcctcgagctggagcagcgcgtccagcgcccccggctcggtgtccaccagcacgccgggcaccaggtccgcgaagacccgtacgccgtgcaccgcgcccaccgccaggcccgcgccctcgacgaggccggtgagctgctcggcggtgaaccggcgcggcacggggtcgctcccgccccagcgtccctcggggtcgccgagggcctgccgggcctccttgaagtggccggccagcgctcgcgcgagaacggcaccgcccagcccggcggcgagcaggctgagcactccctcggcgcgcagggcggcggcagcgttgcgcaggccctcggccgggtcgtcgacgtactccaggacgccgtggcagagcaccgcgtcgtagccgccgcgctcgaccacgtcgaagagcccgtgcacatcgccctgcacgccccgcacccggtcggcgacaccggcctcggcggcacggcgctccagtgcgaagagcgcgttggggctggggtcgacgacggtgacgcggtggccgaggcgggc

SEQ ID NO: 1264 - DNA, 795 bp, Unknown
  Kingdom: Bacteria, Phylum: Actinobacteria, Class: Actinobacteria, Order: Streptomycetales, Family: Streptomycetaceae, Genus: Streptomyces
tcggctgcggatcggtggcggccggccgggccgcgtagacgccgtcccagaacgtgaccgggttggtgctcatcaggcgctccttgtgtcggggaacgcgtccgagtcttgccggggccgccgtgatccggcacgggatcttgccggttcggcaagcagtcccggcggatgcggagttgggtgcgggcgcggatgcggatgtgggcgtcagtccgtcggcgtaccgcgcgaacggcgggacggaccgacggcgacgctcacgtgccgtcactccttccgctactccttcggcggcttgacggcgatgtccaggtagaaggcgtcgatgctgcggaccgccgcctcgaactcctccaggttcaccggcttggtgacgtaggcgttggcgtggtggtggtaggcgccggtgacgtcgtcgggcgcggaggaggtggtcagcacgacgacggggatcgtccgcaggtcggcatcctccttgacgacggccaggaactcccggccgttcatgcgcggcatgttgaggtcgagcacgatcaggtccgggcgctcgttggccgggtcacgcaggtagtccagggccgcgatgccgtcggggacctgggtgaggttgcgggtgcctcgctcggcgagggcgtcctggatgagcatcgcgtcggcgatgtcgtcctcgaccagcagcacgtcgtaggggcgggttgcggcggcagccatgattcacgagctccggggtgtggggcggtgggcgggatgtgcgctggtggtgatcagcccgggccagcggcgccgggctccttg

SEQ ID NO: 1265 - DNA, 1043 bp, Unknown
  Kingdom: Bacteria, Phylum: Actinobacteria, Class: Actinobacteria, Order: Streptomycetales, Family: Streptomycetaceae, Genus: Streptomyces
gtcctgagcgaggccgagcagcgtctgctgcgcgagtggctcacccggctggcggcggacgggggcgcgccgcaggcctgatcccccgccccgggtcgcccacggccggccgtcgaccgccggtcctcagcacaccgccgttcttcagcacctgcgcccggagttgacgcagttggcgatccggtccgccaggccacccttcatcacggcgatgaagtcgtcgtggtcggtgaccggcttgtgcagctgctcggggaagccgtcgaccgcgtacgcgttcttcacctgcccgttccggatcaccggccgcggcacgcggtacaccagccgcatcgtcagctgcgggatcgcccggaaaccggcggggcaggcgccgcgcgcgtcggcgaaggccacatgggagcggtggttggcgctgtcggtgttctggccgtcccagcagctctggaaggcgaacgagcgcaccacgtcgctgccgcgcggacagatcgggtacgtgtcggtcagctggaccttgttctcgaagccggtgcagctccagtgcgcgttggcgttggccgggccgttggtgaaggccttggcgtcaccggtgatgatccgcaggaaccgcggcatcgcgacgaccttgctccgcgggctgccgacgtacgtgatccgggcctgccgggcgaccaggatccggccggcgttgccctccttgccgccgccgtcggcgttctggtcgacgtcacgcgtgccgtcctgcacccgcaccaccggccagtagtacgccgagaggtcgttctggtcctggcagctcgtgccgccccggaggaaggtgtcgtcggaggagaacgcgtcgaccttccggttgccgacgtagtcgtgcaggtgatgcgcgccgttggtgacaccgggcgccacgatcacgttgtcggtgttgtggttgtggtcggcgttcactccgcagcgggtggtgaagctgccggtggaggcgttgcgcgtgccgcgtggctcggcctggacgtcgggacggaccttcgtgatgtcgacgaagtcggcgg

SEQ ID NO: 1266 - DNA, 5394 bp, Unknown
  Kingdom: Bacteria, Phylum: Actinobacteria, Class: Actinobacteria, Order: Streptomycetales, Family: Streptomycetaceae, Genus: Streptomyces
tgctgagcggcccggcgcccgctgcacgggcgccgggccgctcagcacccgggtcgcgttggcctcggcctcccgttcgaagcggtccgacggtgaggagaccttcaggccgtcgccgttgtcggttcccgccacgctgccccggcgctgctggacgacgtgggtcaactcgtgggcgagggtgtgccggtcggcgccgccgtcgccgacgaccacgtgattgccggaggtgtaggcgcgcgcgccgatcgcctcggcggagcgccgggcggcgagcccggtgtgcagccgcacgtcggagaagtcctcccccatgcggacctccatgtcccgcctgaccggttcggcgaggggcacaccggggctgcggagcacctgctcgacggcggagcgctgtaccgcggcgcccgcggcgccgggctgatgccggtcaggtgccgggtgaccgcaggcgtcggagtgctcgtgccgggcctgctccagcatgcggttgaccgccgcgttgccgacggaacgctgcagggcgaggagggagggcgggcgcaccggaccggaggcggcggcgggcacgcgcgaggcggcggccgctctgggacgcgcggcggcctgcggcgtcgtgtcatgtgcgggagcacccatgagggcaggtccttgtcgcggtgcggacgggcagtcgccggacaggtgtgtcgggcaggcatcgggcaggtgtcgggaaatcgacggacatccagacctacacggtggccgacccgcgcgggagtgccgcaagggcacgatcgtctgcccggacagccctctcttcccggacagccgtctctccgtaccggctcccccgacgcggcgccgccccgtccgctcccggccctctcggacggcggccttgcgcgggcaggagccctacgcggacaggagggagtcgtcctgcgggcgggcgccgggaagccggtgacgggccgcgatgagggcggcgtcgatgtcacgggtcccggtggacacgcacagcgtgtacgcgacgtcctccatgcgccggcgcgcctccgggctgccgtcctcggcgtgcaggatccgcagcgtgtcgtactgctcgatcaggttgctgagcacggtggggtgcgccatgagcatcggcagtctcccttgtctcggtcgtccacgggcggtgtacgacggcccgtgtgccccaacccccgagactccattcccctctcttcgactctcggcaagcgcggcggcgcacggcccaggcaccgtccgtcacgggcgaaaccctcccacacctgccgttagcatgttcgaactcgtgacgatcgcccgatcgcccgttcttcaccggagaagcgtaccgaccagcacgatgagcgacctctttgtccaccgtctaccaaatgggccacacaattgaagaacacatcgacacgaatatccccgcggacgaacggtgacccctcgtccgcggcgtggcgccggccgcgcgtgatgctgtgggccacggcaggcgtggtggtcctgggattcctcgtcgcactggaattcgccgcgcgccactacggcctgccgggacccatcaccaaccaggcgcgagaggtgatcttcacccccagctcggggccgctgctgtacgccggcctggccctgctgatggtggtgctcacctggcggcaacggctcatcgcggccgctaccgcgatcggcatcgacctcgtcttcctgctggtgcggtgggcggccggcgcccggatggaattcggcaacggcgccctgtgggtcgtcctcggctgcgcggtcctcgccgtcacccgccgcagcggccgggagcgcatgctgctgctgaagggtgtcgggctggcgctgctgctggtggccgggcacaagaccggcgacacctggctgctcatcacgtcgaagacgcgcccgcaggtgctcgaccagtacgtggcgaccgccgatcacgcgctgggcaacccgtcctggctggtgggccggctcgtcgaggccagcggatcgttcggctactacggcctccacctcgtgtacggtcaactccccctggccgcggccatcgtcgggctgtaccaactgcgtcacgtggccgccgagcgccgcttcccggcccatcacctggtccgcaccttcctggtcatcggcctgctcggaccggccatctacatgatcttcccggtcgtcggaccggtcttcgcctacggccccgacggcggccactgggcgacggccgacctgtggcccggcacgatgccgccgatcggcgtcccgcacgcgatgcccttcgacgagatcaccccgcgcaactgcatgccgagcctgcacacggcgtgggccacgaccctcttcatccactcccgcaagggttcacggacgatgcgccacgccggtgcgttctggctcgtcgccaccctcaccgcgaccctgggcttcggctaccactacggctcggacctcgtggccggcgtggtgttcgcgctcaccgtcgaagcggcgatgcgcgcgttcgcacgcggctgggaccggtccgccgtcctgttcgtcgcccacggcgcaacggtcttcaccgcgctcctggtggcgtaccgctggctgccgaggcagatggccgacctcccgtgggtgttcggcccgctcctcatcgtggcgatgggctcggtgatctactgctacgtgcggaccaccaagcgctgggacgcgcagcccgcgtcggcgccgctgccgggaccgcgttccggacaggaccccgcccccgcgtcccaggccaccgaaccgcagcccgagccggcctgaggggtgtcgtcgaccgtgaactggacctggttcgacctgggcggcccgatgccgtacagttcacggtgtcgacgcggggtggagcagctcggtagctcgctgggctcataacccagaggtcgcaggttcaaatcctgtccccgctacgagaaagtgaaggcccggctcccgccgggccttcactgcgttcgtcacccaccggccggcccggacaccccgccgcgcgggcacgccgtcaccgccgcagcgcttggcacacctgcacctcgctcagcccgatcgtccgggcgatcacccgcggaccgacgccccgagcgcgcgcaccgcgcaggcagccccggtacggctcatgagacgcgtggaggagcgaggggtccccgccgtgacggcccgggccgccctgggaggtgccagagggtcacgaggcgctgaccgtgaaccggctgctgaccggcgcgttcgacaccggccccggctcgcgctacgcccccgtgatcgacgaggccgtgccgcgcccgcccctggcggctgccggttcccgggcggtcgcgcctgctgatcgtccgcggatgggcctgacgttcgcgaacatccgttcccccgccaggggttgacagccggtatggccggaatatgttgcatgcaatatggcgcatgtcatcgattcccggggggcttcatgagcaactcacgcacacagcaccctgatctgcccggcgatccggcccgtgatctgcccagcggtccgcctcgtgatccgcactgcgatctgctgctgtccggcggccgggtcgtcaccgtcggggagcggcgggcggtgtacgagccgggctccgtcgcgatcagcggcggccggatcgtcgcggtcggcccggccgccgagatcgacgcgctctggcgggccacgaggaccgtggactgccgcgaccgtgccgtgctgccgggtttcacggacgggcacacccatctgttccagtcactcgcccgcggcctgggcgaaggcctgccgatctggccgtggctgaacgagttcatgtggccgtacgcgatcgccgtcggtcctgaggacgcgcgggtcgcggccaccctgggcgcggtggaggcgctgcggtcggggatcacggcggtcgtcgaccaccactacgcgcccaccgatccggagaccgtgctcgcggtggcggacgccatcgagtcggccggtctgcgcggtgcggtcgcccgcggcatgctcgggacgaagaccgacgcggcgacggcccggggcctcccggacgccctctaccggtactcgacggccgaggaactggagctgacccgggcctgcctgcgggaacggccgccaggctcgcgggtgaccgtctggccggcgccgctcaacctcagttacggggaccgggagttgacgcgaggagcggtggcactggcgcacgagttcggtacgcgctggcacacccactgctgcgagggcgccaaggatcccgcgagtttcctggacaactacggcgtgcggcccgtggagtggctggagcgggagggcctgctcgacgagcgggcgacgctcgcgcacgccatctggctcggcgacgccgaggtgaagtggatcggcgagcgcggggccggcgtggctcacaatccgccgtccaacgcctacctggcgtcgggggtgatgccgctgcgggagctgcgggaggccggcgcggtggtgtcactgggtacggacggcccgagcgcggggcaccgccaggacatgttcgaggtgatgaagcagaccctgttcacccggcggctgcacaccctggatccggcgtccgtccgggcggaggaggcgctggagatggccactcgtgagggtgcccggtacgcgggcacgggcgcgggtgaactgcggccgggcgcgccggccgacgtcgccgtcgtggcccttgaccggccgcacctggtgccgctgcaccgggtggtgccgacgctcgtgtacgcggcgcgcggcggtgacgtggtgatgacgatcgtcggcgggcgggtggtgttcgaggacggccgctgcgtcctggtcgacgaggaggcgctcttcgccgaggtgcgggagcgggccgaacacctggtcaggcgggccgggttcgagggtctgcgggtggcctggcggcactgatcgcgcaggcgccggccggggtcgctgccccggccgaggttctcatggctgcccgtccgcggccccgtacgtgtgtggcacagacgacgccccttgggcgggcggagggagaacgcacatggcattccggaaaacgcggcagacgtgtcccgacccggtggacgcggtgccggccgtgtggcggctggcggtgtacgggttgcagcacgtgctcgcgttctacgcgggcgcggtggtgatgccgctgctggtggccgagggtctcgggctgggcgccgaggacatcgggcggctggtgaacgcctcgctgctgacgtgtggcatcgccacgctggtgcagtcggtggggctgccgggcgtcgggatacggctgccggtggtgcagggcacgtcgacgacggcggtgccgtcgctggtctcggtgggtctggcggcgggcggggcccggg

SEQ ID NO: 1267 - DNA, 1842 bp, Unknown
  Kingdom: Bacteria, Phylum: Actinobacteria, Class: Actinobacteria, Order: Streptomycetales, Family: Streptomycetaceae, Genus: Streptomyces
cgcctggcgcaccgccggctgggccgggcgcccgctgcccggcgcggtgctctacgagctgcacgtcggcacgtacacgcgcgagggcacgttcgacgcggcggcgggacgcctcgaacacctggtggaactcggcgtcacgcacgtcgagttgatgccggtgtgcccgttccccggccggtacggatggggttatgacggggtgtcgctgtgggcggtgcacgagccgtacggcggccccggggggctgaagcgcttcgtcgaccgggcgcacgagctgggcctgggcgtggtcctggacgtggtgcacaaccacctgggcccctccgggaaccacctgccccgcttcggtccctacttcaccgacacccaccacacgccgtggggctccgccgtgaacctggacgcgcccggctccgacgaggtgcgtgactacctcgtcaccagcgcgctggcctggctgcgcgactaccggctcgacgggctgcgcctggacgcggtgcacgcgctggccgacacgcgcgcgtgccacttcctggaggagctgtccgcggccgtggacgcgctctcggcggacctcggacggccgctgttcctcgtcgccgagtcggacctgaacgacccgcggctgatcaccccgcgcgcggagcacggcctgggcctgcacgcccagtggagcgacgacttccaccacgcgctgcacacggccctgacgggcgagtcccagggctactacgccgacttcgcgcgggccccgctcggcgccatcgccaagacgctcaccggcggctacttccacgacggtacgttctccagtttccggggccgccgccacggccgccccctggaccgcacccgcgtggccggtcaccggctgctcggctacagccagacccacgaccaggtcggcaaccgggcgcggggcgaccggctgtccggcctcctggcggacgctcccgggctgctggcgtgcgcggccacgctgacgctgaccgcgccgttcacgccgatgctgttcatgggcgaggagtgggcggcgggcacaccgtggcagttcttcaccgaccacaccgacccggagctggccgaggccgtgcgccggggccggcggcgggagttcgcggcgcacggctgggcggaggaggacgttcccgatccgcaggacccggcgacccgggaccgctcctgcctcgactggtccgagccggaacgcgagccgcacgcgcgcgtgctggcctggtaccggcggctgatcgcgctccgccaccggctgcccgacctcaccgaccccgacctcgccgccacccgggtcgcctacgacgaggaggcacgctggctggccttccggcgcggcgacgtgcgggtggccgtcaacctcggcaccgagccggcggcgatcccgctgggcacccggccggtccgggtgctcgccgcctgggagccggtcgaggcacccgacgagggcggtctgctgcgcctgcccggccgctcgtgcgtggtcctggcgcagagctgagcgcaccgcccctcagggtgcggggccctcgcctcctcggggtgcggcgtcctcgcctgctcagggtgcggcgtcctcgtctcctcagggtgcggcgtcctcgccgtcgccgccctcctccgcgtcctcacgcagctccgtgacccgctccaggaggatcgcctcccaggcgtggcgcagctggacccgcaggagcggcagcgggctgtcgtcgcggccctccaggcgggcggcgaggcggatcacggtgtcgcagcgggccagccacaggccgcgcaggcagggccgggggccgtagccggcgagggtggcggcgcgtacggcgg

SEQ ID NO: 1268 - DNA, 4790 bp, Unknown
  Kingdom: Bacteria, Phylum: Actinobacteria, Class: Actinobacteria, Order: Streptomycetales, Family: Streptomycetaceae, Genus: Streptomyces
gcctcggtgacctgagcggccggccgccgcgcgaggcggagccgctggcccgcctcaccggcaatgcgggagtcccgcgctgacctgcgaccgcactacgcggtgacgtccttcgccgtgaaccgtgcccaggccgccgagccgaacaccgccgcgtacagcgcctgcagctccaggttcttcaccagcccgtcccagtagaccggctcgcgcatgaggtcggcgaaggacagccagtagtgcgagaagaggtacggctgcaccacgtgcagctggggtatctggtcgacgatctggacggtgatcagcaggcccacggtcgtcgccatggcggcgacaccgctgttggtcagcgtcgagacgaacaggccgagcgcggcgatgccggtcagggagacggcgacgacgacggcgatcagcagggcgcggcccagcccttccgtgaagctgatctgggtgccggagatggtcgtcaggtcaccgagcgggaagagcagtgcgcccacggcgagggccgagacggcgaccacgagcgtggcggccaggcagaagaccatggtcgtggcgtacttggtgagcagcagccgggtgcgcccggcgggggcgaccagcagatagcgcagggtgcccgcaccggcctccccggcgatcgcgtcccccgcgaccacgcccaccgccagcggcaggaagaacggcagtgtcgcggccagtgcggtgaagaccaggaacagcccgttgttggtgatctgcgtgatgaacgccggtccttcaccaccgcccccggccgacgagccgccccgcgtctggatccggacggccactccgacgaggatcggcacggcggccagcacgccgagcagggcgagcgtgcgccagcgccggaaggtggtccccagctcgttgcgcagcagcccgagggtccacagcgggttcgccccgtccgtccggcgcaccgggggcttcgtcaggcccgccgcctcagcccgcgacatcgaatccctcccccgtgagtgccacgaacgcgtcctccagcgaggcgcgttcgactccgaaaccgcggacgcggacgcccgccgtcaccagcgccgcgttgacctcggcgaggtcgccggacggcggctcgccgatcacccggtcctccgtgacggtcacgtcgcccacgccctgttccttcagcacccgggccgcctccgccgcgtccggcgtggtgaccaccagccggccgcgcgctcctgcggccagctcggccaccgggccctgggtgacgagtctgccctgggtcatgaccgcagcgtgtgtacacacctgttcgatctcgtcgaggagatgggaggagaggaagaccgtcgtgccgtcggaggccagctccctcacgagggagcggatctcccgcatgccctgcgggtcgagtccgttggtgggctcgtccaggacgagcagtctgcgtggcctgagcagtgcggcggcgagaccgaggcgctgcttcatcccgagggagtaggtccgggccttcttggcggcggccgccgtcaggccgacccggtccagtgcggcggcggcccgggcgtgccgggtgcgcgggtcggcggtcgggtcggccgcgtcgtaccgcagcaggttgtcccggccggagaggaagccgtacagggcggggccttcgatcagggcgccgacctgcgggagcacggtgcgcgcggaccggggcatgggctgccccaggacccgcgcggtacccgacgtgggctcgatgagacccatcagcatccggatggtggtggtcttcccggagccgttggggccgaggaagccgaagacgctgcccgccggaacggtcaggtcgagaccgtcgacggcgagctgcccgccgcggtagcgcttggtgagcgcgcgggtgtggatgacactgccgccggtgccgccagtgcccccttcggtgccctgaccgccgtcaccgccgccactgtccgcgccgtccatcggctccctcgctccctcgtgcccccgggcgcgcttactgcccgctgtccgccgccttcaccagcgcgtccttggtgacggcaccggcgtagaccttgccgtcgtccgtgatcagcgcgttgaccaggcgggtggagaagaccgtgcccttgccgaacttgccgctcacgtggtcaccgagcgagcccaggaagccgctcaggtcaccgctgccggagcccgccggaaggccgcccttgttgccggtgtcgaaggtggcgatggagttccagcccttgccgatgaccttcacgccgtccttggcgagtcccttgtcctgggagaagcccttgggcggggtgaggtccttgtgcggggcgccgggcttgaaggcgtgctcgcccgccttgccgtccttctcctcggtgatcttcgcgcccttgggcggggtgaagtcgaacgtggaggcggccggctcggtgaagctgatctgcgtgaagcccgcgtcgagcacggcggcgccgccgctcgccggggtcagcgtgaacttcagcggcagcccggtcttggagtccaccgcgatgctgatggccccgacggtggtgcctgaggcgtgcttgggcttgatgaccagcttgtaggcgtcccgcccggcgacgtgcgcggtgccgtcgaccgtgaccgaggtggtgtcgtcgaccgatttcagggcctcgtcggcgaagtccttgggcgtggcggggaccttctggtccttgcgctcggcgccgtcctggggggcggtgccgtggtagacctcgttggacttgctgtcgtagccccagacgtccttgccgttgtggacgaggctgtactcggcggcgctctcgatcagggagagcttctgccggtccgggccgtcggccgcgacgcgcacggtgtgcgtcccggagagcagctcggtgagcttggaggtggggtcggcggacgatccgtcgccgccgcccttgacggcgccggaggcgaggctgctctccagaccgccgaggttgggcaggccgaggtcggtgctgaccttgaccgtgccggacagccgctggacgtccgacttggcgatcttctcgatgagttgctgtgcgctgatcttcggcagatcggggtcaccggagtcggcgagtgccgggacgagcccgatggtcgccgccgccacccccaccaccgcgaccgggacgacgtaccgcgcggccttgcggcgcaccgagtgcctgccgtcggcctccacggtgtccctgttgtcgtcggattcgtacggtgccatgtgtgccttacctccgtcgtcggcggcggctgcccgtgtgcactgctcccaccccaagccgccattctcacccgaatcggtgaggagtggtgcggtccgtgcttccatctgaccaaatcggcggcgcgaaagcgtcagaccccggagccaactccgtgtacctctgcggtatgacacgaaagggcggcgcctcccccatcccgtaggggacagggtggagacgccgcctctgcgaggtgaagatgccgcctctgcggcaggggcagagccgggctgggcaggccggtcgccgtggagggtggggcgggctagccggcccggtgcaccaccgcgtcgcacagctggagcagcgccgccttcgcgtcgcactcgcgcagcggcgccagcgcggcccgcgcctcctccgcgtaccggacggtgtcccggcgggcctgttccagggcagggtgcgcgcgcagcgccgccagtgcctcggcgtgccgggcgtcgtcgctcaggtcggagtccagcagttcgcacagcgcgacgtcctcggcgagacccaggcgggcggcccgctcgcgcagccgcagcaccgggagggtcgcgatgccctcgcgcaggtcggtgccgggggtcttgccggactcgtgcgagtcggaggcgatgtccaggacgtcgtcggccagctggaacgcgacgccgagtcgttcgccgtactgggtcagcacgtccacgaccgtctcgtcggccccggacatcatcgcgccgaaccggcaggagacggccaccagcgagccggtcttgccgccgagcacgtccaggtagtgctcgaccgggtccctgccgtcctgcgggcccgccgtctccaggatctgcccggtgaccagccgttcgaacgccagggcctgcacccggacggcctcggggccgaggtcggcgaggatctgcgaggcccgggcgaagaggaagtcgccggtcaggaccgcgaccgagttgccccagcgggtgttcgcgctggccacgccgcgccgcacggcggcctcgtccatcacgtcgtcgtggtacagcgtcgccaggtgggtcagttccaccaccacggcggacggcacgatgcccggcgcgtaccggtcgccgaactgggccgcgagcatcacgagcagcgggcggaaccgcttcccgcctgccttgacgaggtgctgagcggcctccgtgatgaacgggacctcgctcttggtggcttcgagcagcccttcctcgacagccgccaacccggcctggacatcggcttcgagagcctggtcccgcacgctcagcccgaacggcccgacgacggtcacgaggggtctcctgtctgctggtgtctgctggcggttacgcggtttgtcgataggtcgctgccatcactcaagtcagcgtatccggtcacgtttcgatcaccgatagcgcccaccgatacaggccaggtggtatcggatcacgaccgatatgttttcgatcaccacgtatgaacagatatttatcgactcactcctccctaccccgccccctccctgcc

SEQ ID NO: 1269 - DNA, 731 bp, Unknown
  Kingdom: Bacteria, Phylum: Actinobacteria, Class: Actinobacteria, Order: Streptomycetales, Family: Streptomycetaceae, Genus: Streptomyces
ggtcgggactcgggagacgggctcgggggctggacgcctggcgggtggtgggccgatcgtggtcgggatgaccgaccaaccacgccccagaggcctcaccgaccccactgagctcacgaagcccctgatcccccgttccgccgagaccgacaccgaggccgagaccgcgaccaggaccgggacctccggcgcgaccgggccttccgccgagcccgctacctccgccgagaccgaggccggccaggtgcggtgtttccaggagcggaacgggctgcccgggctcgtcgacgtgcacacgcacttcatgcccgagcgggtgctgcgcaaggtctgggactacttcgacgggctcggcccgctcaccggcggcctcgagtggcccatcacctaccgcgaggaggagcaccagcgcgtcgcgcggctgcgggagttcggcgtgcgggccttcaccgccatgctctacccgcacaagcccggcatggccgagtggctcaacggctgggcggtcggcttcgcccgccgtacgcccgactgcctgcacacctcgacgctcttcccggaggaaggcgtccacgcctacgtccgggaggccgtcgaggcgggcgcgcgggtcttcaaggcgcacgtccaggtcggtgcgtacgatcccgccgacgaactcctcgacccggcctggggcctgctcgccgaggcgggcgtcccggtcgtgatgcactgcgggtcggggcccg

SEQ ID NO: 1270 - DNA, 1667 bp, Unknown
  Kingdom: Bacteria, Phylum: Actinobacteria, Class: Actinobacteria, Order: Streptomycetales, Family: Streptomycetaceae, Genus: Streptomyces
gctggacggcgcccgcctgctggccctggacgcctcggcaccccacgaaccccacgtcgcccgcgtacggcgagcggcacccgtccccaccgtccccacctcgccggtgcccccgccggtcgttgcttaggagtgagcgtgcgccaactcgacctcgtggtggtcgtcgtctacctggtggcgatcgccgtgatcggactcaggctggccggccggcagaagaccgcgaaggactacttcgtcggtgagggccacatgccgtggtggaccgtcgcgttctccgtggtggccaccgagaccagcgtgctcaccgtcatcagcgtccccggcggcgcctacagcgggcagggcttcggcaacgtcgaactggccctcggctacgtgatcggccgcgtcgtcgtggccgccgtgctcatcccgctgtacaagcgcggcggattcgtcagcgcctaccagtacctggggagccggttcgggctgaaactgcaggggctcgcctcggtgaccttcgtcttcacccggctgctcgccgagggtgtacggctgttcgcctcggccatcccgatcaagctgctgctcgacgagttcggcgtgcacgccggctaccgggtcatcatcatcgccgtcaccgtgatcaccgtcgtctacacgtacctcggcggcatcgaggccgtcatctggaccgacaccatccagatgggcctgtacgtgggcggcgcggtcctcgccatcgccgtgctgtccggccacgtcggcggtgccggcttctcggacgcgctgcacgccggccggttcaagctcttcgacaccgacttcggcctggcacacgtcctcaccagctccttcgccctgcccacggccatcatcggcggtgccatcttcgccatggccagccacggctccgaccagctgatggtccagcgcatcctggccacccggaccctgcgcgacggacagaaggccatgatcgcctcgggtgtcttcgtcaccctccagttcgcggccttctccctcgtcggcgccctgctgtggtcctacaaccagggcaagggcttcaaggaactgggcctgaacagctccgacaacctctacccggagttcatcctgcacgggctgcccgtggtgatctccggtctgctcgtggccggcatcctcggcgccgcgatgggctcgctgtcctccgcgctgaactccatgtcgaactcgaccgtcgccgacatcatccacagcttcttccgcggcacgccctccgaggagttcctgctccggctggcccgggtgatgaccctggtgtgggcggtactgatggccgtcttcgcctgcgccttcagcaccagcaccggaaacgtctacctcaccggcctcaccatcgcgggctacacctacggcgcgctgctcggcgcgttcctgctcggccggatcgtccggcgggcgagtgaagccgacgcggtcgtggcgttcctggtgacggtcggtgtgatgacgtacatcgtgcgcgaggtcaagatcgacgtcaccgtggccggcgccacggtgcccaccgggatcgccgcccagtggctggtgcccatcggcgtgctcgtcaccctggccgtcggcggtctgatgagcctgttccaccgcgcgccggcccccggcgaaggggacggcgcgcggtggaacaggct

SEQ ID NO: 1271 - DNA, 2204 bp, Unknown
  Kingdom: Bacteria, Phylum: Actinobacteria, Class: Actinobacteria, Order: Streptomycetales, Family: Streptomycetaceae, Genus: Streptomyces
  misc_feature (2056)..(2057): n is a, c, g, or t
ccccccaccgctcggcaccgtgcccccccaccgctcggcaccgtgcccgtctccgtatcgagcaccggacctgtctccgcgcccagcgacggctccccctcagcgtcgcggttcccagcggaaccaccgccgtacagcaaacaccgcgagcgccagccagaccagcgcgacggccagcgcccgcaggacctcgtacccgctcagctcgccggtccagccgccgcgcagcagggtgatcaccggtgtcagcggcagcagttcgcacaggtgggccaggcggtcgggaaggatctccagcggaacggcgatcccggaacccatcgccgagatcatgatcagcgggatcgaggtgacctgggcgctctccgtggtccgggtgaggccggccgtgaccgccgccagggtcaggcacagcgccagtcccagcagcagtccgagcacggcgaggtgcggtgcgcgcggggcgggcacgtgcagcagagccgtgcaggcggccgtgaggatcactgactgacacaggcccgtgacgacggcgggcagcgcgctcccggcgaggatctcggcgtcgcgtggttcaccggtgcgcagccgcttgaggacgagttgctcgcgccgggcgacgaacacgccgacgagcgtggagtacacggcgaacagcagcgagacgccgatggcggcgggcagcatgacgagccccacggtgagcccggcgtccttgaggttcatgccccgggccgccgagtgcaggctgaacggcagcaccagcgggacgaacacggcggcgacgagggtgcccctgctccgtacgaacagggtcagttcggcgcgggcgagcgcggtcatgcggctcagcggagtgctggggccgccctgccggtgcggcgcctgggtggtgagggtgctggtcatgcggcgtactccgtctccttcgacgcggacgcggacgcggacgtggacgccgtccgtgcggacgcctcccgcgcgatcccgaggaacgcctcctccagggaggccgaccgcgcgtccaggcgccccagttcgatcccggcccgccgtgcccagagcagcagttccgtggcggtccgctgcaactcccgcgtgcgcagccgtacgacgcggccgtcctcctcgtgcccgcacacgcccagggcgtcgagcggcggaaggtcacccaggaagtaacccggcggcaggtggaaggagatccgggacggctgagcggccgtcacctcggcggggcttccggtggcggcgatgcgtccctcgtgcaggatcgccagccggtcggcgaggccttcggcctcctccaggtagtgcgtggtgagcagcacggtcgtgcccgcgtcgcgcagcgtccgtaccaggtcccaggtgtcccggcggccctcggcgtccagcccggtggtcggctcgtccaggaacagcacctcgggctcgccgagcagcgcgagggccaggtccagccggcgccgctcaccgccggacaactgcttgacccgtacgtccgcgcgccgctccaggccgaccagggcgagcgcctcgcgcgggtcacgggcaccgctcacgcagccggcccacatccgcatggtctccgcgacggtcagttcggaagggaagccaccctcctggagcatgaccccggtacgcggccgtacggcggtacgctcggtgaagggatcgtggcccagcacccggacgcgccctccggccggtgccgccagtccctccagcagttcgaccgtcgaggtctttccggcaccgttggtaccgagcagcgcgaagatctcgccgtgtttcacgtgaaacgtgatgccgcgtacggcttcgaacccgcccccgtacacgcgccgtaggtcggtgacctctatcacgtgctcgtgttcgttcctgttcatgacaccagcgtcgcggtcggcacggctccgcagcagtgcgcggtgtcatcgaccgaaatgacaaatgtcagtcggacgcgcagggcaggtaggtgagcggacacgaaaagaccccggtccagtggaccggggtctcattcccgagcggacgacgaggctcnnactgagctacgtccgcattgcctccgaccggctttcaccgatcggtgcgagcaccagcctacctgatccacttgcgtggtcggaacggcgatgcagagcgggtgacagggatcgcacactgcgccttccccctggaagggggatgtt

SEQ ID NO: 1272 - DNA, 2666 bp, Unknown
  Kingdom: Bacteria, Phylum: Actinobacteria, Class: Actinobacteria, Order: Streptomycetales, Family: Streptomycetaceae, Genus: Streptomyces
cgccaccgctccccggagaccggccgcgtccgctaccgctgctcctcagacagccgcgcccgccaccgctccccggagaccggccgcgtccgctaccgctcctcgggggccagccgggccgggaatccgccggtggcgaccggaccccaccgctccggtgtgatgcggatgatcgacttcccctggtcgagcatcgcctgtcggtactcgtcccagtccgggtgctcgcccgcgatgttgcggtagtactccacgagcggttctacggagtccggggcgtcgacgacctcggccgtgccgtcgatctgcacccacggcccgttccactcgtcgctgagcacgacgaggctcacgcgggcgtccctcttggcgttgcgggtcttggcccgctccgggtaggtggagacgacgatccgccccgagtcgtcgaccccgcaggtcagcggcgaggcctgtgggccgccgtcggcgcgccgggtcagcagcagggcgcggtggcgcgggcgtacgaagtccaggagttcctcgcgcgagacgcgggtgttggtcgcgatgctgggtgccatgggggcagcctaggtcctgcggtccgcaggggcccgctcaccggcgcagcgcctgcccggcgtcgtcgtacacgggcacgtccctgcgtacgccggtgacctccaggacgcggctcgggatgccgtacgggagcgccgcgacccggagccggacgtgccggggcagcccgtcgcgtatgtcggtcacgaggcgggcgccctgggagtccatgaagtcggtgtgcgtgaggtccaggaccagcaggcgcagccgcgcggcgcgggcggccgtgaaggacagcacccgggcgcagagcgcgggggcgttggacaggtcgatctccggcggcaggacgagcagcgcgcgggcgggcgtgtcacgcacccggctcgggctcgggaagtgggtcatggccatggctctcacctgcgaagtaggcagacatccgtccggtccagggctgtccgtcaggcggacgctggacggggccgcttcctgacccgtcgtcctccattgcaccaccggcgggcgccggttcccagaggccggggccgagcacccaccaggcgtaagacacctggaagaacgagataaggttctgttcgtcctgtgctcgcagtcgggaatgtgctgcggagctctcctgcgcatggccgtgatgccgtgcatgccgaagaggttcgtggtgcctgcgtccgacttttctgaattgccccgtttttcgggggacatcgagctgtccgaagccctgacggtggcggctcagcaactgcacgacacggacagcccgcacaacaccatgcgcactgccgtccggctcgccgtgcacctgctgccgggcgccgagcacgcggacatcgcggtgaccgaacgcggcggcccgcgccgcacggtggcctggagcgacgacgtggtccgcgccgtgggcgcgccgcacggcgacgacggccgcgagcaggctccccagcggacgccgtactgggacgggctgtggcacgcgcccgtggtggcggtgaccgacagcgagaccgaggacggctgcgcggccctggccggtgcggggctgcgctcggcgctcgcgctgcggctgcgcgccgagaagcggcggctgaccgtgctcacggcctactccggcaagccgcgtgccttcgacgcggcggcgacccggatcggccggctgttcaccgcgcacgtgagtctcgccctggactcggcgaccgtgcgcgagcagctcaccgaggcgatgcgcacccgcgacctgatcggccaggccaccggcatcctcatggaacgcctggacatcgacgcggccgaggccttcgacagcctcgtgcgcgcctcgcagcgggagaacgtcaaactgcgcgacctggcccgccgcatcgtcgacacgaagaacgtcatgtgacgacggacggcgggagcggggcgcgcggcgcgggccgtcaggccgcgggcagggactcgccctggacggcctggatgtccagttcgaccttgagggtggtgccgatggcggcgatgccggcctggaggacctggttgtagttcatggcgaagtcctcgcggcgcagttcggtggtggcgcggaaggcggcgcgggtgccgccccaggggtcggcgccggtgccgaggtaggcgaggtcgaggtcgaccgggcggacgatgccgtgcatggtcagttcgccggtgaccgtccagcggtccgagccggcggcggtcagggcggtggagcggtaggtgatctccgggtactgctcggtgtcgaggaagtcggcggacttcaggtggccgtcgcgcatggtgttgccggtgtcgatggagccggcccggatgacggcctcgacccgtgacttggtgacgtcgtccggggcgatctcgatggtgccgccgaagtcggtgaaccggccgtgcacgctggagatgcccaggtgctgtgcgaccgcggcgaccgaggagtgcgccgggtcgatggtccagggtcccggcggtggcagttcggtgccgccctggcgggccagtgtcacggtgcccacctcggcccggccgctcgcggtgacgatcgcgctggaggcggcgggcgcgtatccgacggcggtgacgatgacggtgtacgcgcc

SEQ ID NO: 1273 - DNA, 1756 bp, Unknown
  Kingdom: Bacteria, Phylum: Actinobacteria, Class: Actinobacteria, Order: Streptomycetales, Family: Streptomycetaceae, Genus: Streptomyces
ctccccgcgggccgcggccgcctccgcctcggcgcggatgaggtcgatccagcgtgcgcggcgggcgaggtgctgctcctccagccgggcgctgacgccgatgacctcgacgaaggcggtgggggtgcggcgcggatcgccggtgacgttgcgggcgtaggcgcggaagagcacggtgacccgctgggccagcggcaggcccgcggcccgacggccgaccgcatggccgtggtcaccgctgcagggcgcaccggtaggcggacgagcagcacccgctcgtcctgttcaccgtcggtgtccgcctgctccgcagccgtccaggcgggcaccagttcctgggcgcgctccagcgccgcctgccgtcccatgcgccggctactgatgtcatggacgagggaggaggcgagatggttgtgttcgcgggggtgctgccagctgtcggcagctttgctgttccaccggtgccacagcgatccccactgcctgcccaccaccgccgggtcacccagcggcgcgagcaacggatcctcggtcggcagctccggatgtccatggccgcgacaccggctgccgccttcagcgcgtcctgggcgaccagctgaccggcctgccgctgcagcagggcgacatgagaggccttgagccgcataccggcatcagcccaggacgtcagccagggaaacggggcgaggagttggtgggcccggtgcaagctggcggcagcgctgcgccactgctcgaagaccacggcgcgcacctgctgggcttcttgccgcgcacgccagtcgtcctcctcgtcttcgtccccagtcttcccggccctcgtgcgggcccgcaggagcagggcagctgcctgcttcacctcgttgtcggtgacggagtcttcgtccgcttcgctgtagctgccgagctcgtgcagcaggcccaggccggtcagcgcgcccaggaagaggcccacccctgtgccgggccgggcccatggcccgtacctggcgcactgcggacatgtccgctcgaccaccgtccgcagcggcaacgcgcaggagctgcggccctgacggctccctcagcgcaggatcggacaacggcccgacctcgacggccgcggggcgcaggaggtggtgccccgctcgagagctcccaggtacacgagggcacggccgttgccgggcccaccgtcgaaggcaggagcgcatcgggactggcccgccgagctggaggccggccgactgtggctgtctgcttcgtcgtcctcggcgggtgtcggccaggtgcctgggcgggcagggtcagatgagccggtcgcggttgtgggcggcggtttcacggacgagctgggcgaagcgttcgcggctgcggttctggtgttgttcggcctgttcgtcgtcccattcctccacgccgtgggtgccggcttcctcgtcgtggttgaggtcgtcgtactcgtcgtgcagcagccagcagctgtgaatgcccgtaagaaggtcttcgaggagatctcgtgcgggacgctgggggtcgagaggggtcagacgcagagcgacgtcactgaggtcgggctcgtcgtcgccggtgtactcggtgagtgtttcctccaggtcctccaactgctcccgcaaggcggtggggtcgggcagcacgccgtcggtgacgtgcatggcatggcggacaaggctggtgacggcttggtgcggggtggcgccgtcgtggatgaggccgaggacggacgggcgggcgggtacggcttccccgggtg

SEQ ID NO: 1274 - DNA, 2727 bp, Unknown
  Kingdom: Bacteria, Phylum: Actinobacteria, Class: Actinobacteria, Order: Streptomycetales, Family: Streptomycetaceae, Genus: Streptomyces
agcgggtcagcgggtcagcggtggacgctgctcgcgcggggcgccgcccggctcgtcgtccctgatcacctcgcccgggacgaccttgccgtcggggcggtgcatgcgggcctgctggaaggcgtcgcccagagtgcccggggcggcctcgcggagcctgcggtccacggtccgctcggtgaaccggcccacggcccgctggacggacgggaccagcaggagcagtcccagcgcgtccgagatcatgccggggatcatcaggagcagaccgccgagcatcatcaggccgttcccgccgcgccgggtggacggggtggcaccgcgctggatggcctcgttgaggttctggaaagcgcggcggccggcccgcttgatcaccacggcgccgagcacgaaggcggcgaccagcagcaggaacacggtgaagcctccggccgcgccggccaccagcgtcagcagccagatctccagcaccagccacacggcgacggccagcggcaggaacctgcgcagccgcgagcgccggggcctggtggagtacggagaggtcggagcgcctgtcgtcatgctcccagtgtgcctgggcgcggctcagcacgggataagagggttgcccgccgccccaccgggcagcgggcgagcgcctgtcaggcgggagcgggcgctacaactgcgggccaccgccccggccggtgagcttggtcacgcgctctcccacgccccaggaggtgacccgccaaagcgcctccgcgacgatgtcccggctcatcttggagtcgccgagttcccgctccacgaacgtgatcggcacctcgacgacatggaagccggccttgatcgcgcgcctggccaggtcgacctggaagcagtacccctgcgaggcgacctcgtccaggcccagcccctccagggtctcgcgccggaacgcccggtagccgccggtcacgtcgcggatcggcacgtcgagcatgaggcgcgagtaggtgctgccgccgcgcgagaggaactcgcgggacttgggccagttgaccacgcggccgcccggcacccagcgcgagccgaggaccaggtcggcgcccttgagggcggtcagcagccggggcagctcctcgggctggtgtgagccgtcggcgtccatctcgaccagcacgccgtagtcgcgctccaggccccagcggaagcccgcgaggtaggcggcgccgaggccttccttgcccttgcggtgcagtacgtggacgtgcccgtcctcggcagccagctcgtcggcgagcttgcccgtgccgtcggggctgttgtcgtcggccaccaggacgtgcgcctccgggacggccttgcgcacccggcccacgatcgtcgtgatgttctccgcctcgttgtaggtcgggatgatcaccaacgcggtgcccagcgggccgaaccgcctctcctgggacccagccgcgggggtgccgtcgccgtggttcactactgccccttcatgtccgtacgcaggggaccaccatagtggccagggcctgcgaggatgtgacaccacgtccgttcggtggtgtcgattagaccagagctgggtaagaatcttcttttcggaatgtgggcccggcgcccttcgggccgacctggtacccgctggctgcggatcgaccgaaagccgttgtctactgagcgaccgggccccacccgggtcacaccctgccgaccgtccggaaccttcccccgccgacgcggacgctgagcctggctcccagtggcggtgacccggtgcggcacaccgtccctgacccagcggcactgcgacgcgggtacggaagttccccggtcgggcgtccggtggtggacccggcagaacctaccggccccctgcctccgcctgtcaaacagcggcacggcccggcgggacgcccggcgccgcccggccggtgccgaggatgcgcaggtcgcgcgagcgggcggcgggagatcaacaccgccgcgccgcaccgggagatcactcgcccggccgtacgaagacggtccggccgcccaccacggtccgcaggcagacgggcaggtcacggccctcgccgaggtcgggcaggccgggcgtgccggagcgcgggtcggtcgaccagcgcgcgacgcggtcgtccggggcttggacgaccagctcaccggtgcgccacacggcgtagtccgccagggcccccggcaccagcacgccggcgtcgtcgcggccgatggcgcgccagccgccgcgggtgtgggcggtgaacgcggcccgcacggagacccggtgctccggggtgcggtggaaggccgccgcacggaccgtgccggcggaggcctcgtcgtccaccgggtggatcgcgccctccgtgtcgcagacccgcaccagccgcagccggttctcggtcagcgtgcccgtcttgtcgaagcagagggtgtccatccgacccagcgcctcaagcgtgcgcggggtgcgcacgagcacgccgtcacggctgagcctgcgggccgccgccagttgcgccaccgtggccaccagcggcagcccttcgggcacggccgccaccgcgaccgccactcccccgctgaccgcgtcccgcacgggcgtgccgcgcagcagcgccagaccggtcaccgccgcacctccggagagcgtcaacggcagtgctttacgggtgagttcctgcagcctcgcctgtacgccggcggcgggcggagtgcgggcggcgtacaggcgaggctgca

SEQ ID NO: 1275 - DNA, 1131 bp, Unknown
  Kingdom: Bacteria, Phylum: Actinobacteria, Class: Actinobacteria, Order: Streptomycetales, Family: Streptomycetaceae, Genus: Streptomyces
gcagtgcagcagcgtggacttcccgctgccgctcgggccggtcacggcgacgatctcgcccgcgcccagctccaggctcgtcccgcgcagcgccggtgtcctgccgtatgccttgacgagatcccgtgccactacaaggggcgccggatggttgctcatgctcggtcgacctccgcggtcagagcggtcagagaggtgagccgggcctgcgtggtggtcatccagcgcaggtcggcgtcgaggtggttgagggcgtagtccgccgccagcacggtcgccagaccggtgtccggggcggtcttgagcgcggtcagttcccgcatccgcgccatgtgggcggcccgctgcgcgagcaggtgggcggccggatcgccgccggtgaggatggcgacgacgaccttggcgaagatctcgttcgtcacgaacggcgctggcggggtgacctgcccggcccagtcggccacctcccgggaaccgtcccccgtgagccggtacagcgtgcgctccgggccgccgtcggcgtcggtgccgacgacctcggccagaccgtcccggaccagccgctgcagtgtcgtgtagacctgcccgtaggccagcgggcgggcctgcgggaagtgctcgtcgtgccgtcgtttcaggtcgtagccatggctcgggccgccggcgagcaggcccagcaggacgtgacgggtgctcatgggactcagtatgtaccgcgtatatgtactgagtgaataggcgcgcgcgggttgtccggccgaggggggagtcgtgacggagccgtggcggagtcgcgatggtgaatggtggcgctgtgccgggtttgcccggatgaggatggcggggaatgtgaccaggagcacgtagttcgcattggtgcgcctgccctcgcgcgcactgggtagggctgcggtaatccgctcgatgccgcacctcgacaaggagacccccgtgaccgcaccggcccaccttctgctctcggctctgaccgacaccgccctgaccgacaccgcactctccgacgccgcgctcgccgacaccgcgctccccggcaccggcctgtccgatacggcagggccggacgccgccctgcccaaacccggggcggagccggccctgccgtatcggaca

SEQ ID NO: 1276 - DNA, 2334 bp, Unknown
  Kingdom: Bacteria, Phylum: Actinobacteria, Class: Actinobacteria, Order: Streptomycetales, Family: Streptomycetaceae, Genus: Streptomyces
ggcggccggctgcgcgcggccccgcgcccggcgcgagctggacgcggagggccttgtcctctcccccggcttcatcgacatgcacgcgcacagcgatctggccctgctgcgcgaccccgaccacagcgcgaaggctgcccagggcgtcaccctggaggtgatcgggcaggacggcctgtcctacgcgccggtcgacgaccgcacgctcgccgaggtgcgccgggcgatcaccggctggaacggccacggcgacgacatcgacttcacctggcgctcggtgggcggctacctggaccggctcgaccacggtttcgacggccagggcatcgccgtcaacgcggcctacctgatcccgcagggcaccgtgcgcgccctcgcggtcggctgggaggaccgcccggccacgccggacgagctggacctgatgcggcggctggtcgccgagggcatggagcagggcgcggtcggcatgtcctccgggctcacctacacgcccggcatgtacgccgaggacgccgaactgaccgagctgtgccgggtggtggccgcgcacggcggctactactgcccccaccaccgcagttacggcgccggggccctcgacgcctacgaggagatggtggcactgacccgggcggccggctgtccgctgcacctggcgcacgccaccatgaacttcggcccgaacaagggccgggcgcccgagctgctggcgctgctggacgacgcgctggcggcgggcgccgacatcaccctggacacctacccctacaccccgggctgcaccaccctggtcgcgctgctgccgagctgggcgagcgagggcggcccggagaggatcctcgaccggctcgccgacgacgacaccgccgagcggatccgccaccacctggaggtcaccggctcggacggctgccacggcgtgccggtggagtgggagacgatcgagatctccggggtgaccgagccggacctcggcgagtacgtcggccacaccgtcctggagtcggccgaacggcgcggcgagagcccctggacggtcgcccgccgcctgctggccggcgaccggctcggcacgacgatcctccagcacgtcggccacgaggagaacgtacgggcgatcatgcgccaccgggtgcacaccggtggctccgacggcatcctccagggcaccaagccgcacccgcgcgcctacggcaccttcccgcagtacctcggccggtacgtgcgggagttgggggtgctgtccctggaggagtgcgtcgcgcacctcacctcgcgcccggcggcccggctgcggctgccggaccgcgggctcgtccgcgaggggtaccgggccgacctggtcctgttcgacccggccacggtcgcggccgggtcgaccttcgagcagccgcgcgtgctgcccaccgggatcccgtacgtcctgatcgacggccggttcgtgatcgaggacgggcggcgcacggacgttctggcgggccgggcggtccgccgtactccgctgtgaccgtgcgccctcgcggggctagggcttgggcaggacgcagccggccgcgttcaggttcagccggttgccggtcgtgaagcaggccgggatctggtaggtctcctcggcgtagttgatgccctggcggacggtgacgttgccgctctggtcgacctcgcaggggttgttctcggtgcagcgctcgccgtcctcgttgccggtgttgttgacggcgacgaccttgccggtggcggtgtcgatgacgggcgagccggacgtgccgccgatggtgttgcaggccgaggtgtagcggacggagtccttccaggtccagtcgccctccttgagccggtagacgaacccgtcgacgttgcagctgtaggtgcgcttccagtagccggagaccaccttgatggcggtgccggcgaccggatgggtgtcgctgacggtcagcggactgatgccgtaggagctcctgatctgcgcgtaggtgcgggtgagctggtagatcgtgacgtcggtgtcggtcatcgtcgagtagacgaccttgttggcgcgcagcgtcgcgacctgggagccggcggagttcagcagcccgaaggagcggctggaggactggccgacgatgacctcgccgggcgacgggaagccggtctccaggcagtggccgttgctgagcacgagcgccgggtcgctgtccgcggaggcggggaagcggatgaccgagccggagcagttgctcagcgccacggtgccggcgaagtcgacggccttgacggcgggcgcgctccgcgcaccggcgggcgcggtgctccccgtccgtgccgcggcagccgcgggtgcca

SEQ ID NO: 1277 - DNA, 1092 bp, Unknown
  Kingdom: Bacteria, Phylum: Actinobacteria, Class: Actinobacteria, Order: Streptomycetales, Family: Streptomycetaceae, Genus: Streptomyces
  misc_feature (389)..(390): n is a, c, g, or t
tgcccgaagggagcgtggagccggaagagccgccctcggaggcggccgagccggtggcgacgggtgcgccgagcgatccggcgagcgtggccgggccggtggtcgtggccgcggcggtggccatggtcgagacgggcgttctcgccgagtcggccgagccggccggtcctgccgagccggtggcgcccgaagcggacgacaccgacgacggtgtcttcaaggtgcggctcgcgaacttcgaggggccgttcgatctgctgctccagctgatctcccggcacaagctcgacgtcaccgagatcgcgctgtcgaaggtgaccgacgagttcatggcgcacatccgggccatggggcccgagtgggacctggaccggacgaccgagttcctnntgcccgccgccgaggtggaggacgaggccgacctcgccctcctggaggcccgtgacctgctcttcgcgcgcctgctccagtaccgcgcgtacaagcagatcgccgacatcttcaacgggcggctcgacgaggaggcccggcgccatccccgtaccgtcgggctcgaaccgcaccacgccgagctgctgcccgaggtcgtcatcagcatcggcccggaggggttcgcacggctcgcggtcaaggcgatgcagcccaagccgaaaccgcaggtgtacgtggaccacatccacgcgccgctggtcagcgtgcaggagcaggcggggatcgtcgtcgcccggctgcgggaactgggcgaggccagcttccgcacgctggtcgaggacaccgacgacaccctgaccgtcgtggcccggttcctcgcgctgctggagctgtaccgggagaaggccgtcgcgctcgaccaggagacggcgctcggcgacctgctcgtgcgctggaccggcggggacggcgacgcggcgacgatagtgaccgacgagttcgaccggccgcgggaagagcccggcaagggcgagcacgagaacgagcacgagcacgagaacgagcacgaggaccaggaggagacggcgtgagcgaggagaccaccgaactgcccgcaggcctgagcagcgtcgccggcctcggcctcaagcccgccctgga

SEQ ID NO: 1278 - DNA, 3618 bp, Unknown
  Kingdom: Bacteria, Phylum: Actinobacteria, Class: Actinobacteria, Order: Streptomycetales, Family: Streptomycetaceae, Genus: Streptomyces
gcgcggcggcggacggcgacgagttcggcggactgcgtcagctcctccgacacccactgccgggacgccgacgcggagtgggccacggccgcgggcaggccctgccccgcggcgaactcgtcccgcttgaggaggaaggcggccacggcctgccggtgtcccgcgcgcgccccgtgcgggcagtccccgcaggtgcagccacccgcgtgggcgtgcgcccccgcccccgcgccgtctctcgcttcctgcaccgccacgcccgacgcccgccttccccggaacccgcagccgtcctgcggacaacacccctacgccgactgcgcattgtgccctacaccaccgtgtgcacgtccgctcggtctggtcagggcgggtgaagtgcggatcaccgtgttgacccggcaggggccgggcctgctcagtatccgcggccggctcagcaggtcgggtcagctcagcaggtggggtcagctgagcaggtcgggttcggcgcggctgatgtcctgccacagcggctgatagctgatccaggccaccaggtctccgccgagctgttcccgggtcgagaccgccgccttgtggtcgatcaggacgggccggccggcggcgcgggcggtcagctgcacctgggcggagcgttccatggacaggaaccaccaggcggccgcgtccaccgagtcgccgaccgtcagcagcccgtggttgcgcagcaccagcgccttgtgcgagcccagtgtcgccgcgatccggcggccttcctccgcgtcgatgacgactccggtgtaggcgtcgtagacggcatggtcctcgtagaaggcgcagctctcctgggtgagggggtccagcaggtcaccgagggccgccagggccctgccgtgcacggagtggcagtgggcgacggcgacgacgtccgggcgggcggcgtggacctgggcgtgcacggtgaacgcggcctggttgacgtggtagcgcccctcgacgacctggccgtcctggttggcgagtacgaggtcgctcacggtgacgtgtttgaagggcacgccgaaggggttgacccagaagcagtcgctgaactcggggtcgcgggcggtgatgtgtcccgagacgccgtcctcgaagccgtggcggccgaagatccgcagggcgcccgcgagccgctccttgcggtggcggcgttcgtcctcggccgactcgtgcctcggtggcatggcgaagtgcagtctgtcggtgggcaggggcgggggcggagtgaggccgcggccgtgcatggggtcctccggcgggtgatcggcgtacgggcggaaattacccgtgggcgtccgggaatggcagcgctggggcgtgaagatgtggcggtcccgagcggacccgttccatacccgacaggagatgtcctgtttccgcgccacactcaccggcatggcgacgaactgggcggctttcgccgcgacgcaacccgggctggccggcctcgccgagcggcgtttcggcgccttccggcaccacgtcctcgtcaccctgcgcagggacgggtctccccgtaccagcggcctggaggtgcgcttcctgcacggcgagctgtggctcggcatgatgcgggactcgctgaaggcgcgggacctgcggcgggacgcgaggttcgtgctccagtcgaatccggggccgggcaacgtggcggccgacggggacgtgcggatcggcgggcgggcgatcgaggtgacggacccggaaaggaagggcgcgtacgtgaaagaggtggaaccgccgcagccgttccacctcttccgcaccgagctgacggaggtcgtgcggacctacgtcgaggacgaccggtatctggtcaaccaggtctggcggcccggagcgccggtgcgcacgctcaagcgggcctgacctctgcggagcgagcgccccctacggggcaggggtcactcccactcgatggtgcccggcggcttgctcgtcacgtcgaggacgacgcggttgacgtcgctcacctcgttggtgatccgggtggagatccgggcgagcacgtcgtagggcagacgcgaccagtcggcggtcatggcgtcctcgctggagaccgggcgcagcacgatcgggtggccgtaggtgcggccgtcaccctggacgccgacggagcgcacgtccgcgagcaggaccaccgggcactgccagatgtcgcggtccaggccggccgcggtcagctcctcgcgggcgatggcgtcggcctcgcgcagcaggtcgagccggtccttggtgacctcgccgacgatgcggatgccgaggccggggccggggaagggctggcgctggacgatctcctccggcaggcccagttcctggccgaccatgcggacctcgtccttgaacagcttgcgcagcggctcgatgagctggaactccaggtcctcgggcaggccgccgacgttgtggtgcgacttgatgttggcggtgccggtgccgccgccggactcgacgacgtccgggtagagggtgccctggaccaggaactcgaccgccgggccctcgtccgcgatgatctcggcctgggcctgctcgaagacccggatgaactcgcggccgatgatcttccgcttctcctcggggtccgagacgcccttgagggcggtgaggaagcgctcctcggcgtcgacgactttcagctggacgccagtcgcggccacgaagtccttctcgacctgctcggtctcgcccttgcgcatcaggccgtggtcgacgtagacgcaggtcagctgcgagccgatggccttctggacgagggcggcggcgaccgcggagtccacgccgccggacaggccgcagatggcgcgcttgtcgccgacctgctcgcggatggcggcgacctgctcctcgatcacgttgcccgtggtccaggagggcgtgaggcccgcgccgcggtacaggaagtgctccagcacctgctggccgtgcgtggagtgcatgacctcggggtggtactggacgccgtagagcttcttctcgtcgttttcgaaggcggccaccgggacgacgtccgtggaggccgtgacggcgaagccctcgggggcggcggagcaggcgtctccgtgcgacatccacacggcctgctcggccggggtgccctcgaacagggtggaggagggcttggagacggcgagatcggtgcggccgtactcgcgcgcgccggagttgtcgacggtgccgccgaggacctgcgccatgagctggaagccgtagcacatgccgaagacggggacgccggcctcgaagagctcacggtccaggcggggggcgccctcttcgtacaccgaggaggggccgccggagaggatgatcgccgccgggttcttggcgagcatgtccgccaccggcatggtgctcggcacgatctcgctgtagacccgggcctcgcggacgcgacgggcgatgagctgggcgtactgcgcgccgaagtcgacgaccaggacggtgtcgggggcggcggcagcgggagtcgctgatgacacggggtgccttccggcggttgggcgggtcgttgtacctgcgattctaccgaggcggcggcgaagcccgccccgcgcaccggggaccgcccgccccgcgcaccggcagcgt

SEQ ID NO: 1279 - DNA, 2854 bp, Unknown
  Kingdom: Bacteria, Phylum: Actinobacteria, Class: Actinobacteria, Order: Streptomycetales, Family: Streptomycetaceae, Genus: Streptomyces
ccggcggggtagctgcccgccggggccgggcgcaggtgccgctggcccaggttggcgtgctcgggcgcagggtccgcgtcgccccacgggtagcgggccgagcggccggtggccgggtcgtgccgcgccgccttctcccactcggtctcggtgggcagccgccgcccggcccagcgggcgtaggcgtcggcctcgtaccagcacacgtgcagcaccggctcgtcgggcggtacggcttcggtggcgccgaagtgccgccgcagccactgcccgccgtcgcggtgccagaactgcggtgcggtgatgccgtggcgccggatgtgagcccagccgtccggcgcccaccagcgcgggtcgtcgtacccgccgtcctcgatgaacgcctggtaggccgcgttggtgaccggagtggtgtcgatccagtacggcgccacctcgcgtacgtgcgcgggccgttcgttgtccagcgcccagggttcggtggaggtgcccatggtgaacgggccgccgggcaccaggacttcgggcggaccggtgaacgggggcgccggttcgggctcgggagcggtcagggcccgcgggccccggcgcagctgatgtgtgatcagcatcgtctcgtcgtgctgctgttcgtgctgcgcgatcatgccgaaggcgaagcccgcctcggtcagccgggtcccgtggaacgcggccgactccagcaggtcaaggacccggccgcgcacctcggaggcgtacgcgcgggcctcggcgggtgccagcagcggcagggaggggcgttcggagcgcgggtgctcgaaggcgtcgtagaggctgtcgatctcgggtcgcatcgcctcccgcccggcgaccgtgcgcagcagccacagctcctcctggttgccgatgtgcgcgaggtcccacaccagcggggacatcagcggcgagtgctgcgcggtcaggtccggctcctccacgcagctggtcagcagcgtggtgcggtcccgggcggtggtgagcgaggtcagcgcacgggcgcgcagcgcctcggggtcggtgccggcgccgggcgtcggaccgggcgcctcgtcgagggcggggtcgggcgcggggtcggtcatgagaggaggtccttcctgtccttcccgtgggcgcggccgtccagccggtccagcaggtcgtcggcggggcagcggcccttgcggacgtagtggtccaggtacgccctgacggcgtcctcgacgtcggcggtggcaccgagccggggcagggccgcgagcgcggcctcgaaacaggtgacggccgcgtcgcgcagctccgggtcggcgagcccggagcgggccgcgtcgatccacagcggattgtgcggcgcgggccggccgagggcccgctcggcgagcggcttcaccgtccggtacgcggtctccgccgcctgagggtcgtcgaagagcgccgccgtcaccgcgagcggcacaatccacccgtcgtcgccgggctgcgcgtcgatcatgcgcagttccagatggccgcgcggccggacgggcgggaacagcgtggtgaggtggtagtcgagatcctccctgctcggcggcctcgggcggccggagcgtatccagtcacggaaggtcaggccctcgggcacgtgccacggcccgtcgtcccgccgtacgcacatcaccggcgcgtccagcacgtgccgggcccaggcgctgcggggagagtggtcgagcgggggagcgcccgcgcgggccgggccgatctccgtccacatcagttgccgcgtggagcgccatccggtgggccggtgccccagcagcggggagttcgcgaacgcggccaccagcaccgcgcccagctggtgcgcgagccaccagcgccgcacatgcccgagcggccccggctcctcgtggccggcgtccaggcacacctggacggaggcggaggcgcacatcatgtgccggccggccgggccgccgcggtccaggcaggcctccagggcgtcgtaacgccgctcgcgcaggaacctgcggggggtgtgccagggatcgtggccgagacctaccaggcagagcccgtcgtcggccagtacggcacggacgcggtccaggtcggcggagacggtgccgacgcactccatcagggaggcggcgggcggtgagctgagttccagctggccgccgggttcgacggtgagcgccgatcgcaggggcacggtccgcaggaccgcgtaggccgcttcgaggcgttcgggtgtcacgcggagccgcggcgagcgcagctcgtggaccagccattccacttcgacgccgacggtacggggcggtccggtcttgaagcagatgccgctgaccagtgcctcgacctcggcttcggtgacggcggtacggggctccgtacagccacttgccgaatcggacatgtcgggatcctcctgagattccaccatgccaccggcccgggatcgacggtccgggacggcgtcgcaccgtcccacccaagtccctgtgaccgattcgcacaagggtgcagaacgggacaatcgtgccctgaaatctccgttcccgcgatgtttcccggggcttcacggtgcttccgcgggtccgccgaaccgtttccgggcggcttacggaagtgcttcggcggcgcgtggaaggcggctcccggcggcggaaactctgttgcaccaagggtcccggatcgctcacgatgcgtgcatgaacacgggggacgccgcgcggggcgcggtcgtggcgcgcacgggggtggcgccatgagcgcgcgcctgcgcggcatcgcacagcagaccgagcagatcgtgatggccggggcctaccgccggagcgacggaggcgaggtgtcggtggcggcggcc

SEQ ID NO: 1280 - DNA, 2132 bp, Unknown
  Kingdom: Bacteria, Phylum: Actinobacteria, Class: Actinobacteria, Order: Streptomycetales, Family: Streptomycetaceae, Genus: Streptomyces
gctgggagacggacgcgggtggctccgggccgctggcccgcgtcatgggccgcacaccgaaccggccccggttcgaactcgcggcggcggccgagctggtgaaacacctcctcgcgcacccggagccacccgcgtccgtctcccagcgcgggaccgccgtcagcagcagcggatggctgtccacggtgtcgtacgtggcgaacgtccagtcctggcgcagccaggaaccgaagagcaggaagagcccgagatagaccagcgggacctgggtccggtccggccaggtgagcggtgtccgttcctccaggagcagcgacacccgctgggacggatcgcgcagcagttccgccgtgaccagggtcagcgcgtgcttgacggtgggcagttgctccagcatggggggcagttgggccagcgccagctcgtcgagccgggcggcgtcgacctcgggctgccggccggacgcctgctccgccttctgcggcttgccccagccgcggtgggcgaggccgaggcactggcgggtcttcagggtgccgggcggcccgacgagggcgtggctgaccgtgctgggccggccgccgcggtcggtggtgggccagcgctggacgagcatgacgtggccgtcgcgggccacggtgcgcacgacactgggccgggccgccgccgctccggacatccacagcaacgggcccagttcgcggccgagttccgcggcccgctcgggcgggcaggagtaggcgacggcgttcatgccggtgccctggcgcccgtggttgccgtcccagcggaacaccacctggtgcacagggccccggtcctggaagtcgctcactgaagtccccctccggccgatccaccggccgatccaccggccggtcttcctgctgcccccggcccctcggatcctgccgtccgctgcccgggaaccgtctcgaacccgggcgtctcccccaccgcgaacgcctcggcgccgcccggcacgtcgatcagcccgtgcatcgcgagcagcgccagcagcggttccagcacccggcgtggcccggctccggccggatagcgtccgcggtcctcctggccgccggtggcggacgcgacgtgcagggtgcaccggcggatcgtgtcgaagggacgcagccaggcctggcccgcgtgccggcgcagcaggctgtggacgtcccggctctccgcgcgcaccagcgcggggtcgagggagccggccggcggcctgctcagccagcggtcgacgggcgtcctgaagcgcagcaggtccgccttgcccagcaccatcgcggccgggacgtccaggtacgggccgttcttcggcagcctgtccaggacggtgccgaaggccaggtcgccgtcccggttcacctccaccccccagcgttccctggcgtggtccagttcgggcagcggaagggccagcgccgggtcgacgacgaagaccagggcgtcgatgccgagcaggaaccgcagcgccgcgtcggtccgtacgaggtcctcgccgccgaggtcgaagaaggcgacgggacgcacctgcccgcgggcgtcggtgatcagcagggactccacgaagcgggcgaagtcgtccaggcccagcgccgcggtgtggtcgaggacattgccgttgcgcagcggctgcacccgttcgcggacgaaccgcgcgtgctgctccgggttgaccgactgccagctcaggccgaacggctcgagaccgccgtcggtgatcgcggcgatcatctgggtcagcagatgactcttcccggtggaggactggccgaccatggccacggtcagcggacggccgttcgtcaggtaggggacggggatgacgtgctcggggaagccgggatccgccgcgcacttctgaaccgcgccgcgcatgacgtcgtccagcaccacggggttggtgatgccggagacgtccagcggctgcttgtactgcatggtgttgtcggcgacgaacagtttcgtcacatcgagctggatggtctgcaggcagtaggggcacagcacttcgccgttgccccgcgcggcctgcgccgcggcgccgtcccgggtgcgggcgagaggggcctgccgtttgagccgcagtgcctcctcgaacgcctcccggtgcgggcgcgtct

SEQ ID NO: 1281 - DNA, 2908 bp, Unknown
  Kingdom: Bacteria, Phylum: Actinobacteria, Class: Actinobacteria, Order: Streptomycetales, Family: Streptomycetaceae, Genus: Streptomyces
gtgctcccgccaggaagaagccgccttcgccgacgtgttccgcgaggtcttcgaactgctcgccgcgggactgccgacgccacccgggccagacgtcctgtcgtagcgcacgcccggcccgggcccggaaaccgcggcagcgcacgcccgacctgggttccgactatccccgtagggcccgcgcgaccctgcccgtagcggccgccccgtcctgtcgtggcggccgccccacttgcccgcttcacccgttcacctgtgtcgaaagagctgttgtgacctcaccaccggcgcccgaagaggcgtctcccaccgccatgaccaaccgtcagatactccaggccatgtcgggcctgatggccggtatgttcgtggcgatcctggcgggcaccgtggtgtccaacgccctgcccacgatcatcgccgacctcggcgccagccagtcggcgtacacctgggtcgtcaccgccgaactgctgtccatgacggcgacggtgccgctgtggggcaagctgtcggacctctacaacaagaagctgctgctccagctgtcgctgagcatgttcgtcgtcgggtcgctgctggccggcttctcgcacggcgtgggactgctcatcttcagccgggtggtgcagggcatcggcgccggcggcctgaccgcgctggcccaggtcgtcatggcctccgtcatcccgccgcgcaggctgggcaagtacgccggcatgttcggcgccgtcttcgccgtcggcacggtggccgggccgctggtcggcggcgtcctggtcgacacctcctggctgggctggcgctggtgcttcttcatcggcgtgccgttcgcgctgctggccatcatcctcctccagcgcacgctgaccctgcccacggtccggcgcgaggtgaagatcgacttcctgggcgccttcctcatcgtcgccggtgtctgcgccctgctcatctgggtctcgctggcgggcaaccagttcgactgggcctcctggcagacggccgcgctcaccgggggcggggttctgctgctcgccgccgccgtcttcgtggaggcgcgtaccgcggagccggtgatcccgctggacatcttccgcaacaggacggtgacgctcacgacggtcgcgagcctcttcgtcggtgtcgccatgttcggcggtacggtcttcctctcgcagtacttccaggtgtcgctcggcaagtcgccgaccgtcgccggtctgatgagcctgcccatgatcctcggtctgctggtctcgtcgaccgtggcgggccagatcatcagcaagaccggcaagtggaagcggtacctggtggcgggcgcggtcacgatgaccgtcggcctggcgctgctgtccaccatcgacgccgacacctccttcggcctgctcagcctctacatggcggtgctggggatcggcgtcggcatgctgatgcagaacctggtgctggccgcgcagaacgacgtgccggccgccgagctgggcgccgccacgtccgtgctgtccttcttccgcagcatgggcggcacggtcggcacgagcgtcctcggtgcgatcctcgcgcaccgggtcaccacggagctggccaagggcctgaaggcggccggcatcacgcccgcccccggccagcaccagggcggctcgagcggtgtgccggacatgaagtccctgcccggtccgatgcgttccatcgtcgagcacgcctacgggatcgccaccgccgacctgttcctcgtcgccgcgccctgcgcgctgctggcgctgatcaccgtcgtcttcatcaaggagaagccgctgaagaccaccagcggcatggaacgcctcgccgaggagtccaacgccgcggcgccggtcgcctgacccgccgacgcgaccacgaccgcacagggggcagtgccacgcgcactgccccctgtgcgatcccgcccactgctacgttcgcggcagcgaccgcgtccgtgcccacctgtgtgcctggacgccccagacgacgaccgcggccagggcgatcgccacgaccgcggtggacatccctgcctgcacgccgacgcggacggtgagcgtgccggccacgagcgcgccgagcgggacgcccaggccggaggagagcatccggcgcgtggtgttgacccggccctggagttcgggcggggtcacttcctgggagtaggtcatcgtgttcaccaggacgacgaggtacgccgatccccaggccgccagtgcgagcagcgcgacccgccagtcggaggcgcggacgacgaccagaccgagcaccgctcccaccggcagcaccccgagcagcagcgggaacgcggcgaagcagcgccgcagccggggcagcagcacggacccgccgattcctccggcgctccacgccatgtacagcagcccgatccgcccgtcggatccgtggatgcccagcacccggtcggcgaagacggcgagctgtccgacgatcgcgccgccggagaacgactggagcgtgccgaccacggtcatgatgcggagcgtggggtgcctgcgcaggaagctgagcccttcgcggacggctgtgctgaacgcggggcggtgcgccgccgccggtgcgccgggccgtccggcggtgcgggcgacggccctgatgagcagcgcggacgcggcgaaggacagcgcgtcgagggccagggtgccggcgggcctaaggaacaggatcaggccgccggccagcgcgttgccggcgatccgtacgacggtctccgcgccgtacagggcgctgttggccgcggccaggttgtccttgccgacgatgtcggggacgaatccgtacacgcccgcgtcgaagaagagcccgagtgcggccgaggcgaacgccacggccaggaggtggccgcccgtgagcacgcccagggccgaggcgagcggtacgg

SEQ ID NO: 1282 - DNA, 3121 bp, Unknown
  Kingdom: Bacteria, Phylum: Actinobacteria, Class: Actinobacteria, Order: Streptomycetales, Family: Streptomycetaceae, Genus: Streptomyces
cccttgttccggtcacgattgggtacaaacaccgtcaattgccttgagatcggcggtctcggagagatacggaatcgagtccgagcttggccggaaccggcatcaagtgaccggccgccgctgcggcggcacggcgccgggacggcgtccgcgacgaggcgggcgagggggtctgggactacccttcaccagtgatggacaaccgtgtaccgccccgtgccgcaggccccggccgtggcgatcacgtcggcgcggcccgatcgcaccgccgcaggtcccgctcgccgcgagccgcgccgaggcgttcgcggacctggtgcaggactccgtggagcgtctggagcggcggtggccgcagctggccgacgtcgacttcctcgtcctggaggtgcctcggcctgccgggtccgggcagacctggagcgatgagccggtgccgctcggtgacacggtgcccgcgggcgaggggcgccgggcgcgggtggtggtctaccggcggccggtggagatccgcagcaagggccgcgacgagcgggccgcactggtgcacgagatcgtcgtcgagcaggtcgccgagctgctgggcctgacaccggagacggtggacccgcggtacggggaggactgagcagcccgggcggcgcaggcagaccgggcggcgtcacggtagagccctgtcagggccggtctccgctccggccctgacccgcccgctccggccctgacccgctccgtccttgacccgctccgtccctgacccgctccgtccctgacctgctccgtccctgacctgcccgctctgggccctgactctcggtcacggccgctgcagtaccgatatgtcctggtccgcgtgcgggaccgacaccgttccgcggtcgtccggcagggtctggatggtgaagcccggggtgccctccaccgtcgcagtgagggtgcgggcgccgtagaccgggccgccggacaggcactccaccgtgagggcgtagctgcccttcaggccggccgggcggggcggggcgatgtcctgggtggtgcccgccttgatcgtgtacgtctgcgacgccgccgtaccgccctcggtgcccgccgacgcggtgaccttgacctgcgcggtggcggtgggggcggtcagcgacagggtggagcccttcgcgctgttgtcggcggacgtcgcccgcgcgccgaccggtcccgacgccgggatgaacgccgtctcctgcttgcttcccttgccgcgcgtcacccgcagcgcggcgaccaccggcaccggtgacgagtcctgggtgagcaccagtgagcccgcctccccgcgcgtgaggtcgcccaggtcgacggcggtcgtcgtgccgcccttgacgtgcacggtctcgtgtccggccggggtgatcagtccggtcggcgaggccagcttcaccttcaggtcggtgtcggcatcggcggccgtgaaggcgatcagccgtacggaggtggcgtccttggggatgcccggcagtaccaggctggccgccgggtccgcggcggccgacagccagtccccgccgttcttgtcgtcgagtgcctgcaccgccgcgccgaccctgccgctgcgcacgttcacgtgcaccgtgaggtcctgctgcggtgtgtcgccgagcgtggacagcaggacgggctcgctggagtgcggggcgacggtgatgccctcccccgcggtcgacttcacggcgccgtccttgccgtacagctcgatgtcgacgacggctgcggagtcgtcgggattggtcagatggacgtagtccgagcggccggaggcggtgctcgcgccggggaaccagaactcggtgtccggagccgtgcagtccacgcccagcagaccgcgtccggcacccgccgcgacctcggtggtctgctgcatggtccagccgggcgcgaacttgccctcggcggtgccgatcagcgcgggtgtgtccccgcccgaggtgtccccggtgaccggcgtgccgggcgccttcggctgcagtgcgggccggtcggccttcttcttgccgcccttgtccttccccttgtccgcggagcccccggtgccggtgtccgactgttcggtcgcggactggagttgggccttgccgtcactgcccgttcccttggtcaccggagtgaaggacgtgtacgaggtgtcggctatgtcggagctgctcggcgccgggcagaccagggtggtgcgctcgacgggcagttgggcagcggccttcgcggtgccggcgtccgccgcgccggggccgtccagcgcggcgaatccggtgacggcggcgagggctgccacaccggcgatcagggacagggtcgtgcggttcactgctggctcccgtcggggcgctcactgccgttgccgtgcgggtggtgctgtgcctggtggtgctgtgccgggtcgtacggctgctcgtcgtacacctgctcgtcgtacggctggtggtaggcctggccgtaggagtcggccggtgcctggccgccgccgtacgcgtacgggtcgtacgggccgctctggtacgggtcggcctgacccccctggtacgcctggtcgtaggcgcccgccgggtactgctggggcggggcggcggcctggtactgctggtcgccgtaggcgccgtagtcggttcccgctccggtgccggtgtaggcgccggtgtcccactcgccgtaggactgctggtgcggtacggcggccggggcgggctccgggacaggcggctcgccgcccgggtcctgcggcggggtctgctggtcctgctcctcggactcggcctgggcgcgcagcctgcgggccctgcggccctcgccggtgacgggctgcgcgggcagcggctcctcctcgggcaggtcgtcgtcgatgtcacggcggcggccgggcagggccagcacgacgaggacgacggcgagggcgccctggacccacagccaggcggtgcgggcgatcggggcgtcgaaggtgacgtcgagcctgccgccggaggcggggagctggaagccctgggcccagccgtcgacggtggtgcgggtgagcggcttgccgtccagggtggcggtccagcccgcggcggcggagtcggccaggcgcaggacgcggcccgcggcgcccgac

SEQ ID NO: 1283 - DNA, 4369 bp, Unknown
  Kingdom: Bacteria, Phylum: Actinobacteria, Class: Actinobacteria, Order: Streptomycetales, Family: Streptomycetaceae, Genus: Streptomyces
gccggtgggtggtgacgacggcatcgcctccgtcgtcaccacccaccggcacgcggaccactggcaggcactggccgaggtggtggcggccacgcgggcgcgtacgtacgcgggccgggacgacgccgagggcatccccgtgccgaccgacgtcctcgtgtcggacggggacacgatcagtgtggggcacgtgcggctcaccgcccgccacctcgtcgggcacactccgggctccatcgcgctggtctacgacgatccgcacgggcacccgcatgtgttcacgggcgactgtctcttccccggcggtgtcggcaacaccttcgggagtccgaaggcgttcgcgagcctggtccacgacgtcgagacgaagatcttcgcaccgctgccggacgagacctgggtgtatcccgggcacggcaacgacaccaccctgggcgccgagcgcccgcacctgccggaatggcacgcgcgcgggtggtgacccccgctgccgccggggcttcgcaccccgtgtgaagccttcgcccccaccgatggcgcacgtgcgctcccgggattcccggccgagcggtccactgggaccagccccgctcaggaagacggctcctgcgcggcacgggccgccggtcctcattccccgccctcgaccggcggccccggcacggcgtgcacgccaccggggctcggcggacagcgggagccggtggccgggtcctacgactccgtgtcgtccccggcggccagagccgccactcgctccaccgcgaacgcgtagccctgcgccccgcagccggcgatgactccgtcggcgcgcagggagacgtaggaatggtgccggaacgactcgcgccggtggacgttggagatgtggacttccatgaccggcatgccgtcgcaggtgttcaacgcgtccaggatcgccacggaggtgtgcgagtaggcggccgggttgatcacgatgccgcagtggtgcagccgtgcctcgtggatccagtcgaccagttctccttcgtggttggactgccggaagtccactgtggcgccgcgcgcttccgcggccttcacgcacagggcctccacgtccgcgagcgtgtcggagccgtagatctccggctgccgctgcccgagcaggttcaggttggggccgttgagaatcatgatcggggcgttggccagggtgcggggcacggttcctccgggtccgtcggtgcacggcgagcggctgcgaccgctgctggccccggtctatcacggggcgcaggacgcacgacccctggctggagcaccgtctcagggattgatggccagttccaggtacgccgcgaagatgaccaggtggacgccgccctggagtggtgtggcccggcccggcaccacggtcagcgagctgaccaccaccgtgagcaggagcagcagcatgtgggtggagccgaggccgagcacgagcgggccggagagccatacggaggccagggcgacggccgggatggtcaggccgatgctggccatcgcggagcccagggcgagattcaggctggtctgcacccggtcccggcgtgcggagcggagggcggcgatggtctccggcagcagcaccagcaaggcgatgatcacaccgacgacggcgtggtgcagtccggcggacgccaccccggactcgatggtcggcgagacgcccttcgccaggccgaccacaccgatcagggcgagggccagcaggcccaggctggtccatgccatgcgagtggagggccgctgggcgtggtcatcggcggtgatcacctcgccctgccgggtgatgggcaggaagtagtcgcggtgccggaccgtctgggtggtgacgaacaggccgtagaggatcagtgaggacagggcggcgaaggtgagctgcacaccggagaactccggtcccggcttgctggtggtgaacgtcggcagaaccaggctgagggtggccagggtcgccactgtcgccagtgccgcaccggtgccctcggcgttgaagaccgccgtacggtgccggagcgaggcgacgagcaggcacagtccgaccacgccgttgcaggtgatcatgacggcggcgaacaccgtgtccctggccagggtggcgctcttggcgccgccgtccaccatgagggtcacgatgagggcgacctcgatgacggtgacggcgatggcgaggaccagcgacccgaagggttcgccgacccggtgggcgaccacctcggcgtggtgcaccgcggctagcaccgcaccggcgagcaccaccgtcaccagcacgacgacggccgcgggaagccccctcccccaggtgaggatcagcagcacgaccgcgagtaccggtacgagtgtcgtccacgccctggcgattcccctgagccgcgtgatcatgctgtgatcgtcgcagaggcccgacggcttcgcactccggcgggcggccggggcggcggcccccgcaccgcccggatgcgggaaccgggggccggtcgtggactgcgtgcgcgttcctgtgggctggtcaggcatcgacgcggtccttgcgcccggtgtcgcccttcccttcccgcacctcctccgtcgcggcccggcccctggtggccatcaggctggtgaccgtggtgacgatcaggaccgcgcagatcacacagagggagaccgggatgctgatctccgggacgtgcacaccggcctcgtgcagtgcgtgcagcacgagcttgacgccgatgaagccgaggatgaccgacagcccgtaggagaggtggaccagcttcttcagcaggccaccgatcaggaagtacagctgcctgagtcccatcagcgcgaaggcgttggcggtgaagacgatgtacgggtcctgagtgaggccgaagatcgcggggatcgagtcgagggcgaacagcacgtcggtggtgccgatggcgagcatgacgacgagcatcggcgtcatcacgcgcttgccgttgtcccggatccacagcttggtgccgtggtagcggtcggccacgccgaagcggcgctcgacggccttgagcagcttgttctcctcgaactcctcttcctcgccgccggagcgggcctcctggatcagcttccaggcggtccagatgaggaaggcgccgaagaggaagaacacccacgagaaactggcgaggatggcggcgccggcggcgatgaaggcggcccgcagcaccagggctatgaggacgccgaccagcagtacccgctgctggtactgcgacggcacggcgaacttcgccatgatcaggacgaagacgaagaggttgtcgacgctcagcgacttctcggtgatgaagcccgcgaagaactccccggccggccggccgccggcgaagaggagcaggccgagcccgaagaggcaggccagagcgatccagacgacggtccagacaccggcttccttgacggacacgtcatggggtttgcggccgatgaagaagtcgaccgcgatcagggcggccaggccggtgatggtcagggtccacagggtgatcgagacttccactgcgcctccggcaggtgcgtcacgggcagatgagtcagcgtcgtcgctgccggaggtctcttccacccgggacgggccggcgccccgggatctggtccgatccgtattgacgggtacgccgcagcagacagggagtactcccctccgtacggaaaacagtacccgaatcaccaagggaaggtaaagtgttcggcaaagaaagatcaaaatacctggtcggagatgctttacttatgcttgacttatgtccgtcgagtggtcaggtcaccggtacccgtcactgcgggcgtcggcgacccgggtcagcacctgctggagcacctggctgcccggcggcacgagcggcggctcgtacgtccaggcgtgtccgacccacgggtcggcgagatggtcgtcggggaccggggtcaggcgcatcagcgaacgccacagcggatcgagcaacggaccgtaggcggcggcgtcctcccggtccgcgaccaccatcagatggacgccgaccgccgggccctcgtccgcgaggtagcgcagctgggtcacggcgcggtcgtcgaagccgtgcgggaagtcgttgacgatcagcagctgctcggccgtgtcgagatccggcggcagtgagtcgggcgcgccggcgcgcagcgccatctgcaccaggtcgacccgctgggtgagccggctcagtacgtccgcgactcccgcggcaccggccgcgggcggtgccgcgagcacccctttccgtaccagcggtgcgagcgctcccgacgcggaacccgccgggtcgatgacgtggacaccgaactcgcccgcggggtagacggcgagcagccgggccgtgtgcgccacggc

SEQ ID NO: 1284 - DNA, 589 bp, Unknown
  Kingdom: Bacteria, Phylum: Actinobacteria, Class: Actinobacteria, Order: Streptomycetales, Family: Streptomycetaceae, Genus: Streptomyces
cgcggataaccggccgccggggcggacacggccgcgggccgccggttggccgggccgggagggggcactcgggcgaccgaccgcacgacagctaccaggtatcacagccaccaggtatcaagcgcacgacagcgaccgccggaggcacgcgtggccgtacgtcaccgtctgatcaaggccagtcccgggaccgtgtgggagctcctcgcggacggcacccgctacgccgagtgggtcgtgggcacggcccggtccgaaccggtgcgcggacggtggccgcaacccgactccgccctcgagtaccaggtccgcctcggaccgctgcgcctgaccaaccagacgatcgtccgcaactgcgaggagggctcgctcctcgaactggaggcccacgcgggcttcctgggcaccgcccgcatcgccatcgaagtgcgtccctggggcgagcactgcctggtcatcgtggacgagcatccgctccagggcgcgggcagcatcgtgcacaacgtcggcgtggagacggtcatccagatccgccaccgtgccatgctcgcccgcctcgccaaggtgtgcgaggcgggcgagcatggca

SEQ ID NO: 1285 - DNA, 5091 bp, Unknown
  Kingdom: Bacteria, Phylum: Actinobacteria, Class: Actinobacteria, Order: Streptomycetales, Family: Streptomycetaceae, Genus: Streptomyces
cgcggcccatgccggagccgaggcagaggccgagacagggaccgcgatcgacgcagggaccgcgaccggggtcgaggaggtttccggcgcgaaggccgcggccgacgtgcgggccgctcgggccgtctccgatgcgcggaccggtcaggctgcgcgggccactcggactgccgccgcgcccgggtgggcgcccgctgatctcggggcaccggccacgctcgtactgctgcggcacggtgagacgccgctgaccccgcagaagcggttctccggaagcggcggcagcgatccgtcgctctccgcggtgggccgcgagcaggcggagaaggcggcggtggcgctggcccggcgcggcacggtccaggccgtggtgtcctccccgctcgcccgtacccgcgagaccgccgcgatcgtcgccgcccgcctcggtctgccggtgacggtcgacgacgggctgcgcgagaccgacttcggggcctgggaggggctcaccttcggcgaggtgcgcgaacgccacccggacgacctgaacgcctggctggcctccccggacgccgaacccaccggcggcggcgagagcttcgcggcgaccgccgtccggatcgccgcggcccgggaccggctgaccgcggcgtacgcggggcgcaccgtcctggtcgtcacccatgtgacgccgatcaagacgttcgtccgcctcgccctcggcgccccgccggagtccctgttccgcatggagctctcggcggcctcgctgtcggcggtggcgtactacggggacggcaacgcgagcgtccggctcctcaacgacacgtcccacctgcgctgagccccgccgcctcgcgggccagccgttcgatccgctcccagtcgcgggcggcgagcgcgtccgccgggaccatccagctgccgcctacgcagccgacgttgggcagcgccaggtactcgggtgcggtgccggggccgatgccgccggtcgggcagaaccgtgcctgggggagcggtccggcgagcgacttgaggtaggccgtgccgcccgccgcctgggccgggaagaacttcatctcgcgcacatcgcgctccagcagtgccacgacctccgaggcggtcgagacgccgggcaggaacggcaccccggacgccgccatggccgacagcagcgtgtccgtccagccggggctgaccaggaaccgcgcgcccgcctccacgcactgggtgacctgcgcgggcgtgacgaccgtgccggcgccgacgaccgcgtccggcacctcggcggccatggcccggatgccgtccagcgcggccggtgtccgcagggtcacctcgatcgcgggcagtcccccggcgaccagggcccgggcgaggggtaccgcgtcggcggggtcctccaggacgacgacgggcaggaccggggcgaggtccaggacggaggcaggcagagatgcgggcatggcgtcatcctgcccgcccgcagcagcatgcgcaaagcgcgttgcgtatgctgcaacagcaattcgggtgcctctcagtgcacctcggtcaccagcacgtccagcgaccacggccgccccgcccccgtgggtgcctgcgcctccacctcgtacccgaggtcgcgcagcgcctccaccagctcggcggggccggccggggcgaccccggcggacagcagactccggacgatccggcccttggtggccttgttgaagtggctgaccaccttccgggtgggcgcgtgcagcacccgcacggtcgccgtccgctccgcgacctcgcccttcggcttccacgcggcggcgtacgcggcggaccgcaggtcgaggaccagcccgctcccggccgcctcgggcagcacggtggccatcggcgcgcgccagtgcgcgcccagcgcgccgagcccgggcagcttcacccccatcgagcagcggtaggaggggatccggtcggtcacccggaccgcgccccacagccccgagaagaccagcagcgagcgggccgcgcgccgcttggcggcggtgtcgagggaggcgaggccgagagcgtcgtagaggacgccggtgtagatctccccggcgggccgggtccccgccgtgcgcagtccggcgttcttggcgacctcgccgcgcagcccctcgctcagcccgagcacctcgcgcgccttgtcgttcgcgtcggggtcaccggagcacaggtcgaccagctcgtcgaacacggccctgcgggcctcggtgagcccgggcagcgacagcgactccagctccagcggggcacctcggccggaggcggccttgccttcggagggcggcagcaggacgagcacgggttctccttcgggtagggctcccggccagcgtacggggagggcgcgacgcctcccggcgggggcggccggaagggaccgtcacccccgcgcgagggcagccaccaggcggtccggttcgtcggcgtggaaacggacgacgcggaccgggcgccgacggccgaggaaggtggtgtgcacgacgggctcggtgagttccagggtgagggtggtctgcccgttcaccgccagttcgagttcaccgtcggcctgccgcgacttcggggtgcacgcctcacgccgtacggaggcgatccggtccagcggtacgcgcaggtcgacgtgggcggcccggcggatgcgcagggtgtccgccgtgagcacatggggccggacggcggaggcggcgtgcagggcgaccacgagcaggatggtgtacacgtccagcacgagcatggtccgctcgaccgcgggccagtcgcgcagcatcacggacgtgcccagcagctcgatcacgcacacgaacgccagcccgaacatgttcgccccctgcccgcgggcgtgcccgaacgtcctcccctcgccaccggcatgcgtccgccggcccatccacagcgccagactgcccagcagccgcaactcgtgccgcatgagtacgtacgtggtcctcatcacgcttcctccccgggcgggcggaaccgctcctgccgcccttgccgttcctccatgatcatgcccaacgcgccccgtacggccgccgcctgggcgggcgccaggtccgcgtagatcgcgcggaggaaggcgtggtcgtggtcgaccgcctcctcgggcagcagcgcggcggggatcagtccggccagggcgcgggcggcccgggcgatccgcggatcatccccgtcgtccggaccggcgtcggcgagcgcgtccagcagcgcgtacgcctcccgtgccctggccgccgcctccggggtgcccagggcctcgcgcaccccggccagcagccgctcgcgctccgcaggacccaccgcgctctccagcagggcgagcacctcccggtccttggcggccatgggggaggcggccaggggagagccgggcggaccggcggcggggccggcgaacagggccgtcagctccggtgagagcggcccctcggcgggcagttcacccgcgtcgagcagggcccgcaaccgcgcccgccgctcccgcagcgccgcctcctgccgcgccaggtcggcgtccagctcttcgagtacgtcgacgagatcacgcccggcgtcctcggcgagcacgtcccggacctcggccagacccagccccagctccgtcagccgcctgatccgggccaggacgacggcgtggcggagcgtgtagtgccggtagccgttggaacgccgctcggcctccgggagcagccccacgtggtggtagtgccgcacggtccgcgtggtgacgccgacggccgcggcgagttctccgatccgcatgggaccagtacagacgttgacgccacgtcaaggtcaagcacgttcggcaggcctgccgaaccagcgttccagggccgtgggcaggggatcggcgccggccgccgcttccgtacgcgtgcccgtaccggcaccgctgcccgcccccgcgtccgccgcccaggccacgaagccgtccggccgtaccagcagtgcggcgagatccggttgcccggcgccggcgcagcggctgctgacgacggtgacctggtcgccgtacccctcggcgcacgaccgcagctcccggttaccggtgaggtcgagcagcaggccgcgggctccgtgcaggtggtcgccgaggcggctgccgtcggcgagttccaggtcgggcgcgctcgcgccgacgagcgggtggtcgccgggcaggtcgtaacgctgccagacgccggagagctgtttcaccaggtacgacgtcccggccttcgtcagcgccaggtcggtcacgacccggcgcagcgcgcgggcgtgccggtccggccgcatgacggcgatctgcgctcgggtccagtccagcacccaggcgccgatggggtgccgttcggccgtgtacgtgtcgagcagcccctcgggcgcccggccgcgcgccaccgccgccagcttccagccgaggttcatcgcgtcgccgatgccgaggttcagaccctgcccgccgaacggtgagtgcacatgggcggcgtccccggcgagcagcacccggcccctgcggtaggtgctcgcctggcgcgcgttgtcggtgaagcgggtgaccgagtggatcttcgtcaccgtcacgtcggggacaccggagacgcggcgcaggctgtcctgcaactcctgcgcggtgatgggcgcggaccggtccgcgggcggcccgtcgaactcgacggtgaggacccggccggggaagggcccgtggacgtacgtaccgacctcggtcgtgttccagcccttccccagcttctcggcgccggtcaggtccgcgacggcctggtagccggtgatctccgggtccgtgccggggaagtcgaacccggcgagcttgcggaccgtgctgcgcccgccgtcgcagcccacgagccagccggcccggacgccgcgggacggggcggatccgccggccggcacgaggtccaccgtgacgccgtcctcgccccggtcctggaagccggtcagttcggcaccgcggcgcacctcgacaccgagctgcccggcccgtacggcgaggatccgctccagttccgcctgcgggatgccgaggccggcctcggccgcggggccgacgtcggcgaaggccgg

SEQ ID NO: 1286 - DNA, 2231 bp, Unknown
  Kingdom: Bacteria, Phylum: Actinobacteria, Class: Actinobacteria, Order: Streptomycetales, Family: Streptomycetaceae, Genus: Streptomyces
gtgctgcggagggagcgggggagggggaggccggggtggcggggagggcggcggtggtcagggaacgagtggtcgccatgagaggtcagctctttcgcgcgaggagtccgtcggtcggggcggcggccgcgagttcgtggtcgggcgcgccggggacgtacgtcgttccgcgctggccgaaggccggggtgtacggcgttagagggcccgcgcgttcgtcgcgcggcaacacacccggtcgaagtcgtggtgctgacgggagggccagaagggctcgaggtcatggcgacccgtcgcggtgttcttctggaagctggccatgagcccattgaagcagacagcgcgcccgggcaggaccctcctctcacagcttggacggttcccggacagcccgaagggcgcccacccggtggtgagcgccctcccggctcgtccgtgcggatcagacctggccggccttctccagcgcggtgcagcaggtgtcgacgagcagccgcgtcacgacgtacgggtcgacgttggcgttcggacggcggtcctcgatgtagcccttgccgtccttctcgacctgccaggggatgcggaccgaggcgccgcggtccgagacgccgtaggtgtactggtcccacggggccgtctcatgctggccggtgaggcggacgtcgatgccggcgccgtagttcttgacgtggtccagcggcttggagccctcgccgagcgactcgcacgccgtgatgatcgcgtcgtagccctcgcgcatggccttggtggagaagttggtgtgcgcgccggcgccgttccagtcgcccttgaccggcttggggtcgagggtggcggagaccccgaagtcctcggccgtgcggtagagcagccagcgggccacccacagctggtcggcgacctccagcggggcgagcgggccgacctggaactcccactggcccggcatgacctcggcgttgatgccgcagatgccgaggccggccttcaggcagttgtccaggtgcgcctcgacgatctcgcggccgaagatctcgtcggcgccgacaccgcagtagtagccgccctgcggggccgggaagccgttctcggggaagcccagcgggcgggtgccgctgaagaaggtgtactcctgctcgatgccgaagaccggctcctgcgcggcgaaccgctcggccacctcggccagttccgcccgcgtgttggaggtgtgcggggtgaggtcgatgtccaggacctcgcacaggacgaggatgtcgtcgccgccgcggatcgggtccgggcaggagaagaccggcttgagcacgaggtcggaggcgtgtcccgtggcctggttggtggaggacccgtcgaagccccacaggggcagttcggcgcccttggcgtcgtcgctgaggatcttcgtcttggaacgcagcttggccgtcggcgcggtgccgtcgatccagatgtactcagccttgaagctcacgggggccacatccttcgggtgtcacgggcgtactcgcggtgcggtggtacgaccggcggcgctgcggcgggagccgcggtggatgcccgtagcctgtcaacggccgatttcccggccgttgcccgagtgtgaaccccgtgttaccggtgacgacgaggggcggcggtgcggtgggcccgctcaaccgcggccgagcgcgtcccgtaccgcctcctcggtccgtgccaccaccgccgtgccgtcgtcggccgtgatgatcgggcgctggatcagcttcgggtgcgcggccagcgcggcgatccagcggtcgcgcgccccggcgtcgcgcggccactccttcagtcccagcttcttggcgtcggcctcctgggtgcgggtgatgtcccacggttcgagcccgagccggtccagcaccgcccggatctcgtcctcggccggtacgtcctccaggtagcggcgcacggtgtactcggcgccctcggcgtcgagcagaccgatcgcgctgcggcacttcgagcaggcggggttgatccagatctccatacggccacggtagccgccgcgcccggtctcccggcgttcgccggccgggaacggcaccgaacgcccgtacgacacgtcttcacaggtgccggtacggcacatctcgacgcacatcagagggagaacggcgcggtgaagcggcaccacaggggcaacaggttctacggagcgctggcgggcacggccgtcctggcgctgacggccgtgcccgccagcg

SEQ ID NO: 1287 - DNA, 8579 bp, Unknown
  Kingdom: Bacteria, Phylum: Actinobacteria, Class: Actinobacteria, Order: Streptomycetales, Family: Streptomycetaceae, Genus: Streptomyces
ccggggccgctgccactgccgacaagggcgccggcgaggagggcggcgtccgcgacgagggcgccgccgaagaggacgcggtgaacgacggcaccgtggacgaggtggaggtcctggcggagccgcgggcctgtgtgctgtgcggcgggccggcccggcagcaggtggcggggttcccgcagcatctggatcccgccgagtgctccgcaccggcgacacccgcgccgcccccggcgcggacctccggcccccgcaccacagggaccacctcccgcaccaccggcccgacttcccactcaagtgaccgcgccggtatccgcatcgtccccaccggccgccgggcgcaggcggcggcctccgccgagccggacctgatcggccgggccgtggccgaggtcctggcccggcacgccggcgatgtcgaggccgccacggccgcgctggtcaagcgggcgatcccggacgcgatggccctgctggaccacacccgcaagggcggccggtacgacgtcgtggcccacccgtggctgcccgacgtcctgcacaagcagagcgcgcacggcgccgaccagatctgggaggcccgccccaagtggacccggcccgaactgcccccgggcacgcacgaggtgaccgcgctcgacgtcaacggggcctacctgagcgcgctcaagacacatctgccgctcggtcagctggagcactccaccggcgaccaccacgaccggcgccgggcgggcgtgcacctgatcaccccgcccgcgtgggagcacgacgcggtcctgccgaacccgatcggcaaccgcgacgagccgggcccgctgtgggtgacggagccgacgctgcggctgctgctgcggctgtccgggccgaagtacggcctctgtgacccgccggagatccacgagtcctggacgtcgggggccacggagaacctgctggagaagttccgggtggcgctcaaggaagcccgggaccgggcgatcgccgaggacgacgaggtgacgctgacgtacgtgaaggcgatgtactcgaagttcgtctccacgctcggcgagtccaacttcaaccgcgagatctaccgcaccgactggatgcacctcatccgcagccaggcgttcgtgaacctgtggtggaaggcacaccggtcctacgaccagggcctgttggtggtacgggcgatgggcaccgacgagctgcacgtgatcggtgactggcgcggggtcttccccgagggccggggcgtcaccgaggtcaaggtcaaggacacctacacggtggacgccgccgaggagccctcccccgagggcccctgacgctcagtaccagtggttcgactgccagaacgaccaagccccgcacgggctgccgtagctggagttcatgtagttcaggccccacttgatctgcgtggctgggttggtccgccagtcggcgcccgcggaggcgtacttgccggccgggagtgcctggaagaggccgtacgcgccggaggaggcgttgacggcgttcatgttccagcccgactcgtggctcacgatgttgctgaagcactggaactggccgctcggcaccatctgccgggcgatcgcctggatctgggacgtggagtacgaaccctgggccgggaagtcggaggcgtcggccgtcgtgctctggctcgacgcctgcttcagctgctcccgctccttggcctgttccttggccttcttctcggcggcttccttctccgcggcttccttctcggccgccgccttcttggcgatcgcggtctcggccgccgccttgcgggccgcctgctcggcgtccttcttggcgctggcgtccgcggcgatcgcctgggcgtcggcctgctgcgtcagggaagcggtctgtacgggggcctgacgacccaccgggatgtccgacagaagcgtcgcgtcggccgccgtcgcctcggcgtcgttgttctgcgcgctgctgaccgaggcaacgcccacgacgcttccgactgcggtgaccgcggtggccgatgccactgcgagtccccggaccgagatccggctcacgcgatttcccttcggcaaggcccccgttcggcacggaggcgggtctgtcgacccccgactctgccgtaccgggcaccacaaggcaatccctggcctctccggccggccctcgccccagcagcctcacgagtcaaagatgggtgacagatgtgcggtgaatccctggggacaccgcacacgtgtgcaagcgcgtaagagcttctctcccccagtggatcagcgaggtcagcatgagcggggaccttccggaccaggccgtggcggcgctttcgccgcacggcgccgcggcacacttctcacgcgaggacgtggcctcttcgcggcaggccgtcgccggaccggtgctcgtgtccggtgacgagggtcacgcggccaagtgcgccacgtacgacctcaagccggccggaaccggcggttgtggccggggccaccggcgcggacgacgtacgcgcggccgtccggttcgccgcccggcgcgggatgcccgccgcggtgaagaacacggccaccaggtgcccgcgcccgcgcacggcgggccgctcatcaccaccggccggatgacgcaccggtccgtgaacgcgcaggcgcggaccgtgcgggccggggagaagccgtacaccgccctcggggagatccgcctggatctggctccgggcgaggactgagacccgggcacggggcgttacttcttcgccttcagcgggcccgcgaaggacttgcgcagggaggagggggcggcgagcgggagcagcgcggcgagcatcttgcccttgaccgaggcgggctgccgggtcagttcgacgtcgacgcgagtgccgtcggcctggggggtggtggtgaagacccagccgccgcccgcgccgaagagcttcgagtcgagcgtggtgatgtcgacccggcccgcttcggcgtcccactcgtagcgcgcccgctcccatgcggcggcggtgccctcggtcacctcggcccaggtgtcaccgagtcggtggacggtgaagtgctcggcgtcgatggtgggccagttctcggcgcgcgaggggccgaagtccgtcagcacctcgacgactccggaggggctgagcgtggagatgaggtggaagcggatgactgccatggtggccctcgcatcgagaagtagtaaccggtttgactggtgacgactcttccatgaaggtcgtcaccagtcaaaccggttacttgcacgagggtggccgtcaggtcgtcagcagcacacccccgtaggagacacccgcgatcacgacccaggagcagagtccgagcgccgcgacacggccgccgtcacggacgagggagggcaggtggaccgcgctgcccaggcccacgagtgcggcggcgagcagcagttcctgcgcgtggtgggcgaggtcgaggacggtgtgcgggacgaggccggtggagcgcagcgcgaccatggccaggaagcccgcgacgaagagcggcacgacgggcgtccgcgctccgcgacgggcgtcccgagcggccgttccgccggcacccgccaccgcccgcgcggtctccttgcgtcggccgcgccgcagggacagcccgaccgacgcgacgagcggcgcgagcatggccacccgcatcaacttgacgagcaccgcttcgcgcagggcggtgggcccggcggtctgcgcggtcgccacgacctgaccgacgtcgtgcaccccggcccccacccagcggccgaactgcccagcgtccaggcccaacgggccctgcagcagcggcagtacgacgatggcgagggtgccgcacagggtcaccatcgccacggccgtcgccacgtcctcctcctcgctgcccgagacgtcgctcatggccccgaccgcggaggccccgcagatcgagtagccggtggcgatcagcagcggctggtccccgggcaggccgagacggcgcccgagccagaccgtgccggcgaaggtcgcggcgacggtgcacaccaccatgacgacggtctgccagccgagcccggcgacgtcgtcgaggccgacactcagaccgagcaggacgacacccgcgcgcatcaaccgcttgcccgcgaaggtcagtccgggccgcgccgcgccccgcacgacggcgcgcacgcgcggcaggtgcgcggcgacgacaccggccacgatggcggcggtgagcatcggcacagcaggcagcagccggtgcaccgtccaggccagcgcgacacccgcggcagccgccacgagccccggcagcttcgcccgcggcccggcccacctcccccgcggcgacggcccgctgcccgccgacgcgggcttcggcatcggcggactcgtcaccggcgcagcccgtaccggcaaccgcccgcctactgacgtggtccgctcgctcatcgttcgtcgtccggcggctcgtagacccggcggacgctgctgcccaggcggccgatgtcggccccgtagatgtgcagggagaccgccttgcccgtgcccccgttccagacccggtggatgtcgcccggcggcgcgaacccgcagacgtcgccctgctcgttgacgacttcctcggtggcgacgagacgtgccgtggcgccttcgccggtcagccggtagcggcgttcgtgttcccggccctcgtgcaccccggtgacgcaccaggagacgtggtcgtggacggaggtgcgctgccccggcagccacaccagggccactacggagaatgcgccgtcctcctccacgtgcaggacgtgctggcggtagtggtcggtgctgccctcgcactggtcgccggtcagcaagtcgtcggcgccgaggtgcggcgccagtcgctccgcgaccaggtgtgcggtgcggtcaccgggcaggttctgccgcacggcctcccgcacttcctggacgagacggtcgaggcgggaggtggtcgccctgcgcgtccggacgtcggtggtggtcatgctgccagcgtcggaccgggagaagcgcgcgtccaacgacggtttcttcggtcgttcccaagctgtgcttatgcggaacgggccgtgtcggcgcgggacggctcagcagccgacgcgccgctgagcgaccgccttgatcgtgtcgacgaccagcgcggtcgccgggacccgcaggtgctcgcgcagcacgtacgccgagatacggcggcgtacggcgggctccagggcgcggcccgcgacccggtcgagccgcaggaaggacagcaccaggctgggcatcatggccacgcccagcccctcggcgaccagcgactgcacgacgagcccgtcgtccgtcgtgtaggcgatgtcgggcgcgaagcccagctcggcgcattcgtgcaggaagttggtacggcagcgcgggcacccggcgatccagcgctcctcggccaggtcggccagcctgaccgcccgccgccgggccagcgggtgaccgatcggcatcagcaccgtcaactggtcctccagcaaggggatttccaccacctcgtccggaacggactcccgcagtcccggataggtgaaggccagcgtgatgtcgcacgcgccgcgcgccagccgctccagcgagtcgggcggctcgtcctcgagcaactgcacacgtatgcccgggtgttcggcggcgagccgggccagcgcctcggggacgaccgtggcgttggcgctgggaaaggcgcagacccggacccgtccgctgcgcagccgcgtgatcgccgtgacctgttcctccgccgcggacaggctgccgaggatggcctccgcgtgccgggccagggtctccccggcctcggtcagccgcatccgccggccgacccggacgaacagcggtgagccgaccgtccgttccagcgccttcatctgctgggtgaccgccggctgggtgtagccgagggccgcggcggctccggagtaggttcccgcgctcaccaccgcgtggaaggtcctgatgtgccgtgaatcgaacacaggtcgaatcataagcagaatttgggttcccgccccagaggtgtccgcacacccgcaccttgcgtgaccattgcccgaccattgcgcgaccaccgggaacgacgatgccctgaggaccgttcacctggcacgcccgccttgcgcgccgaccttgcgcgcacatctggggtgtccggccgacgagttcgcccagcgcgttcgcctggacgtcaccggagccgggccgggatcgagcggatttcgagtgccgggacactacaaccatccgcggctgacggttgtcgtacactccgacgatcatcggcttcaccgaatcttttcatgatgccgacaccaaaacctgatcaatggggggcttttgtctatctcgcgcccattcggcagagcgcgtcgttcgcggctgctcgcctgcaccgccctcgcggcagccgcgggtatgttcctgagcacgccggccctcgccgccgacaagccgtcgcaggacgtcaccatcccgacgcccaagtccgccgtacccaagggagagcggccgcaggccactccgcacgcggcgccgcacctgcgcgcgggcgtcaaggccgccggggcgaccttcgatgtcgacggcgacaacgtcggcgacaacatcctgcggctcgacgacggtacgacgctcgtctggctgagcacctcgggcgacttcgcgcagtacaccatcaacaccgacaaccccgacgagaagccgaaggacatcctcacgccggggaacctcgacggcaccggcggccccgagctcctgacgctgtccacgaccggcaccctgtcgctgttccacagcgagagcgcgtccggcacgggctacagcgcctggaacggccagggctggcagatctacaacaaggtcatcgcgcccggtgacgtgaccggcgacggcaagcccgacctgctcgcccgcacctactccggcgacctgtacctgtaccagggaacgggcagcgacagctcccccttccgcgcgcgggtcctggtcggcggcggttggtcgatgttcgaccagctggtcggcatgggcgacatgaacagggacgggatcggcgacgtcgtcgcccgcacgccctccggcgacctgtacttctacgccggccagggcagcgccaccgctccgctcgccgcccgcaagttgctcggcggcggctggaactcgtacaaccagatcatcgccgccgacgactggaacggcgacggtctgggcgacctgctcggccgtaccacctccggcgagctgtactactacgtggccgacggatcggggaacttccggtcccggcagaagaacggcggcggcttcgagcccgtcgacctcttcgccggcagcggtgcgaacccgtactggggcaagtcctcggtgatcggcatggacaacgccggcacgctgtactggtacggcgtgaagcacaacggccagttcaccggccgcaccaagatcagcgacaccggcggctgggccggcgcccgcatcgcctacgcctcgtcgctcgacccggacgggtacgcggacctcgtcgagcagtacaacggcgtcctctacaaccacggttacggtgccgacgactcgctggccaccggctggagcaagtacaacctgttcctcggcgccggcgacctgaacgacgacggcaagggcgacgtcctcgcccgggacacctccggcaacctgtacctgttccgcgggaacggcaccggtgcgtccctcgcctcgccgctcaagatcggcagcggctggaacggctacgacaagatcgtcggcgcgggtgacctcaccggcgacggccgcgccgacatcgtcgcgcggacgccctccggcacgctgtacctctaccgcggtaccggcagcagctcctcgcccttcgcctccaaggtgaagatcggcaccggctggcagcagtacaacaagctggcctcgcccggcgacatcgacggggacaaccgcgccgacctggtcgcggtcaactccaagggcgacctctaccgttactcctccaccggccagggccagttcaaggcccgcgccaagctcggcaccggctggaacacgtacaagaacctgtactgacccgcccctagcggcctgaacggccgcggtggcgcggaacccgcgacaggaaaggggctcccccggcgtcaaggcgccgggggagccaccttttttctcccgttctctgcgcccggcgcccggcgctcggcgcccggcccggtgagtcccaggcgagtcccctcccggcaagggaccgaagagaccgggaaccggggtgcagtcatatgacctgatacgtcctgctgtgcaaaccggaaccggacggcccccgtggtgccgccccgtccgcaggcgggcgggaccacgggggcggcaggccacgctcccaggcaggcacgagcggcgcgcacctcgccggacgcggcgccaagcggcgaccgcgccccgatggccgagcgcagcaagcgcctgccgagtgcctctcccggcgggcgcggcatgcgcctgccgagggcctctcccgcccccccgcagtgacgcggttcctcgctcaggcggggcgttcgccccgccg

SEQ ID NO: 1288 - DNA, 4272 bp, Unknown
  Kingdom: Bacteria, Phylum: Actinobacteria, Class: Actinobacteria, Order: Streptomycetales, Family: Streptomycetaceae, Genus: Streptomyces
gtccgcaggtcgtccagcgtgggggcggccagcgaactgagccgtcccgcctgccgggtgatcgccgactccaccacctggcgcgccagccgcgcgttgccgaacgtccggtttcgcggcagcgagtcgaagtactcctccagcaccgctcccgtgcccgctccgcactcgtatcccatggacgcggcctgggcgcgcacgatggtgaccagctccttggcggagtagtcgcagaagccgatacggcgtgagaaacgcgaggacagacccgggttggaggcgaggaaccgctccatctcctcggtgtagccggcgacgatcaccaccacctggtcacggtggtcctccatcagcttcagcagcgtgtccacggcctcctggccgaagtcctggccgccgcccggcggggtgagggtgtacgcctcgtcgatgaacaggacgccgccccgcgcccgctcgaagacctccttggtcagctgcgcggtgtggccgatgtagcggccgaccagatcggcgcgcgcgacctccacgagctggccgccgctgaggatccccagctgggcgaggatctccccgtagagccgggccaccgtggtcttgccggtaccgggcggcccggtgaagaccagatggtggctgatggagggcaccggcagcccggcggcggcccgctgccgcgcggtggtgatcaggttcaccaggtcggtgacgtcccgcttcacctccgcgagccccaccatgtcgcccagcgcggtcagcgggtcctcgacgggcgcgccggaggcgtccgcggcggcggtggccgagacgtcctcgggcagcagcatccgcaggtcgcgctcgtcgacccggtccagtgcggccaggcgcgtcgcctgccggtccaccatctcctcgaacacccctcgcgcggcacggccgttgccgaacccggcgtcgcgcggcatccgttcgaagtgcgcggcgagcgccgcggcggtgccctcacccagctcgtactggtgctgggcgcacatcttctccatgatggcgaccagttcgggcaccgtgtagttctcgaactcgacggtgcgggagaagcgcgaggccagccccgggttggaaccgaggaacgagtccatctcccgcgagtagcccgccacgatcaccaccacgtcgtcgcggtggtcctccatcagcttcagcagcgtgtccacggcctcccggccgaagtccgcgccgccgttgccgctgtccgcggccagggtgtacgcctcgtcgacgaagagcaccccgccgagcgcacggttgaaggtctcggtggtcttgatcgccgtaccgccgacgatctgcgccaccagatccgccctcgagacctccaccaggtgcccgctgcgcagcgatcccagctcggccaggatcgcgccgtagagccgggccaccgtggtcttgccggtgccgggcggccccgcgaagaccaggtgccggctcatcggcggcgccggcatgcccagccgctcccggcgctgcgccagctgcgtgaggttcacgagcgtgcgcacctgctgtttgacgttctccagtccgatcaggtcgtcgagggcgctcagcggaccgccgtcgcgtgtcaccgggtcggcctgggcggtgcccgtgcccgccgggtcggtgttctccgcgctgcctgtgccccaggcgtcccgcttgccgttcgaggtgctggtcaggccctccacggcgagccgctccccgggcaccgactgcaccaggccgccgccggagttctcccgcgccgtgcagttgaccagcgacaccacttccgtggactccacccggaagccgtccttctcgccggcgctcgcctcgcagccgctgagcgagccctgcccgccctcacgcaggacgaagccgtgtccccggggggcgtgcaccgtcgtgcggttcgcggtcagcgtgccgccgccggccaccgccaccccgtcctcgccggaggtctccacccggaaatcccgcagggtgacgctgccgccgtcctccaccaggacaccacagccctcgctgccggagaccccgccgcccgccacgtacagcgtcgagccggacgcggcccgcacacccgcacccttcgggctgaggatctcgcagtcctccgcgcggccgcgggcgtccttctcggcggccagtccgtcaccggcgggctccaccagccgggcacggcgcagcagcgggttggcgcccccgcgcacggcgaccgccggtgccccgccgatcacctccaggcggtccagttcggccgccgagtcctcctccagcagcagtccggcgccctcgcagtcccgcacggtcagggcggtcacggcgggggaggaggcaccgtccaccttcaccgccgcgccgtgcgcgaactccacccagcagtcctccagcgccccgcgtgcccggtcggtgacgagtattccgtggccacgcgtacgggaggtgcggcagcggcgcagcaccgggtcggtgccgccggccagcacgatgccgtcggcggtcgtctgccgcacccgtacgtcctccagggtggcgcgccccgcactggtgatgtgcacgccggtgctggtgtcgtgcaccacggtgcgtaccacccgggtcgtgcagcgctcctccagcgcgatcgacggcttgtcggtggaggagatgtcacagtcctcgacggtgccgcgcgcctcgccgttggcgaggaggccgttgccgcgcgcgtcccggacggtgcagccgcgtaccgtggcgtcgccctgctccgccagcaccacgccgctggtgcccagatgctcgatggaacaggactccacggagctgcccgacgccgaggtgatcaccagccccgcgccccgggggttgctcacccggcagtcgcgcagtgccagcgacccggtccccgcggcgagcagcgcggtccacgaggaaccggagatctcgcagccgtccagcgcggcctgaccgcgccgcacgtccacggcgggctcctcggcgtcggcgccgcgcagcgtgagctcggagagcatcacggcgtccgcgcgcagcgacagtacgctgcccgagcgcggccggacctccaccgaaccccggccctccgccgccgtgatggtgacctgggtgtggaccaccaggttctcggcgtacgagcccgggccgacgctgatgacggcgccgttgcgggccgcggccagcgcctcgccgatcgtccggtaacggtcggactgccgcgagccgaccgtcagtacctggcgggacacgcgtgaacctcctcgcctgagcgacacgttgaaccgcggcgcccgcatctggggaaccccggggactcgatcatgccaggtgccgtcctgccgttggaccggggcggcaccgtgcccgcgaaacggcgggcgtcaggcgaaactccacttctggttgtcctggccgttgcacgtgaagagccggatgggggcgtggaggtcactgccctgggcccccacacacataccgaccgcggtgttcaccaggtcgttgcgctcgttcagtgtgaactgctgggcgatgttgccgttgcaccaggccagctggatcgtggtgccgttgctgaagttggcggccgccacgtccaggcacaggccggcgttcccgccgctgcggatcgtgccgtccgactccagccgccacttctgcgcgtcggccccgttgcagtcccacagctgcagcggcttgccgtcggtgaactgactcgccggcacgtcgaggcagcggcccgactggtggccgcggaaggccacgggcccgctcaccttcggcttctgcttgctcgtgccgctcgtgccggtcgtgccggcaccactgccggtggaggatttccggtccgtggcctgcgagccgccggagccggccgtgctcttcttccgggtgccggtggtcgaggacttgccgctctcgctcctgccgctcccgctcttggcgctgtcgctcttaccgctgtcgttcttcccactgtcgctcttgccgcccgcagaagtgccgtccttgccgtcgccgttggccggcgccgacgcgtccgacgtgctcggggcgccggaacgctgaacgctcttcgggctcgccgacttcgtctccgggctcttgtccgggtccggggaagccacggcgaaggcacctgcctcaccgttcccgtcgccaccctcgagcaccgtacccggagcgttctcggaccgcggtggacggttgtcatggccgccgccgagcaggaggaacgggaccgacaccagcagcgcacccgcc

SEQ ID NO: 1289 - DNA, 1634 bp, Unknown
  Kingdom: Bacteria, Phylum: Actinobacteria, Class: Actinobacteria, Order: Streptomycetales, Family: Streptomycetaceae, Genus: Streptomyces
gggccgggggcgcgaggagagaaggccggacccgccgcacgcgccgctgccggccgcgaggcaccgcaccggcgcgcaggcggtgccgaagccgcgggggaggcggccggcgtgccggccgtcagccggcgcggaccccgctccacatctccgcgctgccgtgctcgtcgcgccggtggccgtcggcgacgtcgtgcaccaggtcgcggttctgcgagaggaggaggcgcatctgctcgacggcggcgttccactgctgctggacgctcacgtactccgtcttgtcgtcaccgctccagccgcccttcaggggcgccaggtcttcgtccagcgtggcgagggtctggctgatggcctgggtctgctgctgcatttcctcgatcgcgttggccaccgtgctgtagtggacgtcgatgacgccgtccgtgtagtcgggcatgcctggtgcctctctgctcgtcggaccggggtccgggggaggtgggggacgaatgatgatgagcgggtgccggtttcgcggccccgcgcctcacccgcgggtggtcaggtcagggcttcgaacacgccggccgagacctggctggtctgctgctggatgctgtcctggtgccgcagcgacgtctggcgggcctgctgacggttgtcctccagcgcgttcgtcatcttgtcgatctgctggacgatcttctgggcctgctgatcccaggcgcggaagagggcctggaaggcgtggccctcgtcgccgttgacgccgagcgacagtgccgcgacgttgccgcggatgcggttgacgccctctctggccgtgccgagcgcctgcacgccgctcttgaccgaactgtcgttcaccaaccggttgtcggacatggtgtgctcccttcggttgggattcgtatgcctgtcgtgttttaccgatgctagggagaaccgagtgttccgtgcaacgaaaacggtgcgggttcggccgtcaggtgaggaagtaaatgcccgtaaccgtacggacgttacggaacggccccggcggcatgtggctgtaaaacgggcggcggacaggcacggcggtgaggcgaacggacgctatttggccgctcgttgcccgtttcactgcccgctcgtgctcccaagaggcgccccgggcgggctccatgcgagttcttgaggtttatctgaggttctccggttccgtaattccggacccgcggcaggaatatcgggccggaagaccgtgccctcgccggcaccgctcggctcgcccggcggccgcatgcggtacgggacgggaccggcgctcgcgtcgcgcccgtcagttcttggcccggccggccgcgttcccgtcggcgccggcggccgtcgccgctcccctgcccgtgccgccgcacgccgccgcggtggtgcgcggcggcacggcccccgtggccgcggcgcggtcgaggtccgcccctgtgggcagggccgccagcagcggcgcgggcaccgacgcgacgtcaccggcgccgtaaccgagcgcgctgagcgcgtccgtggacggcacccggtacttgaccccgttctccgccaccaggtacgtcgtgccggcgtgcgccgcaccgctcgcgctcagtgcccgcaccagcgcgccgtgcccgggccgcacc

SEQ ID NO: 1290 - DNA, 2265 bp, Unknown
  Kingdom: Bacteria, Phylum: Actinobacteria, Class: Actinobacteria, Order: Streptomycetales, Family: Streptomycetaceae, Genus: Streptomyces
  misc_feature (1872)..(1932): n is a, c, g, or t
gtgtggggggcggtgtggaggacggcgcgggggcggacccgacggggagcagggcgtcgtagtggtcgcggccgttgtaccgcacgaagaccgtgccgccgcggccggagctgttgagggggatcacgcggtcgtcgccgaccagccgcaggtcgatgtccgcggcgcgggccagcgccaccggtatcaggtccccgaacggcgagctccacaggccggggtgccgggcggtggcggtgagaagtccgccggcgcccaggctgcgggcctccccgggagtgggcgccaccgcgagcagatccgggtacggcgagttctccaccagccggcgccatgaggcggtgtcgccgctcagcacggcctcggagaaccggcgccactgcgcgtccgcgtccgcgtgcaccggaccggggccgacgtaggtcccgcgcaggtcgtccagcaccgtctgcaccggatccgggctcgactcggtgagcgcgtcggccagttcggagccgttcagccggtcgtgcagcagccggcgcaaccccggcacgtccaggccggcccactgaggcagaacgttctggccgcgggcgccggtgagcaccgaggtgaagaagcagtcaccgtcgccggccgtgggcaccgggcggaacgtgtgcccctccgcccggacgggcgtgccgccgccgctcgtcaggtcgaggctgtgcgcggagccggcgtccgaggcgctctccggcaaggaggcggcgccggtcacggtgcccggaccggacgcgcccccggggagcagatccggcctgcggctgatcagggtggccgtgtcctcggggcccaggtggagctcggacaggggcagcggggcgtcggagagctgccaggtgatgtccgccgaggcggagtacgtcaggtcgcggacgtcctcgcgcgagacgagcgtgtccggcggcagctcgggcagcggcggcggcagcagtgtcccgagcgaggcttcggggcccgcctcgcgcagggcggcggcctcccgcaggaaccgcgtgtactgcgccccggtgggtgccatgccctcggcgaggccgtaccggtcggcgaccatgcgcgtcagcagttcgggtgtcatccgggcgtcggtgtagcggcccgccgggtccggggtgcgccagcgcagcccgtccaggaaggccagtgcgcgcagcagggcccgccggtcggagcgctgttcggcgtccgggtcgagcgtgccgcgcagcgtccgcacctgctgcagcgtgcgggcgcggacgaacgcgtcggccgggccgcgtccccggtggagcccggcggagcgggccagggcgtccagcttccgcccggagggctccggtgtgaacagccgccactcgcccggaccgtccggcccgtcggccagtaccgcccgtacctcgccgtgggaatcccgggcggttcccgccgcgccggtcggggcgtacaccggcgtgccggtccggttcgccacgtgctgcgccaccgccaggcccgcgatcttcggctgccggcccgtgctgcaggagaacagcacgatcggccggcgccggccgccacccgtgccccagccttcgccttggccagcagttcctcggcggacttcgccgcctcctcgatctgcgccacggcctcgcgccgggcctccgagcggatcttctcgccctcgtcgaccgcgtcggagcgcagctgctcggcctcgccgcgcagccggcgcgcctcctcctgcagctcgaccgtcttggcgcggtactccttggtgtcgtccttcgccgcgcccttgagctgctcggcgatgtcgtgcgcctcggcacgcagccggtcggcctcggcctccgcctccgagcggatccgctcggcctnnnnnnnnnnnnnnnnnnnnnnnnnnnnnnnnnnnnnnnnnnnnnnnnnnnnnnnnnnnnnggacgccttgttcagcacgtcctcggcggtcttcgccgccttcgccagctgggtggcggtctcctccgcggtggcgctgcgggccttctccgaggcctcggcgacgatcttctccgcctcggcacgggcgtccgcgaccagctgctcggcctcggacttcgtgctctcggcgtccttggtggcctcctcgaccagccgggcgacctgctccttggccgtacgggtgcgctgctcgttggccgactcggcgctcgccagcgtcttggcggcgctctccttggcctcggtgaccagcttctcggcctcggtccgcgccttgcgcagcgcctcctc

SEQ ID NO: 1291 - DNA, 1228 bp, Unknown
  Kingdom: Bacteria, Phylum: Actinobacteria, Class: Actinobacteria, Order: Streptomycetales, Family: Streptomycetaceae, Genus: Streptomyces
ggcgtcagttccacagcaggtcggccgccgcgcgcagcctcgcgtgccaggtgagggtacggaaggcggggcggcggggctggccaggagccccggcaggatgccgcccgccgctccggagggacgccgacggcgtggtcgcttcacaagccggtggtgcgaggggacctgtgggccgtcagtgcccagatcacccacgcgtccaggccgatggagatgatcgcccacaggggcaggtacgggagccagaggaagttggcgatgaggctgatggaggccatgaagacgcccatcacgcgggcccacagggcgtccgtgaggaggcccaggccggtgacggcggagatgatgccgacgatcaccaggacccagccccaggtgtcgaggtcgaagcggtagacgtagtcgccgatgcggccgtagatggtgtcggaggcgagggccgagatgcccttcaggatgtccaggaggccgtccaccagcagcaccaccccggcgaacaccgttccgcccgccgcccagaagctcgtcctgctccggtcggctgcggggtcccggggaggggggcccggggtctccgcgtgctgcgtcatgatgtcgtcctccctgcggtcggatgcgtccaccgtgtgcggcggcggggcgtcccaccagcgggaggccgccgtacgggtgagtccgggacagggggagaggcaggggggagggggtgtcactccacctctatgccgtggtcctccaccagttccaccaagccccccggatagcccttgccgcccaggacgaagtcccagtcgttgttggccctgcggcggaaggagccgaggaccagggcggtctcgccggggcggccgtcggagacgtccaggcggcccagttccgtcagggccgggtcgaggaggcggatgtgggcgtcggtgaagccggagaggtcggcgtccgggttgacctccgggtcgacggcggcgaccaggacgagccggtcggagtgggccgggagcgcgtcgaaggcgacccggacggccgccttgtccggcggcgtgggcgcgagcgcgccgaccgagccgtcgggagtctgcggattgttgtagaagacgaagtggtcgtcgtcgaggacccggttgccgcggcagacgagcgcgcacacgtccagtgcgacggcgccggaccaggacatgcccaggatgttgtagtcgtcggaggccggggctgcggggacgggggccgc

SEQ ID NO: 1292 - DNA, 1803 bp, Unknown
  Kingdom: Bacteria, Phylum: Actinobacteria, Class: Actinobacteria, Order: Streptomycetales, Family: Streptomycetaceae, Genus: Streptomyces
tcagccgcaggctgtcctcggcctgccgcagggcggcgtccacgtcggtgatgtcgtggtccaggcggcgcgcctcgtggagccgggcggcggcgcgctccaccggcgtgccgtcggcgaccccctcgcccatgtgcagcatcagctgccgcatccggcgcgccagcccctcgatggactcgcccgcgtgttcggtccacaccggaggcgcgagcagcaggttgcagcccatgccgaccaccgcgccgatcagcgtctccacgatccgcgcccaggcggtgctgcccacggtggtgacgccgaggaccagcatcgcgctgatcgccacctcggccacgaactcgtcgacccgcaccagatggccgacgcccagaccggccaggatcaccagggccaggctccaccaggtcagccccaccagcagggagaacaggatggccacgaccacgccggccaccaccgcgttcacccgtcgcacgctggtcttcagcgtcgcgaagagggtcacctggacgaccagcagggccgtcagcggagcggtcagcggcgccggctccggactcagccacttcgcgatcacatacgcgatcgtcgccgcgaccgtcgagcgcagcgcctggacgaccaccgggtcccggtgccgcttgaccagccggacaagggacgacatcgactcactcacatcgtgcatcccttgcgctcttccccgttcacacacgcatcgaacgtggttccggccggcggtcaggcgtacagcttgtccaggaaggcggccaggtttcccgtcgtccggacgatctgttcctggagggtcaggctctcctcgaaacgggtgccggactcggggaccttcttgccgcgcaggtacagggagcaggccaggtcggtgcacatgtacaggccgacggagttgccctcacgcccggcggcgcccgtcttgcgggcggtcatcagggagaccccgccgccgggatgcgtggtcaggcacagcgagcacatgctccggtgcaggaagccccgctgggatgcggggaagcgcagcgcgatgcccaccggccgcccttcccgttcggtgaccagatagctgcggtcgggtgcgcccggatcgcgccagcccaggaagtcgagatcgtcccaggggcgttccgcgaggtcacgggggacggccaggcgcttggcctcgcccttggagcagttgacgaaggaggcgcggatgtcctgctcggagagcggtctcatgaaaggctccgggtggatcacggcgacgagaaccctgagggttcgttgcctaatgattttagtttcacggctagggtaagcaggttcagggaggggatccaatggatttcggcgaagtgcgcggaccgagggccgtggcggcgctcacacatgtcgcggcacggtccagcgggccggccgtccaggcgggcctgcgcatcaccctcaacttccaccccgaccggctctcgggcgggctgcccctgctgcgggcgctggctcgcgacggcgcgtaccactcgcagttcgtcaccggcacgagcaacggcggactcaccgcccaccccggcggcgaccgatggcgctgggagagccgcatcttcggcggtgcgtacgacgacgcccccgccggtgaccggcccgtctacggcgcccttgacttccgccggcaggtggtgggcgccgccccgcggttcggctccgcgcacttccggctcacggcggcggcgctcgcccgcgccaccttctgctaccccgacagtgcggccgaacccggcgacttcggcaccgcggccgccatgggcc

SEQ ID NO: 1293 - DNA, 2809 bp, Unknown
  Kingdom: Bacteria, Phylum: Actinobacteria, Class: Actinobacteria, Order: Streptomycetales, Family: Streptomycetaceae, Genus: Streptomyces
gaccgcgcggtggcgtaggtgcgctgcacggacagcgggtcggcgccgtcgccgagcgtgccgccggtcggtgcgacgacgaggggcaccatgccgccggcgagcacggcctcgcgcacggcccgtacgccgtccaggtcgccgtccggaccggcgatgatcccgatcaccctgccgtccgtcggccaggtgtggccgacctgggacagtgcggcgctgggctcgacgtcggcgagcggcaccgtcgcctcgggggcgggcaggccgagcccggcggcgacctcggcgcacagctccgggtcgatgttggccagcacctgcaggccgcgttccttgacggcctgctcgtagcatttgccgagttcgaaggtgtaggcgccgatgatgtgctcacgctcgaccgggctcatgctgagccagaaccggcggggctggctgaagtggtccgcaaacgtctcgggcgcctcgcggaccttcttcgcctccgggatgtgcacgggcgcctcgatgtacgctcccgtgtccgccccggcggtgaacgggcaccctccgtcgagggagttgggccggtagggggcgacgccgcggtgcacggccgtctggtggaagctgtcgcgcagcatgtcgttgacgggcgcgtgcgggcggttgatcgggatctgcgggaagttggggccgccgagccgggtgatctgggtgtccaggtaggagaagagccgcccggacagcagcgggtcgtcggtgatgtcgatgccgggcacgaggtggccggggtggaaggcgacctgctcggtctcggcgaagaagttcgacgggttgcggtccaggacgagccgtccgatgggctgcacgggggcgagttcctcggggacgatgttcgtcgggtccagcaggtcgatgccctcgaaggtctgctcgggggtgtcggggaaggtctggatgcccagctcccactcggggtaggcgcccgcctcgatggcgtcggccaggtcccggcggtggaagtccgggtcgacaccgccgacgatctgcgcctcttcccacaccagggagtgcacgcccagcttgggcttccagtgccacttcaccagcgtggtgcggccctcggcgtcgacgaggcggaaggtgtggatgccgaacccttccatcatgcggaacgagcgcgggatgccccggtccgacatgttccacaggacgtggtgggtggcctcggtgtgcagggtgacgaagtcccagtgcgtgtcgtgggcgctctgcgcctgcgggatctcgcggtcggggtgcggtttggcggcgtgcacgatgtcggggaacttgatggcgtcctggatgaagaacaccgggatgttgttcccgaccaggtcgaagacgccctcgctggtgtagaacttggtcgcgaagccgcgggtgtcgcgcactgtgtcggcggagccgcgcgaaccgagcaccgtggagaaccgtacgaagaccggtgtctcgacgtccttggcgaggaaggcggccttggtcaccgaggccgctgtgccgtagctcgtgaagacgccgtgggccgccgcgccgcgggcgtggaccacgcgctccgggatgcgctcgtggtcgaagtgcatcaccttctcgcgcaggtgatggtcctgcagcagtacgggcccgcgcggccccgccttgagcgagtggtcggtgtcgtacagccgcgccccctgcgcggtggtcaggtagctcccgctctgcgccatacgggcgcggtccgcgccggtcggctgcccggtgggcgagacggtgtccggtccgctctggtcgggcttgggcggcagcggttcacgcggctgcgtcggctcggcgacggagggggactcggaacccggcttccccgggatgccctcctccggtcccgcaccgtcgccctggagcgcgtcggccaccttgtgggccgcctgcttgatggggttggcctcgctcatgcgtaccgttcctccactcctggccgtcaccacggtgcgtgtgcggcggccgtccactgtccgattgccggtcgccccgacggggtctctcgcctgcggctgctgccggtcctgccgttcgacccgagagatcagatatccgggcaaacagcccttaacgggcatcggccctgtcaatctctcacggcccggagggcggcgcacggggcccgcaacgccggagtgaccctccggccacaccgcgtacccagacagggccgctcaagccctgcgaaaaccggggacgaccgccgcccccgacgtgcggccggttccgtaccctgaggccgtgcatatctgtttcgtctgcagcggcaacatctgccggtcgccgtccgcggcactggtgttcgcggagcatctgcgccgggcggggctcgacggcgaggtgcgggtcagcagtgccgggatcgggccctggcacgccggggaggccatcgacgcgcgggccggtgaggcgctggcgcggcacggctaccccatcgagcacgtggccgcgcaggtcggtgccgagcacctggacgccgatctcttcctggccatggaccgcggccacgagaaggcgctgcgccgcctcgtcgacgacccgtcccgggtgcggatgctccgctcgttcgccccggacgcggacgcgaacggtgacctcgacgtccccgatccgtactacggcggcccggagggcttcgaggacgtgctcgccatgatcgagtcggcggtgcccggcctgctcgcctgggtgcgcgagcacctggaaccgtgacggcccgcccggccggcgccgacggccctgctcgtgccgcggcccgcctgac

SEQ ID NO: 1294 - DNA, 3822 bp, Unknown
  Kingdom: Bacteria, Phylum: Actinobacteria, Class: Actinobacteria, Order: Streptomycetales, Family: Streptomycetaceae, Genus: Streptomyces
gggcgcggccgtcgctgccggggtggtcccgatcgcccacgccaccgacgccgccggctcgctccgcatccccgccgcctgcaacggcctcttcgggctgaagcccacccgtggccgggtctccatgggccccgacctcgacgaggtcttcaacggcctggccgtgcacggcagcgtcagccgcacggtacgcgacagtgcggcactgctcgaccagatccgcggcccggaaccgggcgacccctacttcgcccagcagccgtcccggccctacgcgcaggaagtcacccgccacccgggcccgctgcggatcggcgtcctcacccaggcgtggggcggacgccgcaccaccccgcccgtggccgacgcgctctctcgcacggtgcgtctgctcgaatccctcggccaccaagtggaggaggcccgggtcgacctcggggccgactgggaggagttcgtcctggccaacgcccgtctgatggcggcgaatctcacggcccaggccgacgggctggctgccgccttcgaccggcccgtcgacttctcgaccctggagccggtgaccctcgccggctaccactacgggcagcgggtcaccggcgcccagttcgtcaccgctctcacgatccggaaccgggtcgctcgaagcctggcacggtacttcgacgcccacgacatgctgctcaccccgaccctgccggaactgcccgtgcccctgggcacctatgccgagggcgcagaggcgctggacggcctcggctggatcgagcgcatcaacgaccgctcgccgttcaccctggcgttcaacgtggcgggcacgcccgccatgtccgtgcccgtgacggccgacgccgagacggggctcccggtcggcatgcagttcgccgccggttacgggctcgaaggcagcctcttccgcctcgccggccaactcgaacaggcaagcccgtggtcgggccggacccccacggtgtgggcagggaaccccaccggcccctgaggagcgctcctgagcagccgggagcccacgggcgaggacgatgcaccgggcgagggggcagaaccacgtcgtgcatgccgctccggactcccgttgcgcccccgggggccggacccgctccacgggcgtcagccacacgctgccgtgctcggaccatccccgagggtgcggggagcagcctggtcctcgctggtctggccggtccgggcaaccgtccggtgccgatgaggtgccggggcgatgaaaagaccggctgacgtccctcgtcccgtacgccgctaccggtatgtcttggccgccggcagcggcgtacgggaatcccggccggggtccggcgatcgttcctgcaggagccggacgagggcgtgggctgcgggtgaggctcccgaagggttccacagggcctgtatcacgcggggcggcacgccggtcaccggcatgccgcacacctgccgcatgcgggccgcggtcgccgcggaaaccagcgcggtgcccaggccgcgggccacgaggtgttccagcagcggcatggcgtccgcctcgaaggcgaccgtacggacgaccccggccgcggcgaacgccgcgtcgttgtgccggcggatgccggagccgggcggcatgtcgaccatgtcctcctcggccagccgggccaaagtgacctgtgcggccccggcaagccggtgaccgggcggcgcgatggcgaccagttcctcctggccgaggacccgcgcggccagccggcgcgggacctcccgcgggtcggtgtcgacgaacgcgagatcgcaggtgtggtcacgtacctgctgcaccaggtcgcggaccggccgggtgtgcaaggtgacgcgtaccgcagggtgccgttcccggtaggcggcgagcaggtccggcaggtccaccgcgctgagcggggcgatggagccgatgtgcagggtgccccgcacttcgccgccgtgcgccgccacttcgccgcgcgcccgttcgacggcggccagcgcctcccgggccggcccgaggaacacctcaccggccggggtgatccgtacccgcctgctgttgcgctcgaacaggcgggtgcccagctcttcctcgagccgggcgatctggtgactcagggcggactggacgacgaagcagcgctgcgcggcacgggtgaagctgccggtctcggcaaccgcgacggcataggcgagctggcggagttccatccgtgcatcgtgatccgagatcgcctgcatgacaaccatctgttggactcatccaacgggggcggacaccatgaaaggggccggagctgagctgatccgctccgccggggtcgcgcacccgcccgcggccgtgtccccttctgcaagggagagctctacgtggcatcccccgcgaccccgtacccaccctcggaggcgggcaccgccgccaccggcagccatcccggctcccgcgtgatgctggtgatgtccgtcaccgtcgggctctgcgtgggcggcaactactacgcccagccgctgccggacaccaccgcgcgcagcctgcacctgtcgtccgcgtcggcggcgcccgtggtgacggccgctcaggtcggatacgcgctggggcccatcctcccgccgcccctcggtggcctgctggaacggcgccgcctggtgtgcggcctcaccctggccacggcgtgcgcgctcgccctgtcggcgagtatctactccctgcggcctgaggcgcgcgggcgggtcacctccgcctacaggacgtgccacttcgccgccggcgcggccggttcgctccggccgaaggcgcgctcagcggtcaagggccgttggaacacaagtccccagatccaaggagccgttgtatgccgtacccgagggggcagcagacgcacgtcgaccagcggaagctgcggcggtggatcaagagcgacgcgacgctcctgggcatgcaccgggcagtgcgcgggacggacttcccggccgcgcaggcccgtcacctggcctggctcgagagcgtatcccgaaccctcggcagcagcgccccgtcggtcgccgcactggagatcgtcgtggcggaatggcagcggcgcagtgctcacttcgccggtcgcctgccgcaacctcccccagccatcgtcgtgttgccggcaccggcacgcgggccaggcctctcacaccacagcctcgtgccgcgcgccgtcgctgcactatggcggcgctgtgcgagaagcggtcaccagcggacaccgaaccgatgcaccccgcgcgcggacgctgcagaggggcaggccgtcgtgcgcccctgatgggtgctggcccgggggcagccacggtctgcggcgttgacttgccgaccggctcatggcgcatctcagttggtggtggggcgggatggtgaggacgtcgcggcggtgttcggggtgtcgcccgttccctggtgggagcgcagacgggtccggtccgggtccagtccatccgaccaggagggagcagtgtggacgctcacgtaattcggctctgtcgaagatcgatctgatcgtgtgatctcatccgtgcccagcagtcggcggcccagatcattctccacgcccacgccagggctgccggcgcgaggtgcccgcactgctcccggccgtcaggccgagtgcacgggcggtgtgtccggcggctggccgacacctcggcagggcgtgtttcgaaagtgggcctgattcgccccttcgtcgttacttcgggaccgctgtccgctcggtctcgtgcaggcctgcttgggcggctccgtggcgcagtgtctggagtccgatggctgcgacggggccgtgggtgccgggggtgagg

SEQ ID NO: 1295 - DNA, 2073 bp, Unknown
  Kingdom: Bacteria, Phylum: Actinobacteria, Class: Actinobacteria, Order: Streptomycetales, Family: Streptomycetaceae, Genus: Streptomyces
cgccgtctccggcatgccgcgcgcccaggccgcggcgaccccggcctgggcgcgcggcatgccggagacggcggtgttggtgatgggcgcgttgacgaagccgaagccgatgccgaacaggacgtagccgatgagcagggtgaggttggaggtctccgcctcgaagcccgcgaacagcaccgcgctcaccgtcatcgcggtcccggcgatcagcagcggcaggcgcgggccccgggtgccgaccaggcgtccggacagcggcgcgcacaggaacgtgggcgccgccatcggcagcatccacaggccggcgtgcagggcgtcgagcccgcgtacgttctgcaggtacagcgtggacaggaacaggaagccgccgagcgccgcgaagccgctgaccgcgatgaccgtggccccgctgaacggagcggagcggaagaagcgcaggtcgatgaggggttcggcgcggcgcggctcgtaccagagcaggccgagcagcgcggcgagcgcgaccgcggcgaacggcaggacgacggcggcgctcgcgtccggggcctcgatgatcgcgtacgtcagcgcgccgaacagggcgatgacgaggacctggccgaccgggtcggggcggcgggccttcggggcgcgggactcggggacgaagcggagggtgagcaggatcgcggcgaggccgacggggaggttgagccagaagatcgagcgccagccgacggactccacgagcagcccgccgaccagcggcccggcggccatggatatgccgaccaccgcgccccagacgccgatggcgcgggcgcgttcgcgcgggtcggtgaaggtgttggtgatgatcgacatggcgaccgggttgagcatggagccgccgacggcctgcaccatgcggaagacgacgagcagttcgaggttgggcgcgagcgagcacatcagcgagccgatgccgaagacgacgaggccggtcatgaagacgcgcttgcggccgatccggtcggcggtggagccggagagcatcagcagggaggcgaggacgagcgtgtaggcgtcgatcgtccattgcaggccggacgtgctcgcgtgcagctcgcgctgcatggagggcagggcgacgttcaggacggtgttgtcgaggctcacgatcagcaggctcatgcagcagatcgcgagcaccagcatccgccggcggtgactcagctcgggcatgtggtccagcgtaatcgatattagtgcggttaactaatgactattacaagttcgctgccggtgcgggacaatggggggatgtccacgcccgagtcccccctccagatcggcccacacaccgtccggccccccgtggtcctcgcccccatggccgggatcaccaacgcgcccttccgcactctgtgcagggagttcagcggcggcaagggcctcttcgtcagcgagatgatcacgacccgggcgctggtcgagcgcaacgagaagaccatgcagctgatccggttcgacgcgagcgagacaccgcgctcgatccagctgtacggcgtcgatccggccaccgtcggcaaggcggtccgcatgatcgcggaggaggacctcgccgaccacatcgacctgaacttcggctgcccggtcccgaaggtgacccgcaagggcggcggctcggccctgccctacaagcgcaacctgctgcgctccatcctgcgcgaggcggtcagcggcgcgggcgacctgccggtcaccatgaagatgcgcaagggcatcgacgacgaccacctcacctacctcgacgccggccggatcgccgtcgaggagggcgtcacctccatcgccctgcacggccgcaccgccgcccagcactacggcggcaccgccgactgggacgccatcgcccgcctcaaggagcacgtcccggagatccccgtgctcggcaacggcgacatctggtcggccgaggacgcgctgcgcatggtccgcgagaccggctgcgacggcgtggtcgtgggccgcggctgcctgggccggccgtggctcttcgccgacctggtcgcggccttcgagggccgcacggacttcgccgcgcggccc

SEQ ID NO: 1296 - DNA, 2658 bp, Unknown
  Kingdom: Bacteria, Phylum: Actinobacteria, Class: Actinobacteria, Order: Streptomycetales, Family: Streptomycetaceae, Genus: Streptomyces
cgcggacgcgggccgcctcgcgctccaggtcctcggggtcgcgtccgcgccgctcctcgacgggggcggaggtcgcgctcttcacccgggcgtcggcgagcgagatcgtgccgcgcacgcgttcggccagctgggacagttcgtaccaggtctgctgggcgcgggtcaggcgcggggtgagccggcggacctcgtcctccaggagcgcctcacgctggagcgccttgcgcagttcgcgctcggcgctctccttgcgttccttcagcgcggcctcgtcggcgacctcggccctcagcgcctcctggaggcgtacgaggtcgtcggcgagcaggcgcaggcgggcgtcgcgcaggtctgcctggatgacggcggcgcggcgggcgaccgctgcctgacggcccagcggcttgagctggcggcgcagttcgtcggtgaggtcctggacgcgggcgaggttcgcctgcatcgcgtccagtttcctgagcgccttctccttgcgcttgcggtgcttgaggacgcccgccgcctcctcgatgaaggcgcggcggcccatggggtccgcgtgcaggacggagtcgagctggccctggccgacgatgacgtgcatctcgcggccgataccggagtcggacagcagttcctggatgtcgagcaggcggcaggtgtcgccgttgatctggtactcgctgccgccgttgcggaacatgatccgcgtgatggtgacctcggcgtactcgatgggcagggcgccgtcggagttgtcgatggtcagggacacctcggcgcggccgagcggcgggcggccggtggtgccggcgaagatgacgtcctccatcttgccgccccgcagcgacttggcgccctgctcgcccatgacccagctgagcgcgtccacgacgttggacttgcccgagccgttcggaccgacgacgcacgtgatccccggttcgaaccggagcgtggtcgccgaggcgaacgacttgaaccctctcagggtcagggctttgaggtgcacgccgtcggactctacccgccgccgctacctcacttcatgaaccctcgcaaccgcgcggtttcacccatgtacatgcagggcacaccagacgttgaagagctggaagcatgcgcggggggcgcgggggcgagagcccgggaagagcgggggcaagaaagaagggacgccgaagcgtcccttgcaacttctggcaactgagcggttgatacgggcagcccaaccactgtgtcgctgtgccgaggcagtgatcaggtgagcgcaggctccgcctggtgtgcgtcgacgcgctccatgatcctgtcgtgagaagcggcagccgccaacgcgtcgttctccgcctggattcgtacgagctcggattccaggtcctggacgcgctgctggagccgtcgcatctcggcgaggagtcgagggtcggagccgccgacgtaaccgagaagcgcctttgccatgatggatggtcctccacaatgagtgaccgaccgaagcggtgtgggtcgtgagggattcgcacccgtggtgcttggcactgttgagtttttcgtgccgttcttccatgccaaacagctgaggtgcgcgggctttcagcgtctcaccaaaaagtttgacggtcaacacgatcacgccccgtatcgacgggcgtcccgggggcgcgcgaccggaaatcggcggcgctgcggctcctgcgggccccggggggcgtggcgatcatcctgccgtgccgagcgggccacggcaagcgcctctcggtatccatcctccatcacctgccgttttccttcccggcgcatgccggtggcagatgcggcctgccggatgccgggacggcggaccggaggactcagcggatggcgaagccgtcgtagccgccgcgaggtgtgtcccagatctcggtgacgccgtcgacccgtccgggcgtgtcgctgccctccagccagtcgaggaggctctggcaagccgtacgggacccctcggcgaccacctggacgcggccgtcggccagattgagagcaaagccactcaggccgccgatctccagggccgtggcccgcgtgaaccagcggaaacccacgccctggacatgtccccgcacccaggcgaccagtcgaacatcctcgctcatgactgcaacctaaccgggcggggtcgtaccgggcacatccggccccgaccccatgaggtaccgtcccgatccgatgcatctcatatgaaactcactcgatcgagtgacatcggttgaccgcgccggcccagtgcccacctcgacggacaggtcgacaggtcgacgggacgaggaaggccaggagatgggacgccaccgacgctcggacgccggccgcgccgccacgcaccgcgccacggaggtcagcagcacgcacggctcggaccggcggggccacggcccacacgactcgcacccggacgaccgcatgggcatcgcgccctatctgaacccggaggcgtacgccgacgcctacgccaaggccgaggaatacctcttcgcgacggacgacgagtacgcccgggccaccggcacctccgtccgggtcaccggaaccgtgtccttcccgcccgagggcttcacgccgtcgcagggcgcgcgcgaggagcgccgccggcgtcggcgtgaagccctcgggcgg

SEQ ID NO: 1297 - DNA, 932 bp, Unknown
  Kingdom: Bacteria, Phylum: Actinobacteria, Class: Actinobacteria, Order: Streptomycetales, Family: Streptomycetaceae, Genus: Streptomyces
  misc_feature (218)..(291): n is a, c, g, or t
tcttctccggcgccgcggcgctgagcccctcggcgtcgccgggcaccaggaaggccgtgatcccgcgcgggccctcctggccggtgcgggccatgaccgtgtagaagtcggcgatgccgccgtgggtgatccaggacttggtgccggtgagcacccagtcgtcgccgtcgcggacggccttggtgcgcagcgaggccgcgtcggagccggaggcgggnnnnnnnnnnnnnnnnnnnnnnnnnnnnnnnnnnnnnnnnnnnnnnnnnnnnnnnnnnnnnnnnnnnnnnnnnntcggacagggcgtaggcgccgaggagtccgccgccgagcatcgcgggcaggtgctcggcccgctgctccttggtgccgtacgcggcgagcccgtaggcggccagggtgtgcacgctcacgccgagtcccacggtgaggcgggccgtcgccagctcctccaggacctgcaggtacacctcgtacggctggtcgccgccgccgtactcggagtcgtagggcaggccgagcagtccggaacgggagagcagggtgaagacctcgcgcgggaagcgtccggcgtcctcctcctcggccgcgttcggggcgatctcgtgctgcgcgatgtcgcggacgagcgagatcaggtcccgggcctcgtccgtgggcagttgccggtccaccggctgcggggcgcggtcgggcatggcgacgctctcctccctgtcgggcactggcggacaggcaccctgtggggcggctccgccgggggcttcctcggcaccggccggtgctcgtcctcccgggtctcggaagcggctgatcagcggctgtgcgctgtgagtatgcccgatcggaggcatggagtcaccggttaacgaccgcttacttcaagaaagggtgaagcggtccgtgcggggccgtgggtcagcggtccgcggggg

SEQ ID NO: 1298 - DNA, 1247 bp, Unknown
  Kingdom: Bacteria, Phylum: Actinobacteria, Class: Actinobacteria, Order: Streptomycetales, Family: Streptomycetaceae, Genus: Streptomyces
gggcaggagtcgacgccggtgaccgcggcccctctggcggccgccatgagcagggcgagcccggagccgcagccgagacccagcagccgtgttccgccgcccacctccagccgctcgtagacggcctcgtagagcgggaccagcatccgctcctggatctccgaccagtcacgcgcgcgtgcacgcaggtccaccccgggcgcggggcccgcgtgaggcaggtgctgacgcacgagcgtaggtgtcatggataagcgccccaatccgccgagaactgccgctgtgccgattccgtgccgatccgtggcccccgtgcagtgcgcgcgcacttccgtatgtcaggtaactccccgctccgcatcgcgtccaggggtcgtgaggggctgttcgtccgttccgggcacccggcccggagatttcacattccggaaacccgggctctgccgccatgtcgcgggcggccgggggtggggtggtgcgggacacctgggacgctcccggtaacgtcgccgtcgccgcgcacgcttaccgaggtacagccttccgccggggaagcggccgaaacgtctcttgtacaccgcgcgcgtacctgtgcaccggcgtgcgtggcggcctacgcgccggtgcgtacgcggggctacgcaccaccttggtatgagctgtgaggcttctccgcagatcagcgcacccgccctcgtcaggacgcatcagcggcaactgacgggtacgtgcaaattatttgggatgccccggaataggaacacagcggccctcccgctcgttgtcattacgtgagcacgacacagacaccacctgttctcgcagcggagctggcgcaggcgtgggccgacattcagcggtaccaccccgagctgcctgatctcgccgcgcccgagtccctgatcggggagtcgtcgtccgcgtgcgggcacgagctctccttcgagcgactgctccatgaggcagtccacggcatcgccgccgcgcgcggggtacgcgacacctcccgcgccggccgctaccacaaccgccggttcctcgcgatcgccgaggagctgggcctcgaccaccccgacgagccgcacccgagcagcggcttctccctggtcacgctcagccccgaggccaagcggcgctaccgcccgacgatcgaacgcctccagcgcgccctgaaggcgcacacggcggccaccaccgccgacaccggccgcagcttccggggcccggccgcccgccacggctcctcc

SEQ ID NO: 1299 - DNA, 1448 bp, Unknown
  Kingdom: Bacteria, Phylum: Actinobacteria, Class: Actinobacteria, Order: Streptomycetales, Family: Streptomycetaceae, Genus: Streptomyces
acggtgaccccgtgctcgcgccccgcgcgctgcgcgagcacggggtcaccgtgaacgccgtggcgcccgggttcatcgagacgaagatgaccgctgccgtcccgctgttcatccgcgaggcgggccgccggatgaactccctcgcacagggcgggctgcccgtcgacgtcgccgagacgacggcctggctggcgcacccggactccggcgcggtcaacggccaggtcgtccgcgtgtgcgggcagagcctgctgggggcgtgaccatgaccggcgccgccccggacggccgctccaccgtcgtcctcacccgcgctcccgccctcaccccgctcctcgcccgcggcgccctgcgctcgcccttccggcgcccccgcccggacgcgcccttccccggccaccggctcgtcctgccgtccgtccgcgtcgacctcgcgcggctggccgcctacgagcgggtgtgcggcttcgcgaccggcgaggacggactgccgatcacctatccgcacgtgctcggcttcccgctcgccatgcgtctgatgagcggcgggggcttcccgctgccgctgctcggcctgctgggacaccggtcgctggcccgtggaggaccggcgccctgccgtcgcccaggccttcgacagcccgcgcccccgcgagggaggcggtgccgacaatctactgcgcgaccagcgcgtcgacctccagctccaccggctgctgcagctccagccgcagggcgcgcacccgcgccggctctggcacgcactgcgcggcgacgaatcctcctacaacccgagcaatcgaaagatgatccccctgccgagggcgatccgggaaagccgccacttcggcggtcgcgccgatctgccctatgcagcagtaagcgcgagcctcacacggctggccgcagccggggctgcagtcgagggcccggacagcctttggcgagcggttcgcccggtccgacacacgagattccgctgggcgggaagcggatctgaacggaaggacggcttggcgtgaccacgatgatcagcactggaccggacatctggcggccgttcgacggcgagcctgtgctcactcctgccatgaccggcggacacggcagcacacccgccgaggacctggaacggttgcgccactatctggaggcggtcgtcgccgaccgaatgtgtccggtgcacaccgtggtcgccttcaacgcggcctatttcggttacgaactcggtggtgaaggccacggcaagggccccttcgacccagacgcgtttccgtccctgacgctgggcgacgaagtaccggccctgcccgtcggggcactcgtgcgcatcgaaaccggatccgacccgctgtacgcggagatcgtctacaaggagggctgccaccctggcgtcgaagagggtgtcgacgtacccgcttgggtatccggggcaccggccggtgccc

SEQ ID NO: 1300 - DNA, 2282 bp, Unknown
  Kingdom: Bacteria, Phylum: Actinobacteria, Class: Actinobacteria, Order: Streptomycetales, Family: Streptomycetaceae, Genus: Streptomyces
cgaggatcctgcgcccgcggctcggcgaggcgttctcccgcgcggtcatcgaccgcatgctgggcgccggccgcaagccgctgatccagtccttcggcctggagccccaggtcgtcgtggagcactgcctggcggcccaccgcatccgccgtgagcgcgacaactggctctcggcggtgacggtgctgtgcggggtgctgttcctgcccggcttcctggtgtggctgctggtgttcgtgctgcgcaccacgatgacccggcgggaggacaggcgcgccgggatgctcgccaccacgctgctgctcgccatcggcgcgctcgccgtgctcttcctggtcaggatgccgttccacggcttctgggcgtggtacgcacgcgcggccgtcgtcatgccggtcgtcggctggttctgggccaagcggatctgtgagcgcaccgcgcgggacctgcgcgagcgctgggagggcctgctctccggcggcggtgtcggcgccaagatcccggaggcggtccccggcagcccgggcgacgccgccgagcaggtgcgcaaggaactcgcccggctcagcgccgagcagcgctccaactccgtcttctacgccggtcccaagggcatactcggcatgggcacccgctggggcagctggcagctggccgaggagctggtgtcggccgacccgggcaaggagttccacccgttccgcagctgggacgtgatcaccgccatccagggcggcctcggcatgctggagcgcacctccatcaacaccggcggcttcccgaagccgacgatcacgcactggatcgtcacgccgatcggggagaacgccaaggaggtcgcccggccgggcggcgcggacgtcgacgcgtacaccgtccgcagccacgccgtgcaggacatctgcaacaaacagcagttcggcagcggcgaccggcactacctcggcgtgcagtggacactgtgggacggccacctggtgatcaccatgatgatcaccgtcacggtgctgcacaacaccctgcgcatcgaggtcaccggccacgccctgggcccggtcaacccgctcttcaacggcaagcccgcggccaaggagaaggaggtggcgaaggcgctccggttctgggagacccgcaaggtgaagctgcccctggtcgacgccgacgaggtggtacgcctcgccgcccgcgcaccgctgacctggtacccgccgctgctcaactggctcggcggcagcctgaccctcccggagccgttcggcctgcggcacgcctgggccgaccagccctggcgccaccgcttcatggccgacgacgccctgcgcgccgccacgcccgtactgcgggtggtccacgccgcggcgctgaaggtcctgcgggacaacggcgtggacgtggagaagttcggcaaccgctcggcggtcctcagcggaaacgtccaggacgtgtcgcccaagaaggccgacctgtacgacgcgtaggggccctggacgcgcggcggaggccgggcctgcctactcgggccaggcctccgcgagcatcttgcgggtgtcggcgagcagctgcggcaggacccgggtgtggccgaccaccggcatgaagttcgtgtcgccgccccagcggggcacgatgtgctggtggaggtgggcggcgatgcccgcgcccgccaccgagccctggttcatgccgatgttgaagccgtgggcgcccgaggcggcccgcagcgcccgcatggcctgcttggtcagctcccccagctcggcggtctccgcctcggtgaggtcggtgtagtcggcgacgtgccggtacggcacggtcatcaggtggccgccgttgtacgggtacaggttgagcaccgcgtacacctgctcgccgcgccggacgatcaggccgtcctcgtcggacttggccgggatggcgcagaaggggcagccgtccttggcccccggaccggtcggcttgttctcgccctggatgtaggccatccggtggggcgtccacaggcgctggaacgcgtcctgcgtccccactccgatctgctgctccggctcactcgtcatgcaaggcagcatatggcttcggccgttcgcggcgtgtcggcggggcgcccggagcacgggacgcggccaagctgggccggtggacgacgacagcccggtgacccgctgggagcggcacgtggacgcgccgctcgcggtggcgtccctgctccaccctcggctcgtacgcggtgctggtcctcggcgagggcctgcccgcggccgtcgccgaggaccagcaccgcg

SEQ ID NO: 1301 - DNA, 8864 bp, Unknown
  Kingdom: Bacteria, Phylum: Actinobacteria, Class: Actinobacteria, Order: Streptomycetales, Family: Streptomycetaceae, Genus: Streptomyces
gggtgcacgcgcgcgtgcccggcaccgcctgcaccccgtcgtgccccatcgcaccccagcgcgccccgagcagcgcgccgatgtccacgcccagcaccgaccggtcgtcgtccgccatccgcgacgccagcgggtagaacgtgccgagcgcggtgtcgaagtgcgaggtgcagcacaccagggggccgtccacccggtgctcctgcccctggaggacgcctcccgcgcgcgggtcgccgggcagccgggcggcgaacgcgtagtgcgagaaggccccctggagcagcgtcacggacttcaccgcccgcacccccgcgggcagcccgcgcagcgcgaacgacaccagccgcccgccgaaactgtgcccgaccagatggacccgcagctccggggccgcgtccgcgagccgggcgacggccggtccgagcccgcgctcgccgaccgtgcccgcgcgccgcttcatcgtgtagtacgtcgcctgccgcagcagttccttcgcgccctcccacggattcggcaacgagaacgactcctggcccgctggccccggctgcccttcctgccccgcctctgccgccgcctgcgcgaactcggcgcagacgtccgtcaccggccgcgtgaacatgcccggctcacgctccggtacgccctccgccaccgtgtccgccgtgaagtgcgcctgcggccccggccccaccacctccaccagcagccgcaccagccgcccgaactcctcaagagcggcctcgtcgctcgggtgctggtccagtatccgagcgagccggtccaccaccgtggcgcgtcccgggaaggtctccaggagtgcgtgccgggtgtccttgtcgagcgccgggcccggcaccggtccggccgcggtggagcgcgggaagtcggggatcggctcgtcgcagaaccgcatcgacggccagatcacacccacgtacccgatccgcgcggccggcgcgaggcccggcaccggggcgaagaactggcggtagaggcgggtggcggtggagcggtcgttgttccagccgtgcgcgaagacgatcaggtcgcgcacgccgctcgcgcggaccccggcgagcagccggtcccgttccgggccgtccacgtccccgtcggcgtcgaaggtcagctcccagtacggagccgcacccgtgcccatgtccgccataccggaccccctcgtcccccgaagcggtgcgatgtgtgtgcatcgtcctgcgatcgggggaccttggccatacgtcaggacactcccgtaaggagtaattccggacgtcccaccgtgacggcccgggcgcgcctcaccggtagaggaggtagtgccggcgtgtctcgcggaacgcggccagttcctcgcgccagccgcccaccacctcgtcggtgtccgcacccgcgtcgatcatcgtgcgcacccgcgcggaaccggtgagcttgtcgatccagtcgtccgagcgccaggcgaacccgtcccagacctgcttggcggtcaccagcagggcgatcccggtccgtacggggtcgtacgcggcccggtcgtggacgtggatctgcaccccgccggccgtcttgccctggaacttggagaaggtgggcgcgaagtacgcctcgcggaagcgcacacccggcagcccgagcgcgttcacggcctccgcccagcggccgtcgacgccctccgcgccgagcagttcgaagggacgggtggtgccgcggccctcggagaggttcgtgccctcgaacatgcaggtgccggagtagacgagagcggtgtcggcggtcggcatgttcgggctcggcggcacccagggcagcccggaggcgtcgtagaagtccgagcgctgccagcccgtcatcaggacggtctccagccgcacgggcttgctcaggaactccccgttgaacagccgcgccagctccgcgaccgtcatgccgtgcgcctgcgcgatcggccgccgtccgacgaaggtcgagaactcctcgtgcagcaccggacccagcgcctcccggccggtcaccgggttcggccggtcgagcaccacgaaccgcttgccggccagcgcggcggcctccatgcagtcgtacagcgtccagatgtaggtgtagaagcgggcgcccacgtcctggatgtcgaagacgacggtgtccactccggaggcggtgaagacgtcggcgagcggctgcccgctcttgaggtacgtgtcgtagaccggcagcccggtggccgggtcgtcgtagcggccctcggagccgcccgcctgcgcggtgccgcggaagccgtgctccgggccgaagacggcgaccaggtccacccgccggtcggcgtgcatgacgtccacgatgtgccgtacgtcccgggtgacgccggtcgggttggtgacgatgccgacccgctgtccgtcgagcgccgcgtagccctcggcggcgagtcgttcgaagccggtccgcagcggacggccgtggccctgcggggccgcctgggccgcctcggcctgtgcggccggtacggccgaggccgcgaccgctgccgtaccggcgagcagactccgtctggacagcttcatgcggcgacctccgtgatcagggcgggtgtcatgcgcacgcacgctagcgcgcgccccgggccgctgggaacgaacctgcgcgagtgcccgaggtctacaccagtggagccgccctgcggcgcgccacctcttcccgcgccacataccgaccggttagtgtgctggggcagagccgtagcgtgccgtgtcgaaggagaccgatggtgcaagccgttcagggtgcgggagtggtcgtcaccggggccgggagcggcatcggagccgcgctggcccgccggttcgcagccgagggagcgaaggtcgtcgtcaacgacctcgacgcggcccgtgccgccgccgtcgccgaggagaccggcggcatcgccctgcccggagacgcctcggcgatcgtctccgacgcccgcgacgcgctcggcggcaccgtcgacgtctactgcgccaacgcgggcgtcggctgcgccggtacggaggcggccggcgaggaggtctgggcgcgggcctgggacgtcaacgtcatggcccacgtccgcgccgccgaggcgctgctcccggcctggctggagcgcggccacggccggttcgtctccaccgtctccgccgccggactgctcaccatgatcggcgcggccccgtacagcgtcaccaagcacggcgcgtacgccttcgccgagtggctgtcgctgacgtaccgccaccgcggtgtcaaggtgcacgccatctgcccgcagggcgtgcgcacggacatgctggccgccaccggcagcgcgggcgacctggtgctcaagcccaccgcgatcgagcccgaggacgtggccgacgccctcttcaagggcatcgccgaggaccgcttcctcgtcctgccgcaccccgaggtcgccggcttctaccagagccgcgcaggcgaccccgaccgctggctgacgcacatgaaccgcatccagcgcacctgggaggagacccggtgaccgccgccccagacccccgctcccggtacgcggccaagccctggctgcacctcctcgacgaggcccagcgcgccccggtcgaccccgccgactccctggtgcacgccctgcgccggtcggccgccgaggcccccgaccgcaccttcctcgcctacttcgacgcccgcctcacctaccgccagaccgacgagctgagcgactcggtggccgggcacctcgccgcgcgcggcctgcgcaccggcgaccgggtggccgtcgtcctgcagaactccccgcacttcgtgctcgccgtgctcggcgcctggaaggcgggcgccaccgtcgtcccggtcaacccgatgtacaagtccgccgaggtcgcccacgtcctcgaggacgccgaggtggccgcgctcgtctgcaccgaccgggcctgggagtcctacctgcgcgccacggccgccggctcgcccgtgcggatcgtcctcaccgcgtgcgaacgggacttccagacccgcgacgacccccgcgtgctcaccttcgaacggctgccgcaggctccggacgccgacgacctgaccgccgtggcccgcgcaggccacccggccccgggtactccggccccggccgccgccgacaccgcgctgatcagctacacctccggcaccagcggcacccccaagggcgccgtcaacacgcacggcaacatcatgtacaacgccgaacgccagcgcaccggcctcggcctgcccgcggcgcccgtctacttcgcgctggccccgctgttccacatcaccggcatggtctgccagttcggcgcctgcctgaacagcgcgggcacgctcgtgctggcgtaccgcttcgaaccctccgtcgtcctggaggcgttcgccgagcaccgcccgcactacaccgtcggcccgtccaccgccttcatggcgctcgccgcccacccggccgtgaccccggaccacttctcctccttccacgtcatctcctccggcggcgcgccgctgccgcccgcgctggtggagaagttccggacccgcttcggcccctacatccgcaacggctacggcctcaccgagtgcaccgcgccctgcgcctccgtgccgccgggccgcgaagcccccgtcgacccggtctccgggacgctcgcggtgggcgtgccgggccccgacaccgtcgtacggatcgtcgacgacctcggcgcggaggtgcccttcggcgagcagggcgagatcgcggtgagcggcccgcaggtcgtgcccggctactggcggcgccccgacgccaccgccgagaccttccccggcggcgagctgcgcaccggcgacatcgggttcatggacgaacagggctggctgtacgtcgtcgaccgcaagaaggacatgatcaacgcgtccggcttcaaggtgtggccgcgcgaggtcgaggacgtcctctacacccatccggcggtgcgcgaggcggccgtcgtcggcattcccgacggctaccgcggcgagaccgtgaaggcctacatcagcctccgcccggacgccgaggcggacccggacgcgctcgccgcgtactgcaaggagagactggccgcctacaagtatccgcggcaggtggagatcctgccggagctgccgaagacggcgagtgggaagatcctccgtcgggaactgcgttcccgcgacgacacccggtagcaccgacaacacgcgcagaaccacggaaaggcaggtggcggcagtgcccaggacgacggaatcagccgggacacccgtgccccagcggctgctggccgccgccacccggctcttcgccgaccagggctacgaccgcacctcggtgcaggagatcgtcgaggcggccggcgtcaccaagggtgcgctgtaccactacttcggctccaaggacgacctcctgcacgaggtgtacgcgcgcgtcctgcgcgtccagcaggagcggctcgacgccttcgccgacgccgacgaacccgtcgagaagcgggtccgggacgccgccgccgacgtcgtcgtcaccacgatcgacaacctcgacgacgcgtcgatcttcttccgctccatgcaccacctgagcccggagaagaacaagcaggtgcgcgccgagcgccggcgctaccacgaacgcttccgcgcgctcatcgaagagggccaggagaagggcgtcttcaccaaggccacccccgccgacctggtcgtcgactaccacttcggctccgtccaccacctgtccacctggtaccgccccgacggcccgctcaccccgcagcaggtcgccgaccacctggccgacctgctgctgagggcgctgcgcgcgtgagctgagcgacgcgggccgcgcagccgcggggcgccctccggggagccgctccgcaagacccgccggcgagccgtcctagaagaccagcaccgccgcgcacaccgccatcgccaccgtgcacagcaccgccgccgtggcgagccggggagtgagggccggcggggccggtgtgtgcgcgaggcggcggatgcggaactgggccagcagcaggaagcccagccagagcaggcagcacagcgcgcagacgaggagatcggcgggggaggcgccaccgtgcagggccgtcctcacggcgagcacggccgccaccgtgctggacagcgtcgtacgccgccaggcgagccgcgtccgctccggctgcagcccgggatcgcgtaccggaccggccgccccgccccccgtactcacccggcccgtcccgccaggaccaccacgaccatcgccacggccacgaccgccacgacgatgcccagcagcgccgggaagcgggaggcgggcaggtcctcgccgcggcgcatcgcccgctcgcagcgcacccagtggttgaccgcgcgcagcgagcacagcacgcccgccgcgagcagcgcgagcgcgagaccgatgcgccaggcccagcgcaggtgcggcaggaactggtccaccgcgaagccgccgccgatgagcgcgagcgcggtgcgcagccaggccaggaaggtccgctcgttggccagcgagaaacggtagtccggtgtactgccctcctgcctgacctcctcgggggcgaaccacaggcggacgttccgtgcgaagtcgatcacgaggggaccctatccaggcgcgggacgtgcggccccggcggccacgtcaccgtcaccgggccgacctgtgggcgttcaggcgctcgtaggcggcgaggccgtcgggcacccactcccactcgcgcagccgccgccggacctcgtcctcggccaggaagccgtgccaggcgacctcctcggcctgcgggcgcaccggcagctcgcagcggacctggtacaccgccgaccaccagctgcggcccgcgccgtcgtcgtacaggaacttgaacaggtactcggggcgcggcagccccgtcacgcccagttcctcctcggcctcgcgcagcgccgcgtcgtcgtagctctcgccggctccgacgacaccgcccacgaacaggtcgtacagggaggggaagaccagcttggccgcggtgcggcggtgcacgaagagccgtcccccggcgtcccgggcctcgacgaagacgcagcggtgccgcagcccgccggcgtagacctccccgcggggtgcctgcccgatgacgcggtcgtcggcgtcgacgatgtcgaggatctcgtccgcagcgctcatggccccatccaagcaggccgcgccaccacggccgcggcgggtgcgggtcagcgcggctgcagcttccgtttctgctcgggcaccgaggcgccgcacggcatcgccggatgcaggccgagcagcacgatgcccgccacgatcgccgcgagccccgcggcctcccaggccagcgcgccgatgtcggtacgcagccggtcgccgaggaagccgaccccgcaggcgatcccggccagcggctcggccgcggtgagcgccggcagcgacatgcgcagcggggccgtctcgaaggcgctctgcacgaggatcagcccggtgacgccgatgaccagcaggccgtacggctgccagctggtgaacagctccgcccagccgcccgcggagaaccgctgcccgctcacccgggtcagcgcgtcctgcacgccgtacagcagcccggcggccaccgcgagcagcaccggtccccagctgagccgggaccgcttggcgtaggtggtcagcagcagcgccacgcccaccatggtcccgatgatcagccagtgccgcagcggatcggtgaccgcgctgcccgcccgcggctggcccgccaggatgaacgccgtcacgccccccgccagcagcgcgaggcccagccagccctggcggcccagcggctgccgggtctgtctgcgggaaagggcgagcgcgaacagcaggttcgtcgccagcagcggctccaccagcgagatctcgccccggcccagggccatcgcgcccagcaccatgccgacgaccatcaggccgagcccgcccagccagcgcggcaccttgaccaggtcgagcagcagccggggggagaggaagtcgctgagcggagcccgctgggccgcgttctgctggagtacgaaaccgaagcccaggcagcaggcggcactcacggcgaggatcagaaccagaaccgacacgctgcgtacctcgatcatccggccgggccacggggtgcgtaatggccgactgtagcgtcctggagcgccgttcgccggtgcgagtacccggatccgcgcagtcgacccgtccacgacgccctgcgcgtcagggcgatggcccggcagtacgcccatggtgggccgcaccggccgacaccgccatggcgtacgccacatgggtgaggtgcagggggcactcacaccggtgggaccggcctcggcgcgacggagcgctcctggttcacaagtgccttgaatggaggcctggttggtgcgactgcgcaccgaatcggcgccgtccgcaccgcgttgacgcagagccgtcagcggtcggtcccgcgcgccacgggacagggagagcccggccggcgaccgccccgccggtccgacgcgacgcaaagacacgcggcccagccgcataaagatgcgcgccccgaaagatgacggaagtctgacggccccccgagaaccctggcacccccggggtccagggtgctcgaatgaagacgtgaaccccgaaccgtccgaggaaccgggccgccccgaccgcccgcccgaggagcggcgcggtcccgccggcccgcccgaggaacagggccgtcccgtcggccgccgtgtcttcctcgccaccctgggcctgggcgccctcggcgtggccgccgcgcccgcgctgcaacgcggcctcgagggcgtcc

SEQ ID NO: 1302 - DNA, 3505 bp, Unknown
  Kingdom: Bacteria, Phylum: Actinobacteria, Class: Actinobacteria, Order: Streptomycetales, Family: Streptomycetaceae, Genus: Streptomyces
ctgggccgtcgccgaccgacgcggggcgtaagcccacacggcggggcgggacggcagccagcccgcaggagggccgtaagccaccccgcggggcacggagcacgggctccacgccccgcgacaagccctcacgccgggctcgacgacggaggcgtgacgtccgggtggccgttgcgcgcggacggcgcccccgtcaccgcggtcagcggcgtggcgatgtcctccagggagcggcgctcggcgttgaccgcgaggaaggcggccaccaggcccgccgcgcacatcagggccgcgccgatcgagaaggcgaggaccgtgtcgccgaccttgcccgtgcccgtgaggtcggcgaagagcaccgggccgctgatgccgccggcggcggtaccgagggcgtagaagaaggcgatggacatcgccctggtctccatggggaagatctcggagacggtcaggtacgcgctggaggcgcctgccgaggcgaagaacagcaccgcgcaccagcaggcggtcagcgtggtcgcgtcgagcgtgccgcggtcgaacagccaggccgtgccgaacagcagcaggccggacagcaggtaggtggcggagatcatcacccggcggccgaccgtgtcgaagagcttgccgagcagcagcgggcccaggaagttgccgaccgcgatgacggcgaagtagtagccggtgtggtcggcggggacgttgaagaacttggtcaggatggcgccgaagccgaaggtgatggcgttgtagaggaaggcctggccgatgaagagggagaagccgagggcggcccgcttggggtagtcggcgaagaccgtgcggccgatctccaggaaggagatgctgcggcgctggtggatggtgatctcgccgtgcggctcgggcagcggctcgtcggtctcggactcgatccgccgttcgatgccggcgaccacctcctcggcctcgcggtccctgccgtggatcagcagccagcgcgggctctccggaacgtgccgccgcaccaggaggatgaccagggcgagtacggcacccagcgcgaacgtcagccgccagcccaggtcggcggcgaggaaatgggtgttcagcgcgaggatcgacagcagcgaaccgccgaccgcgcccacccagaagctgccgttgatgatcaggtcgacccggccgcggtagttcgccgggatcagctcgtcgatcgcggagttgatggccgcgtactcgccaccgataccgaacccggtcaggaagcggaagaggaagaaccaccaggcctggaaggacacggcggtcagggccgtcgccgcgagatacaccgccagggtgatcatgaacagcttccggcggccgtggcggtcggtcagccggccccagaacagggcgccgacgcaggcccccgccacgtagagcgcggcggcgacaccggtgacctgcccggagctgatcgccagaccgctgcccggctccgacaggcggccggcgatgttgccgacgacggtgacttccagaccgtccaggatccacaccgtgcccagaccgacgacgatcgtccagtgccagcgcgaccagggaaggcggtcgagtctggccgggatgtcggtggtcacggtgcggccggtgccgtcccctgccgcgcctgcggcgcttgcggcgtctgcggtggccatgggctccctcctcgacgagcggacctcactccgggtgcccccgaacccatgggatcacgccctggcaccggccgcctacgctccgacgacgcgcgagagggtgtagatcagcagccccgccagcgaacccaccaccgtgccgttgatccggatgaactgcaggtcacgtccgatgtgcgcctcgatcttgcgggtggtgtgctccgcgtcccagcccgccaccgtgtcggtgatcagggaggtgatctccttgcggtacgtcgtcaccacgtacaccgccgcgccctccacccagcggtccaccttgccctgcgccttggggtcctcggccatccggttgcccagggagagcagcgaggcccgcacccgcagccgcagttcgctgcgctcgtcctccgccgccgagacgatcatcgaccgcaccgccgaccacgcggaggcgatcaggtcctgcacctcgccgcgccccagcacctcgctcttgaggcgttcgatacgcgcccgggtgtcgctgtcggactggaggtcggaggcgaagtcggtcaggaagcggtccagcgccccgcgcgcgggatggctcggcatgtcccgcatctcggtgacgaagcgcagcagctcccggtagacgcgctcaccgaccttccggtcgacgaacttcggcgtccagccgggtgccccgccctgcacggcgtccatcaccgagtcgccgtgcagcaccagccagtcgtgcgcgcggctgaccaccaggtcgacgacccgtctgtggccgccgtcggcgacgatcttctccagcatcttgccgagcccgggcccgatctcctgcaccgccgcccggcgcgtgatcgcctcaccgaccaccgcctgcacgtccgagtcgcgcagcaccgtcagcgcgccgcgcagcgccgtggccagctccgcggtcacccggtcggcgtgctccggacgggccagccaggcacccatccggccgccgatgccgaccgcgcgcagccgctgccgtacgacgtccccggagaggaagttctcgccgacgaactcccccagcgagacaccgagctggtccttcttggtggggatgatcgccgtgtgcgggatgggcaggccgagcggatgccggaacagggcggtcaccgcgaaccagtccgcgagcgcgcccaccatgcccgcctcgctcgccgcggcgacatagcccgcccaggcgccggcgccccggtgctcggcccacttggccaggacgtacaccaccgccacgaacagcagcagccccgtcgcggtcagcttcatccggcgtacgccgcgcctgcgctcctcgtcggccgggctgaacacggtcatcgcgcgccgggcggcggccgcggcatccgccgctcccgcgtccgcctgtggcaccgccgtcgtcgttcgttccatccgctccacccgttccgtgttcccgcacccgccccgcgcacgattgtcccctcctgacctactcccggaacggaacaggagttcccggcatcacccggaagaggcgcgggaggggtgcagaagggacggaggcggggacgggcagcgcccggacaagggaagagccgcagaagggaagggggccgggcaagggaaggcggccgggggaggcgtgtcagaagtcccggtggccgcggccgtcccggcgccgttcccagcggtcccgttgctgcgcccgccgttcccggtactgctcccagcgctcctcgtgccgatcgcggtgctgctccatgcgctcctcgtggcgctcccactcccgctcccagcgctcccggcgctcgtcgcggcggcccgcctgcagctcgcggcgctcggccctgcgg

SEQ ID NO: 1303 - DNA, 3415 bp, Unknown
  Kingdom: Bacteria, Phylum: Actinobacteria, Class: Actinobacteria, Order: Streptomycetales, Family: Streptomycetaceae, Genus: Streptomyces
ccgccagctcggcctggacgtccggcggcagggcgacggcgaccgcgtccacgtccgccagcagcgcgtcgacgtcggcgtaggcgcgcgtgtcatggcgtgcggccagttcctcggcggcggcggtccggcgcccccacacaccggcgaagtccagcccgtcgtgcccgctcagggcgggcgcgtggaccatccgggcccacggccctgtgccgagcagtccgatgcgcataccgctgcctctccactgtgccgaacagggtgacggccgacgcccgcacgggcccggccccggccgagggtgtcacagcggtgccgccgccgggagcccgccgccgcgcgagcgccggcggcatcgcctcaggccgcctccttctgcccggcgggcgcgcccgcctcccggcctcccgctacgtcaccgcccgcctccttccgctccgccgccccggaggccgccggagcaccgggcgtccccgcggcttctcgccgcccgcccgggatcagtcgcaggtgccttcggcgccgggcggggcggccgtgcgccggaacggcgccggacattcggtcctcgatccggtccatgacgagcaggagcacacacaggagcggcagcaacagaactgcgacgaccaccacgacgcctccctctccgacacctgaggcgagtgctccgaaccgcgccgtcgatggcggcggcggcgtgaagaatctgtgacgatcgggctgatcgggacgatcggacccggggtcgccgcccttcgtccgtccatggactggtccgggtaaacgcggggtccctaggatgtactctcagtcaaaccggcccagttggcgcggtggattcggcgaatctgggggatcgatgcctacggagaaccagctgtccacgaagatcgacgagaacgtgccgacggccgcacgcatgtacgaccactacctcggtggcaaggacaactacacggcggaccgtgtggcgtgcgaggaactcgacaaggtcgtccccagcacccgccggctcgccctgaacaaccgccgcttcctgcagcgggcggtcaggacgctcacgcaggaatacgggatacggcagtacctggaccacggctccggcctgcccacccaggacaacgtccaccaggtcgcccagcgcatcgacccggagacgcgcgtggtctacgtggacaacgacccgatggtgctggtgcacggccgcgccctgctgcagcaggacgagcgcaccgcggtcatccacgccgacatgcgggacaccgaccagatcctcgcgcacgaggacacgcggcggctgatcgacttctcgcaaccggtggccgtgctgttcaactcggtgttccactgcatcccggacagcgacaccgacggcccgctcgccgtggtcgaacgggtccgtgagcggctggtgccgggcagcatcatgctgatgtgccagctcgtcagcgaggaccccgaagtccgtcagttcgtcaccgacttcatggcccaggccacccagggacactggggccgggtgcgcgagcggaaggacgtcgccgagtggttcgagggtctggagatcctggagccgggcctggtcgaggtctccacctggcgccccgacaccgaggtggcaccccgccaactcactcacgagtgggtcgagttcggcggcatcggcgtggtccggtagccagacgccgaccggccgaccggagcgccgcgcgccgacggcaacgcccccgtcggccactgacggaagtggccgacgggggcgttcacttgcccgcgcgtgcgcccgcccggctgtccgagcgtgcgcctgtccggtcagctcgccgcgtaccgctcgtccatggtcctgcgcagcaacgccagcgactccagaggcgtcagcgcctcgtcggccagtcggtcgagggagatccggtactcctcggtctcgtcccggtcctcgaggaagttggcgctcctgatgtgctcgaggtagacgacgtccggcaggtcgagcccgccgaaacgcagataggtgaccggtatcgcgggcgccgacgcgttcgtcacgtccagcggcacgatctgcacggtcacgtgcgggcgctgggccagctccacgagccgggcgagctgttcccgcatgatgtcgcggctgcccaggacgcgcagcagcaccgactcgtccatgatcgcccacagttgcggcgcgtccggccgctccagcaactccgcgcgcttcatgcgcagttcgacccggcgccgcacctcgcctgcggaggcggtcggcaggccgcgctccatcaccgcccgcgcgtaggccgaggtctgcagcagtccgggcacgtactggatctcgaaggtgcggatcgcggccgccgcctcctggaggccgacgagacggtcgaaccactcgggcatcagccgcttgtcgtagcgctgccaccagcccggctctccggcccgctgcagcagcttcagcaggaccgaggactcgtagtcgtcggtgccgtacagccgcagcagagcgcggacgtcgccctccgccggaggccgacggcccttgcccgactcgatgcgcgagagcttcgcggcactgaagccgaggccccgggccgcctggtcctgcgacatccccgcgtcctcgcggaaaccggcgagttggacgccgaccagcatcttcagcagagtcggcgccggctcggcacggtcgagatagggttccagacgggagaggcgatgcggctcggcggacatcctgactccccagtggaccggcagacttgaggcttagactatcgcacgggtccgccacggagggcatccctccggccaagcttcggaaactcgccaagtcccttctgcttcagcgcagatgggggtggatcaccacagcagatggtcgaactcgccgtccttggcgcccgccaggaaggcggccacctcggccggcgtgtagaccagggcgggcccgtcggggtcgcgggagttgcgcaccgcgatgcccccgcccgccagcgcggcgacctccacgcagttgccctcggcgttgctgtgcctgctcttgatccagcgggcgtccaacgaactggcccgcactccgttcagcactggtggcaccgcagtctcctcgctgttcccgttccgtcgtgaggcgtgcgcggatcgccgtcgggttccggtggcgtcccatccggatccttcccctcggcgcgcactttcacgagaaatttcgcgtgcaattgcacgcggacgctgacagcgtggataatagccggagcgtcaacccctgggtgggcgcggtccggtgacgccacatcagggagacgccagtgccctcacctgcgatcctccggcccggaacaccgggcgtgaccaccgccgcagcgccccggccgccccacgcgcccgcgtctgctcgccggttcggcag

SEQ ID NO: 1304 - DNA, 1685 bp, Unknown
  Kingdom: Bacteria, Phylum: Actinobacteria, Class: Actinobacteria, Order: Streptomycetales, Family: Streptomycetaceae, Genus: Streptomyces
ccagcatcacgtagttggtgatgtcgacggcgagcgagatcgggcgcatgccggccttctgcaggcggcgctggagccagatcggggagcgcgcctcggggtcgaggccggtcacggtgcgggcggtgaagcggtcgcagccgtacgggtcggagatcttcaccgggtggccgaaggcgttcggcgccggtacgtccagcagggccgggtcgagcagcgggcggccgtaggcgatggcggcctcgcgggccacgccgcggatcgacaggcagtagccgcggtcgggggtgaccgcgatgtccaggacctcgtcgacgagctggagcagctcgatggcgtcggtgccgacctcgtgctcgggcggcagcacgatgatgccgtgcgtgccgtcgtcgcccatgcccagctcgtcggcggagcagatcatgccgtgggacgtcttgccgtacgtcttgcgggcgctgatcgagaagccgccgggcagggtggcgccgggcaggaccacgacgaccttgtcgccgacggcgaagttgcgggcgccgcagacgatctcctgcggctcaccggtgccgttggcctggccgacgtcgacggtgcagaaccggatcggcttcttgaagccctccagctcctcgatggtcagcacctggccgacgacgagcggccccttgaggtcggcgccgagctgttcgacggtctcgacctcgaggcccgccggaatgagcttggcctggacgtcgcggccggtctccgtcgccggcaggtcgacgtactcccgcagccaagaaagcgggacccgcatcagatctccatcccgaacggccgggtgaaccggacgtcaccctcgaccatgtctcgcatgtcttctacgttgtggcggaacatcagcatccgctcgatgccgaacccgaaggcgaatccgctgtacttctccgggtcgacgccgcaggcggtcagcacccgcgggttgaccatgccgcagccgcccagctcgatccagccctcgctggagcaggtgcggcagggacggtcggggttgccgacggactcgccgcggcagacgtagcagaccatgtccatctcggcgctgggctcggtgaacgggaagaagttcggccgcagccgggtcttcatgccctcgccgaacagcgactgcaccatgtggtccagggtgcccttgaggtcggccatggtcaggccctcgtccacggccagcagctcgacctggtggaagaccggggtgtgcgtggcgtccagctcgtcggtgcggtagacgcggccggggcagatcacgtagaccggcagctcgcggcccagcagggagcggatctgcacgggcgaggtgtgggtgcgcaggacgaggccggagtcggctccgtcgtcggcgccgcgcacgaagaacgtgtcgtgctcgctgcgcgccgggtggtcggggccgatgttcagggcgtcgaagttgaaccactcggcctcgacctcggggccctcggcgacctcgtagcccatggcgacgaagatgtcctcgatgcgctcggagagcgtggtcagcgggtgccgggcaccggccggtacgcggtcgtggggcagcgtgacgtccacggcctcctcgaccaggacgcgggtgtcgcgctcggcctccagctcggcctggcgggcggcgagggccttgttcacggcaccgcggg

SEQ ID NO: 1305 - DNA, 4609 bp, Unknown
  Kingdom: Bacteria, Phylum: Actinobacteria, Class: Actinobacteria, Order: Streptomycetales, Family: Streptomycetaceae, Genus: Streptomyces
gctccttctcgttcagtgcgaggcgagcagcggctcccaccacgagcggtgggcgtggtaccagtccaccgtcgcggtcagcgcgggctcgaagccggcgcggggccggtagccgagttccgcgcggatccggctgtcgtcgacggcgtaccggcggtcgtggcccgggcggtcggtgacgtgcgtgatgcggtcggggcccgcgccgcaccggtcgagcaggccgtgcgcgagttccaggttggtcagcgcggtgccgccgccgatgttgtagatccgtccgggccggccgcccgtgcgcacccgttccaccgcgtgtacgtggtcgtccacgtgcagccagtcgcgcacctgcttgccgtcgccgtacaccggcaggttcccgccggtcagcagcgtggtcacgaagcgcgggatgaccttctcggggtgctggtaggggccgaagttgttggtgcagcgggtcacccggacgtcgaggccatgggtgtggtggtgggcgagcgcgatgaggtcggcggcggctttggaggcggcgtagggcgaactgggccgcagcgggtcgtcctccagggcggcgccttcgggcagcgagccgtagacctcgtcggtggagatctgcacgaaggtgcgcactgagtgccgcagggccgcgtcgaggagggtctgggtgccgacgacgttggtgcgggtgaagccggaaccgtcctcgatggagcggtccacgtgggactccgccgcgaagtgcacgatgtcgtcgtgcccggcggccagccgccgcacggtcgccgtgtcgcacacgtcgccctcgacgaaggtgagccggctgtccccgcggagctcttcgaggcgggtgaggctgcccgcgtaggtgagtttgtcgagcacggtcacctcgacgccgggcgggccggccgggccgagcagcgcgcggacgtaggcggagccgatgaagccggcgccgccggtgacgaggatgcgggatgtcatgagtacaactgcaccttgctgtggtcgccgatgacgagacggtgggcctgcgggagccggggcgccgcggccacggtcgcctcacggccgatgagtgactgctcgatccgggcggcgccctccacacacgcgccccgcaggagcacggagtagccgatcgcgctgtcctcgatgcggcagtcctcgccgatggccgtgtaggggccgacgctggagttgctgacgacggctcccgccccgatcaccacgggtccgacgatacgcgaccccctgacgacggcgccctcggcgacacggacccggcccaccagcacgctctgcgggtcgaccttgccgtcgacgcggccctcgatccggtccaggacgtgccggttggcctccagcatgtcgtcgacgctgccggtgtcacgccagggccgggtcgtcgtctcggcgcgcacgggcaggccccgctcgatcatccactgcacggcgtgggtgatctccagttcgccgcggcccgacggcctgatcgcgcgcaccgcctcgtgcacggccggggtgaaggcgtagacgccgatgagcgcgaggtcgccggcggggtgctcgggtttctcctcgagccgccgtacaagcccggtggcgtcgacctcggcgacgccgaaggcgctggggtcgggcaccggggtgagcagcagccgggcggcgtcgtggccggcttcggcgcggcggacgaagccggtgacgccgtcctccaggtagttgtcgccgaggtagagcaggaagtcgtcggcgccgaggaagtcccgggcgagcagcaccgcgtgcgcgaggccgagcggttcgcgctggtgcaggtaggtcacgtggacgccgaacgccgccccgtcgccgagtgcctggcggatgtcgtcgccatggccgccgaccacgacacccacctcctcgataccggcctcggcgatggcctggagggcgtaggcgaggaccggtttgttggcgatgggcaggagctgcttggcgcgggtgtgggtgaagggccgcagtctgctgcctgtgccgcccgccaggaccagggctttcacgtcggccaccggtgtcgcgcacggggctgggtctgtggtctcacggatctctcctcgaacgcgggtcgcggtgtcaccggttgagctgttcccgactcaagcagaggtgggcgcagccgcgcaagacgcttctgaaattttcagcaagtccttgcaggcggcgcttctttggtgtttgactcgccaccggcaacgcccgacggcgcggccggcatcgcccgacggcgtaacgcaacaagcggttcgcacacaggagttgggggcagcaagtgacaggtcggcaccagctcgaacggctggagcgggagtcggtgcatctggcgccgggcgcctccgaggaggcggccgtgggacgccgggttttcgccgaggggcgcgggcccgtcctcaccgatctcgacggcaaccagtacctggacttcgcggcgggcaccctgacccagtcgctgggccacgggcaccccgaggtcgtccgggcgctcaccgagcaggcgggccggctgtggaacgtgcacgactcggcgacacccgagcgggccgcgctgctcgacctgctggcccggctgctgcccgagcggctgaacacgtatgcgctgttctccaccggcgccgaggtcgtcgaggccgcgctgcgcgtggtgcaggcgaccgcgccgcccggccgcaaccggatcggcgcgctgcgcggcggcttccacggcaagaccatgggcgcgcggatgctggtgcactgggacgtcggccaccaggcgttcgccgggaactccgtgctcgggtactcgccctactgctaccgctgcccgctggagctgacctacccctcgtgcggggtgcggtgcgcctccctggtgcgccggcacatcgccgagaaacccaacgtctccgcgctggtcttcgaaccggtgctcggcgccgccggcgtcatcgtgccgccgccgggttactgggagcagatcgtcgaggcgtgccgctcgcacggtgtgctgctcgtcgccgacgaggtgctgaccggcggcggccggaccgggacgttcctggccggcgagcagttcggcgtcgaacccgatctggtggccctgtccaagggcatggccagcggcttcccgttcgccgtgctcgccgggcgctccgagctgctgcgcgatcccgcggcggccggcgcgggggcgtacgcctcgacgtacgcgggcaacccgctgggcatcgccgccgcccgcgccaccctggaggtcgtcgaacgcgaccggctgatcgagcgggtacgggtcctcggcgaccggctgcaggaacggctggcggcgctgcacgcgcgcttcgaccaactcggtgacgtgcgcggcatcggactgctgtacggcctggagttcgtcaccgaccgcgccggccgcaccccggcccccgatctcgcccgtgccgtctactccaccgccctcgacctgggcctacgggtcgccctcggcgggcacatcctgcgactggcaccgccgttcaccgtcgacgaggcgctgctcgacgagggcgtgggactgctcggacaggccatggagcgggtgctgtcgtgatcgtcgcggagaacctcgtcaaggagttccggctcgccgaacgcaggtccggcctggccggcagcctgtccacgctgctgacccgcagacaccgcgtcgtccgcgcggtcgacgacgtgtccttcaccatcccggcaggatcgaagacggcgtacatcggcgcgaacggggccggcaagtccaccacgatcaagatgctcaccggcatcatgacgcccaccagcggacgctgcctggtcggcggcatcgagccctaccggcaccggcagctcaacgcccgcggcatcggcgtcgtcttcggacagcgcagccagctgtggtgggacctgtccgtgccggactccttccgcatcctgcgcaggatctacgacatccccgacgcggtgtaccgccgcaacctcgccctgtaccgggaactcctggacatcgacgccctcggcaccacgcccgtgcgccagttgagcctggggcagcggatgcgcgccgagatcgcggcgagcctgctgcacgacccggcggtggtgttctgggacgagccgaccatcggcctggacatggtcctcaaggacgcggtgcggctcctggtcaaccgcgtccaccgggaactgggcaccacggtcgtcctgaccagccacgacatcaccgacatcgccgcgatctgcgacagcgcactggtcgtggaccaagggcgggtggtgcaccagggcagcatccgggacctgctgcgcggcgccgaccggcggtcggtcctgttcgaccaccggggcggacccggcccggccgcggcctgcgcggacatcgagcgcggcctgccgggcgtgacggccgcgcccgccgacgacggccggatccgcgtggactatcccgtggaccgcttcacctcccggcaggtgctgggcttcctcctggaccgcttcgacctcgcggactgctacgcgcccgaaccggacctggaggacgtgctccgcaagatctacgggggcgggcggcggg

SEQ ID NO: 1306 - DNA, 981 bp, Unknown
  Kingdom: Bacteria, Phylum: Actinobacteria, Class: Actinobacteria, Order: Streptomycetales, Family: Streptomycetaceae, Genus: Streptomyces
  misc_feature (230)..(312): n is a, c, g, or t
cggacgcctcgcgctcccccgcggtgggcgacaacgcgacgaaggccgaggtcaggaagaggtaggacccgaggccgacggcgagggggaagatgaactgcatcgccgtggccccgggcagcaccgtgtcggacggggtgacgcgcacgctcacggcgaacatcccggtgtagtgcatgctgctgaccgccgcgcccatgacgagggaggcgacggtgaccgcgagcggnnnnnnnnnnnnnnnnnnnnnnnnnnnnnnnnnnnnnnnnnnnnnnnnnnnnnnnnnnnnnnnnnnnnnnnnnnnnnnnnnnngccatgcccaggtagtgcatgctggcgacgcccagcccggtggtgagcccgccggcgaacagggcccggccgcgaccacgcccgtagccgacggcgaagactcccgcgcagacgacggccacggcgacgacgaggctgaggatggtcacgaagtgcatggtccagatgccggtcccgatggcggaagcggcggtgacgagccagttgcggcgtgatcgtccggtggtggccagcgcccgtacggtgcagcgcaggcccagagcggcgccgatgcaggccatggcgtacgacagcacgggggtcagccagccgaaggtggcgtggtccaggtgtcccatgggcccgggacgctagaggtgcgcggaggcgcgaagggggcgcatttcgaaagctgcccgaatatgacgccggtatgacgcgggcgtacacctgaacgatcgcctcacgttcgaacgtgcgcacagtgacgtcgcccgatccggtgaggaatcatgcgcagcatgagcgacgaccacacgcacgtccaggagttcttcaccgcccgtgccgcggactgggacagcaggttccccgacgacgggcccgcctatgccgccgccgtcgccgagctgggtctcggccggggcgaccgggtgctcgacgcggggtgcgggaccgtcgtcggggaac

SEQ ID NO: 1307 - DNA, 534 bp, Unknown
  Kingdom: Bacteria, Phylum: Actinobacteria, Class: Actinobacteria, Order: Streptomycetales, Family: Streptomycetaceae, Genus: Streptomyces
gcggacgagccgaccggggcgctggactcgctggcgggcgagcaggtgatgacggccctggtgcgcaccgcccgcgagtcgggggccgccgtgctggtgatcacgcacgacgcccaggtcgccgcgtacgccgaccgcgaggtgcggctgcgggacggcgcgccggccgggctggaggtgaccgcgtgaggaccgacctgcgactggcctggctgctcgtccggggttccggccgccgcgagtggtggcggatcgcgctgacggcggtgggggcgatgtgcgcgacggggctggcgctggcggccgtcgcgctggccgcgctgggcgggcggcagtacagcatccctctcgcgcacggtctgctcgaccagccgggcgagcggcacggcgcggtcctcaccctgctgctcctggagatcccggtcctcggtttcctcgggcagtgcacccggatcggcgccgtccaccgcgaccggcggcccgcctccgcaccggccagccgcagcgaggcgagccgccggtcgcggtggacgg

SEQ ID NO: 1308 - DNA, 3907 bp, Unknown
  Kingdom: Bacteria, Phylum: Actinobacteria, Class: Actinobacteria, Order: Streptomycetales, Family: Streptomycetaceae, Genus: Streptomyces
tcgccgtacggcgacatgggcacgcacggggtctcctcggtgaccaggtccacgtccggcatgccgtagacggccgcggaggaggagaacacgaaggcgccgacgccggccgcggtgacggcctccagcaggacgcgcaggccctccacgttctcccggtagtactgcagcggcaggtccaccgactcgccgacctgcttcttcgccgcgaggtggacgacgccggtgatcccgtgctccgtgagggtgcgcgccagccggtccgcgtccagcgtggagcccaccaccagcgggactccgtccgggacgcgctcggcgacgcccgtggacaggtcgtcgtagacgacggcctgctcgcccgcttcggtcatcgctcggacgacgtgcgctccgatgtagccggcgccgccggtgatcagccaggtcattgcgggcgtctcctcgtcagttggcccaggtggtgcaggtggtgcaggtggtgcaagcggtgcttctgcatgcggatggtgctcgtgggctgggatgcgtgtgccgccctatccggttccgcggcccagcaggcggcggaccctgccgcgcaggaccgtggtggcgccgcgccagccggtggccaggcgcagggccagcgcacccgagtgcgtggcgtagggctggaccagcaggacgccgaaccgcaggctcggcacgacgctgcggcgcagcaggcccgtgtcggcccaggcgtgtccggtcatctcgcggctcgtgccgtcggcgaagcacacccgcaggcgcaggtcccaggtgccggcgcccagggccgccagatccacgaccgtgtctgcccgccaggtgtcaccggcgtcgggccgcagtgcgaccgtggcgcgctgcgtgacgcggcccgcctcgcggtgcagccactccacctccagcgtgcgcggcttcgcggcggcgaccaggccgtacatgtcgtgcaggcgcaggtgcagcagggaggcgccccccgcgcgcgggcgcagtgccgcgtccacggtgaggggcagctggtgggccggccaggtcaggtagggctccagggtgagctggggcaggtcgtcggcccagacggggacgccgtcctcgctgcgtgcgtagggcgggcagagccgggccggccgggcggccagttccttcagccggggcaggtcgcgcggctcgggcgaggccaggacgacccgggcgatgaggtgaccgggcgcggtcggctcggcggaccagtcaccggcgtcgtatccctgcaggtaggtgcgcgtgtgcgtccaccaggcgcggcggtacttggcgtcgcgcagggtcagctcgcgcgcgtacatgcgcagctcgtgctccaggaacttggcccgggcggcccgtgccagtcccttctgcccggcgctcagcaggatctcgtgcgcctgccggttcgcctcggtgcgcgccttccagttctcgacgtcggcccggtccagcgagatggacagctgttgggcggaccggcgtacgttccacacgtacacgtggtccgggacgaaggccatgcgcggtccggcggccaggacccgtgcggcgaacacgatgtcctcgtaggggaagcggccctcgggaaagcggatgtcgtgctcacggaggaaggcggtgcggtacagcttgttgacgcacagcgtgtcgtggacgagtccgggctgctgcgcggggtgggcgaggaccgtggtgcccgcgtacagctcgctctgccacggcacctcgcggcccgagggcagctcgcggcgcacgcacagcccgcccgcgatctccgcgtcctcctggtcggccgtcgtgagcagcgcgtcgaccgcgcccggcggcagtacgtcgtcgctgtcgaggaacatcaggtacggcgacgtcaccgcgtcgatgccggtgttgcgcgggctgccgcagccgccgctgttggactcgcgccggatcacccgcagcctcggctcgtcctcggcgaggcgtctgagcagttcgtgggtgccgtcggtcgagcagtcgtcgacggcgacgacctcgcggaccatcgggccctggacgagcgcggaacgcaccgcgtgcgctatgcggtcgacatcgttgaagccgatgacgacgacgctgacgtgcggggtctgctgcgggtgcaggtgcatggagtccacggccgaatatcgtaggtgtggtcggtaatctcccgttaagtggaactcagtgtcccggacggaagacggtgcgggtcctgctcaggtcgtctgcgggccaccacgggtctcgtcgagcgccacagccggacgaacgagactaccgtggccgtggccagcaggccgtttcgggtcagcatcaacacacaacccgtccacgtacagcccgccacctgactgtagagcgtcgggtaggcgatcgcgctgaccaggcaggcggaggcgaccagcgtggccaccgggcgctgtgtggtctcgcgtgaggtcaggcacaccgcggcgagtcccagcagccagatcatgtactgcgggctgatcaccctgctggtcacggtgaacagcaggacggcgctcagcgcggcgtcgtacggcgtggccggcgtccagtgccgggcccgcacccgccacacgagcagcaggacgaaggccgccgcggacagcgccagtgagacatgtgccacggtggtgacgtgcgggccggtgaactccagcgcgccgtactggtagcgcacggtgcccggccagcccgcgtgggtcgcgagggcgagcaccgtgccgccgaaggactcgatctgcacgccccggccgccctgctggcgcacgaaggccagcgggttgcggaacgtcccggcgaggaccagcgcggcgagggccccggcgccggccgcccagatccacgcggagcgtgtcgtacggccgcggggggtgcccagcagcaccagggcgggccacaccttcaccagggcgcccagcgcggcgagcatgccgcacgcgcgcgcggagcggcgcagcgccagtagggacagcacggcgaaggcggtgacctggacgtcgtagcgggcgagcgggacgtgcagcagcagcggcaggcccaggacccagtagccggctccgcgcaggctgcggcccggccgggtgcccgcgcgggccagtgccagggcgatcaccgcgtcggcggccagggtgagggcgacgaacgcctggaagtacgtcagccagggcagcagcgcaggcgacagcagcacggggccggcgcccggcgggtactgccacagggtgtcgtgcgccgggaaggtgccgtgggtgagcaccaggtaccagtggtggtacagcttccacacctcgcgcgccaccgcgccgccgccgaggccgggcagcgtgtcgtgggcgagcagccacagcatcagggcgcgggtgaggagccaggcggccgtcaggctgaggaggcggtgtcccgccgaggcgcggatcagggcacgcggcacgctctggaaggcactcatcacggcggatcgtaatccgcgtgaatgtcgtggccgcgctgatacgcgggcaatcaccggcaattgtcggtaagaacaggaattcccggtgagagtcgccaagcatgactgatcgggtatatcgggcagatgtgcgggcgctcacccgcgtgagtggccggccttactgctcagccgggctggtaatcagcccggcaggtccgctgccgccctgtccagggcgtcggtgagccgggcgaggcggaggtgcaggtcggcggcctccccggcggtgaggccggtcgcggtcatgatcgcgcgcggtaccgcggccgcgcgctcgcgcagcgccgtgccctcggcggtcagccgcacctggaccgagcgctcgtccagcgcgctgcgctcccgggtcaccaggcccgccgcctccaggcgcttgag

SEQ ID NO: 1309 - DNA, 3094 bp, Unknown
  Kingdom: Bacteria, Phylum: Actinobacteria, Class: Actinobacteria, Order: Streptomycetales, Family: Streptomycetaceae, Genus: Streptomyces
gtccggcccgcccccggcaccttccccgtccgtctcctcctccgaggtccgcaccctcacgcccgctgtgacccggcagctcgaccgggccgtccggcgcgtccagcgcgaggcgcacgtgcccggcgtgatcgtcgggctgtggacacccggccagggccagtacgtgaagtccttcggcgtcgccgacaagagcaccggccggaagatgtccgccgacctgtacacgcgcatcggcagcgagaccaagacgttcacggtcaccgcgctgctgcgcctggtcgaccagcaccgggtgagcctggacgatcccgtcggcaagtacgtcgacggcgtgccgaacggtgaccgcatcacgctgcgcgagctggccggcatgcgcagcgggctgttcaactactccgaggacgacggcttcttcaaggcgctcacctccgaccctcggcgccccttcacgccgcggcaactgctcgcgtatgccttccggcaccccgtgctcttcccgccggggcagaagttcgactacagcaacaccaacctcatcctgctgggcctggtgatcgagaaggtcggcggccggccgctcgccgactacatccacgcgaacatcctcgaaccggccggcctgcaccacaccctcttcccgacgggcgctcagttccccgagccgcacgcgcagggctacacggaccagaccgcgaacggccgcatcgccgatgccgccgactggaacccttcctggggctgggcggccggcgcgatgatctccaacctcgacgacctgcgcgtctgggcccgcaccgtggccaccggcgtcctccccgacggccgtaccctgatcagcccggccacgcagcagcagcggctcaccccaccgccgaccccgatccccggcgcgggttacgggctcggcatcttcgccgtgcacggctggatcggccacaacggctccctgcccggctacgagtccctcaccgtctacctgcccgccgcccgcacgacgctcgtcgtcctgctcaacaccgacatcgaccaccaaggcaccgagcccagcacgctgttcggccgggccgtcaccgggatcgtcacgccagggcacgtgttcgacctgccggcgcagcccgccgccaggtgacgcacgccggtgacacatcccggtgacccgtgccccggcccgcgccggtgaggtgcctcagccggtgcggacctccgccacccgcaccggccggtgttcgcgcagcgacagcgtgcacgcctcggcgatccacccggcctccagcgcgtccgcgaccgtgcacggagagggcagcactccggccacgacctcggtgaacgcggcgagttcggcgcggtaggcggcggcgaaccggtccatgaagaagtcgtgcggaacaccggcgggaaagcccgcacccggttcgaccgagcgcagcggcagcttgtcgtccagcccgacggcgatggagtcggcgaagccgtgcagctccatacggacgtcgtaaccgcgggcgttgtgacggctgttggagaccatggcgagggtgccgtcgtccagggtgaggatcgcgccggtggtgtccgcgtcaccggcctccctgatgtacgcggcgccccggttgccgccgacggcgtacacctcggtcacctcacggccggtcacccagcggatgacgtcgaagtcgtgcaccgcgcagtcgcggaagatgcccccggaggcggcgacgtaggcggcgggcggcggcgccgggtcgagcgtcgtggaccgtacggtgtgcagcgggccaagaccaccggagcgcacggcgccgcgggcggcggcgaaaccggcgtcgaagcggcggttgtagccgatctgcacgggtacgccgctgccggcgacctccttgagcacctcggtgccctccgccatcgtgcgggccacgggtttctcgcagaagaccggcacaccggcccggacggcggcgaggatcagcgccgggtgcgcgtcggtcgcggcggccacgaccacgccgtccactcccgccgccagcagcgcctcgggcgacccggccacctccgcgccgaaccgctccgccgctgcctgggcggccggccgggacgggtcggcgacgacgagcgaggtgaccgtgtcgaggccgtacagcgtctcggcgtggaaggcgccgatccggccgaggccgaggattccgatacgcatgggccgctgctccttgggtgcgagtggtgccggtggtgcgggtgcgggagggcgtcagtcgaggccgccgaggacgttctggtcccagtcgatcaccgatccggtgaccacgccggagtgctcggagagcaggaacaccaggcacgggacagaccatgccgccgcagccggggcccggctgcgggacgagtccggtcagaggttgaccgcgtacaccttgcgcagcgtctcgtgcaccgtccacgtcgtacggtcgccctcgcgcagcaccgccatgtccccgggaccgacgcgcagggtcggcccgccctccacctcgatggtcgccgagccgctgagcacgacgaacagttcgtccgcctcggtgtcggtgacgaccccgggcgtgatctgccagactccgcgcgcctgacggccgtccgccgactcccagacgaccttcccggtcacctcgggcgagccggagacgatctgctccggcgcgagcggctcgggcaccaactcggcatcgggtacaccgggaacgtggagaacgaagctgtggtccataccgcgaccctaaggggccccacgcccgcacggcctggacacagtgtccgggatcgcccggcaggcgcggacacttcgtcgcggcgtgggggtggctgccgtggagccgcggcggtggcttccctgagtggcgagggcgggcgcgaagtggcggaggcggccgtgaagtggcggaggcggggggttcgggtgatcgttgggaggatccgtcttcgtacgcccgggaagcgagcagcccatggcggaccccacggcggccgtgcccgaacggtccgcgcacgacctccggtccctcctgctcttcggcggggtctacggcgccgtggtggccagcgccatggtggcggc

SEQ ID NO: 1310 - DNA, 3751 bp, Unknown
  Kingdom: Bacteria, Phylum: Actinobacteria, Class: Actinobacteria, Order: Streptomycetales, Family: Streptomycetaceae, Genus: Streptomyces
gtgctgtcatgccgggcgccccgcgggccgtggggcgggtgtggtcagccgcccagttcctggtggcgggcggccaggcgcttggcgccgccctccgtcagggagccgaacaggcgcagccgggagatgccgccgtccgggaagatgtccacgcgcgcgtgcgtgccgacggccggcacgggcagcacgaagcggtggttggtgtcgggctggcagcgggtgcgcggcagcacctcgcgccactcgccgtcctcaccgtccttaaccgacaccgacgcccagccggcgctgttgcccttgaggtaggcggtgtcgatctcgatggcgcggatctcggactgggcgaccagctggtagcggatccagtcgttgccctggtcgcggcggcggcgggtctcccagccgtcgtccatcttgcgggagcggcccggctggatggtgttggtggcgggcgagtagaagaggttggaggcgtcctcgacccggccgccgttctccagcgcgaccacgtcgaaggtgccgagcgcctcgagccacttcgggtcgggtacgacctcgccgtacacgcgcagccgcgcgatgccgccgtcggggtgctggttgacgcgcaggtgcgtgaagcactgctcgacgccgacctcgaagccgttggccgcgtggccgccgatcggggtgcgcgcgaggagcgtcgtccacttgacgtcgtcggcgaggagttcctcgggggacggcgagcccggtacgcaggcgccttccaccgacacggcctgcgggtagttgccgcggaagtgcgccgtgtcgatgacgacaccgcgcacgacgcccggcgcgccgagccggatcagcgcccagtcgtggtcgtcctcggtgggccaggggtgctccgcggagacgccgcggcggcggcgggtctcccagccgtccatgaccttgcccttgtgcccgaagtgctcggggtcgaactcggcacgctccggcaccagcaggttctcgcgctgggcgaagaactcgtcgttggcggcgatgaccccggcgcccaggcggcggtcggcgaggttggcgtgctgggtgaaggagaagtcggcggtgcggtagtccgcgtacgggtcaccgcctccgtaggggttcgcgtcgccggtgaaacggggattcgccgtcacggtgatcagttcttcctttctggagtcggccggtgcgggtgggcgcgggcgcggacgtcggtcacgcacccgcgcgcgggggtggatggctcagtgggaccgggtcagcagccggcccttcggctcggtgaactcgccgccgtcgacgatgcgctcgccgcgcagccaggtggacttcaccacgccgtgcagggtccggcccgcgtacgcggtgacgcggttgcggtgctggaggtgggccgggtcgacggtgaaggtctcgtcgggggcgaggaccgcgaagtcggcgtcgcggccggcctcgatggcgcccttgcggtccagaccggccagggcggcggtgcgcgcggacatccagcgtacgacgtcctccaggccgtacccgcgcttgcgggcctcggtccagacggccgcgaggctcacctggagggaggagacgccgccccaggcggtggcgaagtcgtcggtcttcaggtcggcggtggacggcgagtggtcggtgaccacgcagtcgatggtgccgtcggccagcgcctgccacagcaggtcctggttggcggcctcgcggatcggcgggcagcacttgaactcgctggcgccgtccgggacttcctcggcggtcagggtgaggtagtgcgggcaggtctcgacggtgatccgcacgccctcggaccgggcctgggcgatcagcggcagggcgtcgctggaggagaggtggagcacgtgcacgcgcgcgttcaggcgcttggcctgcgcgatcagcgtggcgatggcggtgtcctcggcgtcgcgcgggcgggaggcgaggaagtcggtgtacttgggtccgccgtgctgcggggcggcctccaggtggtgcgggtcctcggcgtgcacgatcagcaggccgtcgaagccggctatctccgccagcgaggtggcgagctggtcctggtcgaggtgcgggaactcgtccacgccggacggggacaggaacgccttgaagccgaagaccccggcgtcgtgcagcggacgcaggtccttgacgttgtcgggcagggcgccgccccagaagccgacgtcgatgtgcgccttgtcgcgggccacgtcctgcttgacgcgcaggttgtccacgctggtggtgggcggcagcgagttgagcggcatgtcgatcagggtggtgatgccgccggccgccgcggcgcgcgtggcggtccagaagccctcccactcggtgcggcccgggtcgttcacgtgcacgtgggtgtcgaccaggccgggcagcaggacgtcgtcgccgaagtcctccaggcgggcacccgcgggtacctcggcgtcgtagggcagtacggccgtgatcgtgccgtcggcgaccgcgacggacgcggcgcgcgtcccctcgggcgtgatgactcgtgtcgagcgcagcaccagttgagcgtcggacaccgggacccctctcttcgtcgccgccgtggctccagcgcacgagggcgcagggttacaccagggcgcagggttatacgcccatttacacccatgtaacggacttcaacgttctgttgaaggagtcttcactcccgccctcaccccgtcaaggggcacactgctggacagctggtcggcgcacacactctggacgtttccacaaagcggaattagtattccaacagacagaacgtagttccgtacaggcagggagtcaaccgtgcccccggtaggctttggcccttcctgcccgccccgaaaggaacgcgccgtgccgacgtccagcgccagcaccaccgactccgccaagtcctccgccagcggtggcgtccagtccctcgagcgcgccttcgacctgctcgaacggatggcggacgcgggcggcgaggtgggcctgagcgagctgtccgccgccagcggactgcccctgcccaccatccaccgcctgatgcgcacgctcgtggcctgcggatacgtccgccagcagcccaaccggcggtacgcgctggggccccggctgatccggctcggcgagtccgcctcccgcctgctgggcacctgggcccgcccctacctcgcccgcctcgtcgacgagaccggcgagacggcgaacatggcgctgctcgacggcgacgagatcgtgtacgtggcgcaggtgccgtccaagcactcgatgcggatgttcaccgaggtcggccggcgcgtgctgccgcactccaccggcgtgggcaaggcgctcctcgcgcacaccccgccccatgaggtgcgctccctgctcgcccgcaccggcatgcccgccgcgaccgagaagacgatcacgaccccggagggcttcctcgcggccctggaggacgtgcgcaagctcggctacgccatggacgacaacgagcaggagataggggtccgctgcatcgcggtcacggtgcccgactcccccaccgctgccgcgatctccatctccgggccggcgggcagggtcaccgagaccgcgaccgagcgcatcgtcccggtgctgcagcaggtcgcggtggagctgtcccaggcgctgaccagcgcggcggcgacgacctgagcgagcgggactgcccgggagatcagcccccgggcagcccccgtacgcagcc

SEQ ID NO: 1311 - DNA, 1629 bp, Unknown
  Kingdom: Bacteria, Phylum: Actinobacteria, Class: Actinobacteria, Order: Streptomycetales, Family: Streptomycetaceae, Genus: Streptomyces
gaagggccgcgcggcccttctccggtgccgactcgcgtccgtccgggagccgttcgcgcacgccccgttgacaaggggcatgctctgacacgaaagtttcaccccgcacggcaacgtacgaaagatattttcagacggcgcggcgggaggcctcacgatgaccgacggcacggcaggcagggacgggcgcgggatcacccgccgtcaactgggccgcgtttccctgctcatgggcggcgcgctgggcatcgccgcactcccggcggtgccggccacggcggccgaccggccgacgcggcaggccgccgcccgtacgaccctgcggcacggcaccgcacaccacgccggcctgctccaggacccgctgcgccaactcgtcaccgatgccgaggcgttcctcggcccctccccccggcacccgtggtacgcgggcgccgtgctgctcgccggccgcggcggtaccgtggcactgcacgagccgatcggcatggcggtgcgctacgcgtcgtacgacgagaagaccgacaccggtgtggagttcccgccgggcgagcagcacccgatgacccgggacaccgtcttcgacctggcctccctctccaagctgttcacctcgatcctcgccgtgcagcggatcgagcggggcgcgctggagctggagggcaaggtcgcctcctacctcccggacttcggccgggcgggcaagcaggacgtgacgatccgccaactcctgacccacacttccgggttccggcccgacctgccgctgtacgacgcgccggcgtacgagcagaagctggagatgatctggaacgaggcgccgctgaacccgcccggcaccgtgtacctgtactccgacctgaacatgatctcgctccagctggtcctggagaagatcacgggccgcaccctggacgtgctgctggccgaggagatcaccggcccgctcgggctgcacagcacccggtacaaccccccggcctcctggaagccgcggatcgccgccaccgaggacgcccgcaagccctggtcggccctggaccggggtctggtgtggggcgaggtgcacgacgagaacgcctacgcactgggcggggtggccgggcacgccggcgtgttctccacggcccccgacctcgccgtcttctgccgcgcgctgctcgcgggcggctcctacgggtccgcccgcatcctcggacccgacttcgtcgaactcctcctgaccccgcccggtctcggcttcgccgtggaccagccgtggctcatgggcgagctggcgggccggggcgcggcgggccacgccggcttcaccggaacctcggtggtcctggacccggtgaccgacaccttcctggtcctgctggccaccaccgtgcacccccgcagacgccgccccgacaaccgcccgcgcgcggcagcggccacccgcatcgcccgggcggtacgcggaacgtgagcgcgcccgggcaggcgcgggacggccgcccgccggggagccgagcatcccctgcgggctgagagaatcgtgcggtgaacgacgtcgtacttccgtcggagaccctccgtgccgcgctctcggggctgctcgacgggctgccgccgcggcaggccgtcgagcagccccgagag

SEQ ID NO: 1312 - DNA, 6603 bp, Unknown
  Kingdom: Bacteria, Phylum: Actinobacteria, Class: Actinobacteria, Order: Streptomycetales, Family: Streptomycetaceae, Genus: Streptomyces
ggcgccccgcctgggtcgttcccgtcgccgtcgtggccgtgcccgcggtcgtggccgggctcgtcgtcgccctcggccggcccaagccggccggtgcgcagaccgtcgccgtctccgagacggagtgcggcaagggcttcaccgcgccccgggcgggccggcagaccttccagatgcacaacaccggctcgaaggcctccgaggtctacctgatcgacccggccagcaacgcggtctacggcgagatcgagggcctggcgcccggcaccacccgcgatctcgtcgccaccgtcgcgggcggcagttacgcctggcgctgtgtgcccaccggcggcaaggcggtcacctccaaagccgtccaggtgagcggcggagcgggcgccagggcggtcgtccccgtctccgagcaggacctggccgggccgctcaagcagtaccggcagtacgtcgacaccggcctggccaccctggtcgcccagaccgccaggctcgacgacgacatccagggcggccacctcgacgcggcccgtgccgactggctcaccgcccaccgcacctactcctccctgggcgccgcctacggcacgttcgaggacttcgacaagaagatcaacggcaggccggacgggctcccgggcggcgtcgccgacaaggacttcaccgggttccaccgcatcgagtacggcctgtggcacggacagggcgccgacctgctcaaggcgccggcccggcagctcgccgccgacgcggccgggctgcgcaaggccttccccactcaggagttcgacccgggcgacctgccgctgcgcgcccacgagatcctggagaacaccctccagttcgagctgaccggcgacgccgaccagggcagcggcaccgagctggccacgaccgacgcgaacctcgacggcacccgcgagctgctcaccgtactgaagccgctgctgaccagccgcgccccgcgcctgctgcccaccgtcgacagcgacatcgcccggctgtgcaccctcctcgacgcggcccaccgcggtgccgcctggaccccggtggaccggctcgacgcgagcacccgggcccacctgaacggtgccaccgggcagctcctggaagacctcgcccccgtgcccgacctgctggagatcaggaagtccgcctgatgcccgcaccccgcgctccccgcccggaccgtccgggcggcgcagaaaccaccggcagccccgcgaccaccgtccatcccgaagggaacacctccatgccgtccgccgccacgcccgccccctcggacggctgccccgccggtcacggccgccggaccttcgtccggacggcccccggggccggggccgccggcgcggtcctggccggcggaggtctcgcgctgagccggaccggcaccgggcaggcgcatgcggcggacggctccgggccgacgagcatccccttccacggcgtccaccaggcgggcgtcgtcacccccgcccaggccgccgccgccttcgtctccttcgacgtcatcgccgacagccgcgcggaactggccgacctgctgaagacgctcaccgagcgggcccgtttcctcaccgccggcggcacccccaccgacctcggcgtcggcgcgccgccctccgacagcggcatcctcggcccggaggtccccgccgacgccctcaccgtcaccgtcggcgtcggcgcctccctcttcgacgaccgctacggcctcgccaaggcccggccgcgccgcctcaccccgatgcgcaccttccccaacgacaacctccgcgccgccgagtgccacggcgacctgtccctgcagatctgcgccgaccgccaggacaccgtgctgcacgccctgcgcgacatcgcccggcacacccgcggcgccctccaggtcaagtggcgcatcgacggtttccagaacaccccgcgccccaccggcacccagcgcaacctgctcggcttcaaggacggcatcgccaacccggacgtgacctccgcccgggagaccaaccgcctgatctgggtcggcgagggccagggcgaacccgcctgggcgaccgggggcagctaccaggtcatccggatcatccgtatgctggtggagttctgggaccgggtgtcgctgaccgagcaggagaagatgttcggccgccgcaaggacaccggcgccccgctggacggcgcccaggagagcgacgtcccgaactacgccaaggacccgcacggcacggcgatcccgctggactcccacatccggctggccaatccgcgcaccgccgcgaccgacgcctcccgtctgctgcgccgcggatacaactacgaccggggcgtcgacaacgtcggcaacctcgacatgggcctggtcttctgctgctaccagcaggacgtcgtccgccagttcgaagccacccagacccggctgatcgacgagcccctcgtcgactacatctcgccgaccggcggcggctacttctacgtcctgccgggcgtgcgggacgccgccgactggctcggccgcgggctgatggcggtctgacggcgccgcgcccaccgcacgccgcccggccgggacttttcctttccatggtcaagaccggtcgcgggctttactgcacatgatgtgcaagtagggcagcatggcagaaggctgcccggcgcagctgcccgcacgacccacgaaggaaagtcccgcctcatgacggccgcccctggttccgctccgaccctccccgccccggcggaggtgaacctgtcgacctggcaacgcgtccgggcgtcgatgacgcgacaggagtggacgaggcttggcgggatggccgcgttcgtcctggcgctgcacctcatcggctggttcacgctggtggcgatcgtcgccccggagcactacagcctgggcaccaagaccttcggcatgggcatcggtgtcaccgcgtacaccctgggcatgcggcacgctttcgacgccgaccacatcgccgccatcgacaacaccacccgcaagctgatgggtgagggccggcgtccgctgtcggtcggcttctggttctccctcgggcactccagcatcgtcttcggcctggctctcctgctgtccctgggcatgaaggcgctgatcggacccgtcgagaacgacaactccgcgctgcacgccatcaccggctggatcggcacgaccgtctccgggaccttcctctatctcatcgccatcatcaacctggtgatcatggcgggcatctggaaggtgttccggcagatgcgcggcggccacttcgacgaggccgctctggaggagcagctcaacaaccgcggtttcatgaaccgcctgctcggccgtgtgatgcagtcgatcaccaagccgtggcagatgtacccggtgggcctcctcttcggcctcggcttcgacaccgccaccgaggtggcgctgctggtgctggcgggctccggcgccgcctccggactgccctggtacgccatcctgtgcctgccggtgctgttcgcggccggtatgtcgctgctcgacacgatcgacggttccttcatgaacttcgcctacgagtgggcgttctccaagccggtgcgcaaggtctactacaacctcaccatgaccggcctgtcggtggccgtcgcgctcatcatcggcacggtcgaactcctcggtctggtcgcggaccaggccggcctgcacggcgccttctgggactgggtctccggcctcgatctgaacaccgtcggctacgtcatcgtcggcctgttcttcgtcacctgggtgctcgccctggtggtctggagggtcggccggatcgaggagaagtggacggcgggcctggccccctccaccgagtccgccgccgagtgagcccacggcggagccggccccggcccgggtgaccacggcggagccggccccggcccgggtgattggagcgggcgctgcgggaaacgcggatcagcgacaccgcgaccgcaagccgccgcaagccgccccgaaggaggcacccgtgagcaccgatccgatggccgacgacgcctaccagcccaccgggaacaacgaggagcaggaggacgccgcgccgctggacatgcaggacgcgatcggcgaacggacctacgacgacaccctcgacgagggctactcaccgccggagaagccgctcggcgtcgacaagtacggcaccaccgccgccgaacagcacgagggcgagagcctcgaccagcggctggcccaggagcggccggacaccggtgagccggagggcgacggcgtgggcgacctgcccggcggcgagggcgagccggtcgatccggaggccggcgacgagcgcgccgggcgcctggtcgccccggacgagggcgcgcactccgacaccacgaaggaggaggtcgcctccgacgcgggcatcgacggcggagcggccggcgccgaggaggccgccgtgcacgtcatcgaggacgacagcaccctgcccggcgaggacgggcgccgctgacggcggcggggaacctcagtccccgagccggtcgacctgccgcagcttgttcgtcgcgtccagcgcggcgaccttgtaggactccgcgagcgtcggatagttgaacacggcgtcgacgaggtagtcgacggtgccgccgcagcccatcaccgtctgcccgatgtggatgagttcggtggcgccggtgccgaagcagtgcaccccgagcagcgtgcggtccccgggcgagaccagcagcttgagcatgccgtgcgagtcgccgatgatctgcccgcgggccagctcgcggtagcgggagacaccgacctcgaacggcacgcactcctcggtcagccggtcctcggtccggccgacgaaactgatctcggggatcgtgtagacgccgatcggctgggtcccgtccatccggcccacgggctccccgcaggcgtggtaggccgccgcccgcccctgctccatggaggtcgcggccagcgccggaaagccgatcacgtcaccgaccgcgtagatgtgcgccacccgcgtgcggtagtgctcgtcgacggcgatccggccgcgcgcgtcggcgctcagcccggccctgtgcaggtcgagcccgtcggtgagtccctgccggcccgccgagtacatcaccgcgtccgccggtatcttcttgccgctctccagcacggtcagcgtgccgttctggtgccgctccaccgaggccaccgtctccccgaaacggaaggtgacggcgaggtcgcgcaggtggtagcggagcgactcgacgatctccgcgtcgcacatgtcgagcatctgcgcccgcttctcgaccaccgtcaccctgctgccgagcgcggcgaacatcgaggcgtactccatgccgatgaccccggcgccgacgatgaccatcgagcgcggcacccgctccagcgccagtacgttgtcggagtccatgatcgtgcgtccgtcgaactccacgctgtccggccgggcgggccgcgtgccggtggcgatgacgatgtgcccggcgctcagcagccgttcctcaccggtggcctcgcgcagggcgacggtgtgttcgtcgacgaagcggccccggcccgcgaacagggagacgtggttgcgggagagctggctgcggatgacgtccacctcgcggcccaccacgtgccgggtgcgcgcggtcaggtcggcgacggtgatgtcctccttgagccggtagctctgcccgtacagatcgcgctgggtgagaccggtgaggtacagcaccgcctcgcgcagcgtcttggacgggatggtcccggtgtggagggacaccccgccgaccatgtcggggctgtcgacgacggcgacccggcggcccagcttggccgcggcgatggcggccttctgtccccccggacctgatccgatcacgagcatgtcgaagtcgggcacgtgcggagtctgccagcacccggacccgccgggaaggcccgcaacacgggcggggaccggagcccacggctccggtccccgccacgccgacggacccgcgcggtccggccgcagcagacccgcacggtccgtcccgcctagggcagcagcttgtccagggcggccgggccctccgtttcgatcttgcgcttggcccactccagggtgcgcggggtgatgtcacggcccgcggccagtacgacgtcctcgggcgagacgtcggtgccggtgcgggcgtgcagcacgctgtccggcgtgcagcggtcgcccggtgaacgggatgcttcgggcgaacgggatgcgtcgggctctgaagtcgacatgtgtcctcctcgggtccggccgggtacccgcccgggtccggactgcgccgcccctgccgcgggaccgggacctcctcctacgattgcccgccgtgccgcaccctgcatccggaagggccgggtccggcccgctccaggagtacctgaccgccccgcgcggaaacctccgccgcacgcgtccgctccgtaagctggaaagacccggcgatgccgcccgggcggcagggccgggcgaccgcgaccggacagggaggccgcagcgatggccgacaccacagggccgccgccggtggcgggcgttcgccggtacgtgccgatcgccgaccacggtctgatcg

SEQ ID NO: 1313 - DNA, 1118 bp, Unknown
  Kingdom: Bacteria, Phylum: Actinobacteria, Class: Actinobacteria, Order: Streptomycetales, Family: Streptomycetaceae, Genus: Streptomyces
gacaaggtgagtgcctgtttccgaaccccgtatcagcaggtcaagacccgctggctcgaaatgggcgccttgtgcaagcgttcggggaccgggcacggtgaccgttgcccgaacggcaactgccggggatggcgtggcgcgagcgaaagagtgctacgaacgccgtggcgctgacggtcatcagcgtcaccgggagtccaccagatggccgcgaccttgatcgatctcaaggtgatgacggtgaccttggcctaccgcccgcctggcaccaggctaccgagcccgcgccttccgagggttcagaaacagggccagtgagtgacgaggtgtcacaaccatgtcataagcggcgtcctatacctttcgccgggaagaccagtggggatgctgtgagacgtcacgttgggaccgacgtactaggagagcaccatgagccgtgccctacgcctcgcagcagtcgccgtactgggactaggcgcgacgttccttccatccgccgctcacgccgccacggtgacgccgaacgccgcgatcaaccacagctgcgggctgaacgtcagcgcccaccagggatacctcgactcgcccgtgaccaagcgctcggtgcacatcggctccgcggtagtggaactgcgggccggcgtcacgccatcgcaggtactcgaatgggcgcggatccggcaggcgaaggtgggcgacaccgtctggctggactggtcggacgacggacgccgcaactggcacgtgtgcggaccgaacaaagtcaggactgggcacgacgcgctcaccagggccaacaaccccgtgtcaggacggtccatgcgcgcctgcggccaccacgccggagtgaccaagtgcaccaagtggtactgacgcacccgcgaccgcccagcggcgactgccgtgccgtctgcgacacgtctcccgaccagcacttcgcctcctctctcaagccgtggagacaccgcgtcagccgcgccactgccgggaggacctcagccgtgacaaggggcccgcggcccgcggtcaacgtggaacgcttgcacgcagtgcctattccggaccttcgggtctttgacctgtgccgacggggttcagaaacaggcactcaccttgtc

SEQ ID NO: 1314 - DNA, 2111 bp, Unknown
  Kingdom: Bacteria, Phylum: Actinobacteria, Class: Actinobacteria, Order: Streptomycetales, Family: Streptomycetaceae, Genus: Streptomyces
ccatccgccccaccgcggccgtcgcgtccgcgtccgtgcgggccaggcgcagggtgagcagggcgttgatcagggcctcggcggacgactcgtcgagcggcgcgaggaagtcgtgctcgacgcgttcgcactcctgctcggccgcgtccaggcactcctggccggccggggtgagggtgacgacgttgcggcgcctgtcctggtcgctgcggcggcgctcgacgtaacccttgtcctccagcgcgtcgatgatgccgaccatcgtcgtgcggtcgatgccgaggagcgcggcgatctccatctgggacgactgctgccgggcggcggcgatgaccgtcatgacgcccagctcgcgggggatgaggcggaagggcgcgagtgcctcgcccagctcggccgcgagagtggcgaaggcgtgcttcagcagatatccgagccgaccggccaggacatcagggggaggcacgtcgttcatgcgggcagcgtacactggactgaccatcaggatcactgacgatctcgtaaggtgacgatggcgtgggggcgtacggcctccggggacgcagacgagcctccgggggcgggggaaacggggccagggaaccggaccttccacgggcatcgctgtccgcgcagcgtcgcgcgcgaccgccctgcccgtgccgctcaccggccttcacacacacgactcaccgcacgcacagacacgcccgcacgcacgcacagacacacctgcacagccacgcacgcgcagacacgcccacacagccacgcccgcacgcgcacgcacatcaccgcatgcctgaccaaagccaaggaagcgacgcccacgcaatgagcgactcccctccgaccgacctgatacggacggctccggccgcaaccgagcacacacccgccgacgccccggacccccgccgctggtggggcctggttgtcatcgccctggcccagttgatggtggtcctcgacgcgaccatcgtgaacatcgcgctgccgtccgcgcagaaggccctcggcatgtccgacggcaaccggcagtgggtcatcaccgcctacaccctcgccttcggcggcctgctgctgctcggcggccgcatcgccgacctggtcggccgcaagcgcaccttcatcatcggcctggtcggcttcgccgtcgcctccgcgatcggcggcgcggcccagagccccggcatgctcttcggcgcccgcgccctgcagggcgtcttcggcgccgtactcgcgccctcggcgctctccctgatgacgacgacgttcaccgatcccagggagcgcgggaaggcgttcggcatctacggcgccatcgccggcgcgggcggcgcgatcggcctgctgctgggcggcgtcctcacctcgtacgcgaactggcgctggtgcctgtacgtgaacatcccgatcgccgtgatcgcggtggtcggcgccgtcatcctgctgcacgaccgcccgggccacagcgggtccaagctggacatccccggtgtcatcctcggctgcggcggcctggtcgccgtcgtctacggcttctccgaggcccagccgcgcggctggagcgacagcctggtggtgagcctgctggccggcggtgtgctgctgctggtggcgttcgtgttctggcagatgaaggcggagcacccgctgctgccgctgcgcatcctctccgaccgcaaccgcgcgggcagcttcctgaccatgggcctcgccaccatcggcatgttcgggctgttcctgttcatgacctactacctgcagggcatcctcggctacagcccggtcaggagcggtctggcgttcctgcccatgtccgcggcgatcatcctcggttccacccagatctccgcccggctgctgccgcgtacgcctccgcgcctgctgatggtgcccggcatgctgctggccgcctccggcctgctggtgctgacccagctcggcgtcgactccgcgtacgccacgcacgtcctgcccgccgaactgctgctcggactcggcatgggcctgaccttcatgccggtgttctccaccgcgacgcagggggtacggccgcaggacgccggggtgacctccgcgatggtcaacacctcgcagcaggtggg

SEQ ID NO: 1315 - DNA, 1408 bp, Unknown
  Kingdom: Bacteria, Phylum: Actinobacteria, Class: Actinobacteria, Order: Streptomycetales, Family: Streptomycetaceae, Genus: Streptomyces
cggccaggcgggcgcgaccccgctcaccgagctgccctgggtcgggcacaaggtccgcaggtgggaaccggagccgctgcgctggctgggcgtgcagggcatgtacgccacctaccgcacggccgaccgccgcgaggccctcacccacagcgcgagctcctcgcgcctggcccggctcgcggaccgggtggcgggacggcactgacgtacgtccggcttccgtccgtcttcgcgtctcttcgcgggcacgcgtcccgcggtggcgcaagaggagggttccgggtgcgaactcggaaccctccctgcccctcgcgggctcatcgggccaccgactccggtaccgcctccgcagccgtggcgtgcttgggcgcgcgcgccgtcaccatcaggccggccaccagcccggccagcagcatgacggccgcggcccaccagatcgcgaccgtgtagccgtgcacgatgccctccgggaccacccgggcccggtccgccggtgagcgcaggcgcgcggtgatgtacgcggtgctgctggagatggcgaccgtgttgagcagcgcggtgccgatcgaaccgcccacctgctgggccgtgttcaccgtcgcggaggtcgcgcccgcgtcctgcggggcgacgcccgcggtggcggtggcgaacaccggcatgaacgtcagccccatgccgaatcccatcagcagcagcgcgggcagcacctcggtggtgtactgcgaggcgaccgtcagccgggtcagcagcagcaggccgcccgccgccagcagcatccccgggaccatgagcgtgcggggcgccacgtggtgcagcagccgcgccgagatctgggtggagccgacgatgatcgcggcggtcatcggcaggaaggccagcccggtgcgcagcggcgagtagccgaggatctcctgcaggtagtaggtcatgaacaggaacagcccgaacatgccgatcacggccagcagcatggtcaggaagcagccggcccggttgcgctcgcgcaggatgtgcaggggcagcagcggcaccggcgcccgggcctgccaccacacgaacgccgccagcatcgccgcgcccgccgcgaacagggccagcaccagggcgtccgtccagccgcgcggctgcgcctcgctgaagccgtagacgacggcgaccaggccgccgcagcccagcaccacgcccggcacgtcgaggcggacacccgcgtgcccgggccggtcgcgcagcagcgcgaacgcgccgaacacggcgacgacggcgatggggacgttcacgtacaggcaccagcgccagtccaggtactcggtcagcaggccgccgaggatgaagccgatcgccgagccgctgcccgcgagcgcggcaaggcgttcgggatctacggcgcgctcgcgggcagcggctc

SEQ ID NO: 1316 - DNA, 2062 bp, Unknown
  Kingdom: Bacteria, Phylum: Actinobacteria, Class: Actinobacteria, Order: Streptomycetales, Family: Streptomycetaceae, Genus: Streptomyces
ttccccggcgtcgtcaccggcagcccgcccagccgctcggtgaacaacgcgcgcgcgtcggtgtcgatccagctcttgtcgacatttgccgccgtacggaccgtggcgccgccggtgacgacgccggggaaggtcagcccgaccggcccggtccagccgaagtgcgcgacgacctcccggacgccgtcggccacgccggcgggcgtggccgggtgcggggtgagcaccttgtggcgctcctgggccaggtcgcccttgtccaggtccaccggggcgcccttgatccccgacccgccgatgtccacaccgaagatctgcatggctccacgttacgacgcgccaccgacagtcacgccggtcgcggcccccgcgcgggaggccgctccgctcagccctgcgccgtacgggatccgaccggcgccgtacgggatccgcctcagccctgcgccgtacccgagccgccacgctcggcggtcagcgctgccgcctcctcgcgcaggtcgcggcgcagttccttgggcagcgagaagatgatggactcctcagccgccttgacgatctccacgtcctcgaagccgcgctgcccgagccattcgagcacctgctcgaccaggacctccggcaccgaggctcccgaggtcacgccgaccgtgctgacgccgtccagccaggcctcctcgatctcgtcggcgaagtcgaccagataggcctggtccgcgcccgcgagcttggcgacctccaccagccgcttggagttggaggagttgcgggagccgaccacgatgaccaggtccgcctccgcgcccatctgcttgacggcgagctgacggttctgcgtggcgtagcagatgtcgtcgctgggcggcgagatcagctgcgggaacttctccttcagcgcgtcgaccgtctccatggtctcgtcgaccgacagcgtcgtctgggagagccagaccacgcgcgaggggtcgcgcacctcgacgttcgcgacgtccccggggccgtcgacgagctggatgtggtcgggagcctcgccggaggtgccgatgacctcctcgtggccctcgtgcccgatcaggaggatgtcgtagtcctccttggcgaagcggacggcttccttgtggaccttggtgaccagggggcaggtggcgtcgatggtggcgagccggccgcgggcggcctcctcgtggacgacgggcgccacaccgtgcgccgagaacatcacgatgttgcccggcggcacctcctccgtgcgctcgacgaagacggcgcccttcttctccagggtctgcacgacgtacttgttgtggacgatctcgtgccggacgtacaccggggccccgtactgctccagggccttctcgacggcgatcacggcgcggtccacgcccgcgcagtagccccggggggcggcgagcaggacacggcggccagacgtagcagtcatgcgccccatcgtaaggccgcccagggcgggccgaagatcccgagggggtggtccggaccggatccgccgcgtccccggggtgctcgcgcggcgcccgcgttgtcggtggtgaccgttacgctcgcgggcatggctgtctccacgtcccccgaaaccccgctgccggtcggtgaggtctcccggctcatcggcggctggatcgaccggctcggcgcggtgtgggtcgagggtcagatcacgcagctgtcgcggcggccgggcgccggggtggtgttcctgacgctgcgtgatccgtcgtacaacatctccgtcggcgtcacctgctaccgcgaggtgttcgacgccgtcgcggacgtcgtcggcgagggcgcccgggtcgtcgtgcacgccaagcccgagtggtacgcgccgcgcgggcagctgtcgctgcgggccgccgagatacggccggtgggcgtgggcgagctgctggcccgcctggagcagctgaagaagaacctggccgcggagggccttttcgcgccgggacgcaagagggcgctgcccttcctgccgcagctgatcggactggtgtgcggtcgcgcgtcggccgccgagcgggacgtcctggagaacgcc

SEQ ID NO: 1317 - DNA, 2629 bp, Unknown
  Kingdom: Bacteria, Phylum: Actinobacteria, Class: Actinobacteria, Order: Streptomycetales, Family: Streptomycetaceae, Genus: Streptomyces
agctcgtcgagccgggcggcgaccggctgcgccgcggccacggactcggccgcctcggcgtccacggcgagctgttcgacgtcgcggtggtggccggcgaaggcgtcctcgcgggcgaggaaggtcacggcccgcttgccgaaggcggcgaggtcgctctccgcaccggcggcgagttcgtcgatgcgggcggtgtcggcgtaccgcatctccttcagcgtgagcaggtgcccctgcgcctggcgcagttcggtcaggccgctcacccaggcggcggcgccgcgcggtgcctcgccgcgcagccgccgcaccacggcggcgagccgtccgtcggcctcctccagcgcctcggccgcccgccgggtcaggttctgcacggtacggaactcgctcagcacctgctcggcggtgccccgtacggcctccagcggggtgcgcaggtcgccgaggtcggcctcgcccagccagtgatgggtgtcggcggcgcgcacgcaggcggcggcgagcgcctcgtacacctccacggtcggcgtggtctcggtgacggcgcggctgatggacagcaggtcggagatgccgcgcaccaggtcggcgttgccgacgcgggccagcggtccggtgcctgccgtggcggcggcgtgcgtgtcggagacgtacggggaggtccacagctggatcgggtgcacccgggccggttccggggcggtgcccgccgggtccgcgcgcagcgcgagcagcgcgccgtcctcgaacagcgcccagccgtggcaggtcagcggggtcgcgacctcctcgcggatggtgttgtacgacagcagcaggccgcgtccctcggcccgcgcgtggaaggcgtacagcacgtcctcgccgtacggcgagcgcacctcgcgctcgaactccagcccgttcgtgtcgagttcgtacgtcttgtacgcgcccgtggccaggcagtagccgccggggaagacgatgccctggtcctcgggcaggcggcggcagccctggccgatgccgtcgaggcggacgaccgagcgggtgagggtgttgaagaccaggtggcggtgggtctcctccttgtaggggcggatccgcagcaggatcagcgcgcccacgcgggcgtgcgcgatgtcggcgtcggcgagcgcctgcagcggctcgtgcaccggctcgctgtggatgccctcgccggtctcggtgtcgtcctcggtcttgacggtgagggtgccgccgacggtggagacgtagatctcgccggcgacactgacgtgcgggtggcggcccaggcgctggtcctcgcgggtcgccccggtccaggtgaagtcgtgggcgggcgacagcacgtggtcgcgttcgccgcgcgcgtcgaggaaggcggcctgtccgccgtcggtcaggttccagcgcaggacgcggatgtcgtcggccttctcgccggtgcggaagacggcgaggagccggccctccacccggtgcagccgcagcagccgggcctgccggtagtagcggtgcagcgccccgaactcccggacgaacgccgggtcgtcgagcaggccgggcacggcgtcctcgggcagcgggttcaggtcgcggtcgtgcagggcgaggacgtcggcgatgcggggctcgggccgggtgccgtcgtccgggcccgggtgcgcgccgttgtacccgaacagcagccggtcaccgacggcgacgacgtcccgggggacgctcgggtgctcggtgcgcagccggcccgtgccggtcaggtcgagccgggtggcgccgaactcctcggcccggcgggcgttgagctgttcggcaccgcgggccagctccgcggcctgggcggccagccggtcacggagcacctcgtaggtgccgctgtccacggcgccgtacgaacccgtctgctgggcggttgccatggacgtgcgtcccttcggaagctgcggaagccgcggagtcgtcaggaggggtcccgaaggctccggggtgcgggatgtggggcggggacccgcaaagctgccgacccccgtacggcggttcagcgggtccccagtctcacgggccggcgagcccctctcggctcgccggtccggcggctcgtcaggccctggcggtgccgttgacggcgagggctgtgaccggggtgtcggacaggcccagttcgcccgcgcggtccaggagctgctggaactggccggcgtgcgtgccgccggacttcatcagcttcatcagcagcgcggacacggtcaggttctgcacgtcggcggtggacaccgagccgaggatgcggccgaggtcgtcggcgaggttcgccgagccgtccaggtagggcttggccagcgcctgcgccgtaccggagtgctcgacgaagccgtcgacgcccttgccgagcgagatcgcgttcaccagccggtcgaagaagacggaatcgccgcccacgatgtcgatgtcggcgtgctccaggccggtcgccagcaccgtggcctgcgcctcggcgacctggcgctgcacgtcgagcccggcgagccggatctccttctccgcctggaggcgcagccggtactcctcgtggccgcgcgaggcctcgtccagggcggccatcgccgccctggtcgaggcctcgcgcggccacgaggag

SEQ ID NO: 1318 - DNA, 3176 bp, Unknown
  Kingdom: Bacteria, Phylum: Actinobacteria, Class: Actinobacteria, Order: Streptomycetales, Family: Streptomycetaceae, Genus: Streptomyces
gagccggacggcctggccctgaacccgctccacctcgcctggcccgcgggcgcccccgtacggcggatcttcgcccagtgcgtgcgcgcggccgggatcgacggacccgcgttcgccgcgaacgacgtcaacctcgccgcgctcgccgagcaccggcacggcgccggacgcggcgcccgcgacctgctgtgcgtggccaccgggcaccgcggtgtgggcggcgcgctggtgctggacggacggctgcacaccggcagttcggggctggcgctggaggtcggccacctcaccgtcaaccccgaaggccggccctgccactgcggcagccgcggctgcctggacgtggaggccgacccgctggccttcctcaccgccgcgggccgggagccgggtcccgaggtatccctgctgaagcaggccgaggacctgatccgcggccactacgacgacccggccgtccgcacggccaccgcggccctgatcgaccgcctcggcctcggcctcgccggcctggtgaacatcctcaacccggaccggatcatcctcggcggactgcaccgcgccctgctcgacgccgatcccggccggctgcgggccgtcgtcgccgaccgcagtctgtgggggcagagcggcggtgtccccatcctgccctgcacgctggcccacaacagcctggtcggcgcggccgagctggcctggcagccggtcctggacgacccgctcgcggcactgacctgacccgggaccgggcaggcaggacggcacagcgacctggtgagcgtgagcgcggcgctcagggcgtatgcgtgtctcgccggcgccgcgcgctcagggccgtagcagcgtcttgatcgcgcggcgttcgtccatggcccggtagccctcggccacctcctccagcgggagggcgaggtcgaagaccttgcccggatcgatacggtcgtcgagcactcgttcgatcaggtccggcagataggcccgcaccggagccggtccgccccgcagcgcgacgtgggagaagaacagctcctgaccgtcgatctccacaccgtgcggcacaccgacgaagccgacgttgccgccggggcgggtggactgcagcgcctgccgcatggactgggcggtgccgacgcactccagcaccgagtcggcgccgatgccgccggtcagctcccgcacacgggccacgccctcctcaccgcgctcggcgacgatgtcggtcgcgccgaactccagcgcgagcttctggcggctgtcgtgccggctcatcgcgatgacgcgctcggcaccgagttccctggcggcgatcaccgcgcacaggccgaccgcgccgtccccgacgacgaccgcggtggagccgggccggacctcggcggcccgggcggcgtaccagccggtgcccatcacgtcggagagcgtcagcaggctcggcaggtacgtgtcggcggtgccgtcggggacggcgacgagtgtgccctgggcctgcgggatccggatgtactcggcctggcaggtgctcatgaactcgcggtgcacgcaggcggagtggtagccgttgcggcagttcggacaggtgttgtccgaggtggcgaacgagccgatcacgagctgtccgggcctgacggaggtgacgtcgccgccgacctcctccacgacgcccacgtactcgtggcccatcggatgcggcgcctcgacgggctcgatgccccggtagggccacaggtcggagccgcagacgcaggtgacgacggtccggacgaccgcgtcggtcggcgcggtgatcgtcggctcgggaaggttctccactcggatgtcacggggggagttgatgatcgttgcgcgcatgatgttctctgctcgtcgtctttcgggtgggggacttcttggtctcgggtttcaggcccgggtgcgggtgctgacgcgcggaccgccgtattcggtgtccgtgacgtgctccagccaggtcgtgtcgtcgccctcccacagcgccaggtgggtcatgaaccggccgggggccgcgccgtgccagtgctcctcgcccggcggggtccagatcacgtcgcccgggcgggcctcgatgatctcgttgccgcgggactggatcagtgcgatgccctcgacgatgcagagggtctggcccaggccgtgcgagtgccaggccgtgcgggcgccgggcgtgaagcggaccatgttcgcccgggcgcgggaggggtcctcgccccggtagacgacgtcggcgtaggcgtcgccggtgaaccattcggcgggcagcttcatggtcggggcctgtgcgagaagttccatggtgcggttcgtctccgtcgggttgtcgggggatccgtgggctgtcggtggatccgtgtggtgcgggtgagaagcagccgggggccggatgtgtgggctgggcaggtgcctcggtcaggaggtgccgaagagttccttggccacggccatcgcggacatcgccttcggccagccggcgtagaaggccaggtgggtgagggccgcgatcagctcctgctcgctcgcgccgttgtccctggccagcgcgaggtggtagcggagctgctcggtgctgccactggtgaccagggaggcgacggtcaccaggctgcggtcgcgcggggagagttcccggccctcccagacctgcccgaaaagcacctcgtccgtgtaccccaccaacgcgggagcgaagtccccgaacatcttctgcgcgcccgagggctcggtgtgctcgctcgtcatgtcgtcgtgcctctcgtctctccgtgtcgtctccttgcggctccggcatcgcggaaccggtgcgtccgattgcgccccagatcgatggaacagcaggtcaggcgggtggggaaggacccgctgatacgtgtactggcagtgcaccccaggtgcgcggcggcggacgtaacctcggtcgggtggacaaccgcaccgagatccgcgagttcctgaccactcgccgcaacaagatcaccccgcagcaggcgggcctgcccgcgcacggcggcaaccggcgcgtccccgggctgcgccgcgaggaggtcgcgctcctcgcgggtgtcagcgtcgagtactacgcccgtctggagcgcggcaacctgagcggcgtctcgcagaccgtgctcgacgccctcacccgcgctctccagctcgacgaggccgaacgc

SEQ ID NO: 1319 - DNA, 587 bp, Unknown
  Kingdom: Bacteria, Phylum: Actinobacteria, Class: Actinobacteria, Order: Streptomycetales, Family: Streptomycetaceae, Genus: Streptomyces
cagctcgacgaggccgaacgcaggcacctgttcgatctcgcgcgcaccgcgaacagcacccgccgcggcccgcgccgcgggcgcccgcagcagatccggcccggcctgctcagcctcctgaacgcgatgaccgacgcgcccgccttcatccgcaacggacggctggacgtcctcgccgtcaacgacctcggcagggccctgtacgcgccgctgttcgccggctccgtccgccccgccaacctcgcccgtttccgcttcctcgacgacagcgcccgcgacttctaccccgactgggacgggaccgccgacacgaccgtcgcactgctgcgcacggaggccgggcgcgatccgtacaaccgggagctgaccgacctggtcggtgaactctgcacccgcagcgaggagttccgtaccctgtgggccgcccacgacgtacggctgcaccagaccggcgtcaagaccttccgccacccggccgtcggtgacctcgccctcctgttcgaagccctgccgctgccggccgacccgggcttgaccctcaccgcgtacagcgccgagcccggcacccccgcccacgacggcctgcg

SEQ ID NO: 1320 - DNA, 937 bp, Unknown
  Kingdom: Bacteria, Phylum: Actinobacteria, Class: Actinobacteria, Order: Streptomycetales, Family: Streptomycetaceae, Genus: Streptomyces
gccctgctgcgcagcggggacccggagagctggctcaccaccctggacagccgccgcagcgccgcacggccggtgctcaactcggcctgagggccccgcggaacggccgaagcggacggtgccccgtcaggatctccggatctcccgacggggcaccgtctcgtgtgcgctcgtgtgagttcgtgcgcgctcccggccggctctcaggacacgacgcgatggaccagctgatcgcggacccgcgccggaatctggggcgcgaaacggcgcagatagtggtcgatgtgccggtcgtgccccaccaggaacggcaggtcgaacacgagcaggcggcgcaccgcgagcagcggcaccggcgagcgcagcggcctgaagtcctcgttccacagacccggttcggcgcagccggggtggaactggccgatcatcaggccctcggcgacgaagtcgtccttggcgcccgcctgcagcgcgtccagcagagccgggtccgtgctgtccacagccggcagcaccatcaggacggtgagcagctcgcgctcgtcctcgggcagctcggccgccagcctctcgtaccatgcgcgcagcgcctccacagcgccgggcagcgcctcgggcgtgctccgcgcgggcaccgcgagcaggaaccggccggtgcgcaacgagggctgcgtgtacgggcacaccggaccgctgcggcccagctccggatggcccgacaccaggtacgtccggctccactccagcacctcgcgcagcggccccagatgcgcagcgggcaccaggccccggtcgacctggcccggggtgtagatctgcagccggtcgtcgcccctcatcgccgcggctcccgccacaacgggcgcaggcgtggcccgcccccgcccagcacgatgtcctcaccgaaccgctcgaagccctgccgccgtgcggaggc

SEQ ID NO: 1321 - DNA, 2633 bp, Unknown
  Kingdom: Bacteria, Phylum: Actinobacteria, Class: Actinobacteria, Order: Streptomycetales, Family: Streptomycetaceae, Genus: Streptomyces
  misc_feature (504)..(511): n is a, c, g, or t
gcgtggccgccgcggagcagatcgtcgcgggctgacccggagccgctccgcacaggcggccccgggtcctgaggacgccgacggaccaccacagacacgaacagcacaggcaccggagcaaccccgcacgaagggcggcgcggacatcccgcgccgcccttcgccatgcccgcccgcgttgccacgacacctttggcaaccggcatttgagaggcagttgggggcagcttcggcaggctcgcgttgacaccgcaagtggtctagtccaacttgagagggcctcggctcgatcatcgcgcagagccgggttccggccgctcggccactgaagaaccacacgccctggagtgattccatgccggcatccgccccctatctgcatcgcgcttcctcggcccgcccctacttcagcccggacggcgagacctacctcgcccagacgccgctgcgggacatcgacaagtcccggccgctgcgcgtgctgtccgaggaggacttcgcctnnnnnnnnccgaagagggcttcgacatcgagctgcactgggacgtcgacaccacgctcggcgtgctgccgcagcgcgtgcagggcatcctggcgctcaacgacaccgacccggcgctcggcggtttccagtgcgcgcccgaactgttcaagcggttcgaggagtggcggatcggtcagccgcaggaccgcgatccgatccggcccggcgtcgaccgcaccgagttcccggtggtgcggcccgatctgcgcgccggtgacctgctcatcttcaacgggctgctggcccacggcgtggcgcccaacgtctcggagcggggtgtgcgcgccgcccagtacctgtccatgatgcccgcgctggaggagcacgaggagctgcggcgctcgcgcgtccggtcctggcgcacgctcagcacgcccgactggaacccgacgctgctgggggacgccgagcggccggaggccgaccggtacgggcccgccgtcctcgacgacctgggcaggaagctgctcgggctggactcctggcgcggacgcggggacgccgcgtgagcggggcgaccgcacccgagcggatctgcctggcgctgcccacgaacagggcctgctccgccaccctgacggccgtcgccgaggaggccgcctacgcggcccgccgcttcggtgtcgaggtccacctgctcgtcctggactccagcgacgagcggacccgcgccgagcacgcccgggtcatgaccgcactccccgccgtgccgggcgtgatcaatcaccacctcgacgaggagcagcagcgcgccttcctgcggcgcgtggtccggcgggccggcgccgcagaacccgaccggctgctgtccctcatgctcccggccgacgtctcctacggggcctgcaccaaccgcgccttcctgatcgccgccgccctcggctgccggtcggtgcaccgccgggactccgacagcgcgtaccagacactggacggcgctcccgtcttccccgtccaccacgaggcggcggcgctcggccggcccgccgcgcaggtgtcgcacgaggtgtccgagaccctcctggatccggaccgcaccggacgtcccgtggcgatggccggtgcctccttcatcggcgaactctccgtggacatcggcgagatggccaagctggacgaggtcgtgtaccacgacgtcgtgagcctgtgggcgcccgggcactggtccgaggagagcaagcgggagctggtcgaggagtccttccggggagccggtagcgcccggttcaccgccgaccgctcgacgctgaccctcgtcgaccccatgcgggtggacatgtgcaacatcagcttcagccgcgaggtgtacgaacgcgtcccgctgcccccggccacccgcaccatcggcagcgactacttcctcatccacctggtgcacgacgccaccctgcccggcgtcctgcacaaccggcacatcgagaacttctacaccccggaacggcgcacggacgccggcttccacgactaccagacgcggttcgtgaagttcctgctgtccatgctctacttccacttcctctacgaccggatggccgcggccggccccgccctcctcgacaccggccaacacctccgggcggacgtcgtcgccgctctcctgcgcgagagcaccggcctggaccgggccgagaaccggtggcgcctggaccggatcgacaccgcctaccgcaaactcggcggcaggtacgaggcgttcgccgagtcactggccgcgcaccgcgagcggctgctcgacgaggccgagcgcgacatcgaggagttcgcgctgctgaccgattcctgggcggcgctggtgcgcgcggcccggagcgacgcgaccgggagcacgagcgggtgagcacggacgtaccggcgcggctgtcccgcgcccttgccgccgccggctcggaccgcctcgtctacgacgtcaccggcatcagggaccagtaccggcgcctgctggaggaactgcccggcgtcagcgtgcggttcgcgatgaaggcgtgtccggtcgaggaggtgctgcgcactctcgcggacgaaggtgccggtttcgacgcggcgagcccggccgagatcgcgcaggccctggccgcgggcgcgcccgcgg

SEQ ID NO: 1322 - DNA, 2492 bp, Unknown
  Kingdom: Bacteria, Phylum: Actinobacteria, Class: Actinobacteria, Order: Streptomycetales, Family: Streptomycetaceae, Genus: Streptomyces
gtcggcgagcggaccgtgcggcgcccggaccacaccctggagctgcgcaccggagtcgaggtcgacctcgatgcgggtgacaccggcgccgcccacctcgacgggcagggcccgcggccggtaaccggcggcgttcaccgcgacggtcaccacacccggcaccagctcggcgaaggagaactcgccctgctcaccggtggtcccggtggccagcaggtcgccgcgcacatcggtgacgatcaccatggcgtccttcaccggcagcgtgctctccgcgccccgcaccacaccgctcagtccgctggtgccgctgagcaggatgtcgtacgtcaccggctcgtcgttcacgacgatggtggacgcctgcggctggaaaccgtcggcggaagcgatcagcacgtaggaacccgcacccggcgcgtccaccgcgtagccgccgtcgccccgcgcgaccgcgcgacccagctgacggcccgccagcgagatcagcgtcaccgccgcctgcggcaccggcgcgccctcggcgccccggacgaagccgcgcaccgcgatcccgccgggaccggaggcctgggcttccggagccaccgtggcgacggcggccagccgctgcgtgccctcgggaccggtctcggtggtggaggcggccgtggcccagctgggcaccttgtcctcggccggggccgagaactggtcggcggccgtggcggtctgctcctgggcctcggcgacggccggggccgccaccgggtcgaccggggccggctcgccctcggcggcctgtgcgagggcgccgcgggtccgcagcgggacctccttgatgaacagcgtgatcaggaaggcgatggccgccatgccgccggcgatcaggaagatgtcggcgatgccgtgaccgtaggcaccctccacgaccgtgcgcagcggcgccgggagcttggagacgtccgggatgctgctgctggagccggaaccgcccatggcggcctggtacttcgggtcgagggcggccaggccgtccttgatgtagtgggtgatgcggttggccagcacggcaccgagcgccgagacgccgaccgcaccgccgagggaacggaagaaggtgaccgtggagctggccgagccgaggtcgctcgggtcgacctggttctgcgtgcacagcaccaggttctgcatcatcatgccgatgccgaggcccagcagggccatgaagatcgccatcttccagtacgccgtgtcgtaccggatggtgcccagcaggccgaggccggcggtcaccaggacgccaccgctgaccagccacgccttccagcgcccggtgcgggtgatgaactggccggagacggtggaggcgacgaacaggccgccgatcatcgggatggtcaggacacccgacatggtcggggtcttgccgcgggccagctggaagtactggctgaagaacacggtgccggtgaacatcgcgataccgacgaagagcgaggcgagggacgccagcgtgatcgtgcggttgcggaacagccgcagcgggatgatcggctcggccgccttggactcgaccagcacgaacagcagggcgagcacgatggagccgccgaccatggcgccggtctgccaggacagccagtcgtacttgtcgccggcgaaggtgacccagatcagcagcagcgagacggccgcggcgaccagggtggcgccggcccagtcgaccttcacgttccgcttgacgacgggcaggtgcagggtcttctgcaggacgatcagcgcgaggatcgcgaagggcacgccgacgtagaagcaccagcgccagcccagccaggaggtgtcggtgatgacaccgccgagcagcgggccgccgacggtggcgacggcgaacgtcgcgccgaggtaaccggagtaacgcccacgctcacggggggagatcatcgcggccatgacgatctgcgccagggcggacagaccgccggtgccgatgccctggaccacgcggcagacgatcagcatgccggggttctgcgagagcccggccgccatcgacgccacgacgtagatgatcagggctatctggacgagcgccttcttgctgtacaggtcggcgagcttgccccacaggggagtggaggcggtcatcgacagcagggcggcggtgacgacccaggtgtaggccgactggccgccgccgaggtcaccgatgatcttcggcagggcgttggagacgatcgtggacgacaggatcgccacgaacattccgagcagcagcccggagagcgcctccatgatctgccggtgcgacatcggagcgccgtccggggcggcacccccgtgcttggcgtgagcccgcacaccggctggtgtggtcgttgccatgggcttcctttacttacgtgcttgcgggtgtacgggtggtctgttcgagtacgggctcggggaaccggaccggggcggaccggcagtcgccgaagctgtcgcgcagtcggcccatcaggcggatgagc

SEQ ID NO: 1323 - DNA, 2495 bp, Unknown
  Kingdom: Bacteria, Phylum: Actinobacteria, Class: Actinobacteria, Order: Streptomycetales, Family: Streptomycetaceae, Genus: Streptomyces
gtcggcgagcggaccgtgcggggcacggaccacaccctggagctgcgcaccggagtcgaggtcgatctcgatgcgggtgacaccggcgccgcccacctcaagcggcagggcgcgcggccgatgcccggcagcgttcacggccacggtcaccacgcccggcaccagctcggcgaaggagaactcgccctgctcaccggtggtcccggtggccagcaggtcgccgcgcacatcggtgacgatcaccatggcatccttcaccggcgccccgctctcggcggagcgcaccacaccgctcagtccgctggtgccgctgagcaggatgtcgtacgtcaccggctcgtcgttcacgacgatcgtggacgcctgcggctggaaaccgtcggcggaagcgatcagcacgtaggaacccgcacccggcgcgtccaccgcataggcgccgtccgtctgcgcgacggaccggcccagctgacggcccgccagcgagatcagcgtcaccgcagcctgcggcaccggcacgctctccgcgccccgcacatagccgtgcacggggaccccgccgccgctctcccggggctgttcgcccggggccagggtggcgacggccgcgaggcgctgggtgctctccgggccgggttcggtggtggacgcggccgtggcccagctcggcacccgctgctcggcggtggcctcgacgggagcggcggcggccgcgacggcctgggcagcctcgtccggcaccgcggccggtgcgggggcgtcgcccgtgttctgctgggcggcctgggccagggcgccggtggtgcgcaacgggacctccttgatgaacaggacgacgaggaaggcgatgaacgcgcagggcgcggcgtagaggaaggcgtcggcgatgccgtgcccgtaggcgccctccagccaggtgcgcaccggggaggggagcgcgttcatgtcgggcagctcaccgccgccgctcatcgccttggcggcggcggcccgcgcgtgcgggctcagggacgtgatggtgtccttggcgtggtcgctgatgcgggtcgacatcaccgagccgagcacgccgacgccgaccgcgccgccgagggtacggaagaagctgacggtcgacgacgccgagccgaggtcctgcggggcgacctggttctgggtggacagcaccaggttctgcatcgtcatgccgacgccgacgccgagcagcgccatgtagacggccagctgcccgtacggggtgtcgtagcgcatgctgcccagcaggcccaggcccgcggtcaggcaggcgccgccggccaccagccaggccttccagcggccggtgcggctgatgatctggccggagaccatggaggcgacgaacaggccgccgatcatcgggatcgtcatgacgcccgacatggtcggggtcttgtcgcgggccagctggaagtactgcgagaagaacacggtgcccgagtacatgccgacaccgacgaagagcgaggcgagcgaggccagcgcgatcgtgcggttgcggaacaggcgcagcgggatgatcggcgcgctcgccctggtctccaccagcacgaacagcagcgccaggacgatcacgccgcccaccatcgtgaacgtctgccacgacacccagtcgtacttgtcgttggcgaaggtgacccagagcagcagcagcgaggccgcggcggtgatgaagaaggcgccggcccagtcgaccttgacctggcgcttggcgaccggcaggtgcagggtcttctgcagcaccagcagggcgatcagggcgaaggggatgccgacgaacaggcagtagcgccagcccagccaggaggtgtcggtgatgacaccgccgagcagcgggccgccgacggtggcgacggcgaacgtcgcgccggtgtagccggagtagcggccacgctcacggggcgcgatcatcgcggccatgatgacctgcaccagcgcggacagaccgcccgcgcccaggccctggacgacccgcgcggtgatcagcatggcggggttctgcgccaggcccgctatgaccgagcccgcgacgtagatgatcagcgctatctggacgagcgccttcttgctgagcaggtcggagagcttgccccacacgggcaccgaggccgtcatggcgagcagcgccgcggtgacgacccaggtgtacgccgactggccgccgccgaggtccttgatgatcgtcggcagggcgttcgtgacgatcgtcgaggacaggatggcggcgaacaggccgagcagcagcccggagagcgcctccatgatctgccggtgcgacatcggagcgccgtccggggcggcacccccgtgcttggcgtgagcccgcacaccggctggtgtggtcgttgccatgggcttcctttacttacgtgcttgcgggtgtacgggtggtctgttcgagtacgggctcggggaaccggaccggggcggaccggcagtcgccgaagctgtcgcgcagccggcccatcaggcggatgagc

SEQ ID NO: 1324 - DNA, 3365 bp, Unknown
  Kingdom: Bacteria, Phylum: Actinobacteria, Class: Actinobacteria, Order: Streptomycetales, Family: Streptomycetaceae, Genus: Streptomyces
cccagccgtccggctccggcggcggcagctcctccaccggccagccgggactggtgggcggcctgctgggctgactcccgggcccccgcccgctcagcgcccaccgaaggctcgtacaccgaaggtccgcacgccgaaggccccgcacctcgcgcgatccgtgcacggtgcggggccttcgccgtccctgtccctcggtacgtcacctgcccagcgcggaaagctccttggcggcctccgtgaggtccttcgcggtgtcgatggcacgccagtaggcgccctgcgggatcgggaagccggccagccgccgctcgcgggccagccgcgggaacgtggtgcgctcgtggtcgccgcgctccgggagcagggaagcgaactcgggggagaagacgtagacgcccgcgttgatctcgaaggtcgacggcggcgcctcgatgaagtccgtgatgtggccgaagccgtccgtctgcacggcaccccacgggatgcgcggccgggccagcgcgagggtcgccaccgcgtcgcgctcggtgtggaagtccgccatgtcgcgcagcgagaaacgggtccagatgtcaccgttggtggcgtaccaggagcgctcggggtgcgggaggtgcgcggcggcgaacttcaggccgccgccacggccgaggggctccgactccacgaccgtggtcaccttgacgggcagcgcggccgacttcagccactcctgcagcacctcggcgagatggccgcaggagaccaccacgtcggtgacgccctcctcggcgagccaggcgagctgatgaccgatgatcggggtgcccgtgccggggatctcgaccatcggcttgggccggtcgtcggtgtaggggcgcagccgggagccctggccaccggccaggacgacggcttgagtggggcgggacgccgcattcggatgggtcatgcccgaactgtacgtggcaccccggggccgttcaggcgctcgggcccgcgcctgcggcacccggggcgggggcgggacggcggagggccggcaaggcggcgcgctcagctgtgggccgcgaggaccccggaggcgtaggaggtgtcgcagaccgggcgggcgtaggactgggcgcgggaggggccgtagacgcggaccgcggcgcggccgagggaccgggcgatggaggcgcagtgcccggccagcgacgggcgttcgtcgaccgcctcctggaggtgggtgagcgcgacgcccgggtccttctcctgcagctccgtcagcagctgctcgcgcagcacgtcctgaggggcgcggtggcgggccgaggtcccggtcgcggacaggtcggacgcggtgagcaccgagctcgaggggttccccgaccagttgactcgggtgaccgcgagggtcccggagagcaccaggacgacgggcaggacgagggcgagggagcggccgatccggcgggcggggccccggccgcgtcgcgtgggttgcgtggtggagtgcttcacgcgagtgagggtagcgcccggtgatgatttggcgacatttagtcaccccttcgggggatgcggcatcgctgttctccgggtgccgtgttgacgcacaccgctcgaaatgtcccctgtgtccgggtgatgccgaggtgcggcggagacgacgagaagggccccgcagcagttcacggggcccttctcgtcaccgcgggtgaatcacccgggtcacacccggggtttcagccgtaaggcgtcagccgtgcgacgtcactccgtggaccgtcggtccggcaggacgtcggtccatgagacctcagtccgcgggacgtcggcccgtgagacctcagtccgcgggacgtcggcccgtcaggcgtcagtccgtgaggcgggcgccggtggaggtggagaacacgtggatctcgcccggacgcggcacgacgtgcacggtggcgcccttctccggcaccgaacggctgctgacgcgcacgacgaggtccttcttctcgccgccgacctcgacggtgccgtagatgtagccgtccgcgccggtctcctcgaccacgttcaccgagacggcgagaccggccggggcgtcggcgctgtccttggtcagggaggcggccgcaccgccgtcgtgctcgaccacgtcgaagtgctcgggacgcacgcccacggtgaccgtacggtcacccttgtcggcggcggccttgagcgcgtcgcggttgacgggcacgacgctgttgccgaacttcacaccgccgtcggtgatcggcacctcgaccaggttcatggccggcgagccgatgaagccggcgacgaagaggttcgcgggcttgtcgtacatgttccgcggcgagtcgacctgctggagcagaccgtccttgaggacagcgacccggtcgcccatcgtcatggcctcgacctggtcgtgggtgacgtagacggtggtgatgcccaggcggcgctggagcgaggcgatctgcgtacgcgtggacacacgcagcttggcgtccaggttggacagcggctcgtccatgaggaacacctgcggctcacgcacgatcgcgcggcccatggcgacacgctggcgctgaccaccggagagcgccttcggcttgcggtccaggtactcggtcaggtcgaggatcttcgcggcctcctcgaccttctgccggatctccgccttgttgacaccggcgatcttgagcgcgaagcccatgttgtcggcgaccgtcatgtgcgggtacagcgcgtagttctggaacaccatggcgatgtcccggtccttgggcggcaggtgggtgacgtcacggtcaccgatgcggatggcaccgccgttgacgtcctcgagccccgcgagcatgcgcagggaggtggacttgccgcagccggacgggccgaccaggacgaggaactcgccgtccgcgatgtcgatctccagggcgtcgacggcgggcttctcggaacccgggtagatccgggtcgccttgtcgaactgcacagtggccatggtgaatgggcccccttctaccggcaggaacgtgccggacgatccgagtaggaaggcggttgccacgacggaagcccaccggggggcatgccccgccgaacggcccgtcctggtgctcgcgtggtccacaagagtgaactggcacaggacggtacctggcgttcacctgccctgtcagtacttgaaggcctgtgaacttcgcggaaattttcgacggggcgcggtggcgacctgggtacactgcacgggcacggcccagcacgcctccttagctcagctggccagagcaacgcacttgtaatgcgtaggtcgtcggttcgaatccgacagggggctcgggaaaaggccaggtcagataggttctgacctggccttttgccga

SEQ ID NO: 1325 - DNA, 3270 bp, Unknown
  Kingdom: Bacteria, Phylum: Actinobacteria, Class: Actinobacteria, Order: Streptomycetales, Family: Streptomycetaceae, Genus: Streptomyces
aagccgcacggaacccggccgtccggcccggccagatccctcgccccggcgaggaagtccgtccgcaggcgggcgacggcggccgggttccgtgcggcttccgcctccatgtggcgacggcccaccgccttcgaggcggcccacgtcgccgcgggagagccgtacggctctctgtagggcgcacggttccgtacggccgtacggttttcgtggcgacggccggttgggtcagcccttgctcaccgcagtgaggatctccgggagccgggacgctgtgcgcggggcggccaggcgcaggcccaggaaggcgatcacggcgccgtaggccgcgcccaccgggaggagcagccggccgaggctgtcgccccacgcgccggcgttcgtccagatggccagggcgatgaccggggagcacagcagggccgcggcgagcatgccgccgaagacggcgatccaggcgagcccggcctggcccggggcgacgttcttgtagccctcctgggggatggagtacgggaaacgggccgatgcccaggcgccggtcgccagcatcgcgccgagcagcgcgaaggagagcccgagcacctcgggcaggcgggcccagtcgccgaccagcgccgccgtcagcaccgtgacgagcgtggcgtagggcagggtcacgaccaggagggccagggcccggccgcgcagctccaggtaggcgtcgcgcggtgaggagatcgtcagcgcgaccatccagaacgcggacgtgtcctggccgaactggttgtacatctggacaccgagcatgccggcggcgaagcacgccaggtagaccgaaccggtgccctggagggcgttgaagaccgggacgatcaggccgatggccagcgacgtcacccaggcggccttggtcttcgggtcgcgcaggacgtaacgcagcgagcgttccatcacggtgccggtgcggccggccgggagcagccgggccggggcgccgttccgggagcgtttccgggtggcgtcgggggcctgcacggtggaggagtcgggggccgtcatcagccgggtcaggctgcgcgaccacatgcccaggagaacggccagcgcggcggcggccagggcgagctgggcgacggcgacaccgtacgacccgtcgctcgccgagttcaccgcgtccaccgccgacgcgggcggcacccagcgcagcacgtccgtcaccgggtcgagccggccgagtcccgaggaacccaggtgctgggcgccgaagttgaccagctgtgccccgaccgcgacgacgagcccgctgagcacggccaggtcgcgtcccttgcggctggtcagcagccgggtgttggcggcggccacggcccgggcgagcgccacgcacaccagcagcgccaggacgacgccgaggacggcgacggcgtacgccgacgcgccgtgcgccaccgagatcacgcagcccaccagcagcagcgccgtgaacagcggcccgacgccgaccagggaggccgccagcagcgcccggacgagcggctgcgggcgcagcggcagcatgaccaggcgggtcgggtccagggtctcgtcgccgctcgggaagaacaggggcatcaccgcccagccgagggcgagcacggccgcgctcagcacggcgacggagacggcgtgcgggtggccgcgcagtacggcgaagccgagcagttggagcgcggcgaagagcagggcgatgacggccgaggcgatgtacgcggcgcgccgcccgccggactgccgcagcccgttgcgcagcagggacagcttcagccgcacgagtacggccgtgatgccctccggcgcccgtcccgcgctcaacgggcccgcgttcatcggagctgcgttcatcggacctgcgttcatcgggcccgtgctcgacggacccgcgctcgacgggtccgtgttcaccgggccgacgctcatcgggtccgtgtccgcagggtccgtgctcatcgggtaccgccgcccagccagtcgaggtccgaaccggcgtcgcggccctgcgcgccgacgagttcgaggaaggcctgctggagggtgggcgcgtcgccgcgcacctcggcgagcgggccgtgcgcgcggatgcggcccgcggcgagcacggccacccagtcgcacagggactcgaccagttccatgacgtgcgaggagaacacgacggtcgcgccggacgcggtgtaccgctccagtacgccccggatggtctgcgcggagaccgggtcgaccccttcgaacggctcgtccaggaagagcacttcggggttgtgcaggagggccgcggcgagtccgatcttcttgcgcatgccggtcgagtagtcgacgaccagcttgtgctgggcgccggccaggtcgagcacgtcgagcagctgcgtcgcccggcgctccacctcggcggcgggcagcccgcgcaaccggccggagtaggacagcagttcgcgtccggagagccgttcgaagagccgcaggccctccggcaggacaccgatcctcgccttcacggcgaccgggtcccgccacacgtcgtgcccgacgacctcgacggtgccctgatcgggccgcagcagcccggtcaccatggacagcgtggtcgtcttaccggctccgttcggcccgaccagcccgatgaaccgtccggccggcagatcgaggtcgatcccggccacggcggcctgctgtccgaaccgcttccacagtccctgaatccgtacggcgctggtacccgccatcgctgctccctccgtcaggacgaaccctacggggagcggcgcttctcccacgggggagcggcgccccgcccgcgggggagtggcgctcaccccgcggaggagtggcgctccttctccctgccgcaggcgtacgccagcgccggcaccagttcctcggcgtccggcagccaccggttcgccgccgtgggacggcaggcccactggacggctccccgggagccgtaccgggtgggcggtgcggcgatgtacgtgccctcgccgagcacggccaggtcgagggagcccggtgaccagcccagcttgcgtacgagatccgggagtttggcgcacgcgccgggcaggacgaggaactgcatccggcgctcgggggtgagggtgaccggtccgagcgtcagctccatccgctccagccgggccagggcgaggaacccggcggtctcggggacgcagagcgcgtcgaaggtgcggcccgtgggcagcaggatggaggcggccggctgcttctgccacatgcggcgcgcgacggtgg

SEQ ID NO: 1326 - DNA, 5796 bp, Unknown
  Kingdom: Bacteria, Phylum: Actinobacteria, Class: Actinobacteria, Order: Streptomycetales, Family: Streptomycetaceae, Genus: Streptomyces
gcagttccgctcgacgccgcgtacaccggcgtacgcggcgtcgagcggaactgcgcccatcggttcggtgcgtgcgtcgtccaggcagtcggccagtaatcgctcgacgtgcaccatgcggcctcacctcgcaagcggcggaaatccaccctggtgatgtccgggccgcggcgacgacaaagcctgagaagacctcttcatatcatcaacagaagtgcgcgagcgtatgtcgggccccacgggtgacagccggatgcgccgccatcccaccggcgccgcccggcactcccccggccctcaccccgcccacggctgaggcggggggggccgccgggacccggtccggtgtggcggcggccgggccggatcgccgtcgacgggccgccgtggccgctcggagcgagtcaccgtcgacgtgccgtcagccgacccccgcaatacgctccttcacgagcccgtacagcgccacggacaccgccatcacgccggccgccgtgaagacgcccggcgcccagctcccggtggcgtcgcgcaggactccgctgaccaccgggctggccaccgccccggcttccgcgacgaggttgaacaggccgaacagcgcgccgcggtcctccgcgccggccaggtcgcccaggaggctgtggacgatgggctggagcgcgttgaagaagaggccggagaagaagaggatcaggccgagcagcaggagggagggcctgccgtccagcaggctgatcccgaaggcggtcgccagtaccgtgtgcacgaccgcgcaggtgatggcgagcgacttgcggcccttgccggcgcgtacccgccggtcggcgatccagccgccgaccgggaaaccgatgatgccggcgccggcgttgaaggcggcggtcagggccgccgcgcccaggctgctgtgcgcgctctcctcgacgatctggaccgaccagaaggagaagaaccacaggttccacatcaccgcgacgaacgcgacgcagaccagccacacgttgcggttgagcagcgccgcagaccgcccttcgcgcacgatgccgcgtacgacgaccgtgagcatgcccgcgaacagcaccccggagcccaccgcggtcagccagtcgggccagccgaaggcgtcggcgcacaggaagagcaccacgatcaccgcggcggtgggcagggagtagccgatcagccgcagcgtgggcggcccgagccgcagcggacggtcccctcggccccggaagaacacccaggtggcggcggcgatcagcagcgagacgacgccgaagacgtacagcggcatgctccaggcccggccgcccagaccgagcgaaccgccccagtcgatcaggtgcggggtggccaggacacctaccgtcagtccgatcgacagcccggacaggacgatcccgagccccgccgtgcgccgggccagcggggtgtgggcgatcaccaggacccggtcgttggagtagaagacgccctcccccagaccggtgaggacccgggccacgacgaaggcgacgagaccgcccgcgagcccggacaccaacgtcatcagtccggcccacagcagggacaccaccagcatctcgcggtggccgtaacggtcgccgagccggccgcccgcgtactgggtcagcatgtagccggtgaagaacatggagccgatcaggccgcccagcgtggcgggatgtgccgcgtccccgatgaacccggccttgctgtcgatcatccaggagacgaccggccccgtgaccgtgcggtcggcgtagctgatcagccagccggcgagcaggaaggcccacagacgggtgtgccgcccggagaagaccgggcgggcgtcgccggacgcgggctcggcgccgggaccggcgacctcgggggctgcggctgcttccttcatacgtccccctcgacgtgaaggctcccggcggcgcggccgggtgctgtacggatgacctgggaagagcccagcagaaagcgcttgccaacatggcagcgccttccggccaagtcaaccgttgactttccgcctggcaagccgtaacgcgaggcgactgggctgcgcgggcggaccccccggagccccgcggggcgcaccccggagacctgcggcacacaccccggaaacgcgcgggggccgtgagccgctgaagggccacggagtcttcgtcgccgaacggttcgcgcagcgctcgcccgccagtaagctccactcctccaagcgaaggccgcaagcgaaggccatcagcgaaggccgcatcacactctcagccggaggatcgtgtgacacgcaccaaccgctcgttcgcccgccgcaccctgaccgccgtcgcgctcaccgtcgcgctcaccgccgcggtcacgctcggtgccgcgtcccccggagtcgcctcggaccggccggcggctccgtcggtgccgctgcgcgtggccacgtacaacatccatgccggggcgggcgaggacaacgtcttcgatctcggccggaccgcgcgggccatccaggacctgcacgcggacgtgatcggcctcgaggaggtcgacgtgcactggggcgcccggagcgagttccgcgacgaggcgcgggacctggcgcggcggctgcacatgcgggtgttcttcgcaccgatctacgacctgcccgccgaggcgccgcagaccgagcgacggcagttcggtgtcgcggtgctgagccgctacccggtggtgagcgcggagaaccacgagatcacgcggctgtccacccaggcggccgacccggtgccggagccggcgccgggcttcgcggaggtgacggtacgggcccggggcgccctggtgcacgtgtacgcgacgcatctggactaccgcgccgatccgtcggtgcgccgcgcccaggtcgacgacatgctggccgtgctggccggggacaccgagccgaaggtcctcgtcggtgacttcaacgcccaacccggtgcgccggaactggcgaagctgtgggggccgctggccgacgccgccccgcacggcggcatgacctatccggcggccgcaccggaccggcgcatcgacgtcgtggcggtctcaccccaggtcgcggtcgccggggtccgcgaggccgtcaccacggcctcggaccaccggcccgtcgtcgccgacctcgtcgtcccggggccgcgcccctgaccctcgcgccgccggccgcgtctcaggagcgggaggtggattcgaggtgggcgaagacgaccacgttggactcgtagtccttgctggtgcggttgaacgtgccgccgcaggtgatcagccgcagttcgggcgtgggcgtgtcggcgtacacctcgtcgtccgggaagctcgccttgctgaaggtgtccactgcgtcgatcgcgaaccgggcgacgatgccgtcctcgcgggtgatgtccacgtgttcgccggcggtgagggagtcgaggccgacgaagaccgccgggccggtcgtggtgtcgacgtggccgacgacgaccgacgtcccgcgctcgccgggcgaggctccgccctggaaccatccgacgagattggtgtcgtcggccggtggcggggtcaggtgcccggtggagtccagggagagtttggtgaacggcgcgtccacggagatcgccgggatggagatccgggtgggagccgaacggggcagcgctccgtcgtccggtccggtggactgctcggcccggggggttccggccgcccgggtggcgaccgtggtggggcggtccggctgccgggagctggtcaccggggcggcggcgcccagggattggtgaatgagcaccagtccgagcccgaccgccgccgcgggccacagcaggcgcagccggccgcgacgaggtgcggtcccggtcccggactgttccgtctgaggcggacgctggagagccatggacggtgcctttcgtcaagaggtggtgcggtccccgcgcggcggggtggggcgccgccgccgcggcccgcgcgttcctcacgaggagggacgcaggccgcgacagcgcaccgacggtggacaggggcctgttcaggccacggacgtacccgacaccttgcggcgccgcagcatgtaggcacccgctccgacgccgccgagcacgagagcggctcccaggcccatggtgttcggggactgggccaggccgccgccaccggcgtggacgccaccgtgcggcttgccgccacggtcaccaccgcggtcgccaccacggtcaccgccgcggtcgccgccgcggtcgccgccacggtcgccgccgttgtcgctgccgtggtcgtcgcccttcgaggagcggtcgttgtcgccgccgcggtcaccggagtcgtcaccggtggtgcgcatcgccagcgcaccgccaccggcgtggacgccaccgtgcggcttgccaccacggtcaccgccgcggtcgccaccacggtcaccgccacggtcgccaccacggtcaccgccgttgtcgctgccgtggtcgtcacccttggacgaacggtcgttgtcgccgccgcggtcaccggagtcgtcaccggtggtgcgcatcgccagcgcaccgccaccggcgtggacgccaccgtgcggcttgccaccacggtcaccaccgcggtcgccaccacggtcgccgccgcggtcgccgccgcggtcgccaccacggtcaccgccgttgtcgctgccgtggtcgtcgcccttcgaggagcggtcgttgtcgccgccgtggtcgccggagtcgtcaccggtgacgacggtggcctgcgcgggcgcgggggcggccatgcccagggcaccggcggcgggagccgagaacgcgacggcggaggcgatcgccgccgagacgaacagagtacgggagatacgcatggtgatccttccgtcgcgactgcgagaacgggcacgatgcccgctcttcgggatcgcaggtgcgacgtgatcactgtcagcgggatgcgcggtccgcaccatcggagcgccgcattcggactactgacggcccttcggcgcgtccacgcgggggaacgccgtactccgtgcgcggaggtgagccccggtcacctgccggggcccccgccgcgccgtcgggcaggtcacggcttgcgggcgagacctccgtgctcggcgatgggctccggggcgggcgccgtggtctccggccgccacagggggacggagacgaccccggggtccagcaggtccaggccgtcgaagaacgccgtgatctggtcgacggtgcgcagcacgtacggggcggcgccgctctcgttgtaggcgtcctgggcctgctcgaagaccgggtcgacgccccgcgacccgtcattgatggagaggtagctgccggacgggagcgcgtccatcagccgggtgacgagtgagcgcgcctgctcgtagtcggggacgtgacccaggatgttgctgaggatcagggcggtggggcgggtgaggtcgagcgtgtcggcggcggccttcaggatccggtccgtgtccagcacgtcggagtcgatgtaggcggtcgcgccctcgtgcgtggagtacagcagggcacgggcgtgggccaggatcatcgggtcgttgtcgacgtagacgatccgtgcgtcgggggcgatccgctgcgcgacctcatgggtgttgtcggccgtcggcaggcccgttccgacgtcgaggaactgccggatgcccgcctcggcgaccaggtgggtgatgttgcggcgcaggaaggcacggctgctgcgcgcgatggtgacgatgccggggaagacggcggtgtaggcgtcgccggcctcctcgtcgacggggtagttgtccttgccgcc

SEQ ID NO: 1327 - DNA, 1198 bp, Unknown
  Kingdom: Bacteria, Phylum: Actinobacteria, Class: Actinobacteria, Order: Streptomycetales, Family: Streptomycetaceae, Genus: Streptomyces
cccaggcgcgcagcgccctcaagccctccacctaccggctccgcccgctgaccggcgacgttccgcagcgcgcccggcccctgccgaccaaggtgcgcaccgcccccatcctgcgcttctccggccgcggcaacaccatgctgctcaccttcgacgacgggcccaaccccgactacacgccgcacgtcctggacaccctggccaagtacgacatccgggccacgttcatggtgtgcggcgagatggccgactggaaccgggacctgctggcccggatggccgacgagggccacgtcgtcggcaaccacacctggacccacccgctgctcacccagctcagccgcagcgagatccgcgacgagatcgagagcaccagcgacgtcatcgagaaggcctacggtgagcgtcccctgtggttccgcgccccctacggcgcctggaaccgcaacgtcttccagctcaacgccgagatgggcatggagccgctggcctggaccgtggacagcctcgactggacgacgcccggcaccagcaccatcgtgcgccgcgtcgaacgcggcgccgcccccggggtcgtggtgctctcccacgacgccgggggcgaccgctcgcagaccgtccgggccctgcgtacgtacctgcccaaactgctcgacgagggctaccgcttcaccgtgccgcgccgcacgtacacctgacgcggaccgggcccgcccggccggggacgccgctgtgccggggcagacccgggccgttcagcggacctcgaccaggcgggcgaagacgacgacgttgccctgatatccggtctgcttggtgtagtcgccgccgcaggtgatgagccgcagttccggcgttcccttcgaaccgtacacgcggtcgccggggaagtcgctcttctcgaacacctcgacgccgtacacctcgaaaaccgctgtctttccgtcctcgcggtggatttcgacgtgattgcctttcttcagggcgcccagtccgtagaagacagccgggcccattttgttgtccacatggcccacgacgacggcggttcctttttccccgggtgtgacggcaccgttgaaccagccggccaggttcgggtcgtccggcgggggcgcggccacccagccgtcggagtccacaccgaccggggtgatcggggcgtcgacctggatcagcgggatcctgacccggtcgg

SEQ ID NO: 1328 - DNA, 1115 bp, Unknown
  Kingdom: Bacteria, Phylum: Actinobacteria, Class: Actinobacteria, Order: Streptomycetales, Family: Streptomycetaceae, Genus: Streptomyces
atcaccgttgcagtactaagatcccgcaaggcatccatcgagcatcaatcacccgacatcaaggttccaccaccctcgtcgaccaattggcgtatagagccgaaagagtacccgtcagcagtgggagtcctctgggacttctttgggacttctggccccatcaaccggcacgaacatgaaacaattgaaagaccattccgcaggtcagaaccttcagtcactcatagcggcaggtcaccgccttcactggtctcttccgggacaactaatcagcaggatgagaaacccctcgccgagcgtcacccgccaccggcacccatcggtctacgccaccgtgacagggcctgacctgcttagcggagcgcctaacaccccatcagaacgagcgtcaaatgagcgtcaagatacctcggagagcgtcatttgagcgtcaagatatcgcccgtaacgcccatagcgcacatcatgcgcatcgactaaagccgcaggtcagcggcctttttgacaggttcaaggatcgcgacgcactccacatggtgggtcatcggaaagatgtcgacttgggccgggcgcacaaaagcccaggtcaggacaggtttcgccgaggaccgccggctcaggctcgccgggtacgagatctaccgcttcggcgtctgggaactcaccgtcccgggtggcaggctgtttctggaggacttcttcaccggcctccttgcacggcaccagaagccgaggctgtgacatggggcctgccctggcccagcaactggcagcgctgccaagaccccggtgggcttcgggggcgcggcgcagcgccggtgtgatgtcagcgccgggtgggatcatgagcgagggcggggtgcgaaggccaggggcgattgtggcggtggggtgggaccgggccgggccgccggggttcgacaggatcgtcgaagcgctggtgcaccgcgtgtatgacacgtccgcgcggaggtggtgaacgggcgcggcggtaaccagggcatcggcatcaaggtcacgcaggggacccgggtgcggaacttccacttgcagcactatctggacggtttcccggccacggcgcacactcacgcctagggtgcttcgtttggatc

SEQ ID NO: 1329 - DNA, 3818 bp, Unknown
  Kingdom: Bacteria, Phylum: Actinobacteria, Class: Actinobacteria, Order: Streptomycetales, Family: Streptomycetaceae, Genus: Streptomyces
  misc_feature (234)..(237): n is a, c, g, or t
acggcgcgctcggcggccgtgtcgatgccgacgcccaccgcgcggtgcagttcccaggtgaggacggcctcggtggcgcgccggaagacctcctcgccctcgccgatgcgggtgcgcacgtgcagggggcggaagccgggcgggcagtggtcctgctcgcgcgtcgcgccgacctcctcgtaggtgaagtcctccgaagccatgggacccaagcctagggcggcacccgggggnnnncgtggtcagcgccttgtaccagatctgcagcgccttgtcccggccgatgccggtgaccgtggagccgttggacgtgggcgagttgtagctcacgccgttgatcgtcttcgcgccgctgccctcggccagcaggtagaagaagtggttggcgacgccggacgagtagtgcacgtccttgttgccgaccgtggaggaccaggagtccgccgaggcgccgtccttgctgggcttgtccatgtagcgcagcggggtgccgtcgccgttgatgtcgatcttctcgccgatgaggtagtcgcccttgtcggtggagttgttggcgtaccactccacgccggtgccgaagatgtcggatgtggcctcgttcaggccgcccgactcgcccgagtagttgagtccggcggtgttggaggtgacgccgtggctcatctcgtgcccggcgacgtccagcgcggtcagcgggtggttgttgcccgagccgtcgccgtaggtcatgcagaagcagctgtcgtcccagaaggcgttcacgtacgagttgccgtagtggacgcgggagtaggcgccctggccgttgttcttgatgccgttgcggccgaaggtgttcttgtagaagtcccaggtctcctgcgcgccgtaggcggcgtcggccgcggccgtctggtcggtcgaggagctggaggccgcgccggtgccccacacgttgtcggcgtcggtgaagagggagccggtgcccgacgtcttgtgggccaggttgtaggtcttgtgaccgccccgggtggtgtcgtacagctggtacgtcgaccccgacaggttggtggtgaggctgacgctgccggagtacagcgtcttgccggtcccggtcgcgttctcgatgccctggtactcgaagagcttcttgccggtggcggcgtcggtgatgacgtgcagctggttgggggtgccgtcgtcctggagaccgccgacgaccgtctcgtaggcgaggacgggcttgccgctgcccgcccagatgaccttgcgcggcgcctggtcggcggcggtccgcgccgaaccggcgtccttggcgagggccaccgcctgctgctcggccttggcggcggcgaccttcggggtgagcgaggcgaccttgatggcggcgctcgtggccttggtgacgccctcggttctgccggccttcgaggtgtggacgatcaggtcgccgccgaggaccggcaggccggcgtaggtgcgctcgtagcgggtgtgcaccgtgccgtcggcgtccttgacgacgtccttggcgaccagcttctcctgggcgccgaggcctatctgccgggcggtgccggccgagtcggcctgcgcctgctggagcagggaggtgcgggcggcgctggtcagcgaggtgggcgcggcggccagggtggtccggccggtcgagtcggccggggtctgggccgaggcggcggtggtcaggccggtgctgaggagggctccggcggcgactgcggtggcgacggccagcgtggtgcgcttgtgacgcaggttgcggggagtcacacaagctccttatgtgggggcgcccggccggcgtgggggtgccggccggacggaaggtcggttgctgtgctcgtgcggcgagtggagagagagtgacatcaaggacgcgtacatgtcaggaccccgaggtgatgttggccgaaagttgactgtctggttcgtgtttcggcagtgtgaacgggcgccgccccgggcgttccgcctccggaacggcgccctgccctcggggtttcggggccccggcgaggacgcgcggcctcgccggacggcccctcaccggcctttacgggaaggtcagcttccagccgtcgatgtagccggtgtcctgcggacccttgtcctggacgcgcagcttccaggtgccgttggccgccgacgcggacgcgttgaccgtgtaggtcgcgtgcacgtccggcgtcgggtcgtagccgctgttcttcaggcggtacgtcgagccgttgggggcgaccaggtcgatctggaggtcaccgctccaggagtggacgatgtccaccgagacctggaggttggagggcgcgttgccgctgcgcccggagaccgtgatggacgaggtgaccgccgaaccgtagtccgggatgttcacgttcgaggtgttctcgaacgacgtgccgccgcccgggctgccgccgccggagcgcgagccgaccgcgacggccgcccaggcgtcctgcacggccttgtactccgcgctggaggtgccgtacagctcgccggccgccgcgagcgaaccggtgcgggcggaggcgtagttggtggtggaggtgaacttcgtggtcagcgccttgtaccagatctgcagcgccttgtcccggccgatgccggtgacgggcagcccgtccgcggtgggcgagtcgtagctgacgccgttgatgaccttggcgccgctgccctcgctcagcaggtagaagaagtggttggcgacgccggacgagtagtgcacgtccttgttgcccacgcccgaggaccaggagtcggcggaggcgccgtccttgctgggcttgtccatgtagcgcagcggggtgccgtcgccgttgatgtcgatcttctcaccgataaggtagtcgcccttgtcggtggagttgttggcgtaccactcgacacccgtgccgaatatgtcggaggtcgcctcgttcagaccgccggactcgcccgagtagttgagcccggccgtgttcgaggtgacgccgtggctcatctcgtgcccggcgacgtcgagggccgtcagcgggtcggcgttgcccgaaccgtcgccgtaggtcatgcagaagcagctgtcgtcccagaacgcgttcacgtacgagttgccgtagtggacgcgggagtaggccgccgcaccgtcgtcgcggatgccgttgcggccgaaggtgttcttgtagaagtcccaggtgaccgcggcgccgtagtgggcgtcggcggcggcggtggccgcgttcgacgtcgtgccgtcgccccaggtgtcgctggactgcgagaacagggtgccggtgccggacgtgccgtggttcaggttgtacgtcttgtggccgccgcgcgccccgtcgttcagcgtgtacgtcgagcccgactgggtcgtcgtcagcgtgacctggccgctgtaccgggtgttgccgacaccggtctcgatgccctggtaccggtacagctccttgcccgtgttcgcgtcggtgatcacgtgcagctggttcggggtcccgtcgtcctggaagcccccgatcaccgtctcgtacgccagcaccggcgtgccgctcgccgcccagatcaccttgcgggaggactggtccaccgaggccttggtgctgccgagcgtcctggcccgctgcacggcctgcttctcggcggtcgccttcgacacgctcggcgtgaggctgcggaccttgacggccgcgcgggtggccttgatgaccgactcggtcttccccgacttcgcggtgtcgacgaccaggtcgccgccgaggaccggcaggccggcgtaggtgcgctcgtagcgcgtgtggagggtgccgtcggcgtccttgacgacgtccttg

SEQ ID NO: 1330 - DNA, 2709 bp, Unknown
  Kingdom: Bacteria, Phylum: Actinobacteria, Class: Actinobacteria, Order: Streptomycetales, Family: Streptomycetaceae, Genus: Streptomyces
tccccgcatactgaccggatcgccgtaccgaccggggagcccgcacagaccggctccccgcgccgaccggatccccacgccgaccggctccccacgccgaccggatccccatgccgaccggatccccgcaccgaccggatagcccgcaccgaccggtgcctcgcagtcagtgcctccccgtaggatggacggcatggccaagaccagtacgacgacccaggggctgcggtcggcgatcgaacgcagcggctactacccggctctcgtggccgaggcggtggaggccgccgtgggcggcgagcccatccggtcgtacctggtccaccaggagaccaccttcgaccagaacgaagtacggcggcacgtcacggtgctcgtcctcaccggcaaccgcttcatcgtcagccacaccgacgaacaggccgccgacagcacctccccgacgccgtacgccacgacctccaccgagtcggtgaagctcggccggatctcgtccgtcgtggtcagccgggtcgtcgccaacccggagcagtacaagccgggcaccccgccccgcgaggtcgtcctcaccatcggctggggcgccgtctcccgcatcgacctcgagcccgccgcctgcggcgacccgaactgcgaggcggaccacggctacaccggcaactcgaccgccgacgacctcagcctccgcgtcagcgaggccggggacggcccggagaccgtgcgccaggccctcgccttcgcgcaggccatctccgaggccaccgcggacgtcacccgctgatgtcggcccagcccaccgcctgggaccaccccgagcccctggccgtcgcctccgcacccgtccccgcctacgggtcgggttcgctcgccgacctgctgcccacgctggccgcgggcatgggcgtacccgagacgacggcagcgatcggcgagctgacccccaccgaccgcgcctgcgtcttcctggtcgacggcctcggctgggagcagctgcgggcgcacgccgacgaagcacccttcctgacctccctgctcggcagctcgcgcggcggcaccggccgcccgctcaccgccggctacccggccaccaccgcgacctccctcgcctccgtcggcaccggcctgcccccgggcgcgcacggcctgcccggctacaccgtgcgcaacccggccaccggcgaactgatgaaccagctgcgctggcagccgtacaccgacccgcggccctggcagccctaccccacggtcttcgagctggcccaccgcgccggtgtgcacgccgcgcaggtctcctccccggccttccagaacaccccgctcaccaaggtcgccctcagcggcggcaccttcctggggcggctgaccggcgaggaccgcatggacgtggcggccgagcagctcgccgccgccgaccgcgcgctcgtctacacctactactccgagctggacggtgccggccaccgctacggagtggactccgacgcctggcgcggccagctgatgtacgtcgaccggctggtccagcgcctggccgagcagcttccgccgcgcagcgccctctacgtcaccgccgaccacggcatggtcgacgtcgcgttcgacgaggagcaccgcatcgacttcgacgcggactgggagctgcgcgccggggtcgccctgctcggcggcgagggccgcgcccggcacgtctacgcggtgcccggtgccgcgggcgacgtgctgacctgctggcgtgaagtgctcggcgagcagttctgggtggcctcgcgggacgaggcgatcgacgccggctggttcggaccccgcatcgacgagcgggtgtacgcgcggctcggcgacgtcgtcgcggcggcccgggacgacgtcctgctcatcgcctccgagcgggagcccaaggagtcctccatggtcggcaaccacggctcgatgaccccggccgagcagctcgtcccgctcctcgaagtacgctcctgacgccccgcccgcgactcccgtcactctcttccgaccgacctcgccgaaaggtgcccgtcccctcatgcccgagctggtgttcttctccggaacgatggactgcgggaagtcgacactggctctgcagatcgagcacaaccgctcggcgcgtggcctcgccggcatgatcttcacccgcgacgaccgggcgggcgagggcaaactgtcctcacggctcggcctggtcacggacgcggtggaggtcgcggacggcgtcgacctctacgcctacctcgtcgatcacctctcccggggcggccgggccgactacgtgatcgccgacgaggcgcagttcctcgcgccggaacagatcgaccagctcgcccgcgtcgtcgacgacctggagatcgacgtctacgccttcggcatcacgaccgacttccgttccaagctgttccccggctcccagcggctggtcgaactcgccgaccgggtcgaggtgctccaggtcgaggccctgtgctggtgcggcgcccgcgccacgcacaacgcccgcacggtgggcggcgtcatggtcgtcgagggcgcgcaggtggtcgtcggcgacgtcaaccagtccgaggacgaggtcggctacgaggtcctgtgccgccgccaccaccgcaggcgcatgacgagcgcatcggagagggcggcggcactgtcgcaggacgtgctgccggtgacctccgactgatcagcctgcccggcggcctc

SEQ ID NO: 1331 - DNA, 1409 bp, Unknown
  Kingdom: Bacteria, Phylum: Actinobacteria, Class: Actinobacteria, Order: Streptomycetales, Family: Streptomycetaceae, Genus: Streptomyces
gccgttgaggccgttgtccggggcgacggtctcgtcgtgggcgttcttgacgaggaccacgtcgccgatcagcgagtggttgaagaaccaggcggccggcgtggagctgtcgtagccgccgcgcacgtcgcgcaggccgatgcagccgtggctggagttgtagttgccgaaggcgtcgccgccccagtagttgccgtgggcgaaggtgccggaggtggtcaggcggatggcgtgcgggacgtccttgatgtcgtactcgccgccgtagccgacggtgtcgccgttcatccgggtcaccgagagcttctcgctgatgaccatccggccgttccacgtgtcgtagccgggcttgccggtagtgaccgggagcgtcttgacggtcctgccgtcctgggtgaccttcatcgtgtgcttcttggcgtccacgacggacacctggttgcggccgatggtgaaggagacggtcttggtctgcttgccgtagacgccgggccggccctccacgccgtcgaggctgagcttgacggtgaccttggtgccggccttccagtagtgctcgggacggaagtcgaggcggtccttgccgaaccagtgcgggcggatctcgaccggcggctgggcggtgacccggacggcacgctggacggcggcacggtcggcgatcgcccggctgaacgccagcgagacgatcattccggtgccgacgacggcgcggtcctccggggtgacgtagccgatgaagcgttcctcggggacgtaggtggtgaagctggtgtgccgggccgagcggtgtccgtcgtcgtcgacggccacggcgtcgacactgtaggcggcggcgagggcgagcctgtcgtcgtcgggccgccagctgcggccgtcgcgggagaggcggccggtgacccgggtgtcctgcgcgtcctgggaccggacgaccttgacggactccaggtgcccctcggtgacccgcacccgcagcttcgtgccgggccggacgtcgtgactgccgtcgtccggcgagacgcggaccgcgtccgccgcctccgccgcctgtccgggtccgccgggtgccccgcccgggccgccggtggtgcagccggtggccccggccagcagtcctgcccatgtcagtacggcggccagcgcggcccccgcgcgccgtgcgcgccgttgtacgtgcctcacgggctgcccaacgaccggcccgctcccgggaaacgtgagtgcgagccgagcgctgggcagaacagtgaggaggagcatgcgcccggaagccgcgccgggaggaagccgcggaagcgaaccggagccgaacgagccgcaccagccgaaaaaaaaggggccgaccaggtgtccagcgcagccgagcaggaggcggtggcgggcgggcgcgccaccgcctcctgctcggc

SEQ ID NO: 1332 - DNA, 1223 bp, Unknown
  Kingdom: Bacteria, Phylum: Actinobacteria, Class: Actinobacteria, Order: Streptomycetales, Family: Streptomycetaceae, Genus: Streptomyces
cagcccgctccggtgggccggcgttctccacccccggggtcggcgccaccgcggacaggccgtcgtcgccgctcagccagcccgcccgcaccgcctggcagcccagctggaagcgcgtccgggcgtcggccagctgcatcagccggctgagcctgcgctgcaccgtgcgatgaccgaggccgagctgccgggcgatgctgacgtccgtcagacccacgtgcagcagcctcaggatcgtccggtccacctcgtccggtccgtcctgcggacccggggcaggccctgtctgctcggggccggccagccgccaaccgcgctcccggtaggcgtggaagagtgccaccagcgcttccagcagcccggtttcatgaatgatcagcgctccggggtcgcggctgcccggcatgggcgagagccggaccatggcgatcttgccgtccgcgatggccagttgcacgggcacggagtccaccacggtgagttcctgcccggcgcgcagcgactcctccacgaggcccccgatcccgggctcgtccagccagccccgctccaggaccacccgataacgcacaccgcgccgcatggcctcggcttcggcgtcgttctcctccgccggtaccacggcgttccgccgccggctcaccggcatcatcaggccgaggacctcccggcgcgcagcgagctgcagttgcaggaaccggtggcgcaccgcttcccgtccggagaccacctccacgggcgccccgggtcggctgctctgggcttcctggtactgctcggtgagccaggctatgagtctctcggcctgccgcaggccgtcgcgccgggcggagagcagcggctccagggcgagggagggtggtgtggcccggtagcggggctcctctccggagtcggtgtccgcgagggccaggccggtgctgaccagccggtgcagcaccacggccaccccgtgctccgacgaggcgacggcaggggtcgcgtcggcgggcgcggcagccagggcccgtgcgagttcagccgcccgcactcccggatgtgcgacgagggcgcggtagaccacgtcctcctcgtctgccagtcccagcgcagtcagcacccgcggcctcctcgttttggcgtcgggcggcgctccgccccccactgccggaactccccccccggctacggcattctccctcccgccgcaggccagccgctagcctcgcgctgtcgcggccggg

SEQ ID NO: 1333 - DNA, 744 bp, Unknown
  Kingdom: Bacteria, Phylum: Actinobacteria, Class: Actinobacteria, Order: Streptomycetales, Family: Streptomycetaceae, Genus: Streptomyces
ccgcgcacaccggccgcctcgtcacgggccacgtcccggaagcggcggagacactgcaccgctgagggcccggaggaactacggaatccgggactccgcctccgtcctcactccggccagggtgccttcgatggccgtgcgcaggagggcgaggcggccgtcgatgatctggtcctcgcggtcggggtagcgctccacggcctcctgcagcgggcctcgggcggggccgacgcgcatgccgtgggtgaggcgggtggcggtgccgtcgtcgaggggttcgagggtgtacgtccagatggcgagcggttcgccctggtggcgttcgttgtagcgcacgacctcccactcgaagacgctgtccggcgtcacccgggcgatacggctcaccgtgcgccactcccccatcacgctgttgcggttgcggccggagaagcaggcgccgaccgccgggccgtcggcgccgtcgatccactccacctcctgcagttccgggctgtagcggaccgaggtggagatgtccgagaccagctcccacacccgcttcggctcggcggcgatccgggtcacgcactccacgtgcgggccatcggcaagacgcatcgtttcttcctcttcttcttcgttctcttccgtctcgcatgtgttcttctccgtgtcacacatgggaggcggttcaggtgtgttgtcggtggggcgcggggtcaggccgccgggctggtggccgggggcgcggcccgggccacc

SEQ ID NO: 1334 - DNA, 1238 bp, Unknown
  Kingdom: Bacteria, Phylum: Actinobacteria, Class: Actinobacteria, Order: Streptomycetales, Family: Streptomycetaceae, Genus: Streptomyces
cccgcaccggcatccgcggcgggcgccgcggatgccggtgcgggacatgggacggctgtagcggtcgctcgacccaccgctccgtggagactcaccgctccgggaagtctcaccgctccgtggagactcgctgctccgtgcaggtgggaactcactggcccgtgcaggcgggaactcacaggtccgtgcaggtgggactcagtcgtccgtgcaggtcggactcactggtccgaggagaagcggaccgcgcccgccgggatgcgggcgtcgcaccacacgcgtacgccgtcccgcagttcgttgtcggcgccgacgaccgcgccgtcgccgatcaccgcgccggtgagcacggagcgggtgccgatgcgggcgcggtcgccgatgagtgagtccgtgatgacggcgccgggttcgatgacggcgccgggcaggatcgtactgccggacacgcgcgccccctcggcgacgaacgcgccctcgccgaccaccgtgccgccggtcagcttggcgtccggcgcgacgacggccgtgggcaggaccaggcggtcgccgcagcggccggggaccgccggggacggggcacggccgaggaccaggtcggccgagccgcggacgaaggcggccggggtgccgaggtccagccagtaggtggagtccaccatgccctgcagatgggcgccggcggagagcaggccggggaaggtctcgcgctccaccgacaccgggcgcccctgcgggatcgtgtcgaggaccgagcggcggaagacgtacgcccccgcgttgatctggtcggtgacgatctcctccggggtctgcggcttctccaggaaggcgaggaccctgccggtgtcgtcggtcggtaccaggccgtaggcgcgcgggtccgccaccttggtcaggtgcagggagacgtccgcgcccgtctcctcgtgcgtgcgcaccagtgcgcggatgtccaggccggtcaggatgtcgccgttgaagacgaggaccggctcgtccggacctgagcgcagccgcggggcgacgttgcgcagggcgccgccggtgccgagcggctcctcctccgtcacgtactccaggtggagtccgagggcggagccgtcgccgaagtacggctcgaagacctcggccaggtaggaggtggcgagcacgatgtgctcgacgcccgccgccctggcgcgcgccagctggtgggtgaggaacggcacgccggccgcgcgcaccatgggcttggg

SEQ ID NO: 1335 - DNA, 1288 bp, Unknown
  Kingdom: Bacteria, Phylum: Actinobacteria, Class: Actinobacteria, Order: Streptomycetales, Family: Streptomycetaceae, Genus: Streptomyces
gcagacgccagaccctcgcgcccgctccggcgagcgcgagggtctggcgtctgctcaggtccatgtccgggttcgtccttcgggctcagtcggtcagcgtggccgggtcggtcgacggcttcggcaggtggagggcggccagttcggcccggccctcggcgtcgatggggaacgcccaggtggtgacgaagaagtcggtgaggtcgcgctccgcgacccggctggcgtaggtggcgagcgcccggtagcgcttggccgtttcggaggcgtccgactgcgggttctcctcgcgcaccagcttgtgcagccggggccagaagtcgtcgccgaaggcgagttccagctgccgcagcggcacgagcttctcgtacgcgccgaaggacttctcgtatgtcagccccggcgtgccgaacttcgcccgggcggactggaagtagttcaggcccgtcttcgggtcgacggtcaggaggttggacggctggccgagggcgcgctgcacggccagcgagtagatgttcaccgtgacctcggtcagcccggacggcttgtacgcgaactgctggtgcagatgcccgagttcgtggtacaacccccagccgcgggtgcgcagccccgccaccgtggtggcccggtcgagataggcgcgggggaatccgttgtagccgtgggtcgcgtatgcgccgacgccggacggcaccacggacacctcggtgaagtggtagccgccggccttgggccggtgcaccggcttggagccgtccagcccgctgatgtcggattcggcgtcgatgatctgttccaggagccgcagcagcgccgcgtggtcctcgtcccggtacagcagcgcgccgtcccgggtgagcgtcacgatcgagcgcggcccgtgcagctcgacgaccgggacatcggtgcaggtgtccaactggcgctggtagtcggcctcggtggtgtgcccgagtgcgaagaccggcatgggcacggaaccgctcctgaaccggacggcggcgcgctgcccacggccctccagggtgaggtagacgggtccgccgtgcgggtcggtcacggtgttcgcgccgggcttgagctcgtagcggcgcggctcggtgacagtgccgtagtagtcccactgcccgatccacagggccggcaccacgccgtcgtaggggagtacgtcgaggcggagggcggtggccggcgggacgtagcgtccggtcgcctggaactcggagccgcgcagggcctggccgagacggagccgctccgcctcggcggaggggctccgtctcgg

SEQ ID NO: 1336 - DNA, 1216 bp, Unknown
  Kingdom: Bacteria, Phylum: Actinobacteria, Class: Actinobacteria, Order: Streptomycetales, Family: Streptomycetaceae, Genus: Streptomyces
ccgccaactcggcggccgcgcacgcggacaaggcggccgacgcggccgaggaagccgtgaagtacgcgggtcaggcccgggactacgccaacaagtcgaaggcgtacgcggccgaggccgtgaaggcggccgacaccgccacccagaccgtcgccgaggccgtcgaggtggagaaggcggcgcgccaggcggagctggacagcctcctccaggtccgcgaccagggcatcgaggaggccgggacactcgccgaggtcgaggcgaaggagcaggcggagtacgagggcaagcgcctccagcagcagcggatcacgcaggagacgcaggacctcctcgacagggccgccgccgcgttgggcgccgaggactacgcactcgccgccaccctgggccgcaaggccgccgtcaactacctcggcgcgagcgggaactggtcccgcgaggcggcgcagttcgccctcgccggggacgacatggacgtactgaactgggtcgacctggaccgcttcgtcgcgcagggccaggacgacagggaaacggtcctctacatcgcgcagacctccgacccctccgtcgccgcggcggccgccaccgcgctcgcggacggcagcgccgccgccatcggtgacttcgtcacctcgggcatgatccgggccggctccgaggagaaccgggtccgcatcctgcgcatcctgtccgccaagccgggcaaggccgtgacgaaggccgccaacgacgcgctcgacgccggtacgcccgaagcgctccagaagttcttcgaccacgatctcgccgaggcgatcaaggaggacgacgccgtcacgacggcgaccgtcatagcccagggcggtgactactccaaggcgtacgccgccgtcgcgatggccgggccgacgtggatgcggcgccgcttcgtggaggcggtgcagtaccgcgccgcgcagctcgacttcgactcgctcagccactccgccgcgatgcgggccgccatcgccggggccgcgaagatcgcccaggacgcccagcagaacgccgcgaaggcgtcccaggccgccgccctggcgaacaacgcggccgaccaggccgaggcctgggcgaagaaggccgtcgaggcgtcggacaaggcgaaggactacgcgacacaggcgcagaacaacgccgacgccgccgacaagtccgccgccgacgccaaggcctcggcggcctcggcggcggc

SEQ ID NO: 1337 - DNA, 2021 bp, Unknown
  Kingdom: Bacteria, Phylum: Actinobacteria, Class: Actinobacteria, Order: Streptomycetales, Family: Streptomycetaceae, Genus: Streptomyces
tcgccggcaggcgtccctcgccgccgaacgcgagcggatgggccgcgtcatcgacaacgtgctcgcggccgacgacgacggcgagagcgcggtgacgatgctgcacgggcaggacctgcgggaggcgctcgtcgacgagaacgccctgccgcgcaccgaacccgaccggctcgccggaccgttcgcgcacgtcgtcgtggacgaggcgcaggaactgaccgacgcccagtggcagatgctgctgctgcgctgtccctcccggagcttcaccatcgtcggggaccgcgcccaggcccggcacggcttcaccgagacatggcgggaacggctcggacgagtcggcttcgaccgcatcgccctcgcctccctcaccctcaactaccgcacgcccgaggagatcatgaccgaggccgagccggtcatccgggccgcgctccccgacgccaacgtgcccgtctccatccgcagcaacggcgtccccgtcgtccacggcaccgccgccgacctggacgcggtcctcgacgcgtggacggcggagcacgccgagggaaccgcctgcgtgatcggcgcgcccgcgttccgggagacggcgcgcatccggtcgctgaccccggagctgtcgaagggactggagttcgacctggtcgtcctggtcgatccggaggagttcggcacgggcgtcgagggagcggtcgaccgctacgtcgcgatgaccagggcgacccggcagctcgtcgtcctcacctcctcctcggcggcctcctgagaccgccgtatctccgtcgccgaccgtgtcgctgttgggccgaacaggtgacatggcgtaagaattggctggtgcaggcgatgagtgcgagtcaggtcggggggagccggtgaacagccacgacgtcaccgatgagcagtgggaggggctcgcccaggtcgtgccgttgcgcggccgggactcctggccgtccgcggtgaaccaccgggccctcccggacgcggacacggagttgcgccgccgcttcgtcgtcctgcgggtcaacatcttcgcggacgcccgcgacgtggccgagacgctgatggcgggcgtcccggtcctgctggacctgaccggggccgagaccgaggtggccaagcgggtactggacttcagtaccggcgtggtcttcggcctgggcagcgggatgcaccgcgtcgaccgcaacgtgttcctcctcacgccacccggcaccgaggtgagcgggctgatggagggagcggcggttcccggggtgtgagacggggtggagctgagcggggcggtgggtcacgggtgatagatctggtgacgtgaccgagccccacgattccacccggcacgacctggccgggttgcagcgtcgcctcaccgagttcgccgccgcgcgcgactggcagccgtaccacacgccgaagaacctggtcgcggcgctcagcgtcgaggcctccgaactcgtcgagatcttccagtggctgacaccggaggagtcggcgcgcgtcatgtccgaccctcgctccgcgtaccgcgtccgggacgagatcgccgacgtcctcgcgtacctgctgcaactctgcgaggtactcggcgtcgatccgctggcggcgctggccgcgaagatcgaccggaacgaacagcgtttccctgcccggggaacgggcccgcgaggaccggggacaagcacggagacggataccaccgaggggaactgacaactccgctattactctccggagtcgttcggtcggtcgaaatcgatttgttgtccagagatttccgtcttcctctggctttttgtcccaggctccctcactctgggtagtggacaagggagttcgggcagacgtgcgacgagcacgtcgggagatgacgggggcagcgcatggacgcggtgcggctcatcctggcgagcaggcgtgccctggcgggcagcggcgaggcccccgccatcctggcggaggtgtggcaggcgcaggccctggcgcaggcggtcggcagccggctcgcggtctccggc

SEQ ID NO: 1338 - DNA, 4833 bp, Unknown
  Kingdom: Bacteria, Phylum: Actinobacteria, Class: Actinobacteria, Order: Streptomycetales, Family: Streptomycetaceae, Genus: Streptomyces
ccgcggatcggggcacgctcatgagccggatcctggtgaccggttccgccgacggcctggggcgcgccgcggcggacgcgctgctgtccgcgggccatgacgtggtcgtgcacgcccgcagccacgagcgcgcggcggtcctggacgggctggtcggccgcggggcgcacctgtgcgtcggtgatttcacgcggcgtggcgacgtgcggcgcctcgccgctgagctgaacgacgccgagccgctggacgcggtcatccacaacgcgggcgtgtggagcggaccggcggtcatgccggtcaacgtcgtcgcgccctacctgctcacggccctgctgcgctcaccgcgccggctggtgtacctcagcagcagttcgcacttcagtgggcgtccgtcgctggagggggtcgactggacgggcgcgagcgcgggctcgtacgccgacagcaagctgttcgtcacgacgctcgcgaccgcggtggcgcgcctgcggcccaccgtgctgagcaacgcggtggatccgggctgggtgcccacgaagatgggcggaccgggcgcgccggacgatctggagctcgggcatcggacgcagcagtggctcgccgccggcgacgacccgcaggcccggaccggcaccggtggctactggtatcaccggcggctggtgcagccgcaccgcgccgtccacgacgaggcgttccaggaccgtctcctgcgcgcactggccgaggagacgggcaccacgctcggctgagcacggtgcccggtggcggctgcgccggaggttgccggggacttcacgcccccggccggagatcgttcacgcgctccgtgccgggcagggcggccggccctctcccggtctccgcatacggttcggcgcccggcggtcagtgctgtgggtggggacgcgcgtggaagagcggccgccgctgcctggtggtggtgccccgggtcagacggccggcctcgatacggatctggacggcgtggaacacctcgaccacgccgaggacgatcgccatgatgcccgtcgccagggcgagcgccgcgatcgagccgaacggcgcgacgatcagcacgatgcccgccagcagcgtgacgatgccgaggaacagctgccagccccgtgccggcatgccgggcgacgcgccggcggccgccgtcatcatgatgccgcgcaggagccagccgaagccgagccagagagcgagcagcaggatcgattccagcgtgccgcggaagcagacgagcccgagcagtacgcagagcgcgcccgtgatgaagtgcagcgcccgcagatgcccgggtacgtgcgcgccgaaggcggaagccagctggaagacgccgctgaccagcaggaagacaccgaagattatgccgatgacccgcagcgtctcccctggccacaccaggacgatgacgcccacggcgatcgaggcgagaccgatggtgaacaacgcctgccagccgaagttcgccagggcgctcagggattccgtcgccgccgctgtcctggggggctcggcctggggcgggggcctgctctcggaggattccgaggggaatgtcatgccgtccacctcctccttcctgtacgacacggccggagcaacacctccatcgtcaccccagggcctcccccgcgcctgggcagggaagacggccgccggtgaagtccggcggccgtccgtgccctgagtcccacgacctcgtgagcaggtgctcaggtgaggagcaggaacgtggtccaggtggtgccgccgaacatgggcttctgggcggcgagctgtccgccggcctggccgtcgtagaggtgcatggtgccgtcgttccagatggcgaagacgtcgctgacgccgtcgccgttcacgtcggccgcggccatctgcttggtggtcagccaggtggtgccgccggtggtgacgcgcttgccgtcggcgacctgaccgttgccgaggcccttgtagtagttgagggtgccgtcgttccagacggccatgacatcggcgatggcgtcaccgtcgaagtcgccgtcgaagagctgcctgacggtcccccaggtggcgccgcccacggtgaccttggtgccgttgccgagctgcccgtcgccgagaccggggtagacgtgcagggtgccgtcgctccacacggccatgacgtcggcgatgccgtcaccggtgaagtcgcctgcggtcatctgcttgaccgtcttccatgtggcgccgcccacggtgacggcgcgcccgtcaccgatgtgcccctgaccgtcaccggggtagacgtgcagggtgccgtcgctccacacggccatgacgtcggccttgccgtcgtcggtgaagtcgcccttggcgatctgcggcgcggtccgccacgtcgtcccgccgagcatctggacgtgggtgcccgccagccccttgtccttgtcgccggggtagaggttcatcgtcccgtcactccacacgccggccaggtcgcccacgccgtcaccggtgaagtcgtcctgcacccggaacgcggtcctggacacccaggtcgcgatgtcgtcgacgcgggtttcgacggcgccgtggcgggtctcggccgggtcgacgcccaggcaaccgccctgccaggaacgcgagctgacggcgacgagttcggcagtgccgtcgacgctgcggacggcgggagcgccggcgtcgccctggcagacggtggcgtcgtccacgccgtcgacggcgagcgtggctccgtcggtggcggtcaccgtgaactggccgctgtgcgccttgtccgggacccactcggtggccgtgcgcccgaacccggtctgggtgagccgttcgccgacggcggcgggcgtggtggcgacgcggacgggggcgatggcggggtcgaggatgcgctgggcgagcttgaccatgaccaggtcgcggtcgggacgggggacgagttcgacggcgtcctggacgctgccgccgctccgggacaggtcggcgcggccgacggtcacggtcgtcctgagtgccggcttgccggcggcgggattgccgtcggcggagaaacaggacgctgcggtcagcacccactgcggggcaacgagcgtgccggtacaggcgcgtcgggtgtccccgctgcctatgtcgaccttcgcgacgaacgtcggcgcggtcgtgctctcggggccgttcagggctgcggcgggggcggtgacaaggccggtggccagagcggctgccatggcagcaccggtggtccacctgctccgtgaacgctgtgcgggcatgaacttcctcggtctcttggtacgggactttcccgcctgcgggcgctgtgcggccggacggccgaagggcaccgccacaccgtgcacacatcgcgcacacaggttcggagatcatcaggaagctttccacgaaaggaaaaagaagtgccagcgtatggaagtgccggaaccggcgaagaggtcatttcgcctgtgacctatcccataaagcacatgaccgtgacaaggtttggtgaacgtcttcccaacgccacgtcaggtacttcccctggtcgtgcgggccggtgcgggacggctgacgacgtcacaccgaagtcccgtccaggtctccgggactgttctcggcgagcagaccgacaagagcgccgacgtgtgcggcaccgctctcctccacgacttcgcgcacgctctgcgcctcgcgtacgagggcgaagtgaacctgtccgcccgcgtccgtgcggtagccgtggacggcgggccggggcagtgcgttgtaggcgaagtgggtcgagaagtagtaggcgccggtgtcgtagagggccacgatgtcgccgggttcgacggccgggagttcgcgtcccacggcggtgaggtcgccggcgaagcagcaggggccggcgatgtccacggtctccgtcgcgccctgcttggggcggccggcggcgtcgaacaccccggcccgcaacggccaggagtcgggcatgaacaccgtacgggtggcgacctgggcgcccgcgtgggtgacggcgatacgccgtccgccggccgacttggtgtactcgacgagggaggcgatcgtgccgctcttggcgagcagcgagcggccgaactcggtgaccagcgtgtagcggccgtcgaacaactcgggcacggtggcacggagttcggcgacgtagtcggcgtagccgggccggtcctcgtcgctgtcgaagtccaccggcagcccgccgccgatgtccagtccggtgacctggcggcggccgagcgcggcgttgatgtgctccgccagttcgtgggccgcgctgacgccttgtgcgatgagcggcagcggacagccctgggagccgacgtgggcgtggagacgggtcagccaggggcgtgcggcgaaggcttcgaccacggcctgcacggctccctcgtcgcgcagggcgacgccgaacttggaggtggcactcgcggtgctcatcgcaccgatcgcgcccgctcccacctgcgggttgacccgcaggccgaccggtccggcgggcagggcgcccgccagcagcgcgtcgacgcgggcgagttcctggaagttgtcgagattgacggcgatgccgtgctcgagcacgaaccgcagttccgcgaccgtcttcgccgggctgtcgtacaccagtcggtcggtgcggaagcccgcctccagcgccatggccagctcgcctggagaggccgcctcgcagcccatgccggcccgcgcgagcaggcgcagcaccggcaccagcgaacacgccttggcggcgaaggtgtgctgcacgggcgcagggccccggaaggcgtcgcgcaggctgtcgacggcggcgaggacgccgtc

SEQ ID NO: 1339 - DNA, 1237 bp, Unknown
  Kingdom: Bacteria, Phylum: Actinobacteria, Class: Actinobacteria, Order: Streptomycetales, Family: Streptomycetaceae, Genus: Streptomyces
gacgaggaaccggccggttcccggccggacgggcaaccgggcgggaccgctccagggtggcgccgggcagggcggggccgggccgggtggcgccggggcttgcggttcgatcacgactgcgacgttacgtcacgggtgtggcacgcatcgtcacccacacgtgtggaaacgggagttacgccccccaggggtttggggtgcgttcagttgacggggagcggggccggcctgcgcgcgccgaccctggtgcgggtcgccaccaactggccgtcctgcgggtaggcgtgccaggtgcgccagtgcacctggccgtcctggcgttgcgccagcatcgcggtgaacgcgtgcgggctgcccgggaagacgccggcgagaccgtgcggatggtcggagaccagggcgagcaactcctgcgcgcggcccgcgaaggagccgggggtgagttcctccacgcgcgcggcgaactcgtactcccagtcgccgacccgcttggcgacgcccaggggcagcggtgtgctggaaccggcgatgcacgcgacggtctccgaacaggtgccccgctcctcctccaggaggacctggtgagaggcgccgagcagtctcaactggagtttcaccccggtcatttcgaggtcgagcacggccagggcgggcagcggctcacgccccagggcccaggcgaggtcggccgcgcgcgtgtcggtgtaggaagtgttcagggtggtgagcatggatcggctccgctagcacgcagaagagagaagggctgggacccggcgcaccccggtcgacatggggaggacggtccgatcaccccggttctgaacccggttacccagttcagaaccagttcggaagaggtgtgagcaggatgtcctgggggctgcgtcggcgaggtagagcgaatcatgaacggcggcgccgccacagcgtttttacccaacttcgtagggtttccatccctcagagggcctacctgctcaactgttcaactacggcgtacgcctcggcgcacggcgggcgcgcacggcgctcgggcaccgggtcccgaaggaagggccgttccggtgggcgcccaggaacggcccgcatcgcactgcgcccggaggggcagcggcgccgtgtgagccacgcccggcccggcgtttcagctgccccgcgtcagccacgcccgggcccggcgtttcggccaccccgcgtcagccacgcccggcccggtggcccggctgtcccgtgt

SEQ ID NO: 1340 - DNA, 1913 bp, Unknown
  Kingdom: Bacteria, Phylum: Actinobacteria, Class: Actinobacteria, Order: Streptomycetales, Family: Streptomycetaceae, Genus: Streptomyces
gcggcccactcacggacgcggacgccctcgccgtgcgcggcgcgcagctcctcgtacgggccgagggccacgatccggtcgccctcgaccgcgaccgagctgtccgggtccgccagcgggcggtggatcgtcagcacgtcacgtgacgtcggccggctcagctggacgcgagcagcttcagttccgggtgcccggtgccgccgtcgatcgccgtggaggagatgtgggacatcacgcggtcgtcgaccgggtcgttcgccgggtcgtcgtgcacgacgaggtgctcgtacgtcgtggagcgctgcgccgggatccggcccgccctgcggatcagctcgatgatctccatgcggttggagcggtgcttggcaccggcggaggagacgacgttctcctccagcatgatcgagccgaggtcgtcggcgccgtagtgcagggtgagctggccgacctccttgccggtggtcagccacgagccctggatgtgcatcacgttgtcgaggaagaggcgggcgatcgcgatcatccgcaggtactcgaagagcgtggcctgggtgcggcccttcaggtggttgttctccggctggtaggtgtacgggatgaaggcgcggaagccgccggtgcggtcctggacgtcccggatcatccgcaggtgctcgatgcgctcggcgttggtctcaccggtgcccatcagcatggtggaggtggactccacgcccagccggtgcgcggtctccatgatctccagccagcgctcgccggactccttcagcggcgcgatcgccttgcggggccgctcgggcaggagttcggcaccggcgccggcgaaggagtcgagaccggccgcgtggatgcgggtgatggtctcctcgacggacaccttggagatccgggccatgtgctcgacctcggaggcaccgagggagtggatgaccagctgggggaaggcttccttgatggccgagaagtgcttctcgtagtactccacgccgtagtccgggtggtggccgccctggaacatgatctgggtgccgcccagttcgacggtctccgcgcagcggcgcaggatgtcgtccaggtcgcgggtccagcccttggcggtgtccttgggggccgcgtagaaggcgcagaacttgcacgccgtgacgcacacgttcgtgtagttgatgttgcgctcgatgatgtacgtcgcgatgtgctccgtaccggcgtacttccggcggcgcaccgcgtcggcggcggcgcccagcgcgtgcagcggcgcgtgccggtagaggtcgagcgcctcctcgtagctgatccgcccgcccgcggcggcacggtcgaggacggactgaaggtcggccttctcggtcaccggcgtccctttcgcagagggttcgtagggattgaggacggaccgaaacagcctacgccagcacgctcgccggaccgacgccaggtcgccgcgggcggggaccgttgcgggcgtgggcacggtgcgggcccggcacaggtgacggacgtcaggccgcggtccaggcgccgaggagaacccccgcgaacgcccccgcgatcaggaacgggccgaacgcgatggccgtcttgcgccccgcgcgccgcagggcgacgagtgcggcggcgtacagcgccgcgcagaggaatcctgcgaaggtgcccagcaggacggtggaccagccgtaccagcccagcgctgcgcccgcgcccagcgccagtttcacgtcgccgaagcccatgccggacgggttgacgaggaacagcacgaagtagccgccgcccagggcgagccctccgtacagcgcactcgtccagtgcccggcgtgcgcgggtgccagggccgccacgccgaggagcaggagggcggcgcccgcgaacggcagggtcagcacgtccggcagccgccgcacccgcag

SEQ ID NO: 1341 - DNA, 547 bp, Unknown
  Kingdom: Bacteria, Phylum: Actinobacteria, Class: Actinobacteria, Order: Streptomycetales, Family: Streptomycetaceae, Genus: Streptomyces
ccgccgggagtcatccggtacggcggccgcgcttgccggggtcgccgggccggaggaggctcgaaggagaggcccgtgagcggcccgctgttccggggccccggggctcgtaggaggccagcatggcgaccacggcaggtcccgtcttcgacgccggcgcgctgcgccggggcatcgagggacacacggcgtccacgctgctgtcgctctacgcggacgacgccgagatccgcatcgtggaccgcgacacccagccgagtcaccccaaggtcctcaagggccgtgaggagatcggttcgatgctcgacgacatctacggccgcgacatgacgcaccggctggagcagtgcgtcgtccagggcgaccacgcggcgtacgtcgagtcctgcgcgtatccggacggcgtccgggtgctcgccgagtccatgatctcgctgcgcgacggcaagatcaccgaccagaccatgatccaggcatgggacgagtgacgaggaggaccgcaaggttccaggtcagctccaggctgacctggtccttttcggcccgg

SEQ ID NO: 1342 - DNA, 1813 bp, Unknown
  Kingdom: Bacteria, Phylum: Actinobacteria, Class: Actinobacteria, Order: Streptomycetales, Family: Streptomycetaceae, Genus: Streptomyces
cgtgctcgtgtcggcggggcgtgatgcgaggtggccggtcggcctgtccagccctcgcccacccctgggacggggtgggcgaggaccaggcggagcgaccggaggtcagtcccggaacgggcagccgctgtgcggatgctgttcggcggccggggccgggggctgcacgggaacgtggatctcgggcttgacggtgaccttggccgggcggccggcgacgacgcggcggcgcagggtcaggccgcgcatcgcgaacgcggacaggaacgtccaggcaaggaccgcgagcccggccgcgacggggcggccggcctgcggggtggccgtccagaccatgaacacggtggccgcgccccacccggtccacatcgcgcgcacgccgttgttccgggagaggtagccgaggaccaggccggtgatgccggtgagcagccacagtgtgtagacggtggaagccgcgaccgggagaccgaccgcgtgctgcgcgaggtacgtgcgcaccggctggtcgacgacagcagccacgccgctggaggtgtcgacgccgacctgcaccttgggcacggcggtgaggatctgatgcagcgcgtccaggacgacttcgccagcggccttggccatcagcacgacgaaggtgagtccggccgtcacgaggacggcgcggatccagggcgccatgtaccggaagccgtccttgggggcgctgaggacgccgtcccacatctcgtacaggacgccgtcgacgtcccaggcccggttccaccagtcgcgcagtacctcgcgcagcgcggcgaggcggcgctgcttggccggtgccttcgggaagggcacggggaggtaggcgagctcctggcgggtgttgtcgttggactgcacggggcaactccaaggtgtcgatgtggtgttcacggagcgtgcgggtgggccaagctgtgtgcgacaggcggcccggagagagggaggcggctgcaatggggtggttcacccgcgatgagccggaggaagtcgtcttcgaagaggtcgtggacacggacgggacgatctggcctgcgttcaccgacgacgacggtgtgctgtggatcgacgtggactacgacgtcgaggtgacgatcaacggcgcgatcgtcgacggccagatccggggtgccgaggtcgacgaccacggccgcatctggatcgactacgactgaccgcgaggccggacagcctgtcccgcacccgaagccccggcccgcgggcgaggtgtcggatacgaggcagggcgcccggagatcagcggacgtcgttgcgggtacgggagaacatcccgcgctggttgctggtgttgttgatctgcgtgttttgcacgaccgggccctcgtagaccgtcttggtcaccgccttgcgggccttgctgaacgcgccgccgatcgcggtggcgaccatggcgacgcccgcgaacggcagggtgaccatgaggacgccatagagcgtgacggaggccaggccctggaggaccagccaggcaccgcagccgatgccggtgatgccggcgcccacgccgatggaggcgaccgcgatcccggccgcccaggcgggcacgatccgcttgtcgtcctgatggacgggtggggtgtcgccgtaggcgggcagcggggtgtcgtcgcggaacgaggtcgggatgtgccgcacgggcggcatctcgggctggaaggaccgggcgatgatccgctcggcttcggccttggcttcgtcgtcggtgagcgggcgggtgatgtggtcgaagtccacggtgatctccgtttcgggggcagacgcgggcgccctccccgcc

SEQ ID NO: 1343 - DNA, 4682 bp, Unknown
  Kingdom: Bacteria, Phylum: Actinobacteria, Class: Actinobacteria, Order: Streptomycetales, Family: Streptomycetaceae, Genus: Streptomyces
agtccggacagctgcgccgccacggagatgacgtacaccggtgtgtcttccgtcagttcgtacgggttgcggcggcggccgtccatctccctcatgctcccttcgcggcctcgaacagctcggcccgcgggtcctcacccgctctcgcctcgcgatacgcctccagcgcgtcacgagccttccccgacacgtccttggggacactcacctccacggtgaccagcaggtccccgcgggtgccgtccttgcggaccgcgcccttgccgcgggcgcgcatggtccgcccgttgggcgtacccggcggcagcttcagcgtcaccggcggcccgccgagcgtgggcacgcggacctcgccgccgagcgcggcctcgtcgaacgtgaccggcacggtgaccgtgaggttgtcgcccttgcggccgaagaccgggtggtcaccgacgtgcaccaccacgtacaggtcgcccgccggaccgccgcgctcgcccggggcgcccttgccgcgcagccggatccgctgcccgtccgacaccccggccgggatgcggacctgcatcgtccgggatgacttggcgcgcccggagccggcgcagacctcgcacgggtgctccgcgatcagcccgcggcccttgcagtcggggcacgggtcggtcagcgagaaaccgccgccggagccgcgcgccacctgcccggtgccgacgcaggtcgggcacacccgcggcgtgccgttcttgtcgccggtgcccgaacaggccttgcacggcgcctgcgaggacatccgcagcgggaccgtggcgccctcgatggcctccgtgaagctcagcgtgacctcggactcgatgtcctggccgcgccgcggctgggtccgcgtgcccgtccccgcgccgccccggttgaacaggccgccgaagacgtcaccgatcccgccgccgaagccgccggaggcgccgcccccctgggcgccgcctccgaagaggtcgcccaggtcgaagttgaaggagccgccgcccgccccgggaccgggacggaagccgccgttgccgaacagggcgcgggcgtcgtcgtactccttgcgcttcttggggtcgccgaggacgtcgttcgcctcggagatctccttgaagcgctcctccgccttggcgttgcccttgttggcgtccgggtggtactcgcgggcgagcttgcggtacgccttcttgatctcggcctcggtggcgtccttggggacgccgaggaccttgtagaagtccttctcgatgaagtccttggtgctcatccccgacgtccctcctctcctgcgtcgatgcctattacgtcagccctcctccgggccaccgctgtccttgtcgtcggtctgctcgccgcccttgtccttgccggactcgtccgccgccttgaccgtctgcgcgcccggctgcggctcggccaccgccacccgcgcggggcggatggtgcgctcgccgatccggtacccgggctgcaggatcgccacgcaggtcgtctcggtgacgtccggcgcgtagctgtgcatcagggcttcgtggatcgtcgggtcgaagggctcgccctccttgccgaactgctgcagccccatcttggccgccacggtctccagcgactcggcgacggacttgaacccgcccaccagttcgctgtgttcccgcgcgcgcccgatgtcgtcgagcacgggcagcagttcggtcaggaggttcgcgatggcgatctccttgaccgcgacccggtcccgctcgacccggcgccggtagttctggtactcggcctgcagccgctggaggtccgcggtgcgctcgccgagcgccgtgcgcacctggtccagctgggccgtcagaccggccgactgagtggcgtccccggccggggccgccccctcctccttggcggaggaggcggccttcggctcggcgtcgtcggaggtggcgccggaggggacgtcgggctgctgctcgtcgaagcccggggtctcctccgtcacgcggcaccgtccttgcgctcgtcgtcgacgatctcggcgtccacgacgtcgtcctcggccttggcctgggaggcaccggcctcaccggcaccgccggcggcctgcgcgccctgggcgtcggcgtacatcgcctggccgagcttctgggagacggcggcgaccttctccgtggcggtgcggatctcggcggtgtcctcgcccttgagcttctccttcagctcggcgacggcctcctcgacctcggtcttgacctcgcccgggaccttgtcctcgttgtccttgaggaacttctccgtctggtagacgagctgctcgccctggttgcgggtctcggcggcctcgcggcggcggtggtcctcctccgcgtactgctcggcctcctggcgcatgcggtcgacctcgtccttcggcagcgaggagccgccggtgacggtcatcttctgctccttgcccgtgcccaggtccttggcggtcacgtgcatgatgccgttggcgtcgatgtcgaaggacacctcgatctgcgggacgccgcgcggcgccggcggcagaccggtcagctcgaacatgccgagcttcttgttgtacgccgcgatctcgcgctcgccctggtagacctggatctgcaccgacggctggttgtcctcggccgtggtgaagatctccgaacgcttggtcgggatcgtggtgttgcgctcgatcagcttggtcatgatgccgcccttggtctcgatgccgagggacagcggggtgacgtcgaggagcaggacgtccttgacctcgcccttgaggacaccggcctggagcgaggcgccgatggcgacgacctcgtccggattcacacccttgttggcctccttgccgccggtcagctccttgacgagctcggcgacggcgggcatacgggtggagccaccgacgaggacgacgtggtcgatctcgttgatggagatgccggcgtccttgatgacgttgtggaacggcgtcttgcagcgctccagcaggtccgcggtcagctgctggaactgggcgcgggtgagcttctcgtccaggtgcagcgggccctcggcggacgccgtgatgtagggcaggttgatcgaggtctcggtggacgaggacagctcgatcttcgccttctccgccgcctcacgcaggcgctggagggccatcttgtccttggacaggtccacgccgtggccggactggaactgcttgaccaggtagtcgacgacgcgctggtcccagtcgtcaccaccgaggtggttgtcgccgttggtggccttcacctcgacgacgccgtcgccgatctcgagcagcgagacgtcgaaggtgccgccaccgaggtcgaagacgaggatggtctggtcgtccttgtcgaggccgtacgccagggcggcggcggtcggctcgttgacgatgcgcaggacgttgaggcccgcgatctcaccggcctccttggtggcctgacgctcggcgtcgttgaagtacgccgggacggtgatgaccgcgtcggtcaccttctcgcccaggtacgcctcggcgtcccgcttcagcttctgcagcacgaaggcgctgatctgctgcgggttgaagtccttgccgtcgaggttgatcttccagtcggtgcccatgtggcgcttgaccgaccggatggtcctgtcgacgttggtgacggcctgacgcttggccacctcgccgaccagcacctcgccgttcttggcgaaggcgacgacggacggcgtggtcctggcgccctcggcgttggtgatgacggtgggctcgccgccctccagaacgctgacgacggagttagtcgtgcccaggtcgatgccgaccgcacgtgccatggtgagttcctccagctgacttgagtgcaacggactcaagtgtgcacgacggcggcgcccgggtcaacagacatgagtcgggagggctcaactcttatccatcccttacacgcaaggcctccgcaaggcttccctgacctgcggcgacgcggtctgctggggcggaggcagggggtaaccgaaggaggagccagggccactcccggggccgtacccctgcccgggccgttccctggaggagctgggagcgggtgtggcacgcggaccgccggcggaggacgccgaggcgcgaggcccacgcgctccgccgcccagggcccggagggctcccagggccgcgctcgcgcccttcgcgctcccgcgtgcgcgtccgctccggcgcgtacgaccgctccggccgcctccctcgcctcctccgcctgcttctgcccgcgtccggggggcgcagacaccggcggacgatttcggtgcggccgacgaggtccgggtgccggtgcccggcgagctccgggtgccggtgaaagaggacctggtgctggcggtgacgtaggccccggtacggctggtgtggccggtgtgacctgtccggccgacgtggcccgccgggcgccgcgggccgtacacccgtacgcgcagcagcccgaggacggccggcagcagcacgcccgccgtccacagcgcgctcaccggcgcgagccatcccgtgtgcaccaggacgccgacgaggaccgtgccgaaggtgacggtgccgagcaggaccgtcgcacccggcggggtcaggcccagcttgcgcagccggtgggcgaggtggtcggggccccggcgcaccaccggctgcgcaagctggg

SEQ ID NO: 1344 - DNA, 3563 bp, Unknown
  Kingdom: Bacteria, Phylum: Actinobacteria, Class: Actinobacteria, Order: Streptomycetales, Family: Streptomycetaceae, Genus: Streptomyces
  misc_feature (282)..(306): n is a, c, g, or t
gacagcgcgtcctccgggcggctagcggatcggccggtgcacgttctcccggccgctcgggcccggttccggttcggcgatccacgggccgtcgtccgaagggtcgacgatgccctgttcgagccactcgtagacgccgcccaggacgcccttgacgaccttgcagtccaggtcgtcggtgttgttccacaggcggtcgaagagttccccgacgcggatgcgggactggcggcagaaggcgtcggcgagctggtaggcctcgcggccgtggtcgccgcgggnnnnnnnnnnnnnnnnnnnnnnnnngcgcagcagttcggcgcgcacgcaggccgcgctcatcgcgaacagttcggcgccgatgtcgacgacacggccgaggaagccctgcttggtctccatccggccctgccagcgggacatggcgtagaaggtggagcgggcgagcttgcgggcgtggcgttcgacgaagcgcaggtgcccggagaggtcggcgtggccgcgtgggtggaactcggcgtacgagcgcgggagttggcccggtcccgcgaccagtttcggcagccacttggcgtagaagacgccggcgttcgcgcccgccctcgccttgtcctggagggacttgtcggggtcgatgaggtcgccggcgaccgagaggtgggcgtcgacggcctcgcgcgcgatcagcaggtgcatgatctcggtggagccctcgaagatgcggttgatgcgcaggtcgcgcagcatctgctcggcggggacggcgcgttcgccgcgtgcggcgagggaggcggccgtctcgaagccgcgtccgccgcggatctggacgagttcgtcggccatcttccaggccatctcggagccgtagagcttggcgagggcggcctcgatgcggatgtcgttgcggttctcgtcggccatctgggaggacagttcgagcacggcctccagagcgaaggtggtggccgcgatgaaggagatcttggcgccgaccgcctcgtgcagcgcgaccggcttgccccactgctcgcgcaccgcggaccactcgcgggcgatcttcaggcaccacttgcccgcgcccgcgcacatggcgggcagggagagccggccggtgttgagggtggtcagcgcgatcttgaggccctggccctcctcgccgatgcggtgggcggccgggacccggacccggtggaagcgggtgacgccgttctcgatgccgcgcagacccatgaacgcgttgcggtgctccaccgtgacgccctcggcggcggcctcgacgacgaaggcggtgatgccgccccggtgcccctcggacttcggcacccgcgccatgacgacgaggaggtcggcgaccacgccgttggtcgtccacagcttcacgccgtcgaggacgtagtcgtccccgtccggcacggccgaggtcgccaggcgggccgggtcggagccgacgtccggctcggtgagcaggaaggcggagatgtcggtgcgggcacagcgcggcaggaaggtgtccttctgctcctgggtgccgaagagtttgagcggctgcggtactccgatcgactgatgcgcggagagcagggcgccgatggcggggctggcggatccggccagggcgagcgccttgttgtagtacacctgggtgaggccgaggccgccgtacttggtgtcgatcttcatgccgagggcgccgagttccttgagcccggtgacgacgtcgtccgggatccgcgcgtcgcgttcgatccgggcggagtcgaccttcgtctcgcagaagtcgcgcagcttggccaggaactcctcgccgcgctgcacgtcgtcgtcggccgggagcgggtgcgggtggatgaggtcgagccggaagcggccgaggaacagttccttggcgaagctgggtttgcgccagtgctgctcccgggcgtcctccgccacctgccgggcctcgcgctcggtgacggtgggtttgctggtcgctggtgcggacatgaggctcacctcgccacgggaacgggccccgcgaatagggatcttgggtacgttcgttaccgaccggtgctactggttcgtatgtacccgataccgggcggtgtcgccacccctcgcgtacggaccgccgggagcacgggcggcccgtgcgagcgcggctccgccggcggggccccgggagggccggcagacagcgacggccggagcccccgcacagtgggctccggccgtcgccggtgatcgaccgtccggcctacagggccagaccggtcaggacgaggacgcgctcgtaggtgtagtcgtccatcgcgaaccgcacgccctcgcggccgacgccggactgcttgacgccgccgtagggcatctggtcggcgcggtaggacggcacgtcgccgacgaccacgccgccgacctccagggcgcggtgggcgcggaaggcggtctgcaggtcgtgggtgaacacgcctgcctgcaggccgtacttggagtcgttgaccgcggcgaacgcctcggcctcgccgttcaccttctgcacggtcaggaccgggccgaagacctcctcgcaggcgatcgtcacgtcggccggcacctcggcgaggacggtcggcgcgtaggaggcgccgtcgcgcttgccgccggtgagcacggtggcgccggcgtcggcggcctcctgcacccaggactcgacgcggcgggcggcgtcctcgctgaccagcgggccgacgtccgtcttcgggtcggacgggtcaccggtgacctgagcctcgacggcggcgacgatgcgcggcagcagccggtcgtacaccgaggcgtccgcgatcacgcgctgcacggagatgcaggactggccgccctggtagttggagaaggtggcgatgcgggtcgccgcccagtccaggtcctcgtcgctcgcccagtcgccgaggacgacggccgcgccgttgccgcccagctccagcgtgcagtgcttgcgcggcaccgagtccatgatcgcgtagccgaccttctcggagcccgtgaaggagatgaccggcagccgctcgtcctggaccagggcgggcatgcggtcgttggagaccggcaggaccgaccaggaaccggcgggcagctccgtctcggccagcagctcaccgaggatcaggccggacagcggggtcgccggggccggcttgaggatgatcgggacgccggcggcgatggccggggcgaccttgtgcgcgcacaggttcagcgggaagttgaacggcgcgatgccgaggacgacgcccttggggaagcggcgggtcagcgcgagccggccctggccgccgccgtcggtgtccaggcgctgggcctcgccgccgttgaaccggcgggcctcctccgcggcgaaccggaacaccgacaccgcgcggccgacctcaccgcgcgcccacttgaccggcttgccgttctcggcggagatcagctgggcgatctcctcggtgcgctcgaccagccgcttgccgacgtggtcgagggcggcggcgcgtacgtgggccggggtggcggcgaactcgtccagcacggcgtgcgcagcggccacggcctcctcgacc

SEQ ID NO: 1345 - DNA, 4591 bp, Unknown
  Kingdom: Bacteria, Phylum: Actinobacteria, Class: Actinobacteria, Order: Streptomycetales, Family: Streptomycetaceae, Genus: Streptomyces
atcaccctggccgccttcctggtcgtcgcctccgtggtggccggcttcctcgccctgacccgcccggactccaccacgccgaccgcgtccgacggcgtgaagcgcgccacgaagagcccggccgccgcgccttcggccacggccacggagcccccgtgggacggcaaggtcaaggtgctcggcgacggctccacctcgtacaccgggccgcagaagggcgagttgaagccggtgccgctcaaaccgggggagaaaccgccgcagttcgtggtgttctcctgggacggcgcgctggagggcagcgaccacctgttctcgcactaccgggagctggccaaggagtacaacgcccacatgaccttcttcctcacgggcatctacctgctgcccaagagcaagaagaccctctaccacccgccgatgcacaaccccggtgacgccgccatcgactacgccaccgacgagcacatccgcgacaccgtggagcagttgcgtatcgcctacgaccagggcaacgagatcggcacccacttcaacggccacttctgcggcaagaagggcggcggcgactggagcgtggaggagtggaagagcgagatcgaccagttctacgacttcgtggagaagtggaagaccaacaccggcttcaaggacatcgcgccgctgcccttcgacttcaggaaggaggtcaccggcggccgtgcgccctgcctggagggccagcccaacctgctcaaagccatcaaggactacggctggcgctacgacgcctcctcgccgggtgacttccagatctggcccgtcaagaagaacggcatctgggacttcccgctccagatgctcccgtacgagtccggcaagtaccagggcctgtccatggacttcaacttcctctacaaccagtccgccggcgagaccaagggcgacccggcgaagtacccgcagtgggagaagcagaccgtcgactcctacatggccggcttcaaccgcgcctactacggcagccgcgcaccgctgttcatcggcaaccacttcgaggactggaacggcggcatctacatgaagtccatcgaccaggtcatcaagaacgtctgcaccaagcagggcgtcaagtgcgtgtcgttcaaggaactcgccgactggatggacgtgcagaagccggagacgctgcaggccctgcgcggcctggacccggcgcagtcgcccgactggtcctcggtggtcaggtgagacgggcaggggcggcccggtgaggtggtcacgggccgtcgggtgaggtcgtcgagggcggccgggtgagggggccggtgggggtcaagtggcgccggtaaccccttggttgcacttgcgcacaccctcttcacaaccggcgcgcgtgtcatgcgaagatgcgaccgcccggtaggtgtaccggcgtagaggggaacatcattgaaatcaagaaaactgagccgtaagcggcgccgcgccaccatagtcaccgccgctgccgcctcggtggtggccggcgtggccctggtgcccaactggagcgcgggcgcggcggtcaccgacgacccgacggtggacgcggccaccaaggccaccttccagaagctcgcggacgcggtgttcaccgaccgcacccaggccctggtcgacggcaactcgggcgccgagcaggggaagaaggggcaccacgagcggctgtccgcgcgcttctccggcaaggtgcgcatgtccggcacgcagtcccaccacgaggactccgcgctgaccgaactgcgcggccgcaaggaccgcctggagaagctcggcgagaagtacagcgcgggcagcaccaccgtcacgctggacgccacccaggtcaagggccacgacgccaaggtctcggtcaccgagagcacgaccctgacctacgagaaggtccgcggcaacgagccgaagaacaccggcttccaggcgcaccacgaactgtcgttccacgccgacaagcacggcgactggcagctcaccggcatccgcgacaccgacgacggcgtggccgtgaaccagcccgccaccccgcaggccgcgaagcccgccacggccgccgacgacggcaacccgccggacgcgccccgctcgtccacggcgaagagcgcgccggccaacaagaagaacctcacttcgggcacgtacgactacaacgccatggcggcgtacgcgaagaagtactggagcaactacaacccggactacccgaacttcaacgggcagggggccggcggcgactgcaccaacttcgtcagccagtccctgaaggccggcggctggaagcacgtccccggttacacgaccgacttccacaagtggttcgggaacaacgagatccagtcggactcgttcatcggggtcaacgagttctcctggttcgccctgtcctcccagcgggtcaccagcctgccgtacgtctaccagatggacgtcggtgacgtgctgcagatggacttcaaccgggacgggtccaaggaccactccatgatcgtcacctaccgcagcccgcagggcgtgccgtacgtgtcgtaccactccaccaacacctacaacaggtcggtggcgagcctcatcgcgtcgtacccgaacgcgtactactacgcctaccgcacgtgaccggtgccggtgcgttaacggagcggggggcgggccaccgcgggccctgccctcagtgaccggctccccgctcctcgcggatctgcgccaccacccgggccgccgtccgccggaccgcgtcggtctccgtcaggaagtgccagtagtccggatggcggccctccaggccggcgagggcccgctccagccgggccacggcgtcgtccagcggacgcgcgtgccgcggatccggtgtcgtacggcccgtcatcgccagccgctgcgcgtcccggatcgcgaaccgggtcttctcgatctcgccctgcgggtccttctgcacggagttcagccgcgtcagccggtcacgggccgccgacaccgcctcgtcggtggtgttcagcagcgcccgcaccgtggagagcagcgcggtcgcgtccggccagcgctgcgcgtcccgggcggtctgcgcctccttcagcttcacctcggcctgccgcacgttctcgccggcctgctccggcacgtgttgcaggtcctgccagcaggcggccgtgaaccgccgccgcagctcgctgaggaccggctccacctgaccgctgcgcgtggtcagcgcctgcgcgcgggtgcgcagcgacaccagccggtggtcgatctcggcggcctgctccggcagccgcccggcctcggcacggatcgcctccgcctcccgcgacacccgctcggcccgctccagcgtcgcctgcacgccgtgctgccccgcaccctggttcagcttcgtcagctccggggcgagcgcggccagccggaccgcgaggtcgtccgccctgagcccggcggcgcgcaccgcgtccagtgcgttgctggcggccagcagcgcctgccgggcgcgctccacggcgggcgcgagccgggccagctgtgtctcggccttgccgagcagcggcccgagcccactgctgaaacggtccagctcgcgcttgacgttcagcagttcgtccttggcggcggtcaggtcggtacgcgcccgggcagcggcggaggcctccaggtcgtcgcggtccagatcggtcgcgtcgaccgcctggatgtagcgctgactggcctcgtcgatccgccggccgagggcctcgaagtcggcgaccgcgcggcgggcgggcggcgaggcgtcgacggccgtgatggtctccatcgagatccgcaggtcgcgctgggcggtgtccagttcgtagaacgcggaggccgccgcgtccttcgccgcctgcgcctcggcccgctggctctcggcccggccgccgaaccagcgccgggtgccgcccccggcgaaggcggcgggcagcgtgaacacggcgagcaggggcagggccacgagcgcgaggacgtcgccggcgggggagggacgggaaccggacccggagcggggctgcgcctgagcagccggagccggtgaagtggacggtgccgggggaacggctggtcctggcggtgcgggcggccctgccggagcggcaggagtcgccggagtaggcggtgtcgcccgtgccgccggtgtggccctcatccctctccccgtgccgtcgtccgccccgcgtggaatcagcgtggaatcattctcccacctgtgcaggacgaacacacgggccgatcagttcgccgtacgcaccgtgatacttccgtcgtcggtccgggcggacacggtatgcgggctggagccgtcgcggggcacggagacatgggtggagccgtcgccggtcttcgtcgtcacccggtacgtggcccggggcagcgtgacggtgagggaaccgtcggaggcgtgcgcgtcgaccaggtcgggtacggcgccgagttcgaggtgtaccgggccgtcgtcggtggcgacccgtacccggcgcgaggagacctccgcccgcacggagccgtcctcggtccgcagctccagcgggcccgtggagtcggtgacgtgcacgggcccgctggagctgcg

SEQ ID NO: 1346 - DNA, 1582 bp, Unknown
  Kingdom: Bacteria, Phylum: Actinobacteria, Class: Actinobacteria, Order: Streptomycetales, Family: Streptomycetaceae, Genus: Streptomyces
gcggacccccgcgcccgcggcggtgggaccggccctcggcgtggaggcgctggacgacgacggacccggcgcccgcatcgtcggcgtgcacgtaccgggccccgggtactcggccgggctggtccgcggtgacgtcctgctcgtgttcgacaggacccggatcgactcggcggcggacctcgcgcgcgcggtggccacggcccggcccggccacgaggtggtcctgaccgtgcggcaccgcggtggcggctaccagcagctgaacgtcacgccgggcgtcctcacctgacgacgcggaagtggctcgtcaggcgcccctcgtcgtccaggacgtggaaggccagcccgggcggggcgtcccggtccgccgggccctcgccctcccagggcagccgcagcgtccaggtgaccccggggccgacgacgagcgggcgcccggcgaacgtcgtggcggccggggtgtgggcgtgcccggtgatcagcccggcgactgcgggccgccgctccagcagggcggccagccggtgcggctcgcgcaggcggtagcggtcgggcagggggtggtgcagggtgaccggcgggtggtggaaggccagcagggccggtacgtcctcgccgaggtcgtcgagcgtctcctcgatccagcggtacgtctcctccgccagcgcgccctcgtcgctgcccgggatgctggagtcgcacatcagcaccgccgcgtcgtcgaacacctggacggagttgacgggctcgccggtcggtgcccggcccagcagcgccttgcggtaggcggcgcgggcgtcgtggttgccggggcaggtgaggaccgggaacggcgcgttgacgccggacagcccgccggacagccccagcagtccggcggcctcctcgtactcgctctccgcgccgtggtcggcgatgtccccggtcaccagcagcgcgtccacccgccccggcagctcccagagcgtgtcacgcacccgcgtggcgcgctgcgtcgcccgtgcggtgccgtccagatgcagatcactgatgtgcgcgatgacgagcacggcgtacccctcctgtagcccggctgatggtggtgcggctcatggtgatgcggtgatctcaccattacgactaatggttgggcaagtcgtgaccgttagcatggatccggcaaagcagtggtctcccgggcgcctcaccggcgaggatggtgccgtggcacggcgggccgcgccgaccggctcgcgcggcctccgccgcgcgggcaggatgctgcccgtggccactgctcgtcccacaccgccccttcagccgcaacggaggcccggatgaccggcaccgcgcccgcgcccttcaccgccgacgactaccgggcccggatggcacgcgccgcccggcgtcggccgctgctgggccgggcaccgaccggcgagcccgtcaactccgtccaggtgttcgacgacgcggcggtgctgatgtgcgactccagcatcccgggcagcgacgagggcgcgctggcggaggagacgtaccgctggatcgaggagacgctcgacgacctcggcgaggacgtaccggccctgctggccttcca

SEQ ID NO: 1347 - DNA, 2389 bp, Unknown
  Kingdom: Bacteria, Phylum: Actinobacteria, Class: Actinobacteria, Order: Streptomycetales, Family: Streptomycetaceae, Genus: Streptomyces
gctcaacaccatcgccacctcggcgaccaccacgtacatcggcagccacctcaccgacccgtcgcgcaaggcgcaggtgctgcgcgagggcatcgtccacggctacacgcaggccatctggtggggcgtggcggccatgctgctcgccgcggtggcctgcggcgtcctggtggtcgcgcgtccggccggccacggacgcggccgcgccccggcgggagcggccgcgcactgagtcccgtcccggcggacgcacacacggccgcgccccgctccggaaggtacttcttccggggcggggcgcagccgtatccggttacgtccggggcggggcgcagccgtgtgggacgggcatgccggacgtcagatgacgccctgggcgagcatggcgtcggcgacccgctcgaacccggagatgttcgcgccggtcacgtagtcgccgggggcgccgtaacgctcggcggtctcgtggcaggtggtgtggatgtcgctcatgatccccgccagttcctcctcgacccgggccggcgcccacgtcgtacgggcgtggttctgcgccatctccagggcgctgaccgcgacgccgcccgcgttggcggccttgccgggtccgaaggcgaccccggcgcgctggaacaggtgcacggcctcgggcgtggccggcatgttcgcgccctcggagacggccttcacgccgttgcggatgagcgcggcggcgtcgttctcgtccagctcgttctgggtggcggacggcagtgcgacgtcggccggcacctcccagatgcggccgccgggcacgaaccgcgcggaggtcccgcggcgctcggcgtactcgctgatccgcccgcgctcgacctccttgatctgcttgagcaggtccaggtcgatgcccttgtcgtcgacgacgtacccgctggagtcggagcaggtcagcgggttggcgccgagggcgagcagcttctcgatggtgtagatggcgacgttcccggagccggagacgacggccgcctgtccctccaggtcctcgccgcgctcgcggagcatggcctcggcgaacagcacgttgccgtaaccggtggcctcgggccggatcgccgacccgccccaggtcgggcccttgccggtgagcacaccggcctcccagcggttggtgatgcgccggtactggccgaagaggtagccgatctcacggccgccgacgccgatgtcaccggccggcacgtcggtgtgctcaccgatgtgccggtacagctccgtcatgaacgactggcagaagcgcatgacctccgcgtcgctgcggccgtgcgggtcgaagtcgctgccgcccttgccgccgccgatgccgagaccggtcagcgcgttcttgaagatctgctcgaagccgaggaacttgatgatgccgaggttgacggaggggtggaagcgcagaccgcccttgtacgggccgagcgcgctgttgaactccacccggaagccgcggttgacgtgcacccggccctggtcgtcctgccacggcacccggaagatcacctgccgctccggctcgcacagccgctcgatcagcccgggctcggcgtactccggccgcgccgccagcaccggcgccagtgtctccagcacctcgtgcacggcctggtggaactccggctgggcggggttgcgccgctcgatctcgacgcgcagggcgtcgagctgggtctgggtctgctctcgggtcgtcactgaatccctttctggcacggctacagccggtacgagaccggtgaggggcgctcggcgccgttgccgcgcgcaggggcgggccgccccgaggagcacttctcgcctaccgagcggtcctccgggaaacggccgacccttcagtcttactcctgcacgcaggtactgaccagtgaccggacgctggaattccacgtagtgagatctgttttccgaatccgcacacgggaggggcgggtcacgcgaccccgacgacgcctccggagccgtcggagagggaaggcgttgccctggcgtacccagatccggggcggtccgggccggtgcggccgtgtgcgccgccggtgcttccagtggtccggaccaaccccttgccccttcgccgtgtgcgcagcaagctcccttcatggagctggagttgcggcatctcaagacggtccgggcgatagccgaggcgggaagtctcaccagggctgcaacggccctggggctcgcgcagcccgcgctgagcgcccagctcaggcgcatcgaacgggccctgggcggggagctgttcgagcgcggacggcacggcgtgcgcgcgaccgcgctgggcgagctggtgctggaacgcgcgcggatcgtgctgcccgccgtgaccgaactccagcaggaagccgtccggttcgcccgg

SEQ ID NO: 1348 - DNA, 571 bp, Unknown
  Kingdom: Bacteria, Phylum: Actinobacteria, Class: Actinobacteria, Order: Streptomycetales, Family: Streptomycetaceae, Genus: Streptomyces
gcacgggtgcggccgccgccgcgcgcaccggccggccgcacccgtgcgacgcggccttcgcactgcgcgtgacggagatcctcgcggacgccgagacgctgctggagagaaccaccgacggcggctgaggaggactccggggtgcgggacccggggcggcgtagcagcgtggtggtgtggtgaagccgccttccccggtgtcgcgccgggacccgcaccggcggggctggctgcgcggtgccccgccgccccgctgggtgcgggccctgccgatcgcgctggccgtcgccgtctgcgtggcgaccctggtgagcccgaacccgctcgacatcggcttcctgctcggcgccatcccgccgctcgccgtgctgtcgtacggaccgttgacgaccgcgctgctcggtggcgtggtggtggccctgctgagcgttccggcgttccggctggaccatcccggcaacaccgacctggagacggtctgcttcgtcgccgcgctgagcgtcctgctgtcgtacgtgcgcagccgccgcgacgcacagctcgacctgcaccgcacggtagagacccgcgc

SEQ ID NO: 1349 - DNA, 4146 bp, Unknown
  Kingdom: Bacteria, Phylum: Actinobacteria, Class: Actinobacteria, Order: Streptomycetales, Family: Streptomycetaceae, Genus: Streptomyces
cggcgggggaggcctgcggcggaccgcccggggtccgctgtaccggggcggccccgtcgacctcgccgaactcatcgccgcctggcaccgcgagggcgccgtcgacggcttccacctcgtgccgtccgacccgcgccgtgacctggagcggctggtcaacggcaccgtgacgctgctccagcatcgcggcctgttccgcaccttctatccgggcagcaccctgcgcgagcacctgggcctggcccggcccgtcgagcgccgtaccggccggcccgtcgaccgcccggccggccggtccggtgcgcggcgggccggcgcggaaggagcggcgtgaccgtaccgccgcgggccgcctctgcgcgggcagggcggctgtgtcccccgcggggccatccggtcgtcgtccgggcgggggattcggaccggaacccggaccggaacccgggccggcaccggcgtcaggacaccgccgccggcttggttctcccgtactcgctccagggcgccacgctgcgtccgtacctcggtttggccgcacggccgcacatggaagggttgatcacatgacggacgcatccgaccggtggaagcagtggcacgaggaccgcaccgcgacggtgtcggcaccctacgggccgctcgcgctgaccggcacgcactggctggaggaccacccggagggtcggctgccgggcgttcccggaagctgggcggccgacggcgacgcggtcgtgctcaccgccgccgaggcggacggactgaccgtcgacggccggcccttcgccggacgggtgcggctcggcgccgacaccgcggcggcggacgcgcgggtcgcgctgggcgaacgccggctggtcgtgctcgtgcgtgaaggagcctggggcgtacgggacttcgacccggcgtccgcggcccgccgcgcgttccgcggcatcgcggccaccgcgtacgacccgcgctggtcggtaccggggcgcttcaccccgtacgagcggagccgcaccgtgcgcgtgccgaacgcggacggacgcgagcgcggcctcgctctcgccggggagctggcgttcacgctccaggggcgggacctgacgctccaggtcgccgagcagccggacggcggtctgtgggcggtgttcgccgacaccaccggcggggacagcggtttccgcttccgtttcctgcatcccggggccccggacgccgagggccgcaccacggtcgacttcaaccgtgcggtgctgccgccgtgcgcgttcgccgaccacttcatctgcccgttcccgccgccgggcaacacgctggacctcgcgataccggcgggggagcgcaccctgctctgagccgcggcgcacacggctgacgcacgctcgtacgtcgccggtacacagctggcccaccgtcaaaccaccgggcccgcacagcggtcactcgaaccgcacacagtcgcacggccgaaaggcactcttgcgccgaccggccgttcggccgaatactcccccacagcgcttgtcaggggcacaacgtgtccggaacccggatgtccggtgcccggatctccgcccctggctctgcgcctcacgggccccgaccccacgcgggcccccgacttcctttgtggaggaacgacaagtgaggatcaagcgcacttccccccgcaccgtcatcacgagacagacccggctggtggctctcgccgccgggctcgtggccaccgccgcgttcgcggtccccagcgcgcacgcggccgacaccaacaccttcagcgccgcccagctcaccaaggcgagcgactcggtgctcaaggccgatgtcccgggcaccgcctgggccgtcgacagcaagaccaaccgtgtcgtcgtcaccgtcgacagcacggtctcgcaggccgacatcaacaggatcaaacagcaggccgggaccgactccggggccctgaccatcaagcacaccccgggcaagttcaacaagctgatctccggcggcgacgccatctacgcgagcagctggcgctgctcgctgggcttcaacgtccaggactccagcggcaactactacttcctgaccgccggtcactgcaccgacggcgcgggcacctggtggtcgaactcctcgcacaccaccacgctcggcaccaccgccggctcctccttccccggcaacgactacggcatcgtgcgctacaccaacagctcggtgaccaagtcgggtgccgtgggcagccaggacatcacgagcgccgccacgccctccgtgggcacgaccgtgtaccgccgcggctccacgaccggcacgcacagcggccgcgtcaccgccctcaacgcgacggtcaactacggtggcggagacgtcgtctacggtctgatccagaccaccgtctgcgccgagcccggcgactccggcggcccgctgtacggcggcagcacggcctacggcctgacctccggcggcagcggcgactgcacctccggcggcacgacgttcttccagccggtcaccgaggccctgagcgcgtacggggtccacgtctactgacccggcccctccgccggcgcggtcccggtccgaccgcgtccggcggtggacgagcccccgcacacaactggtgtgcgggggctcgcccttgtgcgcggccggggctaccgccgaaggacaccctgatgcgcccgcgtcggattgcgggggccgtgatggtcgaggaactggtggcggcgggagcggcgctcgcgggcgccggagccgtgtacgtggcggcggcggcccgggtcgtcaagaactcccctctcgtcctgcccttcccggtggaactgctgcgcttcccggagaaggcgcagcagcaactgccgctgcccggaccggccggggggtcgaaatcaggacaggagtagacctcacagagtgccgacaggttactcgctcgtagtgtttgctgagcgaacggtggcggcgcgacctcggacgcgcaagccgcacggggcgcacgccggttgacgtacccgcgtccagaactcgaccttgtgtgctccctgggggcctcggaatagtaggcgccgttccgcccaccgccttccggcccgcagaggtccccacaaccttttgggccgaccccccacaggaggacgtcagttgaagcaccgacgcatatcccggcgccggacgaccgtggcggtcgcgggcgtcgccgcgctcgtcgccgcgggagtcactttccagagtgcgaacgccgacgagcccgccaaggctcctacgacccgcaccctctccgccccggcggccggaaaactcgcctcgaccctgctcaaggacctcggcgccggcagcacggcgggcgcgtactacgacgccgggtcgggccacctcgtggtcaacgtgctcgaccaggtcaccgcgcgcacggtcgagcgggcgggggcgagggcgagagtcgtcgagaacaccctcgccgaactggacggcgcccggacggaactcgcgaaggacgcgaccatacccgggacctcgtgggcgaccgacccggtcaccgacaaggtcgtggtcaccgccgacagaacggtctcgaaggacgcgtggaccaagctctccgaggtcgtcggcagcctgggcggcaaggttgaactcaagcgctccacaggggagttcaaacccttcgccgcgggcggtgacgccatcaccggctcgggcgggcgctgctcgctcggcttcaacgtggtcaaggacgggcagccgtacttcctcaccgcgggccactgcaccgccgccatctccacctggtcggacgccgacggcaccgtgatcggcagcaacgagcgctccagctttcccggcgacgacttcggcctggtgaagtacacggcctccgtcgaccacccgagcgcggtcgacctctacgacggctccacgcagacgatcaccagggcgggcgaggcgaccgtcggcgagaaggtgacccgcagcggctcgacgacccacgtgcacaccggcacggtcaccggtctcaacgccaccgtgaactactccgagggcagggtcggcggcctcatccagaccgatgtgtgcgccgagcccggcgacagcggcggctcgctgttcgacggcgacaccgcgctcggtctgacctccggcggcagcggcgactgcacctccggcggc

SEQ ID NO: 1350 - DNA, 1824 bp, Unknown
  Kingdom: Bacteria, Phylum: Actinobacteria, Class: Actinobacteria, Order: Streptomycetales, Family: Streptomycetaceae, Genus: Streptomyces
tacgacgtggtggtggccggctccggcgccgccggcctggccgccgccctcaccgcacggctgcgcggactgaccgccctggtggtggagaagaccggccactacggcggcaccaccgctctgtcaggcggcgcgatctgggtgccgaacaacttccacctggacgccgccggcctcggcgacacccccgagaaggcccgcgcctacctcgacgccaccgtgggcgaccgcgtccccggcgaacgcaaggacgcctacctcgcccacgggccgcgcatggtccgggagttccacgaccgcaccgccgtacggttcgtctacacacccggctacagcgactactaccccgagcggctcggcggctacccgcagggccgctccgtcgaaccgcggatcttcgacctcaacaagctcccgcccgaacagcgcgcgaccatgcgccgtgccgggctgcccaccttcgggctcaccatcacctccaaggacttccggcacctgaacatggtcgcccgcacctgggccggcaagcggacctccctcaaggtcggcgcccgcgcggtcggagccctcgccaccggccgcaaactgctcgcgctcggtgaggcgctgatcggcaggatgcggtactcgctcgaccggctcggcggcgaactgtggctgaacaccccgctgaccggcctggtggaggacggcggccggatcaccggcgtccgcgtcctgcgcgacggccgcgaggtcaccgtacgggccaggggcggcgtggtcctcgcctccggcggcttctcgcaccagcagcaactgcgcgagaagtaccttccctcgccgacctcggccgagtggagctccgccccggaggggcagaccggtgacggcctggaactgggcatcgccgccggcgccgccgtcgacctcatggacaaggtgtggggtgcgccgtccgtggtgccgcccggcggcaggccgttcttcctggtcgccgaccgcggcatccccggcatggtgatcgtgaacgcggcgggcgagcgttacgccaacgaggcggcgccgtaccacgagttcgtcgacgccatgtacgcgggcgaccggcccggcgcgtccaccgtgccgtcctggctgatcctcgacgccgccgccaaggcccgctacctcttcctcggcctcttccccggccagcccttccccaaggcatggcgggagagcggcttcgtcaaacaggccgccaccgtggaggaactggccgggctgatcggcgcgccccccgagcggctgcgcgccaccgtggaccgattcaacggcttcgcccgtgccggccgggacgaggacttccaccgcggcgacagcggctacgaccgctactacggcgaccccaccctgcccaaccccagcctcgccccgctggagaagggcccgttccacgccgttcccgtccaccccggcgacatcggcaccaagggcggcctggtcaccgacgccaccgcgcgcgtgctgcgggagaacggcacggtgatcgagggcctgtacgcctgcggcaacgtctccgccgccgtcatgggcgagacctaccccggccccggcgcgaccatcggccccgccatgacgttcggctggctcgcggcggaccacatcgcacactcctgacacccggagccggtggtggcgtggcagtacgtcgtaccgccaagccaccaccggccaggtcatgcgcccgggagccccagcgccgcccgcaggtcgtacgccgcctcggtgagcgcccggtccgcctccggcaacagcccgcccaggccgaggaagccgtggaacgtgccgggccacacccgcacc

SEQ ID NO: 1351 - DNA, 5279 bp, Unknown
  Kingdom: Bacteria, Phylum: Actinobacteria, Class: Actinobacteria, Order: Streptomycetales, Family: Streptomycetaceae, Genus: Streptomyces
ccgcgacgagccaggcggccgagccgcgcgcgacggcgaaggccccgtccgccgccaagtccgcggcgtccggcgcgaagaccaccgggaccagcaggttcgcggcaggctccggtgaggactgcacccccaccgcgccgggctccaaggagcgccgcgctggcgccgtcgagtcctgtgtgacggtcgcccccgcccctgtgcgggcgaagacccgcaccggtgtcgccgcgcccgccgcgaccctggccgccgccggcagttgcgacctcaccagccccggcaactacagctacgagcgcttctcgtactgcgtgaccggcatcaacgtcacctacatcctgcgcgacagcaacgctcgggagatcggacgcggcaccctggcggtctccaccagcgccgacctctccccgaccgcgacgacctggaacgagcaggtcaccgtcaccatgaccagcgcccaaggcgacgtcgccgcgctgaacgccaagttccgcgcctcctgcgacgccggctgcacggccaccaagaccgcgccctggtacggcggcggcctcaccctcggccagaccctgaccggtaccgtcacgtactcctcgccgcagacggcgggctcctccgcctccttctacacggcgtacgcgatgtacgtgacgtccccgggcgcgacggcgaccgacccgaacgcgtcgtggaagaacgcgcgtcagatccggtgcgacgacgcggtcggcggcacttcggtggcgggctgtgcggtcccctccgtcatggccgtcgtgccgctgaaggcgacgagctcggacgcgggcggcgccgtggccgcctacggctgggcccagaagaacctcgacggcgcctggggcaagaagggcagcccgctgacccggtcgacgagcggcgtggccggccgcaccgccaccacctgcacgggcttcacggcccagacggagctcgtcgacagcgacacctgcgccgacttccccttcggggaggcgaaggagggcggtgccgccggcgcgcagtgcgtcgaggtgatccccaatctcggcaacggcgaatgggacacctacgtcctgaacgacgcccatgtcctggaccgcacctcaccctgcgtgcaggcccatgtcacgcccgacgagaagcagttcgccgacacccagcttgccgacggtttcaaggatcagcgggtgatcgacgccgaccagttcgagctgacgttctcgttgccggacaccggcccgcaggccagctgcctgaacgacccgccgccgatcaactcgattccaaacggcgacggctggttcatgaacaccaccgagccggttccgctcgtcaacaagagcgacccgacgagcgggcccggacagcggccgacccaggcgcaggcgtgcctggggcggaacacccgcaaggggaccggaaccagcgatcccatcaccggcatgaaggacgcggaggagttcaagaaggcgaacggtgtcacctatcagctggtccggtgccatctcatcgcgaacatcctcggcggacagggcacgagtgcgctcactcgccccaacctcgtcccctgctggcagtccgggatgaacacgggcacgcccagcatgcggacgttcgagaccaaggcgcaggacctcatcaagggccccgtcgccgcgttcggagcgaacgacgcggtcctgtaccaggtgacgcctgtctacaaggacgcgaacagcaccatcccgacgggtgtcactatgagcgcgacgatccagcgggcgaacgggtcgaccgaggaactgttccccaacgtctacgtcaccaacacctatcagaacaccgggacgctcaacctcggtaactgatcacgtccatctcgcgccaacgggagcctgcatgagtctcaccaccccaccgcggccgttcgacgtcaccgcgctcttccctcaactggccccgttggcgcgcacggcgacccggctgcacccgcggccgggggcgccgaccgcgcgcgacagctccgccggcgggccgctcctgtggcccgccgacgagccctggccgtactgccacgagccgcacgaccggcacgcagcgccggtggtccactccccggacgacgtccggatcctgcgccgcgatctcaccgcggcgaccgagcggctgcgcctcgaccccgaggcacccgaggtcaccgccgaggagcgggagaactgggagcggatcaaagtgggccgcccgtggttcgacggcccgatccccctgctccctgtcgcccagctctacgcccgcgacgtccccttcccgcgcccgtccgacgcggacctcctccaggtcctgtggtgccccttcgaccacgaggagcacgccggccccaagaccgcactcttctggcgctcgtccgccgccgtcaccgacgtactcgacgcacggcccgagccgcccatcgtccaacgggactgctacctcccggagccgtgcctgttctcaccggagcaggtcaccgaatacccgcaccccagggagctggacaaggaactccgggaccagttggacgacttcggccgctgggagtcgatcgaccccgcgctgtacagcggttacgcgtacgacccgggtgagctctacctgaacaacctctgcaccgcccccggctggaagaccggcggctggacccgctgggacccgaccgatcccgtcgaccgtccctgcgccgagtgcggcaccgagcaggtcccgctcctcaccatcgcctcgtccgaatgggacggcggcagcgggacctggatcgccgaggaggagccggcgaacccggccccgcctcccctcggcgcccaggacggcaacttcaccttgatcgacatcgtcggcggctacaacctccagctccacgcctgcccggccgacccgtcccacccgcacatcgagctgatccagtgaccggcaccggcactcgggggcccggggaccggccgtacgcccctccccgtgccggggcgggaccggccctgagcagcttcggagtaccttgatcgtgtcacccgcagccgagtacacatcggcggtacccggcagcaaggccgcagcggggcggcagcagggccggcgagcggtgatcgccggtccgatgaccgacaaggagatgacccaccatgtcagcgaccgtgctgcgctcggctgattaccaccggatgccctggaagaacggctccggcagtacggcggaagtggccgccgggcccgccggctcggcgctgtcggacttcgagtggcgggtgagcatcgccgacgtcggcgccgaagggccgttctcctcgttccccggtgtcgaccgggtcatcatgctgatcgacggatccagcatggcgctcaccgtcgacggcacggaacaccggctcgctcctctcgcgccgttcgcgttctccggcgagagcacggtgacgtgccggctgcccgacgggcccacccgggacttcaacgtgatgacccggcacggccgcgcgacggcagccgtgaccgtgaccgagatcccggagcacctccacagcacggctgaatccggcgagacactcctcgtggtggtactcgccggccaactgaccctgagcgtggacgagtcggctccggtgacgctcggacgactggacaccgtacggcaggacggccctggtgccgtccggatcgcgggacatgggaccgtcgccgagatccgcatccgcccgagcaggtagtaccggcggtcaggcagtactggcgttgttcctcgtgcgaaggcgggcgcccggtggtccgctgtcgcggtccgccgggcgcctgtggtgtgcgggtggtgcgggtgtcagtccttgatctcgcagatgggggcgccggaggtgagggaggcgccgacggtggcggtcagtcccttgatggtgccgctcttgtgggcgttgaggggctgttccatcttcatggcttccaggacgacgacgaggtcgccttccttggcctcctgcccgtcctcgacggcgatcttgacgatggtgccctgcatcggggaggcgagggtgtcaccggaggcgacggggccggacttcttcgcggcgcggcgcttgggcttggcgccggcggccaggccggtgcgggccaggctcatgcccaggctggagggcagggagacttccaggcgtttgccgccgacctcgacgacgacggtctcccggccgccctcctcgtccgcctcggtgtcggcgggtgcggtgaagggcttgatgtcgttggtgaactcggtctcgatccagcgggtgtggacggtgaagggttcggcggagccggtcagctcgggggcgaaggccgggtcggtgacgaccttgcggtggaaggggatcgcggtggccatgccctcgatgtggaactcttccagggcgcgggaggcgcgctggagggcttcggcgcgggtgcggccggtgacgatgagtttggcgagcagggagtcccatgcggggccgatgacgctgccggcttccacgccggcgtccaggcggacgccggggccggtgggggcgtcgaagcgggtgacggtgccgggggcgggcaggaagttccggccggggtcctcgccgttgatgcggaactcgaaggagtggccgcgcagggcggggtcgtcgtagccgaggggctcgccgtcggcgatgcggaacatctcgcgcaccaggtcgatgccggcgacttcctcggtgacggggtgttcgacctggaggcgggtgttgacctcgaggaaggagatggtgccgtcctggccgacgaggaactcacaggtgccggcgccttcgtagccggcctccttcaggatggccttggaggcccggtacagctcggcggtctgggcctcgttcaggaacggggccggggcctcctccaccagtttctggtggcggcgctgcagggagcagtcgcgggtggagacgacgacgacgttgccgtgtttgtcggccaggcactgggtctcgacgtggcgggggcggtcgaggtagcgctcgacgaagcactcgccgcggccgaaggcggccaccgcctcgcggacggcggagtcgtacagctcggggacttcctccagggtgcgggcgaccttgaggccgcgtccgccgccgccgaaggccgccttgatcgcgatgggcaggccgtgctcctcggcgaaggccacgacctcgtcggcgccggagaccgggtccgaggtgccggcgaccaggggagcgccggcgcgctgggcgatgtgccgggcggcgaccttgtcacccaggtcgcggatggcgtgc

SEQ ID NO: 1352 - DNA, 3703 bp, Unknown
  Kingdom: Bacteria, Phylum: Actinobacteria, Class: Actinobacteria, Order: Streptomycetales, Family: Streptomycetaceae, Genus: Streptomyces
cgcggcggccgccgcgagggaccgcaggaccaccggtgccgtgaacacccagggacccacggcgcagacgagggagacgccggcgatcgccgagggaggcaacagcctgtgcaggggaggggaatggcggtgacgtccacgtggcatggccagaaacttaccgcgcgtaggcgaatcgtggtgggccgccccgcaaaaaggcggccataccgaaaccttcacaccgcatcaggagttccgctcctctcctcacgcccctaggcacccgagttccacccgcgtaccgcgcgagttcggccgaactccggacccatttcaagatcatttcctgaagctcccgactggttcccggagatcggccccgctcgttcccggagaccggcccgcccgctgtcagcgctcggccagtcgcatgctgatccactgcaggctcgccgggatctcgcgcttccaggtgttgaagttgtggccgccgctgtccaggatgatcgacgagatgcgggtcttcttcgtcgccttgaccgcgtctatgaacttcagcgtcgacttgtagtcggactcgccgtgcctgctgctggtgacgagcagggaagtgtccggagccggcaggtgcttgacgctccagccgaggtcggcgcgattcttcagattcttgtcgccctggaagagatcgcccgtcgtggggtcgatcggtgccttgtagtaaggcgacagacccacaccggcgccgtacaccgcgggatagtgcatggcgattttcagcgcgcagtaaccgcccgtggaatccccgatgacaccccagccgcccggcttccggtcgacccggtagtgggcggccacggcgtccggcagatcgcggccgaagaaccgctcggtctgcgggccgcccgggatgtccacgcactcggtgtcgcgcggcggcgccaccgtcggccgcagcatcaccaggatcatcggctgcatccggctctccttggccaactgctgagccgtacgcgggtaattcagcttgctgatgagcgcctgagcggtgcccgggtaaccggtgaggacgacggacgcggggaacgtacgcgtgcggtactgcggctggaagtactccggcggcaggtagatgaaggcgggcgaggcgatgtgggacgtgcggcccacgacgtcgaccttctgtatctgccccgtcagctgcggccgggatccgccggccagctgcacctgctgcgtgccgaccacccgcagcgggccggtcgaaccgctcgccgcgtgatcgacgacgacgccctgatcggtctcctgaccgaacaggtcggcccagctcgcgtagaagccgaacgcctggttggcggcgagaccgacgcaggcgaagatcgccgcctgcgtggccagcaggatgccgacccggccgctgaccgacggccagctgcgccgcgccaggcgcggccagagccacaccgtggcaacaaacagcagtacggcgaacagcaccgccagtaccagcaccttcttgctcgtgagccccatgagcctttcctgcctgcactcgatgcccggcccgccggcacctccttggcgcgagcttgccccgggctttccctggcctttgacccggattccgggtggggagtgaaccttcctcccccagacaccgtcctagagggcgcaatgtcgccggatgcccggatcggcaccggattcaaggtctctcgcagaactatgggatgcgatgtctgtcaggatagatggggaaaagccgggcggggttccgagccgatcgagccgggtccggcgcatactgcgcggtccgcgccccgaggccgtccccacgctgatcggcagggcctgcgccgtcgtgggcctcctggacatcgcggcaggcgtcttcccgcgcttccggcacagccggatgcacgcctgggccgaggtactgccgggctccttcggcccgttcgccgcggccctctcgctcagcgcgggcgtactcctgctgctcctggcgcacggtctgcgccggcgcaagcgccgtgcctggcgcgccgccgtggtactgctgccggccggcgcggcggcggagttcctctaccggcactccgtggtcggcgtcgtcatcgccctggcgctgctcaccccgctgctgctgcaccgcaaggagttctccgcgctgccggacccgcgcagcaggtggcgggcactgaccaacttcgtgctgatgagtgccggttcgctggcgctgggcatgctcatcgtcagcgtccacgcgcaccgcatggtcggcgacccgagcgtcgcggaccggctcacccacgtcgtgtacggcctcatcggcttcgaaggcccgatcgactaccagggcaacacctcctggaccgtcgccttctccctgggcgccctcggctggatcaccgcggtcaccacgatctacctggccttccgccccgagcacccggccgcccgcctgaccgaggaggacgaggtccagctgcgcgcgctgctggccaagcacggccgccgcgactccctcggacacttcgcgctccgccgcgacaaggcggtcgtgttctccccgagcggcaaggccgcggtgacctaccgcgtcgtctccggtgtgatgctcgccagcggcgacccgatcggtgacgtcgaggcctggccgggcgccatcgaacgcttcatggacgaggccagggcccactcctggacgcccgccgtcatgggctgctccgagaccggcggcgaggtgtggacccgcgagaccggcctggacgcgctggaactgggcgacgaggcggtggtcgacgtagcggatttctccctcgccggacgcgcgatgcgaaacgtccgccaaatggtcaagcgcatcgaacgggccggctacgaaacccgggtacggcgtatccgtgacctcggtgacgccgaactggagcgcgtgcggcacgcggccgaggactggcgcggcaccgacaccgaacgcggcttctccatggcgctgggccgcatcggcgacccggccgacggcgactgcctgatagccaccgcgcacaaacaggacgaggagcccggcgagtacggcgacctcaaggcgatcctgcacttcgtgccgtggggcgaggacggcgtctccctggacctgatgcgacgcgaccgctccgccgaccccggcatgaacgaactgctgatcgtggcggcgctccaggccgccccgaagttcggcatcagccgcgtctcgctcaacttcgcgatgttccgctcggcgctggcccgcggcgagaagatcggcgcgggcccggtgctgcgcgcctggcgcgggctgctggtgttcctctcgcggtggttccagatcgagtcgctgtacaagttcaacgccaagttccagccccgctgggagccgcggttcgtcgtctaccgcgcctcctccgacctggcccgcatcggcttcgccgccatgcaggccgagggcttcgtcaacctggccctgcccatgccgcgcttcctgcgccgccgccgcgccgccgcccagcggccgtgcccgcacggggtggcggaacgagacgtccgcgcggcctgacgtccgcgtggtcgtccacagggtctgacggccgcattgcatgaaaccgatacggcctgaaaccgatacggcccggcaccgacacggcctggcaccgacacggcctggcgtcgacgcggcccgtcccccgagcgggccgcgtcg

SEQ ID NO: 1353 - DNA, 674 bp, Unknown
  Kingdom: Bacteria, Phylum: Actinobacteria, Class: Actinobacteria, Order: Streptomycetales, Family: Streptomycetaceae, Genus: Streptomyces
ctcccgcacgcgggcgagacggcggcggccaccgaggagatcctcggcctggacgccgaggccgacgccccgcgccgctccctgcggagccggctcggcccgctcaccccgatcgccgtgcggaccgcgctcggctgcgcgctcgccgggtacgcctccctcgccctgggtatcggccgcccctactgggccctggtcaccgccgccgccctctaccaggcgaacgtgacgctgacctggagccgtggcatccagcgcgtcgtgggcaacctcgtcggcgtcctcgtcttcgccgcggtcacgccgctggcgcacaccagcggcgtggccctcgtcctgacgtgcgtcgccctcaacttcggcgccgaggcgctgatggggcgcaactactggctcggcagcatctgcgtgactcccatggcactgctcgtcaccgagttcgcagggcagcatccggcgggcgagctgatgaccgagcgggccgtggacaccgtcgtcggcgcgctggtcggcttcgtggccgccgtggccgtcaccaaccggcgggcgggggaccgtatcgggcacgcgctgaccgctgtcgaccgcgcccgcgagcgggccgcgcgcctgctcgccgaaccgcgtcccgagcccgccgcgctggagtccgcccgccggggcctggccgcggc

SEQ ID NO: 1354 - DNA, 1230 bp, Unknown
  Kingdom: Bacteria, Phylum: Actinobacteria, Class: Actinobacteria, Order: Streptomycetales, Family: Streptomycetaceae, Genus: Streptomyces
gccccgcgccacgtccaacagtgcggacagggcggcctcgccgccggggtcggcgccgccgacgccgcgggcgtccacgacgtgatcgggccgcaccccgtcgacgccgctctccccggccggtgcggtgaccacggtgtgaccggccgcctcaaggagcggcaccaggctcttggcaagccccgcctcgtcgggcaggaccagccaggtctcaggccggggctgcgccgtcgcgggccgcggagcgcgtcgccacaccggcacactcgtccagcgcgcggggtcgagtcggccctgcgcgccgctgttccggggccggggcagcaggtggtcctcgccctcgaagggatagccgggcagggacaccctgcggccggcggacgcgccgcgccacgctttccagtcgacgggcacgccacgagtccacagctcggcgacaccctcccggaacgtcctcgtctcgtctgcgggcacgcccccgcggcgccgcatcagggcgaccgcctcgaccggacggccggcgacgcggtgcgccgcggccagcgaggtcagcgcggcgcccggaccggcctccaccagcacgccgcggtccaggaccgtagtcagtccttccgagaaccgcaccggccgacgggcgtgccggacccagtactcggggtcggtggcctgctcgtccgtgatccaggtaccggtgacgttcgagacgaacgggatgtgcggggccgcgagcgcgaccgagcgcagcacctcgccgaactccggcagcgcgggctcgacgagcgccgtgtggaaggcgtgcgaggtggcgaggagcctggggcgcagcccttcggcggtgagcaggcgcgcggcccgctcgatcttctccggggccccggccaccacgcaggacagggggctgttgtcggcggccaccacgccgtcgtcgccgagcagcggcgcgacggtgtcggcgggggcgtcgacggtgagcatccggccgggcggcgccgcgtggatgaggcgggcccgtgcggccaccacggtgatcgcgtcgtcgagggtgaacacaccggccaggcacgcggccaccagctcgccgaggctgtgtccgagcagggcggcgggccggatgcccgcggccgtcagggtgcgcgccagcgcgtagtcgagactgaacatcaccggctgcgtgtggacggtctgccgcagccgttcggcggccgcgccgtcgtcctcgtcgtcggcggc

SEQ ID NO: 1355 - DNA, 1580 bp, Unknown
  Kingdom: Bacteria, Phylum: Actinobacteria, Class: Actinobacteria, Order: Streptomycetales, Family: Streptomycetaceae, Genus: Streptomyces
catcgtcatccacgacaccgagggccgctgggacggcgtcctcaacctcgtccaggacccgacctacgtgtcctggaactacaccctgcgctccaccgacggccacatcgcccagcatgtgaagggcaaggacgtggcctggcacgccgggaactggtacgtcaacgccacgtcggtcggtctggagcacgaaggcttcctcgccgagccggacgcctggtacacggaggcgatgtaccgttcctcggcgcgcctggtgaagtacctggccgcgaagtacgacatcccgctggaccggcagcacatcctcggtcacgacacggtgccgggcccgaccgccgggaccgtcccgggcatgcacacggaccccggcccgtactgggactggcggcactacttcgagctgctcggccgcccgttcgaaccgaccgcgggcaagaacggcggactggtgacgatccgccccgactacgcggccaaccaggtggagtacacgggctgcaccacgggcgaccagccgtgcgcggcgcacggctccaacgaggtgcggctgtacacgcagcccgacacgtcctcgccgctggtcaaggacatcggcctcaggccggggggcggtgactccacgatcgacgtgaacgacgtggcgtcacgggcggagaccgggcagcagtacgcgctcgccggccggcagggcgactggacggcgatctggtacctgggccagaaggcctggttcctgaacccggcgaagcagcccaccgcggtgaacgcggccggcctggtggtgacgccgaaggccggggcggacagtgtgccggtgtacgggcgggcgtaccccgagaaggaggcctatccggccggggtgccggtgcagtcggtgacgccgctgccgtacaagctgctcgcggggcagaagtacgtcgtcgggggcgtcgtgccgggcgagtacttctactcggtcacgttcaccacggactcgcaccgggtggtggtcggcaaggatctgtactacgagatccagtacggccaccgggtggcgttcgtacgggccgcggacgtgcgggtgcagccgtccggcctgtagggacctcagtacgcacctgtggtgacctcggtacgcggacgggagggccggtccaggtggccggcccttccggctgctcgtgcgcgcccgggtcagccctgctggaacagctcggcggggagcggcttgaggagggcgtacaggtcgtcggtgatcgggcggtcccaggcggcgatggtgacgaggacgccgtcgctgcggtcgaactgcacgcaggagatccggctctcggagagcttgagacggcgcacgatcaggaggttgtcgccctgcagcacgggcatgtcctcggtgccgacgacggtgacctcctcgtcgttctccagggcgagcagcagctgggccacctcgaaggggacctcgccgtcggcgacctcccgggccggggagccctcggggaggttgccgatgatcatggcggtgccgcgcccgacggcacctgccagggtgtgttcctgcgctacgacctcttcggcgggcgcggcaccgccatgat

SEQ ID NO: 1356 - DNA, 848 bp, Unknown
  Kingdom: Bacteria, Phylum: Actinobacteria, Class: Actinobacteria, Order: Streptomycetales, Family: Streptomycetaceae, Genus: Streptomyces
ccgctcaggtcgacggagccgctgtcgcggccgcccgtctcgtgcgggcccggctggtggacggcctcgacgaccggctccggggcgggtggcggcacttcgttgccccaggcgccctgagagcccggcagcagcaggtcttcgtcctcggcgggagactcggagaggtaggtgtacgcgccgtgcgcggggacgcccggctgttccaccatgcctgcgctctccggcagcccctcgcccgggatctggccggtgtcggtcatgcgtacccctcgcccatcggttagtgctcctacgaccagctcaccgggaacggcgcaccgaccgcccccagtgaagaacgagcgtccgcgcccagcggcacgagcgacccgcccaaaaaaggcgacaaagccattgagtggcattctcgcggtcgttcgcgcgccgcgacagcgtcatccgccacggtccgctgtggactgcgccacgtcgcgcgtcctccggttccgccgtaccacacccaccgcaaaacgggcgggttttccggacattgacgaaggaagctccggaaccccccagtgcggtacaacgatcggccagcctaccgcgcgcggtacgacaacccgatcacggggcgcggtccgcgaggccccgccggacgaccgcccgcgggctttcagcgcgtcgcttcgctccgcggcatttccccgctgagcaggaacgcgacgctccgctccgactccgtccaggccctggtgtcgagttcgacggactggagcagggcgcactcgacgcggtagccgtgctcggtgaggccgcggccgacgcgttcggcggcgtcgcgggtcgcggcatgggcgacgatg

SEQ ID NO: 1357 - DNA, 2161 bp, Unknown
  Kingdom: Bacteria, Phylum: Actinobacteria, Class: Actinobacteria, Order: Streptomycetales, Family: Streptomycetaceae, Genus: Streptomyces
gtgggcacgaggtctccggcctcgacgacgtgcgcgccgaggtcgagggccagttcgtaggagccgaaggtgtgctcgggccggtatccgctggctccgcggtggccgatgaccgtcggcacgggcaggcttcccaggccgccgccgtggtggccggccgccgcggcacgcccggcctcgccccggccggcctcctgcggcgcggtcccgccctcggcggctccggccgtgccgggcgctccgaggaccgcgcctgtggcgccgagcaccgcggcaccgagcagcgcccggcgtccggtccggcccgtgcgcccgtcggactcgcgcgcctgctcctgccgctccggctcctgcgtccccatgaccgcctcctggtctcgtgtcggtctcgcgtcgatctcgcgtcgtaggtgcgcgccgatcgtaggggggcgggggtgacgtccgggagacctcgggcggaacagaggggtgacggtccgtaacctgcgtcacaccgttgcgcgctgttcatcggggcgccacgggccttccgcgcaggtaaacgtacgtcaacagtacgtaagaggtggtgagcccgatgtgcattccgggccgcgccgcgagtatcgtcctcacctgcacagacttcatagagaatcccttgactccggagggcccgttgtcccgcttcgcgctcatcaaggcagtgctcggtccgatcatgcgcctgatgttccgcccacaggtggagggcgcggagcgcattcccggtgacggtccggtcatcctggccggcaaccacctgacgttcatcgactcgatgatccttccgctggtctgcgaccgtcaggtcttcttcatcggcaaggacgagtacgtcaccggcaagggcttcaagggccgtctgatggcctggttcttcaccggtgtcggcatgatcccggtcgaccgcgacggcggccggggcggggtcgcggcgctgatgacggggcgccggatcctggaggagaacaagatcttcggcatctaccccgagggcacccgctcccccgacggccggctctaccgcgggcgcaccggtatcgcccggctgacgctcatgaccggcgcgccggtcgttccgttcgccatgatcggcacggacaagctccagccgggcggggcggggctgccccggccgggcaaggtcaccgtgcggttcggtgagccgatggagttctcgcgctacgagggcatggaccgggaccggtatgtgctgcgggcggtgacggactcggtgatgaccgaggtcatgcgcttgtccgggcaggagtacgtggacatgtacgccacgaaggcgaaggtggcgtaagcctccggcggttgggccggtcggcgccgcggggggtgaagggttttcgccccccgcggcgccgttgtggttgagcgcgcagttccccgcgccccttgtggggcgcggtcctcaccggggtttcagagtttctggttcttcagcaggacccatgctgctgccgctgccgccaggaggactgccgcgcctgcgcccgaggccaggtggaggccgtggacgaaggcttctcgggctgcggagagcagggcgtcggccgtgggggccgggaggcctgccgccgcttccaccgcgccgcccagtgactcgtgggcctgcggcggtgtgccgctcgggccggtgaagcctcggtaggcgccggtcacgatggagccgagcagggcgatgcccagggccgcgccgagttcgtacgccgtctccgagaccgcggaggcggcgcccgcctggtccttgggcacgctggagaggatcacgtcggcggtcaccgtgaacgagagaccggcgccgacgccgaccaccagcagggccgtgccgagcagcgggtagccggtggcaccgctgagcatcgtcagcgccgccagggccaggccgaccgcggcgagtccgccggagacccccgtccgcaccgagaagcgccgggccgagcggccggccaccagaccggccgccacggcgcccacggcggccggcagctcggccaggcccgcctcgaacggccgcctgccctggaccagttgcaggtactgggacaggaagaacaccagcccggacatgccgaggacggtcagcaggtcggcgaggaccgcgccgctgaagccgcggctgcggaag

SEQ ID NO: 1358 - DNA, 6582 bp, Unknown
  Kingdom: Bacteria, Phylum: Actinobacteria, Class: Actinobacteria, Order: Streptomycetales, Family: Streptomycetaceae, Genus: Streptomyces
agcagcgcggagcagcgcggatcagcgcggtagcgaacccgctcaattcccggtacgggaagccacgttgacagggaaaacgcaacttcgacaaggcccgcaggggcagctaccttcacctggtcctcggcgaccgcccacggtcgcacgagttctttcaggctgggccaccggcgcccccgaccagggagagacgcatgccccatctcgcgctgtacacgttcggcgtcctgaagtcaccactcgccgatcccgcacctctcacgcgcgcattccacgacagcgccgaggccgtctaccgggaggtcggcgagcaccccggatacctcgctcgcgctgaagcggcagccggcggccagggctcgcacttcgacttggactggggtgcgtggggcgagttcgccgtaccggcctggtacggcaagggccgcaccgtggaaaccatcgccctggccgcgaccctctccctctggaccgatctgcgccccgccttcgacgccctctacaccggcctgcaccgtgcggcgctgaacaggcggcacgactggttcgagaggacaggacacccggctcacgcgttctggtgggtctccgagggcgtgatccccacctggcaggacggggtctcccggctggaagacctccacgaccacggccccacgccgcacgccttcaccttcccccactcgttcgccccggacggaactccgaccaggatcaaggcgccggggcatgcggagtgcccctcgtcccctaggggccactgagggggtaaccccccgatcgcgtatgccagttggccggatgggacgggagccaccggtccgcgaggctcgtcgcatgaccacacagcgcacgcccggctccgcccgcacccgtacccgccgcagctccgccctcatcggcgtctccgccgtgctcctcacagtcaccgcacccgtgacggcggcagccgccgctcccccgcaccgaggggacaccctcacctggacggcatgcgagggcaccggcctcgacccacggcagcggtgcgcgaccctggacgtgcccatggactacgcggacccgcacagcccgcgtatctcggtcgccgtctcacgcatcccgagcgagaagccgcccgcgcggcgcgggacgctgctgctgatcccgggcggccccggcggttccagcctcgacgacccgtcggggaaagggcagaagctgccggaggaggtgcgcgaggagtacgacctcgtcgggttcgcgccgcgcggcctcgcgccctccacggcggtgtcctgcggcctcgaccacgccgacctggccacgtccaggctgcgcccgtggccggccgccgacggctcgatcacggggaatctggccaccgcgcgccgtatgtcgcaggcgtgcgggaagaacggcgggcagctgatccggcacctcagcacggtgaacgaggcgcgtgacatcgaccgcctccgggcggcgctcggcgaggacaagctgtccgcgtggggcgtgtcgtacgggacgtacgtcggagccgtctaccaccagctcttcccgcggcgcgtcgaccgcatggtgctggacagcaacgacgacccggacccgacccgggtcaaccgcgcctggctggccgggcacgagcagggcgtcgaggacaccttccccgacttcgcggcctgggcctccaagcccggcaacccggaccgcgtcgccgagcgggccgccggcgtacggccgctgttcctgcgcctcgccacccgcctggaccgcaccccgatcccctggcccggcgccaaccctgaggaactcaacggcaacgtcctgcgccagaccatgctggacagcctcggctcaccgcccgactacccggtcctggccaggctgatgctggccgcgcagcggggcaccgtaccgcccgcgccgaaggctccgccggaggaggtgctccagaacgtcgcgggcgtgggcgccggcaccctctgcaacgacgtcgcctggccgcgcccggcggcggcgtacgagaaggacgtcgccgacagccgcgccgcgcacccgctcaccgcgggcatgccgcgcaacgcgatgctgtgcgccgcctggccctacccgccgcgccaggcccccgtacggatcaccgaccgcggcccgtccgacgtgctgctcgtgcagaacgagcgcgacgcgatcactccgctcagcggtgccctgaagctgcgcgcggcgctcggccggcgcgcggtcatggtcaccgtgaactccacgggtcacggctcctacctggccaacggcaacccctgcggcgaccgcaccgtctcccgcttcctggccacgggcgtacggccggaggcggacgtgtactgccgctgagcggctcggccctgaggtgtccgtgtctccctgtccgcgcgcccctgtgcatcggacagccgctctgtaggatcctcctccatccggacgacccgccaggctgaacggaaccgatggacatggacgcatggtctacccgggcggcccggccggccgatctgccgcggatacgggcgctgctggccgagacctgttccgcggcggagcaggctgcggcggccttcctcggcgaggcgatcgggagcggcctggtgcgggtcgccgagtcctcgggagagctggtgggctgcgtcgcggtggagatgccctctccgggacacgcgcgcgtgtcggtcgtagcggtcaaggccgggatgcgccgccaggggatggcctcacggctgctcaccgacatggtgcggtcgcttccgcggagtccgcagcgatcgagcgaacctccgctcgtctccgcgatagcgagcaccgcgcagccggtggtgacacgcctcttactggcgaacggtttcataggcacccggatcatgcgcaccggcggccagggcgatacggccggcgccctggccatccactaccagcacaagatgcgcgtcgaatacatcgacccggacgcgcggcacctggtcccggcaagcgaccgggagcaactggtggaatccctcgctcccggcgaccacgccgtgaccgcgctggtcacgctgtccggtgcaccggcgttcgagatcgcccgtttcgagcgggacgatccggcgacgctccagtccggcgaggccgcggcggggatcgcgttctccggttccatcctcgccgccgtgaccttcctcctcggcttcgccttcgcctcgacgcggttccccgacgacgtccggctgctgctcatcggcgcgacgttcagcaccgtgctctccctggtggtgtacgcgagcgcctccggagaactggccaggatccgctcgaactccttcggcaggatcatgaaatggggcaacgtactgtccgagtacggcggtgtgctgcccttcgtgatctcgctgcccgtcacctacgcccaggtcagcagtgatccgtggtcgatcatggtgctggcggtcgtgctcagcgccgcgctcgcctggtacgagcactccgagttctccatcgcgacccgcttccgccacagccgggtcgaactctgcctgcggctgctcaccgccgtctcgccggccgtcggtgcggcgctggtggcgaccaagaccaccagctggccgtggaccgcagccctggcggtcgtactggcgacccgcacctggctgtacctgttccgcaggggctccgagagcgggatcacggagcgccggcagtggcagatcagggaatgagtccgccgctcgcgccgacccgttcggccacctcgcgggcgcagccccaggacagggtcacaccggcgccgccatgaccgtagttgtgcacgagcagcgtgcccggccggggcttctccgcctccagccggacctcgctgcgcacgggccgcagcccgaccctgtggccgagcacgcggacgccttccagggcgggttcgacctcggcgcagcgccgcacgatctcccgggccgcggcctcgtcggcgcgcaggtcccactccccggcgaccgcggttccgccgagcaccagcgtgtcggagtgcgggtagatgtaggtgagttcgtccgcgccgggcgtgtcgtcgcagaagaacgagcggatcccggggttctccgtcaccaccagctggccgcgcaccgcgccgacggccgggtccgccgccagtgaacgggccccgatgcccgagcagttgacgaccacgggcgcctggtccagggcctcgtcgagtgtggtgtagcggtggtgcctgagctgcccgccggccttctccagccgagcggtgaggtagctgaggtaccggggcatgtcgacgaccggggcacggtagcgccagccggtcacgtagccggggcgcagctcgtccggcgcgcagacccgcgctcggaccacggcgccccagtccggcatcgggcacggtacccgcgactcgtgcgtgccctccaccagccggatcccggtgtccgggtcggcgctcagcgtgcacagcaccgccagggtccgtctgctccacccgtccaccagacgggcgggctcgacgaggtacgggtcccacatcgcgcccgccgccgccgaggtcgtctcctgcgggaggcggtcggcgtcgacgcgtacgtccatccctgactccgccaggcacaccgccgtggtcagtcccacgaccccggcaccgatcaccaccacgccggcctgcaaaccgcacacctccgaagctccccgccggctcccgccgttccgggccggtcctctccggccgctacccgtggcggccctgtccgaacccccgtacgtaccgcgcctgccaaggcgtctccaccgcgtgccggtcgtagtgctgccgtacgtaggcgaccgcttcctcgggcgggacgccgtccagaacggccaggcaggacagggccgtgcccgtgcggccgtggccgcccgcgcaggcgaactccacccggtcggtggccgtgcgccgcagggcccgcgcgaactgttcgcgggccgcctcgcggtccgccggcaggcggaagtcgggccagcgcagccagtgcgactcccaggggaactccggtggcggcttgcccaggaggtagacgccgtacgtcggggcgggcaccgccgggtcgagcgggcggctgaggcccctgccccgcaccagccggccggacgggaggcggaggacgcccggggcgtcttcgtcccagccgggttcggactgctcacgcgtgggcccggactgctcactcatgggcgtggcgctcccttcctgcgtgtcccggtgcggcgcggcgactatacaaggcaggtgtcgtcgcccatcgccgttcccgggagtccgtatgaccttccccgcgccgctgaccggtgtcgtcccgcccgtgtgcacgccgctgaccccggagcgcgaggtggacacggtttcgctgctgcggctggtggaccatctggtggcgggcggggtgcacgggctgttcgtgctcggttcgacctccgaggcggcgtttctgacggaccggcagcgccgtcaggtggtggaggccgtcgtcgcgcacgtgggcggggcgctgccggtgctggccggggccatcgacatgagcaccgcccgggtcctcgaccacgtggccgcggtcgcggcggcgggcgcgcaggccgtggtcgtcaccgcgcccttctacgcccgcgccgcccatccggcggagatcgcccgccactaccgcaccgtcgccgccgcgagcccggttccggtgctcgcctacgacatcccggtgtcggtgcacaccagactgcccgccgcgctggtcctggagctggcggccgagggggtgctggccgggctgaaggactccagcggtgagctgggcggcttccgggaggtggtgaccggggtgcggggaggggccggcgcggccgggttcagtgtgctcaccgggtccgagcaactggtcgacgcggcgctcgcgctggcgcagtgggagcaggtgcgcgaggtgtaccggtccctcgggcacgccgtggaggtgctggtcccggagccggggctgccggacatggtgttcacggcggacggcgccctggtggtggacgggcgggtgttcggcgcccggttcgcccacgcgcgccgggagccggaggcggaggcccacctgcggtggttcgccgggaacggcttcgcgcacctgcacgtgcccgtgcacatcaacgagggcgagggcgacttcgccgtcaccgcctcctggctgctggccgggcgggggttccggaccaacccgctcgcgcacggcgaggcgcaggagttcctcggccgtccggtgatcggcctggaactggtcgacccccgcttctaccacctcgggctcgccctcgccgtgctcgacgacgcggcggacgaggtggcgtactacccgcccgccttctcccccggcagccgcgaggtgctgcgccggctgttccccgacgccctggtcgcgagcgcggaggacgccgccgccttcggtctgaacgccgtctccgacgggctgcacgtggtgctgccgcaggccgctgccggactgagcgaggcgctgcgcgagcgcggcttcactccggtcggcgtggacgtgagcgagctgcgcaagggcggcg

SEQ ID NO: 1359 - DNA, 547 bp, Unknown
  Kingdom: Bacteria, Phylum: Actinobacteria, Class: Actinobacteria, Order: Streptomycetales, Family: Streptomycetaceae, Genus: Streptomyces
cgctcgactcacccagcgacagggccagttgacgtactccgtcgtcggggtcgacccgtcgcacgcggtgcccggacgccgcctccggggccctgccgccgtgcacggcaccggtggtgacctcgtcgagcagggagagcgcggtgctcgtccgtccggtgcccggagcggcgccgagcaccagcagccggcgggccctgagcgcgttgcgcagttgtacgtacccgtcgggttctacgtggatgcggcggagtctgcgcagttcctcgtcgggcacgggaccgctgcgcattcccgctccggaacggcggctgtcgagcagcaggttgacgtcgccgatgtgggcggtgcggaagtagttgcggtcgaagctggtgtggtcgcggccgacgtcgaacagcccgcgggtggcgcggcgggtgcgtgcggcggcggcgaggtcggtggggccgtcctcgctctcctcctcggccagggggtcgcgggtgtgctccttgaaccgcccgacggcccgctcccgctcccgttccttttcgcgctccttctc

SEQ ID NO: 1360 - DNA, 3075 bp, Unknown
  Kingdom: Bacteria, Phylum: Actinobacteria, Class: Actinobacteria, Order: Streptomycetales, Family: Streptomycetaceae, Genus: Streptomyces
gtaggtgtactgggcgccggcatcgccacctacgcctcggccggcgcccagtacacctacggcaccctgttcttcatggtgctggtcacctgcgccctggtgatggtccaggagatggccgtgcgcctgggcgcccacaccggcaagggcctgggcgccctgatccgcgagcagttcagcctgcgcctgaccgcgctcgccgtcttctgcctgctgctggccaacaccggcctggtcgtcagcgagttcgccggcatcggcgccgccttcgaactcctcggcgtgcccaagtgggcggtgatcccgccggccgcggtactgctctgggcgctggtgctgttcggctcctaccactgggccgagcggatcttcctgatcatgtcgctcgcgttcttcgcgtacccggtcgccatgatcctcggccatccggactggggcgcggtcggccaccacctggtcgtgccgcacatcgagccgaacaaggacttcatcctgctcgccgtcgccctcatcggcaccaccgtcagcccgtacatgcagttctacgcggcgtcgggcgtcgtggaccgcggggcgcggcccgccgactaccggctcatccgcgccgacgcggtcctgggcgccgtgttcgcctgcgtcatcagcctgacgatcatcatcgccaccgcgtccgcgatcggcggcagcggaccgctgcagtcggccgcccaggccgcgcgggccctcgaaccggtcgcgggcaaacaggccgaactgctcttcgcgctcggcctgctcggcgcctccgccctggccggagcggtcgtcccgctctccgcctcctacgccgtcggagaggccgtcggcgtggaacgctccgtctcccgcagcttccgcgacgccccgctgttcctcggcctgttcaccgcccagatcgtcctgggcgccgcggtcgccctcactccggtcgacgtcatccagctgctcatcggaacccaggtcctccaaggcctgatcagccccgtgatcctggtctacctgctggtcctcaccaaccggcgctcgctgctgggcgacgccgtcaacggcccgcggtaccgcgtcgcggccaccgtcgtggtcgtcggcgtcgccgggatgtccaccgtcctgctggcccagaccgtgctgagctggttcggcctggcctgaccgggcgcccggcgggggctagtcacccgatatgggccgcaccgtgaggatctgctgcgcgtggccgaccgggccgtgcacatcgtgcagcaccgtgctggtgatcccctgtccggtcggaccgaagacgacggtggtgtccaggccggtccagcggccctccgggtggcggtgcaggtgcagggtcaggtcgacgttgggaaagagccacgccttgggcgactcgcgtacggcgatgccgttggccgtgtcgacgagtgcgacgtaggaggccagcgggctgcagggctcgccggccaccaggtcgagcggggtggagatccaggcggtggtgcggccgggccggggcgtgccgaccgggcggacgtcgagggaggccacgtagccgccgggccactggtcggccatccgccacggcgcgagccgctccggcggagtgagccggtcggccccgcctccggcgacggcggccgtgtcctgcgcggacagcagccaggcacgggcccgcaccaccggacgcccggcgacgctcacgaccgcctccagcagctcgatggtgcggcccgggcggaccgtctccacctggatctcgcactcgtccagggcgagccggcccaggatgtcgtagctgatccgcgacagcagcagcccgctcggcggacgggtggcgaggtgctggtcgatcgcgtgcacgacgagcccgccgagcggactgaagtgcagctcggtctcgtcccacgccccgctcgcacgggcggtgggcttgaaacggtgggtgtcggtgcggacgtagtaactgtcgctggccgcggtgccggtgttcaacgtgcgcctttcctcggtgcttgcgcgggcccgcatgccgcggacgagttccgcccgggccgccggattcccgcaggacctcgggcaggatgacacgaacggcggaaccagggctccggcaggggcaccagctcccacccgcggcccgccctcagcacgagcccgggcacccgcgcgacgtcacgcggaccccggcggcaggctcacccagcggcgttcctccgcggagcgggtcatcgcgtccagggccgtcgcggcggccaccgcgtcggtgagggaggcgccgtgcgcggtgccttccgtgagggagcgcaggaagtggtgggcctcgatgaccttgaggtcgtcgtagcccatggcgttgcccgcgccgggctggaacgcgccgtacgcgccgtggtccgggccgacgtggacggtggcgacgggctggtcctggtagcccgtaccgcggcagacgcccagttcgcccatgcggcggaagtcccagaagagggcgcccgtggtgccgtggatctcgaagccgtagctgttctgctcgcccaccgaaacccggcacgcctccaggacaccgcgtgcaccggaggcgaagcgcagcaggcagctgacgtagtcgtcgttctccacggcgccgggtgccccgcccgccgcccgggtgtgaccggcggtcgcccccgccggacgggccctctcgcgcaggaacacggcggtgtcggcggccagcgagtcgatctcgccgagcaggtgacgggccaggtccacgccgtgggaggcgaggtcgccgagtactccgctgcccccgcgtgcgcgctcgtagcgccaggtcagcgccgactccgggtgggcggcgtagtcgctgaagaacctgatgcggacgtgcgtgacccggccgatctccccggcggcgatcatgtcgcgggcggcggccacggccggtgcgttgcggtagttgaagccgacggtgccccacacaccggccgccgccgcggcgtcggcgacggcacgcgcgtcctcggcaccgaggccgaccggcttctcgatccacaggtgtttgccggccgcggccatggccacaccgat

SEQ ID NO: 1361 - DNA, 3005 bp, Unknown
  Kingdom: Bacteria, Phylum: Actinobacteria, Class: Actinobacteria, Order: Streptomycetales, Family: Streptomycetaceae, Genus: Streptomyces
gtgtgcggctgcccgagcgggttccgccgtgggacgtggcgctgctgggcgcggccacgttcaaggcgtcccggctgctcaccaaggacaaggtcaccagcttcctgcgggcccccttcacgcgtcgcacggaggagatcccggccggtgaggtcatggacgaaccgcgcggcagcggtgtccggcgtgcggtcggagacctggtgtcctgcccgttctgcacctcggtctgggtgtccggcagcctggtcggcggctacgcctgggcgccccgggccgtgcgtctggtgtgcgcggggctcggcgccgtcacggtggcggactggctgcagtacgcgtggagcctcacggaacagaaggccgagggctgagcgggtcctgcccggccacggcgaggagcagccgtcatacgggagctgaccgaggacatcgaaggcgtccgcgaagaacgccggacccacccgcatgcgggccatccccacgtgacgtgttcgctcccgttctcacaggacgaccgagtcggaagggatcgcccggcacggacacgaaaggtgtcagcccggtcccggaccgggcggacagatcttcccgggaaggtgctgccatggccggaccgatcagctaccgcaggatctacgaggacgcctcgccgcaggacggcaagcgggtgctcgtcgaccgtctgtggccccgtggggtgagcaaggaggaagcgcagctggacgagtggctgcgggacgtggcgccctccacggacctgcgacgctggtaccaccacgaccccgagcgctttgccgagttccgccgccgctacatcgccgagctgggtgaccccgatcacgaggaggcggtgcagcggctgcacgacctggccgcccacggcaaggtcacgctgctcaccgccacgaaggacgtggaccacagcgaggccgccgtactctcccactggctgaacgacaccgggaaacaccgcacctgatcactccgtgcgccctcccggcggcgcggggacgcggttgccgtggaaaccttccgtcgccacggctgccatgggtgcggcgggcggtgcgtcgaggtagccggcgctcggcacggagatgagtgtttctcggggaccaggccggctcacacgggggtgtggccctggaggtacgcgcgcacggcctcgggcagcccggcaccggcggtctccgtcatcggggcccagcggatctgctcgggcgtgagactcgcccccgacgacgggtcctcgctgagcaactggcacaccacggcctccccggccgccgcccgctgttccaggggcgtggagccgtcggggtgcagtgtcgtggagccgtcgacgagatagccggtcagctcgtagacgaggcgcgcggcggtggcctcggcggactccgccggttccgaggcgcccgacggcagtccccagccgtccccctgccgtaccagcagcaggcgtccgtcgtagacgaccaccgcctgcaccacgcttccggcagcctgctccggtgccatcgcccagccccccttgttctcgcgcggcccgtccggcagggcaccgtccgctgtccgcgcctgtcccctaccctgcgccgggcgctccgaaaagcgtcccggcggccggtcagaggtctgccgggaactcctgcggggcgatcggcgggacacccgtcgctctgcacgacggggacgacctcgccaccccgccagacgacgggtgttcccacgacgccggagaacccgaagttcccgaccgcctgcgaggcccaggtcatggaggtgaccaacgcggcatgttccacagttcctgcgagccaggttgccgtgctctgtaacgctcccgggcccgttcgaaatctccctgggtcggctctgcggttccgaagatctcgatggattcttcgtccgacagcgggcgaacggtgtgatcatcgtcgtatgcctcggtctcgatcacttcccaaacgtcgatgatcgtgtgtgttccttcactgccgaaggtctcgtcttcccatagatcgtcgaggtcatccacagaggtgaaggactggcctgcgggctggagcccgtcccaataggttccgcggacgaagagtctctcgaactcacgctgccgcacggtggctaagaccgtgtcctacatggtcagtttgaggagtcgcttgtagcagcagagggcggctgcgagtccgaggaaggccaggtagctgcgaggatcgcgttcgtagcggtggttgagacgtcggtagccggtcagccaggacatcgtgcgttcaatgacccaccgtcggcggcccagccgctcgctggactcgatgcccttgcgtgggatgcggatgccgatgtgtttgccccatagccatcgccgcaggtgagggacgtcgtacgccttgtccgcgtgaaggcgtcggggcttggaatcgttcgcatgggattcgtgtcccatgtggaaatgggacagcatcggcttcagggcgaggctgtcgtgggtgttggctgcggagactccgacgcgtagaggcagtccgttcgcatccgacaggacgtgcatcctggaaccgggcctaccccggtccacggggctcggacctgcaagttcgccccttttttagcccggacatgcgccgagtcgagcaccgctcgcgatagatcgatcaggtcctggccgtccaggaggtggagcaccttctggtgcagccgtccccacacgccagcccgggaccagatgaggaaccggcgatgcacggtcgacttcgacgccccgaagcacggcggcagggcccgccaggcgcagccactgaccagcacgtagatgatcgcggcgaacaccgcctcgtcatcgatgttcgcgaccccaccgccctgcggacgcacccgcgccggcggcagcagcgacctcccacaagccatccggaacaatccatccccaccgtccactccccacgtccagcacaactgctaacagaccatgtaggacacggtcttagtactgcaacggtgat

SEQ ID NO: 1362 - DNA, 4101 bp, Unknown
  Kingdom: Bacteria, Phylum: Actinobacteria, Class: Actinobacteria, Order: Streptomycetales, Family: Streptomycetaceae, Genus: Streptomyces
gtcgccgtccgccgccgcgcagaaggcgacgcatggctgggacggctgtggcgctggacggcgtacgcggtctgggccggggtcgtcctgctgcttctggcgcaggcgctcaccgcgatcggggccggctggagcaccgcccgcaccgcgggcctgctggcggcggtggtcgtggccgtggcgctgacggccgcctcgtggttccaccgggggcgcggcggcgcgctggccccagtcatcggcgaggacaacagactgtccacctcccgttctgtcgctgcgctgtgggtgctgttcgtggcgtacgcggtgctggtactggtgggtcggctggctgccgcctccgaccacgcggaacgcgatgccctgatctcgggcctaggactggcccggggcgccggtgtggtcaccgtgctcgccgtggtgtgcgggatcgccgtcctcgtacggcgggtggtcggcctgcgggtcctggggcagcggctgcagaaggtgcgggcggaccggccacgggcggccgacctgctgaccgacgacgcgggacgcggcaccttcgcggacatccagtacgtcctgatcaacgccgtcgccctggtcttcgccgcggtgcggctggcccggcggcccgatcagctgcccgacctgccctgggggctcgcggtgctgacgctggtgtccgccgccacctacctggcgggcaagtacgcggagggcgggcgcccggtgatcctctcggtggtccgggcccgcgaggccggcgacctggacgcaccgatccgcaccggcgacgacatcgagatccgcggcgccggcttcgtcccaccgggtgcgcagggcgccgaccggctgtcgcggatggtggtccgcatcggcgcggtcaacgtccacgtgcccctggtgcccgtcacgggaggcttcagcaacccgacggacgcggtgctgaccgtgccggtcccggcggacgtggagccgggccgcgtcgaggtgcaactggtgaccgcggccggcgcggagaccaaccggtacgcgatcgacgtgacggagtgatcgatgtacggggtgatcgatgtacggggtggtcgatgtgacggggtgaggcaggccgacggggcacgcgcgacagggcgcccacgacgaggcggacaggaccgggcggacaccgacgggtgaggtgccagggccaaccggacgccgaatccatacggacgtcgcaaaaagcccggccggggtgagcggctcctttctcgcacacgtatggtctgtcgaggggtgaacggcagtgcggtgagaggcgagaggcggctggtagcgatgactcacggccttcgtacggacacgcagacctcgtatctcgaccggcggggcacctggcgggagaccgccgcccgctacgccctccttcctcttcgcgtcttcctcggtgtcaccttcatctacgcgggcctggacaaactcaccgacagcgccttcatgcgggccgccggtcccgggtcgctgggcgacacgatgcgcgcggtccgcgactcctccgccatcccggccctcgtcgacctggcgctgaagaacccggtcggcttcggctacgccatcgccctcggtgaactcgctgtcggtatcggtgtcctgctcggtctcctgggccgcctggccgcgctcggcggcgcgctcatctccctcagcctgtggctcacggtcagctgggccaccaccccctactactacggcaacgatctcgcctacctcatggcctggatccctctcgtcctcgccggcacccctctgttctccctggacgccctcctgtcgggacgacggcgccgaggcctcgggaactaccgctagcgggcctcgtccaagtccgggccgcggggcgctctgcggcggcgtacggaccggttgaccaccgccaccgcgccggccaggcagaggccgcccaccacgacgggtatggacacgaaccacggtgtctcccagaggccgcccgcgtccccggcgtagaccacggccgcgccgatgaggcagacaccggccaccagcttcccgggctggaactcatgaagcagcacggctcacctccgcctgtcccacaccgacgtgcagatcgagatcgaccgtccccgcgctcctgacgcccgccggcggatccagcgtgacctgctggtgcctgtccggtgctacgtccacgtcctgcgagccgtcgcccggcaactggatgtcgccgacgcccacgtcgatgttcgcccgcagcgtcacgtccttggggaggatcactcgcagccgtcccacgcccacttcggcccgcgccgtcaccttctggtccttggcgaggtgtattcgggtcaggtcgagggtgccctcgccggtgccgaggtcgtaccgcggccggacgtcggccaccgcggccggcttccaggtcgcgtgcgaccagtgggtggtgacgttgcggggcagtgccgtggacccggcgaggagagcggcggtgatgacggccagcaggatggacccggcgccggtcctccccaggaacgcgctgaccgcgatgcccagtccgaagacaccgagcgcgcaggccagtccgatctgcaggctgccgcccagcgtgtggtcgtaccaggtcaggcgcgtgccgaggccgccggccagcagggcgagcaggaagacccagccgccgatcccgcgcgggccgcgcgaacggggcggttgtgcgcggggtggccgcgcggtctctcttccgcgctcgccccggctgatgttgacggccgcggcgacgtcccggtcgcgtgaatccggcggcccccacagatagccggtgccgccgacatgggtgccgtccttgacgatcggatcccgccaccaggacgggtaggaggcggtgaccggtggcgccttggcctccggcggcgcgtcggcggccgcctgggcggccagggggtcgggatcggcggagccgcggtgctgcgaccagtaccccgctccggcgaggagcagggagaggacgacggcgaaggtgagcacgtcgccgttggtcagcatcgacaggaacaccccgcagccgaccagggcgaacaggacggcggccagcgcggggccctccacccgcccggtgaggagcttgcgcacctcgttctcttcctcgtcgtcgaacggtacgaagagccaggcgaacccgtagaagatgagtcctatgccgcccgtggcggccagcaccgccagggtgatccggaagatcaccgggtccatgtcgcaccgccgcccgaggcccgcgcagaccccggcgagcagcttgtgccgccggtcccgccggaatcccgacgagccgcccttcgtggtttccgggctcccggcggtcgcggagcccgccccggcctccgcttccggcccgccggccgcccccgctgtccccgtcacgttcgcctctccggtccggccgggcccgcggcccggacccggttgtccgcctgtctcccgcgcgtccgtgcactcgtgcgcgcgcggttcctcacccgcgcccgcgccgggcgcggcggctccgggcccctcgccccgaaccgggcgagggccgctgccgggttccggacccgtcgtggcgtgctggtgattcctcatgcgtccatggtgacgggcgggccgccgccgcggcagtcgggaagaccctgtcagaaccctgattcgcccctgagctcccgccggggatgcgttcgacggacaggcgcggagtccgtcgagccccgctcggcgtccccctcagcccgctcgcagcgcccggtcgcggaccgcacgggcaacgggctggggaagatcagggacgtctcgggggcggaccctgatgcccccgtccggtggacatgtgaccatcgatggcatgccggaagccgcagcgatgcccctcgacgacccgcggccgccgcgcaagctctaccgcagcagcgacggacgctggctgggcggagtggcgcggggtctcgccgggcatctcgggctgcccgtgatctgggtgcggctcgtcttcgccggactgttcatggccgacggtctcggcgcgctgctgtacgcggccttctggttcttcgtccccctcggtgtcggcggcgtcggcggcca

SEQ ID NO: 1363 - DNA, 3307 bp, Unknown
  Kingdom: Bacteria, Phylum: Actinobacteria, Class: Actinobacteria, Order: Streptomycetales, Family: Streptomycetaceae, Genus: Streptomyces
cccccacacccatcccaggaggccgttgtgctctcccgtcgtgcccttctcaccgccgcggcggccaccgcgaccgctctccccctggcagccgccggtaccgccaccgccaccgccgcccgctccggagcaggcgccctcgccgccgccctcccgatctcgctggccaacaactcgggcggctccgcaccggtctatgcgtacatatccggcgccgacacctccggctggcccggcttcgtcaccgcggacgggcgcttccagcggctgccgagcccgtcctcggtcctgacaccggtacccgactactccatccagctgggcggttcgggttccgcgcccacacgggtgacgctcggcgactacgtgatcggcggccgcgtctggttctcgaccggacggaagatccagttcttcgtcaacccgccgggcggcaacggcggcgtgcccggcctggtgcagcccggcttcaccagcaccgaccccaactggaccaccagctggacgttctgcgagttcacctacaactcggcgaacctgtacgccaacatcagctacgtcgacatggtcgccctgccggtctcgatggccaccaccggcgccgccgggaaccagtcggtaccggcgctgccctccggtgccctggcctcgatcgcctccgggctgcgggcgcagcacgcggcggacggcgcgccctgggaccagctggtggccagcgactcctcgggcacggtactgcgcgtgctggcgccctcccacgcgcccacgggcttcggcacgtactggagtccgtacctggaccgggtgtgggactactaccgcacccacaccctcaccgtggacggccagggctcgatcggcgcgtactccgggaccgtcagcggcgacgtgctcacgttcgccgggctcaacaccaacggggtgccgttcaccaagccctccgccaccgacatcttcggctgcgcgagcgggcccctgtacaactccgggaccgacgcccgctccgccgtcgccgcccgcctcgccgccgccctcaaccgctccagcctcctggtcgccggaggcgcctcccagccgaacggggtcactcccgcccagtactacacggagtcgatcaccaaccactacgcccgtctggtgcaccagtacgcgagcatcggctacgccttcccgtacgacgacgtcggccccaccggcagcgcgccggtcgacggtcacctccaggacccggcccccacgtcctggaccatcaccctgggtccgggcagcggagggacgacgccgccgcccggaggcggcggcacgagcgcctactccaccatccaggcggaggactacaccgctcagagcggtacgcagaccgaggcctgcaccgacaccggcggcggccgggacgtgggatacctcgcggccggtgactggctgaagtacgccgcggtggacttcggttccgcctccccggcacagttcctggcccgggtcgcctccggagtgggtgccgatgtcagcggcgcgatccgcgtccgggtggacagtgccaccgggccgcagatcgccgagatcgacctcggttccacgggcggctggcagagctggcgcacggtgcctgccaacatcacccgggcggtcaccggcgtccacgacgtctacgtgacgttcgcggagagcaccgtcgagttcgtcaacgtcaactggttcacgttcacccactgatcgtcggcgtcaggcccggcaccgcagcatctccagcggggggttggcgtggaagtccgcccagaattccgcgccgaactcccgcaggccggcctccgacaccgtcagcgggacccaggtcacctcgctgaagccggccgcccgcagagccttctcgtagacctcccggcgcggccggttggcgacgaaggacaccggcgggtcgagcagcgccgtgatccgcacctgcggtccggtctcggcctcctccccggtgagtacgctgcggaagccgtacttgtccggggccggcccgtcgaagcggaagtcgggcgactggttgagcacgaagaactcgccgccgggccgcaggcttcggtggatgttgcggcacatccgctccatggtggcgatgtcctcggcgtagccgaacagctggaccgcgaggccgatgtcgaaacgccgctcgaacgtccgcagggcggagacgtcgccgacctcgtagcgcacgtccagcgggtgttgtgcctccaactgccgtgctactgccaccatttcactggagatgtcgatgccgagcacctccgtggcgccgcgccgcctgaactcccggctgtagaagcccgtaccggaggccaggtccaggaccgatctgccgcgcacgtccccgaccatggccaggaagctgggtaccaccgcgtactgctccagcggcagggccttgaacccctcgtacgcctcaccgatctcgtcgtactgctgctgtccgctcaccgctcggtcctccccgcgtgccggtcacgtccgcggccacggctcccgtccccgaggacggccgcggcccgcactcggcagtctctacggattccggcaggccctcgtactggccgaagccacaaagaacgggagggtgttccgtcctcccgtacaggcggtccggggccggggctccagcacccgccgcagcggcggccgcaccggccgaagtccaggttcctcctgcgtaatcttgcctagggcagggcgagttggcgtaggaacgggcgcgtcgaggcggccgggcgtacgctgcgttgccaccggtcaagggagggacacgggcgatgaacgactcgggcggacgcggaggctggctgcgcgggaggcgggagcggcgcctcaggcagaacctcgacgcgctccagggcacgctggcgacggcgggcatgacctaccggagcctgacggagcggttggaccgcctgatcctggacggccgtatcgaggaggcgatgcggctggccgagtccgcgcgggcctccgggctgcccgacatgcgggcggcggccgaggtcttcaccggcctgtgggagacggcgaacgaacgctacgccgaggcgctggcggcgctggaccgcgcgctcgcgctcgccggagcccaggcggaaccggacgtcgcctaccatcgcggtgcgatccacgcccggacgggtgacctcgcgcgggcggccgagcatctcgccctggctgccgcctgtgacgtggagcgggtggcggtgaacgcggcggtcgcgctgggccacctgtacgtggaggcggggcaggacgagcgtgcgctgccgttgctgcgcagggc

SEQ ID NO: 1364 - DNA, 3786 bp, Unknown
  Kingdom: Bacteria, Phylum: Actinobacteria, Class: Actinobacteria, Order: Streptomycetales, Family: Streptomycetaceae, Genus: Streptomyces
ttgagggcgacaccgccgaccgcggccggtgccacgatcttcacgaacgacccggcgacctgggcggccaccgtccgcacgaacggcacccgctccggcacgaaccccagcagcgccatcgccgccgccacgtagctgagcgccgagaacagcaccgccgcggccagccagccccactgggcgtgggcgaacagcgtgttgaactcgatgtgcgtgagctgtgtcagcaggtagtacgcgccgatggcaccggcgatgaggctgatcagcgtccgcggccgtactcgttccagccgggccggttcgaccggcgcctggggcctgatccgcagcacctgatggcggatctgcgtcagcaggtcctcttcccgggcttcctccagggcctcgtcgatggcccgtttctccgcacgcgcctcggcgcgctccgccttcttgtcctgcttcctgtccttctccaggatgacgccgaccggggcacccgtggtctgggagacgtgctccaggcgtgcctgcttggcctgccgggacgcctccaggaccgcgtcacgctcccgctgcgcccgctcccgcgcgagcctgcgcagggtggcgcgcgtggagcgggtcagggcgatcggctgcagcatgggcaggcagtcggcgaccgcgtccggccccaggacgtcgaccgccgaggcgacggcccgctcggcgcccacgcgcaggccgagcgtcgtcaccagctgggcgacgtccatgcgcagcagcagatcgcccgcggcgatctcgccgccgcgcagatcggtcaggatcaccttgccggaacgatccaccacgatcgcgtcaccggccagcctgcggtgcgcgatgcgccgggactgcagcgcccgcacctggagccaggtgtgccgcagcagctcgtcggtgatctcctcgtcggccagcgagtcgagcgtgcgtccgccggtgtgctcgtagacgagcatgacggcgtcggggcccagctcggaggtcgcgatcagcttcggcgcgttggcaccggcggcgatggccgcgtaggcgaggagcgcctcctgttccagggcctggcgcagggactgcaggctgctgcgggtggcgaatccgcgcagcgtgatgttgcgccacagacggtagaagaacccctgtgcctgctgctcacggtcgacgaccgtcacgtccagcggcgggccgtcctccagggtcacgaagtagcgccggccgcggtcgccgctgtcggcggtcgtctcggcggcttcctggcgggccgcgctcaccgggcggaagccgacggtctgcagcccggccatcagtgtccgtccggtgggccgcacgttcggcgagccgaccgcgtacagggtgccgtaggcgatggaccagccgatcagcaccgtcaggatgatcgagaacggtgtcgtgtacccggtgaccagcatcgagaaggcgtcgagcagcaggacgatccacagcaccgaacgccagcgcggtctgcgggacatgccgacggccgtcatgtacgcgatgaccggggcgaggtagccgtgcaccgggtcggtcagcgcgtggaggttgccgggggagggctgggtgagggcgtcctggatggagcccggggccgctttggccacccacaggtcggtggccagggtcaccccgtgcgcgaggaccgccgcgagcacgccgtcggcgatccgcagtccgtcgcgtttgatcagtcgttcgatcgcgaaggccaccggcaccagcaggatcgcgatgctggacaccagtccggcgatcttgatgaggaagtcgggggcctgcccggtgcccttgttgatgtcctgttcgaggccggaggtcgtgccgtgcgcgaacgcggcgatggcgagcaggacggcgatggcgagcacgcccaccagcagccgcatcaggtccgagggacggtgcacgcgcgcggggagcagcggttcgtcgccctccagctcgtcgatgtgcgccacgtcggcggtctcggggagctgcttctgcgcggtgtcctcgccggacgccttctccgcgttgccggcgggttgcccggccgcgccctcgtgagggtcgtgcgcctcggcgtcagggacgtgcgcctcggcggcctccttgccggtgtcccggggggcctcgccgcccccgccgtccgtgccggccgcgcggcctgtgttcttggcgatgcctgtgtcctcgccgccgtccgtgcccttcacggggcccgcgtcagcggcgtcagggcgcgatgagaccccagaggtgccctccgcgtcgtcggggtgcacaccctgctgcttcatggtctcttcttggtctcgtatcaccggtcaccgcccgcatgatggtggcatgccccaccgacacacgggggcatcagggtgcatatgcgggtccgacagtctgccggaagcgcagcccggcagcgagggccgcggtgggcggcggtccggccgcattgtcggtggcgtgcggcaggatgggtgggatgagcgaagtgagccttccggacgacggcagcctccgcccgcccggggcgctgcccgagtacgccgagcgggtcctggaggtcgccgagggcattcctgagggccgggtcatgacgtacggggacgtcgccgagtggctggaggagggcggcccccgtcaggtgggccgcgtcatggccctctacggcggcgccgtcccgtggtggcgggtcgtccgctcggacggtgtcctgcttccggggcacgaactgagagcgctcgcccactaccggtccgagggcacgccgctgcggcaggcgggcagaacggccgagggacacttgccccggctcgacatgcggagggcccgctgggacggcgacggcggcgaacgtgcgcagggtcacacctgacagcttccgccatccggcacccgcatggggagcccgggacccgtacgagcgaatccgggcacgtccgcgcaatgccgtacgttcgtgcgtcgagggacgcacgtgacggcagcgctcaccgtggcccccgggcccagcgagggctgcgggaaggacgggaagaaggggaagccctgcttccgctgcgggtgcgggcgtagcgtcggccgagcgtgttcccctcaccccgaggccaccgcccaccgagaccggcggaccgtcctcgcggccacggcaccccgcgtcggccgcgacaccatccagcacacccaccaggaccggcgaaccacgtgagctcctcttcctccaccaggcacctgtcgcaccccgaggtgcgaccggggaaccgtggcgcttaccgactggtgcgtaccccgccggcccgacccgatccccctcgtctggacgccgcccagcgtgccgtggttgaccaccggaccggtccgctgctcgtcctcgcgggccccggcacgggcaagaccaccaccctcgtcgaatccgtcgccgcacggatcgcccgcggacaggaccccgagcggatcctggtgctgacgttcagccgcaaggccgccatggagctgcgcgaccgcatggcacagcgtgtcggagcggtccgtgcgccccgggcgaccaccttccactccttctgctacgccctcgtccgcgcccaccaggacagcggtctgttcgcggagccgctgcggctgctgtccggacccgagcaggacgtgaccgtccgcgacctcctggcgggccaggtcgacctggaaggactgggcctggcccatgtgcgctggcccgacgagctgcgcgcctgcctgaccacccggggcttcgccgacgaggtccgcgccgtcctcgcc

SEQ ID NO: 1365 - DNA, 544 bp, Unknown
  Kingdom: Bacteria, Phylum: Actinobacteria, Class: Actinobacteria, Order: Streptomycetales, Family: Streptomycetaceae, Genus: Streptomyces
atcgcccaggaggagatcttcggcccggtcctgacgatcctgccctacgacgacgaggaggacgccctgcgcatcgccaacggcacggtctacggcctcgccggcgccgtctgggcgggcgacgaggccgaggcggtcgccttcgcccgccgcatggacaccggtcaggtcgacatcaacggcggccggttcaacccgctggcgcctttcggcggctacaagcggtccggggtcggccgcgaactcggcgcgcacggactcaccgagtacctccagaccaagtccctccagttctaagggagtcacgcgtcatggccatacgcgccgccgtcctgcccgccatcggctcaccgctggagatcaccggcatcgaactgcccgaacccggccccggacaggtccgcgtgcgcctggccgccgccggggtctgccactccgacctgtccctgaccgacggcaccatgcgggtccccgtccccgccgtcctcggccacgagggcgcgggcaccgtgctcgccgtcggcgacgacgtcacccacgtcgc

SEQ ID NO: 1366 - DNA, 2166 bp, Unknown
  Kingdom: Bacteria, Phylum: Actinobacteria, Class: Actinobacteria, Order: Streptomycetales, Family: Streptomycetaceae, Genus: Streptomyces
gaaggagccggtgcgctggagcagctccagcttcgcggtcaccgggacgccgagcagcgcggacaggcccgggctcggcacggtcggagtgcgcacgacgtggccggcgatgcgctcggccgtggtttcgatctgcgagatgccgatcaaggcggtccgtccttccggcgcggggcggggatccgcgccgcctcgaccctcacccgccggggcacctgaggtcaaccggtgcccggtggtccgacgcccggtgtgctcagtgctgctgggccttctgcggggtcgcctcgctggggcggacgatgacgtggccctcgccctggagcatcagctgcaccgcctcaccggagccgccgcgcagcatcgagccgatcgactgcgagcggtgcagcgaggtctgcagccgggccgtccagccgaccacggcgtccgtgtcgacgtacaccggctgctcgggcgtgaccggtatgaccagcgggttgccctcgcacgccaggcccagccggccctggccggtgaacacgctgttgaacagcccgcccccggcgatgcccgaccccttgaccgtcttgatctcgtacgacagcgaggcgtcgaagcacagcacgttgcgcccgttgacggtgaactcgtcgccggggtcgagctggatgatgaagcagttctgcgcctcgtgcgcgaaccacgcctcgccctgcccgcgcaccgccatcagcggcaggccctccccggtgaccgcgcgcttgagcatgccgcccacgccctggcccttgcgctcgaactggaggctgccgcgccaggccaccatggcgccctgacgcgccagcatctcgccgttcaccacgtaccggacgcacttggcgttctcgacgtacatgcccggtgcggtcgcgggccgcaccatgtgctcactggaaaagaggtcacccttcatgagggcatcctgtcccggaggcggtcattccgccaagatcaccggacaggctcactcggtgaggtcgtgcgccgggcccgagcccgcccgtggccgcgcgccggcgccgcgcgtcgtcctggcctgctttccgcagaacgccgtctccagggtgcgcagcatcgtctggtgcaccgcgccgttgttggaggtgttggcgaccgcggagagactgcgcagcccgtccccgctcgtgaacgcgtaggtgtagaaaccctggaccgccccggtgtgcccgtacacggagatcccgcaggacaggtcgcgccggcgcaggccgagcccgtacgcctggccggtgccggccgggacccagcgtcgcatctcggtcaactgggcggcgggcagcagccggccgcccagcagcgcggagaagaaggtgttcaggtcgcgggtggaggagatgagcgcgcccgcgctctgcgcccacgacaccgtctggtcggtcgcgtccaccagggcgcccttggcgtcgtccggagtgagatagccgtgcgcgtgccggccggggatctgcgtgtccgggtggacgtagaaggtgtcggtcagcttcagcggcttgatgatgcggttctcgtactcggtgcgtaccggatggcccgtcagcttctcgacgagcagtccggcgaccacgtagttggtgttggagtaggcgtaggcggcgccgggcgcgttcgtgagcgggtgccgcagggaccggtccagcagctcgcggtaggtgaagaccttggtgcgcacggcctcgaagccggggaccgaacgggcgaacatgtcgtcggtgtagtcgtacaggccgctgcggtggctcagcacgtgccgcacggtgatgcggtcgtcgggcagcaggccgggcaggtagtggtcgacggaggtgtcgagccgcagccggccctccgccgccagttgcagcaggacgacggcggtgaaggtcttggtgacgctgccgatgcggaagcggtccgcggtgtccatcgcccgggcgtcggtgcggtcggcggttccctcggtggcctggtggacggtggcgtggtcggcgtaggacgtgcggtggtcgtcgacgcgcgccgtcgcgccgggcgcgccctgggcgagcgcggtgcgcagcagggagtccagcgcggcggtgtccggtgcggggagcgcgggggcgctgggcgccgggagcgccggggcgtcgggggccggggttcgcg

SEQ ID NO: 1367 - DNA, 1320 bp, Unknown
  Kingdom: Bacteria, Phylum: Actinobacteria, Class: Actinobacteria, Order: Streptomycetales, Family: Streptomycetaceae, Genus: Streptomyces
ggcggcggctccggccaccgctccccgcgccgcacggcatccgtcctcgcgatgctggcgggcgcggtcctcggcgcctggctggtcgtccaccgcgacctgggcacaccactgctgatcgcggcgctggcggcgggggtgggggcggtggtgacctcgggccgggagtgaggtcggccgccgtcagcgtacgtacgttattctgtacaccatgaagacgatgagtgtcaccgaactgcgcgccggcatcgcggacgccctcgatgcggtcgagaacgacgcggaagagctggtgatcacccgggccgggcacgagccgatggtcgtcgtctcgctcgcagagtacgaggcactgaaggagaccgactacctcctgcggtcaccagcgatggcggagcggctgcgcaggtccatcgagcaggaccggacagggcagggtacggtccgcgagctcgcggaccctgacgaggagtcggggccgggcgccgcgtgaaggtcctcttcgtcagcgacggctggagcgactacctgtggtggcaggcgaacgaccgcaagttgctgaagcgcattaatcagctcatcgccgacatcgcccgcaacggccacgaaggcatcggcaagcccgagccgctgcggaacgatctggccggctactggtcgcgacgcatcaactccgagcaccggctggtataccgcctcgatgaggacgacctcatccacgtcgtggcatgccgcttccactacgaaagatgaagtagtcgcgcccggtctggcggagcccgtgaagtgagcaatccggccttcacctgcgccacctgctccgccttcatgactttcaccgcaaagcgcgcactgaggtttcttccgatcgcggcgatggcggccgggggctgggcgacagtgccgtcgggcgggtgccggccagggcgttggtggatttggtgaggacgaaacgtggtcgtcctcggcttcgccgccgccggtgccccgggcttctcggtgccgcacacactcacctcactggtgtgcttcctgctgggcgcgctggccggcggccgtatcgcggtccgctacggcggcggctcgcgccgcacctgggcacgggtgaccctggccgtcgaggcgtccctggtcgggctctcggcggccgtcgccttcgccgcaccgggcgccaccgccacggcgtacgcactgatcgcgctcaccgccttcgcgatgggcctgcgcaacgccaccgtccgcaagctgggcgtgcccgacctgacgacgacggtcctcacgatgaccctgacgggcctcgcctccgactcccgcgcaggc

SEQ ID NO: 1368 - DNA, 1997 bp, Unknown
  Kingdom: Bacteria, Phylum: Actinobacteria, Class: Actinobacteria, Order: Streptomycetales, Family: Streptomycetaceae, Genus: Streptomyces
  misc_feature (1556)..(1557): n is a, c, g, or t
ggaccagccggcctgccctcggcaccgccgtcgctcacggctcaggtcaggcgtcgtcggcaaccgcgccgcctcggcgccgaacgcctcacggcctcaccggcctcctcggcctcctcggcctccccggcctcaccgacccactgcgtaccgccccgacgacctaccgacttaccgcgccgactcaccgcgccgactcaccgacccaacgacttgccgacttaccgctcgtcccgacgacgcaccccgtgtgcgcaccctccgacgaaggatcccgaccgatgcccatgttgctgccgcacgacgacgctctccacggctcccacgacgaggcccatgacgaggcccacgacgaggcccacggcgagactcacgaccaggcccacgacgattcccacgccgactcccgagatgcgaacggtcccgcctccgccgcactggacggcgtctccggaacggctctgtggaccgtccggatgcgagcccaggagtccgcccgcgccgacgccctcttcgacgacccgctggccgccgagttcctcacccgcgcacgtgaggcgggcaccccgcccggtagcggcctgctccagcaggtgctgcccgactggctggccgtacgcacccggttcttcgacgaccacctcctcgcggccacccgctcggggtgcctccaggtggtcctgctgggcgccgggctcgacacccgtgcgcaccggctcgactggcccgccggggtagacctcttcgaggtcgacctgccggccgtgcacgccttcaaggaacgcatcgtcgcggctcacccgccggccgtcgcccgccgtgtcccggtccccgccgacctcctcaccgactggtccggcgcgctgctcgccgccgggttcgaccccggacggcccacggcctggctgtgcgagggactcctcttctacctggcccacgaggcggtggaccggctcgtcgccaccgtcggcgaactgtccgcgcccggcagctcgctcggcgcggagtgcctgaacgccgacgccgccgactcgccgttcgtccggccctggctggaggccctgtccggctcgggcaccccgtgggtgtggcacctcgcggacgccgagcactggtggggcgagcgcggctgggacgcccgggtggccgacctgctcgccctgccctacgccgtcgaacgcttcgctccgcacctggccgcccaccccggcctggagaagcagagcatgatcctggtgtccgccacccggcccgccggcaggaggtgagcgcgatggacggccacaacctctgccagacaccgacgacctaccggctgctgcgcctggagtacctgctcggcctgttcgtcgccgccgggttcttcctcgcccacctcaccgaggtccgctggtgggtcgccgccgtgctcttcctctacgtcgatctgatcggctaccttcccggcgccgtcgcctaccaccgcagccccgaccggcggatctcccgcgtctattacgtcctgtacaacaccatgcacagcctgagcgtgcagggcgcggtcctcggcgcctggnnctgttcggcgaccgcgccctgttcggcaacttcgtcaagtcgttcaccgtgtccttcgaaccccgcccgcatccgtcggtgcagtccgcgctgcacgacttcgcgtccgtgccctggcaccaggcggcgacgcgatgagcacccggcgggcaccgcggccgtcaccgtcaccgcggcgaccgcaacctcagcaacctcagcaaccccaagcgcaaccgcaaccgcaaccgccgcaggcactcgccgacgacgaggcctacgccatgctgcgccgccacgccggccacagcagcgccttcctcgccctgaacgcgggcaaccgccgcttccggacgccgggcgtcgacggcttcgtcccctaccgggaaggcggccgacggcacctcttcccgctgggcggccctgtctgcgccgccggtgaccgggaccggctgctcacc

SEQ ID NO: 1369 - DNA, 2668 bp, Unknown
  Kingdom: Bacteria, Phylum: Actinobacteria, Class: Actinobacteria, Order: Streptomycetales, Family: Streptomycetaceae, Genus: Streptomyces
aacgtccgtgcccgctgaacgtccctgcccggtgaacgtccgtgcccgctgaacgcttgggtccggcccgcgctctactgccaggtcgcggtgtcgggatcgatgccgtgggtccgggcgcaggcgtcgatgatgcggcggaaccacgtggcgaggccggcgcggatgccgtcgtagtgggcggcgaacgccggatcggcctcgtacctgcggccgaggcagacctgcatctgccgggtcaggggaaagtacgaggaggtgaacacggcgcggtgccgctcgacgagttcgtccgcctccgggctgccaggtgtgacaccggcgtccatcgcatcggcgagggcgtgttcgaggccggccatggcgtcggcgacggcctgccactcctgcgcaccgcgcgcggcggagcgttcggcatactgccgccattgcgtcgtgtctccgtagcgctgcctggcctgggcggcccagtccgggttccaccgggggccgaagatcgcggcctgctgctcggcggtcagcagcaggccgcgctcgtgcgcctcgatcaaccggtccagtccgacgccgagttgccgaaggcgctcgatccgttcggcgacctgggtgcgctgcgcgcgcaacgcgccgggcaggtcagcggccgagtcgtccaggacggcccggatccggtccaggccgagaccgacctcgcggtagacgacgatgcggtggaggcgttccagatcaccggcggtgtagagccggtacccgccggccgtgcgcagcgacggccgcgccagaccgatctcgtcccagtggtgcagcgcgcggaccgtcacgcccagacgcgtcgacacctggccgacggtcagaccatcggcaccagcggcatcatccatggtcctcattgtctccgcgcccggtgcccggcgggatgatcccgacggccgcgaggttccgcgcctcctgaccggccgggtcgaagggcttcgccgcggtgaagacgatccgggcgttctcgggggtggtcaccgtcacgtcgcgggtgttccagggagtgtcccgcggaccgtcgaccgagtccgggcgcagcgcacgacaggcctcgacgagggagtcgacctggctgagcacgcacgcgaaactgacgctcagcgccggtgcctcctgcggcacgccctccgccgagacgagcagcacgtcctggaacgcccaccggcgcagatgcaccagcctgccggggatggcgaacagctcgaagaacccgagcccacgggtccagaagtccaccgacgccgccaggtcggcggaggggatcgtcacgaacgcgggcatcccgtagatgccgcggaacggttccggcggcaccgcgtccgggccgggagcggggacggggctcatctcgaacgcgttgtagtggtcgctcatgcacccccaccttccagcctcacgcgacgtgagggtcaagcccgttcgtgaacccgcgcggcctcggcataatgcggtcatggatcaagcaacggcacggacgttcgtcgactcctgggtgaccgcgtggaacgcgcacgacctggactccctgctggcccacttcacggacgacgtgacgttccggtcaccggtggccgcccagctcctcggcggtgacggggtcatccggggcaaggacgcgctgcgtgcgtactggacggagggcctgcgccgcatccccgacctgcgcttcgaggtcgtcggcagctacgtcggtgtggactgcctggtcatcaactaccgtaaccagaagggcgggttggtcaacgaggtgctggtcttcgacggcccgagggtccgcgaggggtacggcacctacctgggcgaggacgccaacccggccggagcgcgctgaacaggccatccccggccgcgcgcgcgtcggccccgcccgcacgggtaggaccgggggacgagggaccgcacgagtgtgggggagagatggcagtggcacgtgttctcgtcgtcggcggcggcatcgccggcacggcgacggccctggccctgcacaaggcgggctacgacgtcaccgtgtacgaggcgcaccccgactcggccgaggacatcggcgcgttcctcacactcgccggcaacggcatgcgcgccctcgcccagttcgacgccgccgccgcggtcacggtgctcgggttcccgctgacgtcgatgcgcgtgctcgacgccacgggagccgagaccgcgcacgtgccgctcggcgaccccgacgacgcggtgctgcgttaccggtgcctgcgccgcggcgaactcaacgccgccctgcaggcggaggccacgagccggggcattcccgtccgccacggcatccgcctcgccgccgtcgaggacggcccggacggcgtcaccgcgcgcttcgccgacggcaccaccgcgacgggcgacctgctggtcggcgcggatggcgtgcactccacggtccgccgcgccatcgcccccaccgcacagcccggctacgccggccagcgcgtctactacggctacaccggcaccgcgcccgccgccggggacacggcgtgcatcaccatggtgcggggcagcaccgccgcgttcggccacgccacctcaccctcggggcagacgtactggttcgcgcgcgtgagcagcggcgaaccactgcccgccgacgagatcgcgcagggca

SEQ ID NO: 1370 - DNA, 1120 bp, Unknown
  Kingdom: Bacteria, Phylum: Actinobacteria, Class: Actinobacteria, Order: Streptomycetales, Family: Streptomycetaceae, Genus: Streptomyces
gccggccgggacgcccgcgcgagcgggtgagggacacgaggtcccgtccggccggctgctgctctgtcgtgggtgtccggccggtccaacgaccggttccggacaccgtcacgcggcgccccgaggcgcacgaggcgccggaggggtcacgcgccggtggcgcgcgcctcccgcgtctcccgggtcgagcgccgtgccatccacgcggcgacgagcgcaccggagatgttgtgccacacggagaagaccgcggcgggcagcgcggccagcgggctgaagtgggcggtggcgagggaggcggcgagaccggagttctgcatgccgacctcgaaggccatcgcccggctggcgggccggccgagccgggagagccggccgcagccgtagccgagggccagtccgcagccgttgtggagcacgacagccagcaggacggtgagggcggccgacttcagggcgtcggcgctgcccgcgacgaccacggcgacgatcgcggcgatggcgagcgaggacagccacggcatcgcgccgagcacccggcctatgtaccgtccggcgaccaggcgcacgacgaccccgccgatgacgggcagcagcacggtcttgaggatgtccgtcaccatcgacccggcgtcgaccggcaggtactggcccgcgagcaggagcgtcagcggaggggtcagcagcggagcgaggacggtcgagacggtggccacggagaccgacagggccacgtcgccccgggcgaggtaggtgaccacgttggaggccgtgccgctgggtgcgcagccgacgaggatgacgcccgccgcgagggcgggcgacaggtgcagcaggtgcgcgatgagccagccgagccccggcatgatcacgtagtgggcgacgaggccgagcaggaccacccacgggcggcgcgccacgcccctgaagtcctccagggacatggtgagacccatgcagaacatgatcacgccgaggaggtagggcacgtcggtgccgtagccggcgaagctgccggggaacacgaggccggcgacgcccgcggcgatgacgaggaccgggaagacggtgacggcccggcgggcggcgcggtccgccgggccgggcccggccgcgctcg

SEQ ID NO: 1371 - DNA, 1554 bp, Unknown
  Kingdom: Bacteria, Phylum: Actinobacteria, Class: Actinobacteria, Order: Streptomycetales, Family: Streptomycetaceae, Genus: Streptomyces
atctggtggtcgccgtccacccggagcccgccgcgcacgcccggcgcgagcatcggctccaggcgccggcactcgcgccccgacagccactccgactccaggccggagcgctgctgcagggcgtgcagttcgcgcaggtgggcgcggtcgtcggtgtccagcgcgacggccagcgtgccgcacctgcggtagccgaggtcctggccggtcagctcggtcagctcggccgcgaagtccgggtagcggcgggccgaggccaggttcaggccgagcagggtctcctcgccatagtgcagctccgtgacggcggccagcatcccggccgccacctgcgcggcgccgccgcccggctcggggtccaccacggccgtggcgagtcctctcccggccgcgcgccaggcggtcacgagcccgatgatcccgccgccgatgacgaggacgtctgacgtacgtggcaacgacatgggcgtccagcccctcccttcgccggcatgacccggatcaggttcgtacggtcggaggccgcgagcctccctctcagcccggtgcgtccgggctcccgcgagtgcttgtacggtggccaccctagcccctggagcagcgcttttgtaagggagcctcccgtatgccgccctcgctggacggtctcgtcctcgcccccgtcaccgaccaggcccccggccaggtgggcacccgtacccgcttcacgtaccacgagcggggcggcgagatctgggccgagtacgcgggcggcgacgtcgtccgcggtcatctgatcggcacccgggacggcgaccgcctcgacttccggtacgtccagctcaagcacgacggcacgacctcctcggggcactgcgtctcgacggtggtcggactgcccgacgggcgggtgcggctggaggagacgtgggagtgggagtcgcagcaggggagcgggacgagcgtggtggaacaggtgagcgagtgacgtctgcgggagtggtgcggcctcagcgggcgtgacgcggactcggcgggcgttgtggagcacgtcactccgcacgccccctgactgacaaaacgtcaggtgactatggtgatcaggtgagcgagcagacgcaggaacagggcacggcccagccgcggcgcgtggtcgtcgccggcgcgggcatggccggcgtgcagaccgcggtcgccctgcgcgagcagggcttcaccggcacgatcacactgatcggcgccgaaccccaccagccctacgaccggccgccgctgtccaaggccgtcctgctcggcaaggccgaggggtccgccttcgacgtcgacttcgaggcgctcggcctggagctgcggctcggctgcgaggccctggccgtccgtcccgaagcccacgtgctcgacaccgctgagggccccgtcccgtatgacgtgctggtcctcgccacgggcgcggaaccgatgcggctgcccggcgccgaggacgtccccggcgtccacctgctgcgcaccctggacgacgccgaacggctgcggccggtcctcgccgagcagcacgacgtcgtcgtggtcggcgcc

SEQ ID NO: 1372 - DNA, 3058 bp, Unknown
  Kingdom: Bacteria, Phylum: Actinobacteria, Class: Actinobacteria, Order: Streptomycetales, Family: Streptomycetaceae, Genus: Streptomyces
cggcgggcgccgccggcatcccgggcccccagaggtcccgcagcagcccccgctgcgcgtcggacatgtcgcccggctgcgcggtgtacgcgaccgggacgccgagcgcggcgcaccgctcgcgcagcagcgcggcgttggccaccagctcccggcgcgggctgtccggcagcgggttcaggaagtaccgctgcatgtcgtggacgagcaggaccgcgcgcgcgggatcaagggtccagcgggcgacgttgccgggcaggtcggccgccgagggcagggcgtacggttcgatgcggggtatgcccgtcatgtcgttcctccgttgctggggacacgtgggtgggacgcacgtggtgggcgcccgtgcgccgagcgcacgcgaggggggcacatgtgcgtggtgcgcgcatacgcgggacggctgcgcgtgccgggtccggtgggtcacacgccgagtgcggcgccgccgtcgaccgtgaggtcgtgcagggtgatgtgggaggcccggtcggagagcaggaagacgacggcctcggccacgtccgcgggacgcgccagccggcccagcgggatgcccacgcggaacgcctccggccggccctcgaccgtcccccggggacccgactcgtcgtgccacatcgaggacagcatcggggtgtcggtcgaacccggcgccaccacgttgcagcggatcccgtgtcgggccacctccaggcccaggctcttggtgaacatcgacgcggcggccttggaggcggcgtaggcggccatctccgtgcggggcgtcccggcggcgttggacgccacggtgacgacggccccccgtgaccgcggaaccatgcgggcgacgaccgcacggcacatgtggaagacaccggtggcgttgaccgcgaaggtggccgcccagtcctcgtccgtcaggcgcgtgctctcgccgagccgcagcactccggcggcgttgaccaggtactccaccggaccgagccgttcctcgacggcgccgaccgtggcgtcgacccgggcactgtccgacacgtcgcagccgaacgcctcgacgctcagcccgtcggccaccgcagcggccacggtctcacggagccgcgccgggtcccggtcgacggcggccacccgcacgccctgctccccgagcgcccggaccacggccgctccgattccccccgcggccccggtgaccagggcaaccttgtgctccatctgttccgtcctccactggtgctgatgcgcgggaccggtcgtccgcgccgccgggtgccgccgtcggcgcggacggcacgtcacccggcggcgagatcgcgcttcagggcggcggcgatgtcgatgacacggcgggcctgcacctcgatcgcggcgaggttgtcagggctcgcgctgccgggccggttgcgggagacgctgctgaccccgtacgggttgccgttgtcgggcgcggcgaggacggggtcgacggcgccggtcggcacgatgatcgaaccccagtggtagaaggtgttgttcagggccaggatggtgctctcctggccgctgtgcgtggccgcgctggaggtgaaggacgacacgaccttgttcaccagcttcccctgcagggacagcgtgacggtggtgtcgaggaactgtttgagctgggccgcgggcagtccgaagcgggtcggcgtgccgaacagcaccgcgtcggcccactccaggtccgtcggcgcggcctcctggacatcgcgcgtcgcggcgaggtgggcggcccagtcggggttgccggcgacggtgtccggcgggaagagttcggcgacccgccgcaggcgtacgtcggcgcccgccttcttcccggcggtcgccgcggcgtcggccagctggtggacgttcccggtggacgagtagtagatgacggcgaggttggtcataagcgcttcccgttggcgtgaaaaggcgcgccggtgccgggcacggtgagccgcggccggtttccggtcgccccgatcgtgggccgcggcgcaccggcccgccaacggcccgcgccgcactccgtcaagtaccgccgactccatcaggtcggacagcggcggacgccccaggccccggcagcgattcaacaaaatgttgacgccacccccggcgcatgcatagcttcaaccactcgtgagcactcgtcagcactcgccagtactcgtcagccaggaaaaacagccggaacgccgggggagcaacgtgccgcgggaccacgggtcgtacacgaccgccgtactggagttactcgccggcgacgcgccggcccaccgcctggaggacctgcgggcggacgtccggcggaccggcgccggcacgggggagtacgagcaactggaacgcgcccgggaactggggctgagcgtctacgcgcggctcggccgccaacggcagcgcgagaaggggctgtcgacgctgatcgacatcgcgcgggacctcgccgcaccgcacgacctggcctccgtgctcaaggtcgtcacccggcgggcgcgcacgctgctcggcgccgacatggcgttcgtcgccttccgcgaagaggaggagggactggtccgggtccgggccagcgagggccacacctcggtgctcaccgccgggctgcggctgcccgacggcgccgggctggtcggtgacgtcctggccgactcggcgccggcctggacgcccgactacctcaccgacgccacgatccggcgcagccgcgccctggacgaggtggtccgcgccgagggactgcgcgccgtgagcgcggtaccgctcagccacggcagcaggaccttcgccgtgctgtacacggccgaccgcaaggtcaggcacttcaccaccgacgagctggcgctgatgacgtccctggggaacctcgcgggcgcggccgtcgagaacgcccgcgtcctggaccgctccgccgccctcatccgccgtctcgccgaccacgccgaccgcatcgaggcggcgctgcgcgacgaacgtgaactggccgacacccagaacctgttgacggatctggtgctcgacggcagggaccagatccgtcaacaggttc

SEQ ID NO: 1373 - DNA, 521 bp, Unknown
  Kingdom: Bacteria, Phylum: Actinobacteria, Class: Actinobacteria, Order: Streptomycetales, Family: Streptomycetaceae, Genus: Streptomyces
gccttcaagaagagcctcggcgagcacgcccgccgggtaccggtcagctccatcaagtcgatgatcgggcactcgctcggcgcgatcggctccctggagatcgccgccagcgccctggccatcgagcacgacatcgtgccgcccaccgccaacctgcacgaacccgaccccgactgcgacctcgactacgtcccgctcgtggcccgcgagcagcgcaccgacacggtcctcagcgtcggcagcggcttcggcgggttccagagcgccatggtcctcaccgcaccgcggacgggggtggccgcgtgagcacgccagtgcgccggcacgcaccagctcccgaacacgacggcctgctgcaggcccgcaccctgaccgcggccgtcaccggcatcggcatcgtcgcccccggcggcgtcggcaccgaggcctggtggtcggcgatgctgcacggccgccgcgccatcggccccgtcacccgcttcgacgccaccggctacccggccgcactcgccggcgaggtc

SEQ ID NO: 1374 - DNA, 2694 bp, Unknown
  Kingdom: Bacteria, Phylum: Actinobacteria, Class: Actinobacteria, Order: Streptomycetales, Family: Streptomycetaceae, Genus: Streptomyces
caagaccgccgagaagctcgccgcccagcaggaggccgcgcgggacgagtccgccgagccacccaccaagccgtccgccgacccacgggaaggagagtcgtgaccccggccaccgcaccccagggcttcctctccccgaccggggtcgaggtcgccttcgtcctcgtcggcctcgccaccttcggcgccgccctcgtcaccgtcaccacccggcaactcgtgcacgccgccctgtggctcgtggtgaccctcggcggactcgccgtcgaatacctcctgctcaccgccgagttcatcgcctgggtgcaggtcctcatctacgtcggttccgtcgtcgtcctcctcctgttcggactgatgctcaccaaggcgcccatcggccgctcaccggacgccgactccggcaaccgctgggccgccctcgccgtggccctcgccgcggccgccgccctggtctgggtggtcgccgacgccttccgcaccacctggatcgacctggacggcgccgccgccggcaccacgaaggccaccggccagagcctcttccagaactgggtgctgcccttcgaggccctctccgtgctgctcctggccgcgctggtcggcgcgatcgtcctctcccgcaggcggaaggcggcgaaggcggacgcgaccgcctcccggcccccgcagacacccggcgaacgggccgccgaggagggcacccgctgatgcacctcgtctacccggccgtactctccgccctcctcttctgcaccggtctctacggcgtcctcgcccgccgcaacgcgatcctggtcctgatgtccgtcgagctgatgctcaacgccgtcaacctgaacctggtcgccttcgacgtctggctcagcaaggccgccgccgagaccctgcactccggtcaggccctcaccctgttcaccatcgccatcgccgccgccgagatcggcatcggcctggcgatcgtcctcgccgtccaccgcaaccgcggcacctcggacatcgaccggctccgcgactccgccgagggacccgacgacgaccgcggcgacggcacccacggcaccgacggcgacggcaccgacggcgacaccgccgcgaccgcgccgacctccgggaaggctgaggccaccgcgtgaccacgaccaccctcgccgtcctcgtccccctccttccgttcctggccgccgcggccggactgctgctcggccgcaccgcccccggcttcgtccgcccgctcgcggtcctgccggccctcgcctccctcgtcctggccgtgctggtcgccgccgaccagggcggcggctcggccgtcgacgccgccaccgaactgacacccaccggctcggtccccgtcgaactggcactgcacatcgacggttacgccgcgctggtcgccgtcctggtcaccgtcgtcgccacctgcgtgcagatctactcgaccggctacctgcgcgacgacccgcgctacccgtcctacgccgcgctcgtctccctgttcacctccgcgatgctgctcgtcgtctactccggcgacctgatcgtgctgctggtcggctgggaggtcatgggcatctgctcctacttcctggtcggccactactgggagaccccggaggcccgcgccgcctccatcaaggccttcctggtgaccaaactcggtgacgtccccttcctcatcggactgttcgcgctcgccggcgacgccggctccttccggatcacgaaggtcctcggcaccgtcgcgagcggcggcctgcaccacccgaccctgatcgccctgctgctcctggcgggcgtggcgggcaagtcggcgcagttcccgctgcacacctggctgcccgacgccatggccggcccgacgcccgtctccgcgctgatccacgccgcgacgatggtcgccgccggtgtctacttcgtcgcccgtctcctccccgtcttccaggcctcatcggccgcgatgaccgtcctcgccgtcatggccgccgcaaccatggccggttcggcgctcgccgcgctcgcccaggacgacatcaaacgcgtcctcgcctactcgacgatcggtcagctcggctacatgaccggcgcactcgccgtcggcagcccgggtgccgccgtcttccacctcctgtcccacggcgccttcaaggcgctgctcttcctcgccgccggtgtggtcatccacgccgccggcaccaactcgctggccgtgatgtcccgcacgggcggcctgcgcgaccgcgtcccggacgccttctggacgatgaccgtcgccctcctcgcgctcgccgcgatcccgcccttcagcggcttcttctccaaggaatccgtcctcggagccgccgagcacgtcgccaccggccacaccgaccacgcccccggcgctgccggctggatcgtcctcgtggccggtctgctcaccgccctgctgaccggcgcgtacgcgacgcggctgtggctgctggccttccgcggccagggcgcagaggcccccggccacgacaggcagcccgtgaccatgaacgccgtgctctgggtgctcgccgtgccctccctcgccttcggcggactcgccttccgcgtcctgcccgactggttcggcggcgcctccctcgcgccgaccctgaccacctccgtcctcggcacgggcctggccctggccggcggcgtcgtcacctacggcgcctggcggcacac

SEQ ID NO: 1375 - DNA, 2269 bp, Unknown
  Kingdom: Bacteria, Phylum: Actinobacteria, Class: Actinobacteria, Order: Streptomycetales, Family: Streptomycetaceae, Genus: Streptomyces
gggatcacgctcgccgcggcgccgcagcccggtaccggcggcgaccggctcgatccggtggagcgggtcgcccaggcctctcgcatacggacccggtccgtgcgtctggagggccgctggtggcatacggacgtgggcccgctggtgggtcaccgggcgctgtcgggcgcgccggtcgcgctgctgtggcggcgcggcgggtatgtcgcggtgcatccggcgaccgggcgggagaccccggtggagaaggcgaacgcgcaggagttcgagccgcgtgcggtgatgttctaccgcccgctgcccgaccgccgcctctccccgctcgccctgctccgcttcagtctgcgcggcacctcgagcgacctgttgaacctgctggtcagcggggtggtgacggtcgccgtcggggcgctggtgccgatcgcgacgggcaaggtgctcgggcagtacgtgccccaggcccagcaggggctgatcgtgcaggtgtgtctggcggtgatggtcgccgccgtggtgtccgcggcgttcacgctgctggagaacctgacggtgctgcggctcgagggccggatcgaggcgacgctccagccggccgtgtgggaccggctgctcagactgcccacggcgttcttcgccgcgcgctccaccggcgagctggcgagcgcggccatgggtgtcagcgcgatgcgccgactgctggccgggatcggcccggtggtcgcccagtcggtgaccgtgggcgcgatgaacctggcactgctgttctggtacagcccgtcgatggcgtgcgcggcgctcggcatgctcgtggtgatcgcggccgtgttcctcgggctcgggctgtggcaggtgcgctggcagcggcgcctcgtggtgctcggcaacaagctgaacaaccaggcgttccagaccctgcgcgggctgccgaagctgcgggtggcggcggcggagaactacgcgtacgcggcgtgggcgcggcagttcgcgcgcagccgtgaactccagcagaaggtgggccggatcaagaacctcaccaccgtgctcggcgccgtctacctgccggtgtgcacgctggtgatgttcatgctgctggccggaccggcgcgcggctcgatgtcggcggcggccttcttgacgttcagtacgtcggtgacgatgctgctgacctcggtgacccagctgaccggggcgttcgtgtcggcggtgggcgcgctgccgctgttcgaggagatccgaccggtgctggaggccacgcccgaggtgcgcaccggcagcacccggccgggtccgctgtcgggcgcgatcgaggcgcggcggctgtcgttccggtacaccgaggacgggccgctcgtcctggacgacgtgtcgttccgcgtacggccgggcgagttcgtggcggtcgtcgggccgagcggctgcggcaagtcgacgctgctgcggctgctgatcggcttcgaccggccgctgtcgggcagcgtgctctacgacggccaggacctggccgcgctcgaccagtcggcggtgcgccggcagtgcggggtggtgctgcagcacgcgcagccgttcaccgggtcgatcctggacgtcatccggggcaccgagccgtgctcgccggaggaggcgatggcggcggcggagctggcgggtctcgcggaggacatccggcggatgccgatggggctgcacaccatcgtctcgggcggcggggccgtctcgggcggccagcggcagcggctgatgatcgcgcaggccctggtcaggcgcccgcggatcctgttcttcgacgaggcgaccagcgccctggacaacgagacgcagcgcacggtgatcgagagcacccagaagctcgacgcgacgcgcgtcgtcatcgcgcaccgcctgtcgacggtcatggacgccgaccgggtgatcgtcatggaggacggacgggtcgccgaggaaggcacgcccgccgaactgctcgcggacaccggcggccggctgcacgaactggtgcggcggcagctggcctgactccggtcccgcttcccggagacccggcaacgccgctccccggagcggcgaggctcctgggtgccgttgcgcgtcaccggaacaccacccgccggaaaccggccgttgtccccgtgttcgtgcgccgctaccgccggtgacaggcgtaggggatcaccgggccgggtacccaccggcccatgcggatcagcgtggtggacgtggggtcgaagacggttcggctggtggtggcggacgcggtgggcggggcgccgct

SEQ ID NO: 1376 - DNA, 1711 bp, Unknown
  Kingdom: Bacteria, Phylum: Actinobacteria, Class: Actinobacteria, Order: Streptomycetales, Family: Streptomycetaceae, Genus: Streptomyces
ctccgggacgccctgctcgacgacgaagacctccttgcgcaccgcgaagcaggcctcgcggtcggcgaggtcccgcacgacgcgggtcaggtacggggccggggtcatgcgtaggtctcctcgcggacctggtcgagtgccttctggaggtccgccgggtagtcgctggcgaactccacccactggccgtcgccggggtgctcgaagccgagccgcacggcgtgcagccactgcctcgtcagcttgagccgcttggcgagggtggggtcggcgccgtaggtgaggtcgccgacgcaggggtggcggtgggcggccatgtggacgcggatctggtgggtgcgcccggtctccagcttcacgtcgagcagggaggcggcgcggaaggcctcgatgaggtcgtagtgcgtgacggacggcttgccctcggcggtgaccgcccacttgtagtcgtggttcgggtggcggccgatgggcgcgtcgatggtcccgctggtcgggtcggggtggccctggaccagggtgtggtagcgcttgtcgaccgtgcgctccttgaactggcgcttgagcgacgtgtacgcgtactcggacttggcgaccaccatcaggccggaggtgccgacgtccaggcggtgcacgatgccctggcgctcggcggcgccggaggtcgagatgcggtatccggcggcggcgagtccgccgatgaccgtggggcccgtccagccggggctggggtgcgcggcgacaccgacgggcttgacgatcacgacgacgtcgtcgtcgtcgtggacgatctccatgccctcgaccggctcggcgacgacctgcacgggcgcgggcgcctgcggcatctcgacctccagccaggcgccgccgcgcacccgctcggacttgccgaccgccgcgccgtcgaccagcaccttgcccgcggcggccagctcggccgccttcgtgcgggagaagccgaacatgcgggagatggcggcgtcgacgcgctcgccctccaggccgtcgggcacgggcagggtacggatctcgggaagcgtgctcacccgtcgagtatgccggacgggcaggacacacccgtacgcgcggcctccgccctgtggaaaaccccggtccccggggagtccacggagggcctcagtccttgtggacggtgccgtccgggtcccggccgctgaaggagagcagcacgatcaggatgccgccgcagacgatcgccgagtcggcgaggttgaagacggcgaagtgcttcggggagatgaagtcgacgaccgcgcccttgaagacgcccggcgagcggaagagccggtcggtgaggttgcccagagcgcctccgaacagcagcccgagtgcgatcgcccagggcaggctgtagagcttgcgggcgagccggatgatcaccacgatcacggcggcggcgatgaccgtgaagatcaccgtgtacgcctcgccgaagctgaaggcggcaccggagttgcggatcatctggagctggagccagtcgccgatgacgtccaccggcgcgtggtgctccagcttggccacgacgaggatcttgctgacgaggtcgagggcgtaggcgaaggcggccaccgcgaacagcacgccgatgcggcgcttgccccgcggccgctcctgggtggcggtgccgggccgcccgtccgcgcgggaggccgcctcggacccgcccggcgcgtccggggcatcc

SEQ ID NO: 1377 - DNA, 2881 bp, Unknown
  Kingdom: Bacteria, Phylum: Actinobacteria, Class: Actinobacteria, Order: Streptomycetales, Family: Streptomycetaceae, Genus: Streptomyces
gggcgccggcgccccctccttcggctacgtcctcggcatgctcctggcctccgccgtcgtcggtgagctggcccgccgcggcggcgaccgcaaggcctggcgcatggccggcacgatgatcctcggcgaggcggtcatctacgccgtcggcgtcccctacctggccctgtccaccggcatgtccgcctccgccgccatcgccgcgggcctgaccccgttcctgctcggcgacgccctcaaggccgccctggcgatgggcgcgctgccggccgcctggaagttcaccggccggcgctgacggcccctaagcggaaagcggaaagcgaaagcgggcgagcctctccgagaggctcgcccgcttttcgctttccgctttctgttttctcccgtctctccaggagtgttccgcgggatcagccggccggaatctgctccgtcccggcggattcggtggtcgccgcctggtggccgtggccgccggagagcttctgcttgaccatggcgatcaccagcacgaccgccgccaccagcagcgacagcagcacggtctcccggccgtcgtgctcggtgtcgaagagcatgtagaccaggacggaggtgatcacgcccgccaccgtccaggtcaggtacgggtacagccacatccgcacgaccagcttctccggcgcctcgcgctggatgatccgccgcatccgcagctgcgagaagcagatcaccagccagacgaacagggcgaccgcaccggaggagttgacgaggaagaggaagacggtgtccgggaacttgtagttgaagaacacggccacgaagccgaaggccaccgagacgaggatcgcggtcctcggcacaccgcggccggtggtctgtgcgaacgccttcggcgcgtccccgcgctgaccgagcgagaaggccatgcgggaggcggtgtagagaccggagttcaggcaggacagcaccgaggtcagcacgatgaagttcatgatctgaccggcgtgcgcgatgcccagggagtcgagggcggcgacgtaggagcccttgtcggtgatcgacttgtcgctccaggggatcagggagacgacgacgaggatcgagccgaggtagaagacggcgatgcgccagatgatgctgttggtcgccttggtcaccgcgcgctgcgggttctcggactcaccggccgccagcgtcgcgatctcgctgcccatgaaggagaagacgacgagcagtacgccggtcaggatcgagccgggcccgtgcgggaggaagccgccgtggccggtcaggttggagaaggaggcctggtcggtgtggacgcccggcagcacgccgaagatggccagcagcccgacgatgatgaacgcggcgatcgcgacgaccttgatcccggcgaaccagaactcgaactcgccgtaggagccgacggagaccaggttggtggcggtcagcaccagcatgacgatgagggcccagccccactgcggcacggccggtatccagccggagaggatcttggcgccggccgtggactccacggcgagcacgacgacccagaagaaccagtagagccagccgatggagaaaccggcccagccgccgagcgcgcggtcggcgtgcgcggagaaggagccggaggtggggttggcggcggacatctcgccgagcatgcgcatcacgaggacgacgagggtgccgacgagggcgtaggagaggaggatgccgggtccggcggtggcgatgccggagctggagccgacgaagagtccggcaccgatgacaccgccgatggcgatcatggtgaggtggcggttcttgagcccggcctgaagcccggagccgtgtccgtccgggttcgcggggtcacttccagactgctgcagggtcggctgcgaggtcatgggggattccttttgcgccggtgagcggttaccagtacgagcggtgtacgagccggtccagtgaatccgaggcgacggaattcgtgaaccttcgaaacgtaatcgttacttgaggtttccttgaggtttgcggttcggatggatatccggcggcggtattgcgtgcacgtcgcgtgtgcattcggtgacgcattcggaatgcgttccgaatgcattccggccgcgctccggccgccatcgggatgagtgcgggatgagtgcgggatgagttcggcatgagttcgggatgcgtgccgggggaggggcggccccgacccgacccgcccgccccggacccgccgtgtcacactcggaccatgcgcgtgtatctcggctcggaccatgcgggcttcgaactcaagaaccacctcgtcgaatggctcaaggcggcgggccacgaggccgtcgactgcggaccgcacatctacgacgcccaggacgactacccgcccttctgcctccgcgccgccgagcgcacggcgggcgacccggactccctcggcatcgtgatcggcggctccggcaacggcgagcagatcgcggccaacaaggtcaagggcgtacgggccgccctcgcctggagcgaggagacggcgtccctcggccgccagcacaacaacgcgaacgtcgtcgccgtgggcgcgcgcatgcactcggcggaggaggcgacgaagttcgtcgagaccttcctcagcaccccgttctccggtgacgagcggcacatccgccgtatcgacatgctgtcggagtacgagacgaccggagagcttccgccgatcccggcccaccacccgcagcagtaggacagcccagggctccgcccgggcccctcactcgtcaccctcagcggtgagggaggcagagtccgccacctcagaggtcagggcggcgcagcccgcaccccggcggtgagggctgcagagcccgcccggggtgcagggctgcgccgc

SEQ ID NO: 1378 - DNA, 1894 bp, Unknown
  Kingdom: Bacteria, Phylum: Actinobacteria, Class: Actinobacteria, Order: Streptomycetales, Family: Streptomycetaceae, Genus: Streptomyces
cccgcgggcagcgtcagcacgtcctcgccgcggggaacgcgcggaccgagccgcatgtccagctccaccagcgcgcgggcccgcgcgaactcggtgggcgtgaagggcaggtacggccgctccacgctgatcactccgccctccggcgcccgcagccgcagcaccgtgtcctccagcaccccctccgtcggaacctcctcgtccgcacggccgccgcccgccggccggcccggcagcgaacggatcgtgcaccggcccagcaactggcgcagcgccaacggaagttcggccgcgtccagcgccgtgcgggtggccagggcgagggcccgcgtcggcgcgtcgaccaggtcgtgcgcgtcggcccgctcgatccaggtgtcgcgaccgccggccgccgcgaccgctgcggtcaggtccgacgcctcgaccgcgcccggagcgcgcagcaggaactcgtccaccgtgccctgggccagcgggtgcgtctgcaggctcaggatgtccacgccccgcccggccagtgccgcgcacagccccgccagcgatcccggctcgtcccgcaccgtcgtccgcatccgccacagagcgctcgccaccggcgcctcctcacggcccgtcggcgaaagggtggtcgacggcccggcctgccgccgcccggcggcgaacggccgggcgccggtatcctccgccggaggcgcgtgcccgtgacgccgtgcccaccaggtgtggaacgccgtcgtggccagcagtgccagcgccgagaccaccagcagtacgggcccgtccgggccgtgcccgaccatgttcgccaccgcgtccgccaccgcgacggccgtgaacagcgcggcgagttccaccaggtcccgtcgccagtggtgcaccggacgcccgtgcttcgtggtccgtgccgtccgcgtcacatcagacatttctctcctcatgccgtcactgtggacgaagcgtgttgcgtgatcacgaacgctctgtgacgtaccggtaaagcgcggatccgcctgttccgccgccttcgcgggacccagggtcctggcggcgcccggccgcttcacgccgtggccacgagggacggtccgcgaggccgcgcaccgggggatgacgccggtgcgcggcacggaaaagcctaacgggaaccggagttgctctccgacaggggcaccggagacaccgcccgacccgcagccggagtcactgcccgacccgtcccggctgcagcacctgcgtgaacagcacgctgccgtcctgctcgcgcagccggaccgtgagttccccgctgtcgccgtcgatgtcgacctcgccgaagaactggtaaccctcggcgggcgagacgttggcgacggacggcgccttgacgaacacccggtcgggcccgaacgtcccgtcgagcgcactggccgggaaggcgcccgcgttgagcggcccggagacgaactcccagaacggtgcgaagtccttgaacgccgcccgcgacgggtcgtagtgctgcgccgaggtgtggtggacgtccgcggtcagccacaccgtgccggtgatccgccggtgcttgacgaaccgcagcagctcggcgatctgcagttcacggccgagcggcgcgcccgggtcgccctgcgcgaccgcctcgaagttcggcctgccctccactccgtcgggcacgacgagaccgagcggcatgtccgcggcgatcaccttccacaccgcccgcgaccgggtcagctcccgcttgagccactgcaactgctcgcggccgaggatgccctgcgggtcggtccgctggtcgtcgggcgagttggcgttgcggtaggtgcgcatgtcgagcacgaacacgtcgagcagcggcccgtgatggtggacgcggtagatccggccgtccggacggccg

SEQ ID NO: 1379 - DNA, 1222 bp, Unknown
  Kingdom: Bacteria, Phylum: Actinobacteria, Class: Actinobacteria, Order: Streptomycetales, Family: Streptomycetaceae, Genus: Streptomyces
gccgtagcgctgggcgggccggcggttgcgcctggagacgccgcagtgcgctggctccccgaggaagggctgcgcatcctgtaacgccctgcgcgtcaccagtggcaccaccgccttccaggaagagccgggcggcgaagaagggcaaccacccacctgaccttgcgacctcgccccggcgacccggcattcggggacgtccatccacggcgaacacgcccccagaggcgggaaccggcagctcaaaagccgccctgttactctccgcgttcgcggcccggcacgatcccggctcccgcgcctactacgaccgctgccgagccagaggcaaaacccacacccaggccctcctccgcctcgcccgccaccgcatgagcgtcctgttcgccatgtcccgcaacggaaccttctacgagccgaggagtcctcgaaccgctggacgaacaacgtagaggcaccccccggccagggcggagacgacggcacacacggggcgcgcggcgtccagtggctcctgcatgccagccaccatgcgagcgcagccggtgccctgcgaaccggcacaccgcgtcattccgagggaatgcgaaactcgaattcgggacggtcccacggcacggcgggcgggttcgcgagcgcggtcccggtccgcactgcaccgacgcggtggtagaagtcctcggcgggaagatgcgacacgaccttgacacggtcgagcccggcggcacgggcttcggacagcatgtgcgcgacgagcagtcgtccgataccccgtccttgcgcttcgtcggcgacgaacagcaggtcgagctccggtggagcgaggacgagcgagtagaacccgaggatccggcctccctgctcgtcggcgccgacggctacgaaggcgcggtgggcttcgatgtaatcaggaccgacccggtagcccgccactgcggctgcgtacttgccctcgtaggcgcttgagccacgcacgagccgcgtgagccgtctggcatcccgcgcgacggcccgccgtattctgatcggctggctgaccggagaagtgcgtgaactcatcgggagagtatttcgcaccggggagtgccttcctgcggcgggtcggccgctcgggcaggcgttcctgccccgcccccgggaaccactcgggcgagcgcaccgatctcaggccggagccgcgccggggcgcaccggcgcggctgcggcgcctcccggctccgcg

SEQ ID NO: 1380 - DNA, 2379 bp, Unknown
  Kingdom: Bacteria, Phylum: Actinobacteria, Class: Actinobacteria, Order: Streptomycetales, Family: Streptomycetaceae, Genus: Streptomyces
tgtcctccagccgcgcgtcgtactggccggagagcaggaactgctccagcgcctggtccccgccgtcggagagggccgcggtcgcctcgcgcttgaccgcctgcgcgccggagttcatgacggtcagcgtggcgacgcgcaggtcctcggagacggccggggcgtaacccgtctccatgaactccttgatcgccgaatcgccgccggagagcgcggtgttggcggcggcgcggatgccccgcccgccgttggcgaggtagctgaacaccgccacccggttgtcctccgccgaggcgacgggcagatgcgtggtgaggaaggcggtgatgtcggcgtcggtcccgctcagtgcgtactccgccgccgcccgtacggccctgccgccgagcacccaggcccgtacggccttggcgcggtcggtgtcgggcaggtccagggagccgggggcctcgccggtcccgtcggcggccatggccggtggtgtcagcccctgcggcagggctgtcacggctgtggcgaccgcgagcgcccccacgaatctgcgtcggctccagaacgtagtctgcatgtcctcttccacccgtcgggccggccggtgaccgggctgtcgtcgccaggggggaggggtgccacgtccaacggtgccccccggaccacgcccacgggcgccgccgtgccgagggagcccgccgccgaccgcggccccgctgtgcacatccccccgttcgcacatcgccccccagcagatcagaagttgactgcaacggccagggatttgtgaggtaactgtcatgcagggaaagcgacttgcaatgcccggggccaaaagctaggagtgtcgccatgggccccggggaccagcccacgagggctgcggagctgtccgtgcccacctacagccgtttcgcaccacaccggcagcccgaccaccgtcaccgcggaccgtcgccgggtggatcctgacccacctcgacaccctgccggagaacgagcgattcaagctgaggtcagtgctcgcgcactgccctgaactggaagcgctcacccgccacgtccgcgcgttcgggacggtgagcaccgagctccgaggcgaccggctcccgcagtggatcgaggcggtggcgccgacgacctgccgagtctccacgtcttcgccaacggcctggaacgagaccttgccgcggtcaccgccgggctgaccctgcccaggagctcgggcgtagtcgagggccacgtcaacttgtgccgattggcagctactccacgagaccgaagccgtccgggaacgcttccaggaattcacggcggccgggatcggtctcggcctccgtcatcgcatcgatcacctgctggaactctccacgctgggagtccgacaggcgatccaccactgcggcgacaccgtccagtgccttcaccgcatcgttctgatccatgtgctcatcatccgcgctctcgacgaaccagacgaggtccacaagcgcctccgccagggcgcgggacagcgacgggtactgcgacatggaagacccccaggtgatggctgcagaactctccgcgcaccccatcacatgcggctgacaacgctcactgtcgcctcgccgcagaagttggaccagcaccgcttgtgtacaaagccactcgatcacatccttttccgggaatccccatcaacgggcttctaggatctgtgcatccggatcccgagttgctggaacagatcaccgcggcgcgcggaactcggcgaactcgacgagcaaccggccaagctgttgacacggagatgcgcgccgaacggggcgaactcctcgtccctgagcgagtcgtcgagcaggatcgacttggccctgccgcgccgtgccgtgccgcgccgcgatcggcgtctggccgatctggccggcggcaacagcctctccgatgtccgccgtccactgctggcgcgacgaactgatctccctgctcgccgcgcaggccccgctcctggaccgcgccttggagaaggtgatcgtcaccggcttcgccgcggcccgcgcccgcgaacccaccctggccagaaagacgccaaccgcgtcctcgccgtctaggtgtcactctggtgctgcgggcccgccccgggaagagcggggcgtgcgacagcgtcatgctgacggacgtgacgatcaccctggtgtctacaggcggatgtcgagtcgtacctccggctgagcggcgcgcagcgtgaccggttcggcgcgcggggagtgctcgggcgccgacacgacgacgatgtggtgccccggccgcaggctgagccggtagcggcccgcgtcggtgtacgtgtgggcgatccgctgcccgcgggcgttcacgacggtgatccgggccgagcagccacccggg

SEQ ID NO: 1381 - DNA, 550 bp, Unknown
  Kingdom: Bacteria, Phylum: Actinobacteria, Class: Actinobacteria, Order: Streptomycetales, Family: Streptomycetaceae, Genus: Streptomyces
  misc_feature (240)..(351): n is a, c, g, or t
acaccggcggcaccctggacaagctggagtccatccccggctggcgcgccctgctgtccaacgaggagatgctgtccgtcctggacggcgtcggcgcggtgatctgcgcggccggtgacggcctcgcgcccgccgacaagaagctctacgccctgcgggacgtgaccggcaccgtcgaggcgatcccgctgatcgcctcctccatcatgtccaagaagatcgccgagggcaccggctcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatgctggacgcggccggcctcaaggacgccgaccccgccaaggccctggccgacggctccgcgatggacgtctggcgccgcatgatcaccgcgcagggcggcgacgcggacgcgccgctgcccacgtcgaaggaacagcacgtcgtcacggccccctcctccggcgtcctcacccgcctcgacgcctacggcatcgg

SEQ ID NO: 1382 - DNA, 821 bp, Unknown
  Kingdom: Bacteria, Phylum: Actinobacteria, Class: Actinobacteria, Order: Streptomycetales, Family: Streptomycetaceae, Genus: Streptomyces
aaaccggcccggcccagccgcctctggtgcggctgggccgggccggtttctccaccgtcgtttttcagcgcgtcggagcggagcgctcgcgcgtcgcgcgtgcgaggctgtgacgacggtcctggaggcatatgacgctcagaggcatatgacgctcaggggtgggggaggatgtgccgcagacatggggagggccccggcgccgtgcggcgccggggcctgtcctcccctgtgcgacccggagccccgagctctcagggtcgtccccctcggaccgcttttccccgagtggtccgcctcccgttgaagatctcccctcggcggcggcgatcattccttgtggggggtcactcgaacgaggggtgttcgtgaggcaagcggcattttcgaatgagcattcgataatctggtgagggcaacacggctctgtgaacggccgggaagggccgggaccgaccgggtggggccggaaagggccgggcccggtcgggaacgggaggccggggcggagccagggcagagctagggggtgccgggaccacatggcgcgacgcatcgatgtgaccggggcgggcggcgtacggctggccgcctgggagttcgccgagcccccgaaggggccgccgttcgtaccggcccaggccgtggcgtaccggcacgacctgccgcagcagctgccggggccgcccgatccgcccgcaccggcggacggaggcgcggccgggcggagcggcggggtgctcttactccacggactcatgggccgggcctcgcactgggcgccgacggcccgctggctctccgagcggcaccgggccgtc

SEQ ID NO: 1383 - DNA, 5548 bp, Unknown
  Kingdom: Bacteria, Phylum: Actinobacteria, Class: Actinobacteria, Order: Streptomycetales, Family: Streptomycetaceae, Genus: Streptomyces
cctcgcgcgcccggcggctctcgtccttggcccgccgggcctgctccttccactcctgcttgacgcggcgcatctcctccttggcggcgcgccaggcctccttgtcgtcggccccggcagcaccggcgtgctcctgggcgcccgcaccgccggtggagccctgccgggcctgcgaggccgccgcgcgcatctcgcgccgcagatcgcccgccgcgccgcgcacgtcggcccggatctcggcggcgagttcggcgaccgactcgcggatctccagttccagatcggccagttcaccgctgcggtcggccagttcggcgcggcccgcgtccgtgatggcgtacaccttccggccgccctcggtggtgtgggtgaccaggccctcggcctccagcttcgcgaggcgggggtagacggtgccggcggagggtgcgtacaggccctggaagcgctcctccaggaggcggatcacctcgtagccgtggcgcggggcctcgtcgagcagcttgagcagatagaggcggaggcggccgtgggcgaagacgggaggcatgtcagagcaccttcttgtcggtcgtaccggcgttcgtgtcggcggggccctcgccgcccggccccgcgtcccaggagccgtcctcggccggcgggcgccgcagcagggcgatggagccggagaccgtcgtcgccttcagcctgccccggcccgtgcccagccggcccgtgatccgcttggcgccccactggccgctgatccggaggtcctcgaaggcgttcgagaccgaaccgctcgccgtgttggcctccacctccgcgtcggccgggtggggcaggcggatggcgatctcgccggacacgttcgtcaggctgatgtcggtgggggagaccgcccggtcgaggtcgacgatcatcgatccgctcaccgagtcggcccgcaccgaggagccggagccctcgaccagggtcaggtcgccggagaccgacttgaaccggaggtcgccggagagggcctgcgcctccacgttccccgagacggtgtcggcgcgaaccgggccggtgacgccgaccagggtggtgtcgccggtgacgcccttcacctccgtacgcccgtcgatgcccgagaccatggcggcggcgccgacgaccccgacctcgacgtgggtgctcgccgggacggccagggagatcacggcgctgcgctgccagcccttgcggtcgagccacttgaggaagcccttccagggcaggtcctcgtaggccacggtcagggtgtcgccgtgctgggtgacgatcaggggcggtccctcgatccgggagacctccatgcgggcggaaccgtcgtccgtgcccacgacgttgaccgttccgtggacgatgcggacgttcagctgtgtcaggggctcgtcgaaggtgagcttgacgggctcgcccacggaccactcggacatggtgcagacctcctgggacggaccggaccgcgcgggaccgcagggccggagacgggaccgggacagtggagcgacgggcgcgaccgacgtgacacgccatatcgcgtccttcactagacacgatatatcgcgtacacggaaagtcaagacacaccgcgaaaacgcgagcacggcacaccgtgcaacgcgacagggccgcctgcggaaacgcgaaaggcgcccccgcaggggcgcccgtcccgactcgccgcgaccgctcgccggtccctactcgtcgtcgtcctcgtcgtcgtccagccgtgccagccaggtcgccagccgttccaccgggacctcgaagtccggattcaggtcgacgaaggtccgcagctgctcggcgagccactcgaaggtgacctcctcctcgccccgcctcttctccagctcttcgatgccacggtcagtgaagtacatgaggtcaaggatagaggcgccggaagggcgcggaaacggccgggccgcacccccggcgaagggggtgcggcccggtcaggtgcggcccgcgggagcgttgccgccccgcgcagcgatcacgatctcgcagcggtcacgcagcggtcacgcggtcacgcctcgaacacctcgcgcaccagctgctcctgctcggcctggtgccgcttggcggaaccgacggccggcgaggaggagtgcggacgcgagatgcggcgcagccgctcgctgtgcggcacgtccgcgccgaccgccaggtccaggtggtcgatcaggttgagcgcgatgaacggccaggcaccctggttcgccggctcctcctgcgtccacaggtacttctcggcgttcgggtacttcttgatctcggcctgcagctccgcacccggcagcgggtacaggcgctcgacgcggatgatcgcggtctccgtgtcgccgcgcttcttccgctcggcgtcgaggtcgtagtagaccttgccggcgcagaagacgaccttcttcacggcgttcgcctcgaccgagtcgtcgccgatgaccggacggaactggcccgacgtgaactcctccgtcttcgaggcggcggccttcaggcgcagcatcgacttcggggtgaagacgaccagcggcttgtggtgcgggttgtgcacctgccaccgcaggaggtggaagtagttcgacggcagggtcggcatcgcgaccgtcatgttgttctgcgcgcacagctggaggtagcgctcgatgcgggccgaggagtggtccgggccctggccctcgtagccgtgcggcagcagcagcgtgacgccggaggtctggccccacttctgctcggcggccgagatgtactcgtcgatgaccgactgggcgccgttggcgaagtcgccgaactgggcctcccacatgaccagcgcgtccgggcgggtcagcgagtagccgtactcgaagcccatgaccgcgtactcggagagcagcgagtcgtagacgttgtagcgggcctgctcgtcggccaggtacagcagcggcgtgtagtcctcgccggtctcgcggtcgatgagcaccgcgtggcgctggccgaaggtgccgcggcgggagtcctggccggagagccggaccgggacgccttcgaggagcagcgagccgatggcgagggtctcgcccatgccccagtcgatggtgccgtcctcgaccatcgccgcccggcgctgcagctgcggcagcagacgcgggtggacggtgaagtggtcggggatgttgacctgggactcggcgatgcgcttgacgacctcggcggagatcgcggtgctgaccgcgaccgggaagcccgcctgcgggtccggggactgcggggcggccggctgcgaggtggcctcgcggacctcggtgaagaccttctccagctggccctggtagtcctgcagcgcctgctcggcctcttccagggtgatgtcgccgcgaccgatcagggactcggtgtagagcttgcgcaccgagcgcttcttgtcgatcaggtcgtacatcagcggctgggtgaaggccgggttgtccgactcgttgtgaccgcggcggcggtagcagatgaggtcgatcaccacgtccttgttgaacgcctggcggaactcgaaggcgagccgcgccacgcggacgacggcctcggggtcgtcgccgttgacgtggaagatcggggcctcgatcatgcgggccacgtccgtggcgtacatcgaggagcgcgaggactccggggcggcggtgaagccgacctggttgttgatgacgatgtggaccgtgccgccggtgcggtagccgcgcagctgcgacatgttcagggtctcggccaccacgccctggcccgcgaaggccgcgtcgccgtggatcgccaccggcaggacggtgaagtccgtgccgcccttgttgatgatgtcctgcttggcgcgggagatgccctcgatgaccgggtcgaccgtctccaggtgggaggggttcgcggccagcgagaccttgatctgctcgccgtccaggccggtgaaggttccttcggcgcccaggtggtacttcacgtcgccggagccgtgcatcgacttcgggtcgaggttgccctcgaactcgcggaagatctgcgcgtacgacttgccgacgatgttggcgagcacgttgaggcggccgcggtgggccatcccgatgacgacctcgtccaggcgcgactcggcggccgagtcgaggaccgcgtcgagcagcgggatgacggactcgccgccctccagggagaagcgcttctggccgacgtacttcgtctgcaggaaggtctcgaaggcctccgccgcgttcagccggcgcaggatgcgcagctgctcctcgcgctccggcttggagtgcggacgctccacgcggtcctggatccacttgcgctgcttggggtcctggatgtgcatgaactcgatgccgaccgtgcggcagtacgagtcgcgcagcacgccgaggatgtcgcgcagcttcatcatcgacttgccggcgaagccgccgacggcgaactcgcgctccaggtcccacagggtgagcccgtgctcggtgatgtccaggtcggggtgcttgcgctgctggtactccagcgggtcggtgtcggccatgacgtggccgcggacccggtaggagtggatcagctcgaagacgcgggcggccttggtgacgtcgtcgtcgtggctggcgtcgatgtccttgagccagcggaccggctcgtaggggatgcgcagcgcctcgaagatctcgtcgtagaagccgttctcgccgagcagcaggttggcgacgacacgcaggaactcgccggaggcggcgccctggatcacccggtggtcgtaggtcgacgtgagcgtcatgaccttggagatgccgagcttgttcagggtgtcctggctggtgccctggaactccgccgggtagtccatggagccgacgcccatgatcaccgactggccgggcatcagacgcggcacggagtggaccgtgccgaggccgccggggttggtgagggagacggtgacgccggtgaagtcgtccatcgtcagcttgccctcgcgggcgcggcggacgatgtcctcgtaggcctgccagaactcgaagaagttcagcgtctcggccttcttgatcgccgcgacgacgagctggcggtcgccgttgggcttcaccaggtcgatcgcgagaccgaggttggtgtgctccggcttgaccagggtcggcttgccgtccttctccgcgaaggagtggttcatcgacggcatggccttgatggcctggaccatcgcgtacccgatgaggtgcgtgaaggagatcttcccgccgcgggcccgcttgaggtggttgttgatgacgatgcggttgtcgaacagcagcttcaccgggacggcgcgcacggacgtggccgtgggcagttccagggaggcgttcatgttcttggcgaccgcggcggacgggccgcgcagcgtcacgaactcggggcccgcgggggcctcggtggcgggctcggccttcgccttggcggcggcgggcttggcggcggccggggccggcttcgcgggggccggagcctgggcggcgggcttggccggagccggggcggcggcaggggcgggtgc

SEQ ID NO: 1384 - DNA, 744 bp, Unknown
  Kingdom: Bacteria, Phylum: Actinobacteria, Class: Actinobacteria, Order: Streptomycetales, Family: Streptomycetaceae, Genus: Streptomyces
cgagccgacgacgtacctggacatccagcaccagatcgacgtcctcgacctgtgcgccgaactgcacgaggagcaggggcgcaccctggtggccgtgctgcacgacctcaaccacgcggcccgctacgccacccacctcgtcgccctgcgcggcgggaaggtcatcgcccagggcgcgccggacgagatcgtcaccgcggaactggtcgaggaggtcttcgggctgcgctgccaggtcatcgacgaccccgagacgggcacgccgctggtggtgccggcggcgcgcaaggcacgcgcgcgcgtcacggccgagtaggggccgcgccccgggcaggggccgggaaagcggccgaagcggccccggggaaccgcgtccggagagcggtcacagcagctttctgagccggaacaggtccagcaggcccgcctccagtttcacccggcccgaggcccaggcggtggcgaagttcagcccgccgccgaccagcgcgaccaggtcgtcgcccgccatggcgagccggatctgggccttctcgggcggcggccccggcacggtgtcccgcacatcgatccggccgccggtcagacggccggtgaaggtgatgtcgagatccgtgatgtggcagctcaccgagcggtccagcgccgcggcctcgcggaccttcccgtccgcgtccgccatgctgtccgagagcttctcgagtgcggcacggcactcctcgatcgtggccatcgcgaccgacg

SEQ ID NO: 1385 - DNA, 2396 bp, Unknown
  Kingdom: Bacteria, Phylum: Actinobacteria, Class: Actinobacteria, Order: Streptomycetales, Family: Streptomycetaceae, Genus: Streptomyces
gccgaagacgaagtcgagcgcgtcgcgggccagccccgagtcgtcgcccagcaggactctgccgtccagggcgtgggtgatctgggcgaccgtcggcgcggacagggcgggctcgtcgggcacgacgaagcagggcacgggcaggcggccggtcagccgcccggctatctcgtcgcggtcctcccgggccacccggttggtgaccatggccagcacgtcgcagcccaggccgtcgtaggcgcggaaggcgttgcgggtctcggccagcaccgactcggggctctgcccccggccgccgacgacggggatcaccgaggcgccgaactcgttggcgagccgggcgttgagcgacagctcgtccgggagctgtgtggcggcgaagtcggtaccgaggacgaggacgacgtcgtagtccctggcgacctggtggaagcggtcgacgagggtggagaccagctcgtcggtgccctgctcggcctggagggaggacgcctcgtggtaggccatgccgtagacggtggcggggtcctgggtcagccggtagcgggcgcgcagcagttcgaagaggcggtccgggccgtcgtggacgagggggcggaagacgcccacccggtcgacctgccgggtcagcagctccatgacacccagctcgacgacctggcggccgtcaccgcggtcgatgccggtcacgtacacgctgcgggtcacgcgggctctccgtttcgtcggggcgggggtgcgctgtcgatgtgcgggcggcgggggacaaaaatcgcccaccgaggtgagcggaaccctcttgacaatacctccgccgctggataaggcgcccgtcaagagagcgggggctcagggcaggcggccggggcgcccgtcaagacgtaggcgcccccgggacgtgaaacaatcggacaggatcaccggtgtcaacagtgggcaggagacacagcacgatgcgtatcggagttctcacggcaggcggcgactgtccgggactgaacgcggtgatccggtcggtggtgcaccgggcggtcacgacgtacggcgacgaggtcatcggtttcgaggacggctacgccggcctcctcgacggccgctaccgcgagctggacctcaacgcggtcagcggcatcctggcccgcggcggcaccatcctcggctcctcccggctggagcgcaaccggctgcgcgaggcgtgcgagaacgcctccgacatgatccaccggttcggcatcgacgcgctcatcccgatcggcggcgaaggcacgctgaccgcggcgcgcatgctctcggacgccgggctgccggtggtgggcgtgcccaagacgatcgacaacgacatctcctccaccgaccgcaccttcggcttcgacaccgccgtcggcgtggccaccgaggcgatggaccgcctcaagaccaccgccgagtcccaccagcgcgtgatggtcgtcgaggtcatgggccggcacgcgggctggatcgccctggagtccggcatggccgccggcgcgcacggcatctgcctgcccgagcggcccttcgaccccgccgacctggtcaagatggtcgaggagcgcttcgcccgcggcaagaagttcgccgtcgtctgcgtcgccgagggcgcgcaccccgccgagggcagcatggactacggcaagggcgccatcgacaagtacggtcacgagcgcttccagggcatcggcacggctctggcgtacgagctggagaagcggctcggcaaggaggccaagccggtcatcctcggccacgtccagcgcggaggcgtacccaccgcctacgaccgcgtcctcgccacccgcttcggctggcacgcggtggaggcggtgaccgagctgaagacggtgccgaaggaccgcatggacgaggcggagtcggtcttctaggccttccctaccggcgccttcctggggtctccctacggggctgcctcgacccgcgtccagaagtgctccacgatccggtcgaggaagtcccggccggcgtcgcccgcctcgccggacgcgctggtgccgccccagctcagcgaggcgaccatctgcccctggtagtcctggtgcagctgctgcaggaccttttccagcaccggccgctccagcggcaccaccttgcccaccgggcggacgtacccctgccagcgggtgccgacggcgctgcgcagcagcccggcgagctgctcctcgcgtccggtgacggagacgaagtcgggcagcgacagggcgagcacgtcggccagcgcggccgactgccgctcggtgccgcgccagtcgtcgcgctcctccatccgcaggtagcggggcgcttcgagacctacggcacgggccacgtcctccggccgcagaccgcgcgcgatgcggtgctcgcgcaggctgcgcggc

SEQ ID NO: 1386 - DNA, 1614 bp, Unknown
  Kingdom: Bacteria, Phylum: Actinobacteria, Class: Actinobacteria, Order: Streptomycetales, Family: Streptomycetaceae, Genus: Streptomyces
cccgccgccgaggatgagcagcccgctgatcccgccgtcgctggtgcggatgcgtgcggtcaaccgcggtctgctcatcctcggcggcgggttcctggtcttcagcggcttctccttcgcggtcccgctggcgctgcaggacggcaacggcatgagcgcggtcgagtccggtctctcggtggccccgctggccgtgggcgccttcctgggctcgctgcgcgcgccgaaggtcatggccaaggtcggcacccgcaccgtgcaggtcggtgccgtgatcatggtcgccggtctggcgctgctgatcggcgccaccaagctgtggtggccgcacatccacttctacgagctgatcgtcgcgatgttcctggtcggcatcggcaacggcctgttcatcccgccggtgttccgcgccatcctctcctccctgccgccggaccaggccggcgccggcagcgggatcatgtcgaccacccagcagacctcggtcgccgtcggcaccgccgtcctgggccaggtgttcatcagcttcgccgcgggcggcggcatggacacgggcttcaccgcggtgaccgcggcctacctcgcggtcggcgtcctcatcgccctcttcggcggcgcggccctgaagcagaagaccgccgactgacccaccgtccgaactccccgactccaggaagcggcagacatgttcatcggcgacctgtacctcaacggctgcgcagtgtcctatcccgccacacgcgtccccgtggccgaggccctggcgcagggactgatccgcgatgccgacgagaccctcggcaacccgtccgtgcccgtcttcgacgccggcggcccggtcgccgacatggccgtcgacgccctgcgccggtcgctgaagtcggccggcaccgaccccctcgacgtggacctgctgctgcactgcggctggtggcaccagggctacgacatctggagcgcggcccactacgtcgcccaccagaccggagccctgggcgccgtaccggtcaacctctcgcagggctgcaacgcgcccatggcggcgctcgaactcgccgtgcgctccctgcgcgccgacccggcgctgcgcaccggcgcggtcaccgcgtccgacgccatgcagttcccgcaggtcgaccgctggaacctcaactacggctgcgtgcacggcgacgcgggcaccgccatgctggtggcacggacgccggccgagcggggcgccttccgcatcctgtccctcgccagccgggcggcccccgagctggaggccatgaaccgggccggctacaccccgaccccggggccggcgctgcgggacggcggcaccgtcgacctgaaggcggccaagaaggcgtacctcacgcagtacggcatggaggggttcatgggccgctcccgcgaggccctgaccggctgcgtccgccaggcactggaggacgcccggctgaccggcggcgaggaccggatccgcgtggtctccgtgccccggctcagcggcaagatcttcgagaccgtctaccgcgcccagctcgccccgttcttcggcgaggacaagctggtctggtggggcgaccgcaccgcccacctgggcgtcgccgacgtcggcgccaacat

SEQ ID NO: 1387 - DNA, 2411 bp, Unknown
  Kingdom: Bacteria, Phylum: Actinobacteria, Class: Actinobacteria, Order: Streptomycetales, Family: Streptomycetaceae, Genus: Streptomyces
gaggtgcagccgcagccgggccgcgagttccgcgacggacagcggcaggcggcaggcggcgatgatgtcgtgctgttcgaaggagaggccgtccagggccgcgagcccggcggcggctgcacctcaacgtggtgcgggtcctcgccgaggacctgcgcgccgaggggcggctggcggtgcacgtgcccgactccggcgccgtccacgacgcctccgtcctgcgcagggttatcgatggcctgcgggccgtccccgactcccgtggagtaactccgtgacaccgaccgaacaactcgcccgcggtaccgccgcggcggccggcccgagcgccgcacggccgccgctgccggtcaagatggtgatcgcgggcggcttcggcgtggggaagaccaccgcggtcggctccatctccgagatcgagccgctgaccaccgaggcggccatcaccgaggtcgccgccggcgtcgacgacctcacgcacaccccgcgcaagacgaccaccacggtcgccatggacttcggctgcatcaccatcgacccgaccctgaagctgtacctgttcggcacgcccggccaggagcggttcggcttcatgtgggacgacatcgtggagggcgcggtcggcggcctcgtcatcgtcgacacccggcgcctggacgactgctacgcggccgtcgactacttcgagcaccggcagatcccgttcgcggtggcgctcaacgccttcgacggccgggtggaccactccctggaggaggtccgctgggcgctcgacgtctccgagcacgtcccggtgctcgtcttcgacgcccgtgaacgcggctcggtgcgggacgcgctgctggtcgtactggaactggcactggcccgcaccgaggcctgaccaggacgcgtacgtgaaccagggcccgggggcggcgagaaccgcggcccccggccgccctcgtcacgcgccgcgccgtaccccccgtgacaccgcgagccgcgccgcggcccagaacaggacgagcgtcgcgagcgccagcatcgcgaccagggtggcgccgcccaccaccttctcgtagttgcgctggtagagcccgtcgatgacgtagcggccgaggccgccgatgccgacgtaggcggcgatggtcgccgtggagacgatctggatggcgcccgaacgcaggccgctgaggatcagcggaagcgcgacgggcagttcgacctggaagaggatccgcgactcctgcatgcccatgccccgtgccgcgtccaccggcgacgggtcgacggagcgcatcgactcgtaagtggtcaccaggatcggcgggacggcgaggacgaccagcgggaccatgacggggaccagaccgaaaccgaccagcatggtcatcagcaccagcaggccgaaactgggcagcgcccgaccggcggtggccaggaacgcgaggacgttgccgccgcgcccgtagtgcccggtgaccaggccgaccggcagcccgatggcggcggcgatcgcgagcgcgatcaggcagtagcgcaggtgctcgaccaggcgggtggggatgccgtcgtagccgtgccagtgggcgctgtcgctgaagaaggcgttgacgaagtgcagtacgttcaccgggaggcgtcctccagtgcgggcgcggccggctccggccggtcctcggcggccggaggcccgctgcggcgtgagccgcgcggcatccacggggtcagcaggaaccgtacgccgaccagcgcggcgtcgacgaggatggcgaggacggcggtggtgaccacggagttcaccgccagctcgggccggtggtagatgttggcgtcgttgagcaggttgccgagcgcgccctggttgccgatgagcatgccgacgctgaccagggagatgctcgacacggtggccacgcgcagcccggcgaagatggcgggcaccgcgatcggcaactgcacctggaagtaacgccgtacggggcccagccccatcgcggtggcggcggccagggtctcctgcggcaccgcgcggacgccgtccacgatggccgggacgagcacgaccaggctgtagacggcgagcgggatcatgacggtcagctcggtctggccggtgtagtcgatgaggaagacgatgaaggccagggacgggacggcgtagagcaccgtcgtcaggccgagcaccggcgggtagagccagcgcaggcgcacgcacaactgggcgatcggcagggagacgaccaggcccgccaggaccggcagcagcgcctcgcgcaggtgcagtccgatcaggccgaaccagctgtgctggaggtcgctcgggaggtcgaagaagcggttcatcggacggccttggcgtccgcgccggtgtccgcgccggccgccgcgcgcccttccgcttccgcgcgccgttcggcgtccgcacc

SEQ ID NO: 1388 - DNA, 786 bp, Unknown
  Kingdom: Bacteria, Phylum: Actinobacteria, Class: Actinobacteria, Order: Streptomycetales, Family: Streptomycetaceae, Genus: Streptomyces
ccgttcctcacccggcgcaccgccgaccccaccctgttccgcggcaccgaggtcgtcgaacagaccggacggcccggggtgcgccgggtcacgtacgcgctgcgcaccgtgaacggcgtgcgccagcggccgcggcgcgtggagtccgcggtggtgcgcgcgccccgcacgcagatcgtgagggtcggcacccggccgcatccgccgtcggtgcgcggcaccgaccagctggactggcaggggctggcgcagtgcgagtccgggggccggcccgacgcgcaggacccgtccggcacctacggcggcctctaccagttcgaccagggcacctggcacagcctcggcggcaccggccgtccccaggacgccccggccgaggagcagacgtaccgcgcgaagaagctctacgtacgccggggcgccgctccctggccgcactgcggcgaccgcctgcgcccgtgagctgccggggaagggcggggcagcagccggcgccccgtacccttgtgccgtgagcagccccctccccgacgccctgctgggccccgccgacgtccgcgagctggcggcggccctcggcgtgcgccccaccaaacagcgcggccagaacttcgtgatcgacgcgaacacggtccgccgcatcgtccgcaccgccgacgtcaccccgaaggacgtggtcgtcgaggtcgggccggggctcggctccctcacgctcgccctgctggaggccgccgaccgggtcaccgcagtggagatcgacgacgtgctcgccgccgcgctgcccgc

SEQ ID NO: 1389 - DNA, 1097 bp, Unknown
  Kingdom: Bacteria, Phylum: Actinobacteria, Class: Actinobacteria, Order: Streptomycetales, Family: Streptomycetaceae, Genus: Streptomyces
gcgcggccgtcgcccgccgcccgccgcaccggcgttccgggaccgcgcagcaccgcaactcccctggcggcggggcggatcggggcatcggcgatgatcatcgggtgcacacccccacagatcaccccccgcgcactggcgcccgtacggcaggacgcccggccctcctcctcgccctgctcctcctgctgctcgccggatgcgcgggccggacggacggcggtgacggcgacggcggcggctcggcgaaggacggctccccgggccgcagtacgggctcggcgggcgccgccaccgcgaccccggcggcccgctggcagccccggcccggcaccacgtggcagtggcagctcagcggccggctcgacacctccgtcgacgcggcggtctacgacatcgacggcttcgaccactcgaaggagaccgtcgccgggctgcaccgcgcgggccgcaaggtgatctgctacgtcgccaccggcgcctgggaggacttccggcccgacgccggcgagttccccggggcggtgctcggcaagggcaacggctggaagggcgagcgctggctcgacatccgccgcaccgacgtactggagccgctgatggcggcccgcctcgacatgtgccgggacaagggcttcgacgcggtggagcccgacaacatggacggctacaagaaccggaccggattcccgctgaccgccgccgaccagttgcgctacaaccgcctcgtggcctccctcgcgcacgagcgcggcatgtccgtcggcctgaagaacgacctggagcagatcccgcgtctggtgggggacttcgacttcgcggtcgacgaacagtgcgcgcagtacggcgaatgcgccgccctgaagccgttcgtcgcggccggcaaggcggtgttccacgtcgagtacgaactgcccgtcagccgcttctgcgcacagtcacgcagcctgaggctgagttcgctgctcaagaagtacgagttgggggcgtggcgccaggcgtgttgaagccgggaccgaccgggccttcgaaggcggcggggcccgcggccgggactgagggcgtgccgggggcggccagccacaggccggtgaccg

SEQ ID NO: 1390 - DNA, 2565 bp, Unknown
  Kingdom: Bacteria, Phylum: Actinobacteria, Class: Actinobacteria, Order: Streptomycetales, Family: Streptomycetaceae, Genus: Streptomyces
ggctacgagcagcggatcatggtcggcggcggactgcgccttgagcacctgccgccgctgcgcgccgccgggatcgacgccttccacatcggcggcgcggcccggtccggcggctgggccggagcggtctgcgccgacgcggtcgcgcagtggcgttcggtcctggacgggcagaccgtcccgcagctcgcggtgtgagccatgcgggccctgccctgcgcgccgtgtgcccgccaggagctgatgcgaccgcgccgcggggtggtcaggccagctgcgtcgggagcggggccgtgtgggtgacgatcaggcctgagacggcacgggtgagggccacgtacagacggcgcaggccggtgcgttcgtccggttcgccgtcgaccaccgcctgcgggtcgtccaggacgacgtagtcgtactccaggcccttggcgagggaggccgggaccagcgtcaggcgggtctcggccgtcgtctcctcgccgggggccaggtgcgtcaggcccgccgcggcgagggcttcggccagggccgggatccgggcgtcggcggcgatcaggccggtcgacccctcctggcgcagcagctcctcgcaggcggcgaccacgtccgcgtcgccctcggccggccggatccggaagaagcccgggttctcacggaccgaggcgaccggcgtgagtcccggcgcgatgtgcgggagcagccgggaggcgtacgtgatcacgtccgtcggcacgcggaaaccggccgtcagctcctcgatgacaccctcggacttgccgaggtgggccagcgcctcctcccaggtgcgggtcgcccacggcgtggtgccctgcgccaggtcgccgaggacggtcgcggaaccggtggtgcagcgccggccgaccgcgcggtactgcatgggggagaggtcctgcgcctcgtccaggaccacgtggccgagggagtgggtgcgctccaccaggtcggtggcctcgtcgatcagcacggtgtcggccgccgaccacttggcggacttcaccgaccgcaccggcttctcccacaggatcgtcttctgttcctcgccggtgaggaccccctcggcgtgctcggcgaggaagtcggcgtccgtgagcagccgcagcaccagcttggccgggtcgaccggcggccagacggccttcacggcggccttcaccgccaagttgcgggccacggtgtcctggacgcggtcgtcgggggcctcgccggcccgttccatctgcaccagcacggcgtgcgcgatgcgctgcggcagggcctcgcgggccgcgccgtagcggatgccgcgctccagcaactcccgtaccagcttctccagttcgtacgccgggacgcgccagcggcgcgagccgcgcaccaccacgaccggttcggcgggcatcgtgacgtgcgagtacagcgccctgcgcagcacctcggccatgcgcgcgtcgcccttgaccagcgccgccgccgcgtcgtccgtgccgcgcacctcggcatgggcgaccaggtcgtccacggtcgcctgctgcacggccagctcgccgagggccgggagcacctgctcgatgtagtgcaggaaggaccggttcgggccgatgaccagggtgccggtgcgggccaggcgctcgcggtgggcgtagaggaggaaggcgacccggtgcagaccgacggcggtcttcccggtgccggggccgccctggacgcagacggtgccgcccaggccggagcggacgatctcgtcctgctcgggctggatggtcgcgacgatgtcgcgcatcggtccgacgcgcgggcgttcgatctcctgctggagcagtttgctggtggtcgccgcctcggcggggtcggacaggtgctcgtcctcgtacgcggtgaggtcgccgccggtgtatccgaagcggcggcgcagcccgacgtccatcgggtccttcttcgacgcccggtagaacggctgcgagaccggcgcgcgccagtcgatgaccatggggtcgccgtcggcgtcgtgcacatgccgccgaccgatgtagaagcgctcgccgtcggctccctcggcctggtcggcgcccggggcgtgcaggtagtcgaggcggccgaagaacagcggggtgtcgctcaggtcggccagcgccttgatgcgctcgtcgatctggcgggcgagcacctcggcgttgacccagttcgcgctgacgtcgcggatgtcgagcgactggacgtcctcgcgcatggcacgcagggcggcgcgggagtcggtcaggtgggagcgctcacgggcgagcgggtcgtcggcggggggtgcggcgggcggtgccggtgcctcggtcgcctgaggcgcggcgggatgtgcttcgcgtgcttcggggtcggtgggcgtggtcgacgacaagggggtgcctccggatgacctgcgggacgggcggcgcggcgcggcgccgtgcgcgcggctgcgggtgacgcggtgccgtgcggcgcgggcgcgcgggaactgccggccggtttccgtccggtcggcggcactccgtggggaggcgggcaagagcggagattgtagagggccggggg

SEQ ID NO: 1391 - DNA, 689 bp, Unknown
  Kingdom: Bacteria, Phylum: Actinobacteria, Class: Actinobacteria, Order: Streptomycetales, Family: Streptomycetaceae, Genus: Streptomyces
ccctggaggtgtacccctcctccgtggggccgggcgggcaggtcaccgtgaacaccaaggcgtgcggcgagaagtcgtcggcggcgggcgacgccagcgcggtgggcgcggggcccttcccgctggcgccgagcacgcacgagggcgacgcgatcggccagttccgggtgccggagagcgcgcagccggggacgtacgagatcgtcgcggagtgcgccgagggcggccgggaggtcaggggcgacctggtcgtcacgctgaccgcggcgcaggggcagcaggtggagccccgcggaagtgtgaagacgggggtcggtggcgccctgggccacgaccccgtgcagaccgcggccggcgttgcggcactcgccgtcgccgccgcgggcggtacctggctcctgcatcgccgggcgagaggcgacgggatctgacggacaccctccgctgtccgtccgccggtaccgcacgtcccctccccctccgggtgcgacgcccctcgtgacccggaggggggcgggggacacgaccgcagtacccgtccgggagaggggttgccatgcgcaggatcggcgactgtgcgatagcggccgtcaccgtcgtcagcctcggctgcggcgtgtggctgctgaacggtgcggacaccacgcacgccccgccccagcccgccgcggccgagggcacgcccgacc

SEQ ID NO: 1392 - DNA, 584 bp, Unknown
  Kingdom: Bacteria, Phylum: Actinobacteria, Class: Actinobacteria, Order: Streptomycetales, Family: Streptomycetaceae, Genus: Streptomyces
ggcgacgaccgtccggctgccgactcgggtcgcggcctcctcgtcggcccatcgctccaggacgaagccaccggccccggccagcggtcgcaggagggggttggctgccgccgtgagtcgccacacggtctggaaacggtggtggcgtccgctgagatgggcccgttcatgcgcgaggagggcctcgcgctccgtgtcagcgagacagcgcagcatcccccgggacaccactatccgtccgggggcaccgggcagcgcgaacgcctgagggacctcgtcgtcgatcaccgccagctcggtgtctccgggcattcggccgcattcccgccgggcccacaggacgtggcggacctgctgcacggcggccacccccagtgacacgagcccccacaccagggtcagggcgctgaccgccgcgacggtcagggagacggggtcctgtgtccgcagcacggtcaccgaccagtggccctcctcggccacctcggggatctgcgcgaaaccggtgaacgccagcagggccagggagccgagccagccggtcgccgccacgagcgccgcacacgccagggaccaggccgcgg

SEQ ID NO: 1393 - DNA, 3158 bp, Unknown
  Kingdom: Bacteria, Phylum: Actinobacteria, Class: Actinobacteria, Order: Streptomycetales, Family: Streptomycetaceae, Genus: Streptomyces
gatcgctggcacttccgaagagtgcccaacaatggagctaaggtgaattgaactcctgacctcctgcatgcaatgcaggcgctctactaactgagctatagccccttccttcgttccccgctcggcggggcgaacaagaagaattttagcctgcgacctgccggaaagtgaaatccgggtcccgcagggccagggggccaccggaagcgggcccgcccatgcgtccggcggcccgagacgcacccggccccggcggtgccgccgggccgggtgcgtcgcgggccggcggacgcatgggcgggcccgcttccggtggccccctggccctgcgggacccggatttcactttccggcaggtcgcaggctaaagttcttcttgttcgccccgccgagcggggaacgaagcaaggggctatagctcagttggtagagcgcctgcatggcatgcaggaggtcaggagttcaattctccttagctccactgatcggcactcttcggaagtgccagcgatcggtgatgagaatcccgtccctgaaggggcgggattctctgcgttccgccccgccggcttgagtcactcgcagcccaggggcgtacacctccgcgaagacgcccccggcgtacgcccgcacgtcggcccggtggtcgcggcggatgccgtggccggactggtaccgaggcgtcgctgaccgtattggcccggccgtggcagaatcaaacggccggaagggggcgcggcccgactgggagggagtgacgatgcctgcgagcatcctcgaggagggcggtcacctcctcggcgcggcgttgatacgggacaccctcactcgcctcgtctgcccctcctgcggctccctccacgtggcccaggtccgcggtgacaacggcggagtctcgtacgtgtgcacggcctgcggccacagctggagctgatcgatgggtgcacacaggcgaaagtgcgactggtgcggcagcggtacgccgatcgtccgtgacatggaaccgatcaaccccgactaccagtactggtgcgaggaatgcgcacgggcgctgatcataaagggcgatccgatcgagacctaccgcgagctggagggcgagccgatctacggacggttgcttgaggagcactgcacgttgaagcggttctattcgttcgtcacggcctgagcgccgcagctcagcgccggtctccagagccgcgtcagacccggcgccaggacctgtgcggggcatggtgccggacccggaccaccccaccgagtggtgaatatcggtcataccgggcaaagcggaaaccgatttggtggagcacccccgggaccgtgtaatgttggcgtcgccgccgggaaaccgggcggaacgaagcaaggggctatagctcagttggtagagcgcctgcatggcatgcaggaggtcaggagttcaattctccttagctccacagaagtcgaaggcgggtcacccaccagggtggcccgccttcggcgtatccgcgtgtgcgtcgacccgctcccggcgtaccggcgtcgcaccgacggtgtgctcagcggcccagcgcgcgccgcccccggcccggtgagaggaccggcaggttccgcgagggcgcctgcgcacgcgtgtcctcctcgatccgcagggccagcgccgggcaccggcgcaccgcgcgcagcgccttggcctccgcggagcgcggcacctgcgcctgggcgacggtcggaaacccgtcggcccccagttcgaacacttcggggaggatgtccgcgcacaggccgtggccccggcacagcgtccagtccacatggatcttctggcggctgggcccgtcctgttcgtcccggccgccgccgggcactcccgtcgggatcctgccgcgttcgaacagcggcaggacgccctccacgggccgcccgcagccgttgccgagcacatgggcggccaggtcgtccgtgaacgccctgagcgcggactccaggaacatcgcggagccgtccggatgcgaacacgcgccgcgccgcttcacgttccgggtgacctgcttgagcgcttccagggcggccgggccgccgccgtccaggatgtcctccaggccgcgtgcggcggccggcagcccgaggtagcaggggccgcactggcccgcgctctcctccgccagccacttcgccacctggagcgactcacccagcgcacaggtgttctgcccgatcggcaggatcgcgccggcgcccagcgaaccgcccacggcgtccagggagttgcgggagacgatcgcctcgtcgacggtggccgcgccgatccacttgccgtggtagccgccggtcagcacgccctgcggcaccggcggagcaccggccgactgcagtacgtagcgcagcggcacgccggtgggcacctcgagcaccatgggccgggcgacggcgccggagaccgtgagcatgacggtgcccggctcgtcgtgcaggccggtgtggccgtagcgctccgggccgatgcgggcggcgatcgccaactgggcgaaggtctcggcgttggacagcagtgtcggcgcgccgcccacaccgctcaccgaggcgctggtcttgcggcccggcgggatcgcgggtccgccgtcgatggagcggatcagcgacgccgccgcgccggtgaccatccgtaccgggttgcgctgcacgcgcgcgcggagcgccgatctgcgtccgttgctcaggccgcgttcggccagggcggcctccatggagtgctgggtggactcccgggtgacgcccaccacgagcgtgcgggcaccgagggcctcggcgcacagcagggcgccgtccaggatgaggtgcggggcacggttgatgagcaccgtgtccttgcggcaggccggctcgtcctcgcttccgttgacgacgacgaccggccgtaaagcgcgggtccatgcgcgcggcaggccccggggccaggggctgcctggagccggtcggcggcgtcgacagggcccggtaggccgcggcgaaaccggagacgggccgagcggcagggccggtcgcggacgaggcgtcggacggaggcgccgcgggggccgggatgtgcgcgaggggcgcggccgggccggtgcgcggcgaccacgggacgccgcgcatccgctcctgactcggcggcgcggcccccggca

SEQ ID NO: 1394 - DNA, 2653 bp, Unknown
  Kingdom: Bacteria, Phylum: Actinobacteria, Class: Actinobacteria, Order: Streptomycetales, Family: Streptomycetaceae, Genus: Streptomyces
  misc_feature (2373)..(2374): n is a, c, g, or t
cgccgcggccggcagcgcgccgggcagcagccgaggccaggccacgcgggcggcgagcagcaggtgccgggccgacatctttccgatggcggatcacgtgacgtgcccgtcactcgaagagtctgcgccggccagaagtcccagaagagtcccagaggcacccacgagccccctcctggctcgcatttgcacaggtcaggaggggtatatcaacgcttttctgaggatcctcagatgtcccggaagatctcgatctgcgccccgatggagttcagccgctccgcaaggtcctcgtaaccgcggttgatgacgtacacgttgcgcaggaccgacgtgccctcggcggccatcatggccaggaggacgacgacggcggggcgcagggccggcgggcacatcatctcggcggcgcgccagcgcgtggggccctcgaccaggacgcggtgcgggtcgaggagctggaggcggccgccgaggcggttgaggtccgtcaggtagatggcgcggttgtcgtagacccagtcgtggatcagggtcttgccctgcgccgtggccgcgatggccgcgaagaaggggacgttgtcgatgttcaggccggggaacggcatcgggtggatcttgtcgatcggcgcctccagcttggaggggcggaccgtcaggtcggccaggcgggtgcggccgttgtcggcgacgtactcggggctgcggtcgtggtcgaggcccatctcctccaggaccgccagctcgatctccaggaactcgatgggcacccggcggaccgtcagctccgactcggtgacgacggcggcggccagcaggctcatcgcctccaccgggtcctcggagggggagtagtcgacgtcgacgtcgatgaccggcacgccgtgcacggtgagcgtggtggtgccgatgccctcgacccggacgcccagcgcctccaggaagaaacacaggtcctggaccatgtagttggaggaggcgttgcggatgacggtcacgccgtcgtggcgggccgccgccagcagcgcgttctcggtcaccgtgtcgccgcgctcggtcagcacgatcggacggtccgggcgcacggaccggtccaccaccgcgtggtactgcccttccgtcgcggccacgtcgaggccgaagcggcgcagcgcgatcatgtgcggctcgatcgtgcgcgtaccgaggtcgcaaccgcccgcgtagggcagcttgaagctgtccaggcggtgcagcagcgggccgaggaacatgatgatggagcgggtgcggacggcggcctcggcgtcgatggcgtccaggtcgaggtcggccggcggcacgatctccaggtcggtgccgtcgttgatccagcgggtgcgcacgccgatggagcccagcacctccaggaggcggtagacctcctcgatccgagcgacacggcgcagcaccgtgcggcccttgttgagcagcgtggcgcacagcagggcgacgcacgcgttcttgctggtcttcacgtcgatggcaccggacagccggcggccgccgaccacgcgcaggtgcatcgggccggcgtagcccagagagacgatttcgctgtcgagcgcttcaccgatccgggcgatcatctcaaggctgatgttctggttgccgcgctcgatgcggttgacggcgctctggctggtgccgagtgcctcggcgagctgcgcctgcgtccagccgcggtgctgccgggcgtcacggatgagcttgccgatgcgtacgaggtagtcgtctgccatggggttgaggctatctcagatatgagatggcacctctcggggggtccgttcgggtgatgtgccgtcagtcctgcctgctcaccagggtcgagcgccgctcgcgtgtcactccaacggaccaggaaaatccggctatgtcctatgaaattctctgttgcggtcggtgtgtcgcggtccgttcctcccgccgacggcgacgggccaggagcgcttgtcgatgccgagccgcactccgggaagaatgtgaaaaccacgttctctccggataccccgacttggcctgctgatgcccgggccgggtgaggggagttcgccgtcgaccgggcggtgccgggcttcttccgggctgttcgtcggccagcgcgtccagacgcgtacgcccgacgcccgcaagccatgcggaagccatgcggacggcctctcaccgtcggccgacggtgcgtaccccgcgacttggcgcatgtgttgcggatcaccgtgcgctgcgaaacccgtcgttcttcccgccgctcttcttctgcgaacggggtggtggggacggctgtcccgcgggtgaacggagtccgaacgagtgagtcgtccgaaggatgtgaggccgtcgcccgggcgacgnnggcggccgcgctggtcggctgttccggcgcgaggaggccgaagccggcttcgaacagcgccgagccgctgacgctgcccgttgccacccgggccgggttcggcacggccggccgcccggtggtgatgcaggtggtcgcccacccggacgacgacctgcacttcatgaacccggacacgctcggcggactcgaccagaccgtccccctggtgtcggtgtacgtgacgggcggcggtgcgtacggcgtcaacgccgtccccggccaccccaagcccccgcc

SEQ ID NO: 1395 - DNA, 2925 bp, Unknown
  Kingdom: Bacteria, Phylum: Actinobacteria, Class: Actinobacteria, Order: Streptomycetales, Family: Streptomycetaceae, Genus: Streptomyces
aggggctgctcgacgggcggcacggcatacgggaactggagggcgaggagttcgcggagctgcccgtgcgcacggcgggcgtcgtgcccgtggatcctgcctccctgctgccccgcgccgccgcccgtcgagcagcccctgccacagctcgcccaccccggcgcccagcggcgtcatggccccgagaccggtcacgacgacccgccgaggaccggcccccgacggctcgcgggtcggccgcccgtggtggcgtacgacgtacccggcccggtcggcgtcggccgcccacgcccgtacgacgtcgtcggagaccgtctccgtggtcctgtcgtccaggtcccggtgccacagaccccaccgccgctggtacgtcacctcgacgccctccgggtcgacggcccgcagccgggtgacgctgtcgccgtcccggaactcgacggcgtccagccgcggcgacgacacggccggcacggccgcaacgtccacccgccggccggcgacgaccacctcctgctcccgtgcgaggaccgcctcgcggtccggaccgccgagcggcggccgcagggtcacccggatcgtctccggcgactcgggcagggtgtgcatcacgacacaccactggctgcgttcggcctcgtcccgcgagagggcgatcagatcgccggggacggtctcggcggcggtaactgtgtgcgggttgagagggacttcaggcatctcggatgaattggacatatcggtacggcttcctgtgacccgaggtgtcgtgcggtggacatcccgagtgaaagggacaaacagctgaaaaaccacggaagtagatccgggtcccaaacaggacgcctgtacgaatacccgcaaatgcggtgaacatgccgcgagttgaccgcctgccgctacgtgcctgtgtgccagctcacgcacgcaccgccgggcgcgaggtgatgccgtgtgacctacggcacgtcaggtgcgggcgtgtggggacgcggggtgcgggggcgcgcccggaacgcgggcagggccagagtgaaagcggggcgcgccgtggcgtacggggccggggaaaagcaggtgtgggccgggtccttcgcgggctaggttgatgctgttcgaagggggaagcgtgaccagactcaaccagatcatcgctgtcgagaagggcgtcaagagcaaagcgctccaggacagcgcagccgcgcaccagaaggtgcagaagcccgcgctgctcgccggtatctcgcggacgtaccagcccaaggacgaggagggcgagcagctgccgcccgagtcgtcccgggtgcaggtcaagggggaggagatcctccgggagatgtctgcgtcgctgacccggctgttcgacgtggtcgcgacgaaggactgggcgaaccggacggcgtgcgcggacgtcaccgtggacggccggacgatcctcaccgaggtcccggtcagctatctcctcttcctggagaagcagctcaccgatctgcacgccttcgtcaagaagctcccggtgctcgacgcggccgagtcctggtcgctcgacccgtcgacggactggtggaagacggacccggtgcgcacgatccgtacgaagaaggtgccgcgcaaccacgtcaaggccgaggcgacggacaagcaccccgcccaggtggaggtgttctacgaggacgtgccgatcggttactggacgacggtgaagttctccggcgcgctgcccgcccggcgggtgaacgagctgctggaccgggtggagaagctccagcaggccgtgaagttcgctcgcgaggaggccaacggctccgaggtcaccgaccagcgggtggctgacgcggtgttcggctacctgttcgcctgaccggcgacgggcagccccctgatcgcccccgcgtgcgagcgcgggggtgcgtgaagggcgcgggccggactgaggaccggtacgcgccgtgagcgcaagctgaaactgacgttcagcctgaatcacgcggccgcggcgaacgaccgtgaccgtgctcagactcagactctcgctccagcttcagcattcgccaccgatcgccggtgggaccgagacggacgaccgtcgccggatgcgagttcgaatctcgcctgcacttctccgcagtgcggtagttcaagggaagaacacggtggcttgagcccgatccgtactcatgaacgccatcggcgtgcgcaatggggtggcatccccaggggcccgggagctggatacgtctcccgggccccgccgcgtccgttccggcccgagccggtccctgccggtccgttcctgatgcttccggtctgctccctgccggtccgttgctgatgcctccggtctgcttcctggcgggaggccgcgcgccctgcgcccaccctgccccgccctgcacccggcctcagacgaggcggagcaccaaagccccgtcatcgtccgtgccgtcccatccgtttccgcgctcccttccgtttccgcgctcccgggcgtcgcggcgcgccaggccgggggaggcgcccgtgccgaccacctgccccttgcgcagggcgacccaactgccctccggcgcaccgccgaagtccgtcgcaccgaccgcggcggtcagctcgggatccggcccgagggcgcccctgcgcggtgacggggcctgggcaccggcacgccactcggcggtggtccgctcaccacccgcccgccgcgaccacaccaggtgctgcaccacgatcagcggccccagcgcggtcagcaggggaaagccctccgtgagcgtgcccagggcgaacagtgcgctgatcgcgctggtgaccgcgacaccgacggctcccgccgccagcgccgccttcgggccgtacgccttcgccgccaccagcgggaacaggacgagcagcagcagatccccgaggccgacggcgcgcatccggtcgccg

SEQ ID NO: 1396 - DNA, 3313 bp, Unknown
  Kingdom: Bacteria, Phylum: Actinobacteria, Class: Actinobacteria, Order: Streptomycetales, Family: Streptomycetaceae, Genus: Streptomyces
cgtaggcgacggcgacggcgacggtgcgcggcgggcccggctcgccggctcggacggcctgcccgcgcccgccggttccgcggcaccggacccgatggaggccgcccgtggccgccgtatccggatgcccaccggctacgagatgaacccatgggcggatctgcgcccggcgggcgaagggcccgcgagcggaaggaagttgtggcaccagagtccagggagtgcgggatgaccattctctgcgtacgtttccagctgcccccgatgtacgaggcggccctgcccgggctgctcgggctgctggaggagttcaccccggtggtcgaggcgctgccgcccgatgcggcgctggccgatctgcggggcgccgaacgctacttcgggcgcggcgcggtcgagttggcgtcggtgatccgggtccgcgcgctcgcgcggttcggcgtcgactgcgtgatcggcgccggaccgggtccgatgctggcccgcgtggccctgcgcgacgcccggccgggactgacctgcgcggtacccgccgaaccggccgcggtcgcggagttcctcgccgaccggcccgtcaccgcgctgcccggcgtcggtacggccacggcccgcaccctgggcgagtacggcctggacaccctgggcctggtcgccgccgcgcccctgtcgacgctccagcggctgatcggcgccaaggcggcccgcgaactgcgcgagaaggcgaacggcgtcgaccgaggccgggtcgtccccaacgccgtctcacggtccctggccgccgaacgccccttcgaccgcgacgaactggaccccggccggcaccgcgccgcgctgctgtcggccgccggagagctgggcacccggctgcgcgccctcgaccaggtctgccgcaccctgaccctgaccgtgcgctacgccgacaggtccgccaccgtccgcgcccgcaccctgccggaacccaccgcccactcggcgacgctgaccggcgccgcctacgcgatgtacgaggcgctggggctccagcgggcccgggtccgcgtgctcgccctgcgcgccgagggcctggcccccgccggacacgcctcccaccagctcaccttcgacccggtggacgagaaactccgccgcatcgaggaggtcgcggaccgcgcgcgggccaggttcggcccccgcgcggtgataccggggaccctggccgcgtaacccctgctgaagcgcggtcagttggcccacggcggggtgagcacggtgccgtccgccaggtgggcccgcagaccgatggaggtggtgacccaggagagtgcggtgcggtccgtggggttctccacggtgagcgtcgcaccggggttgatgatcaccgtgtcgcccgcggtcacgcgctcggtgcactcgtcgagcgtgatcaggagttcgccgtcgagcaggtggaagatctcctcgtgggtgacggtgtgggcgggcgcccgggtgccggccgggatctcgccacgccaggcgcacagttcacgggcgccggtgagcggggtggcgtacgagacgaaacgggcgccgtggatctcatgggtgacggcttgggacgcgcggacgacgggcatggggcctcctcggggaagtgacgaaagtcgtcaagttgcttgaccaagtgctctggattcatggtcaagcaacttgaccaattggtcaagggtgtttcaatggccctgtgcagaactccgaggccatggccctctccgccgccctgctcgccgttgccggtgagctgacgcagcgcatccacgagggcgtcgtcgcccggggtttcgaggggctcaggcccgcgcacggtttcgcgttcgcgcggctggcgccggacggcgcgaccgtcaccgagctggcggcccatctcggggtcaccaagcaggcggccagccagctcgtcgacgagatcgtgcgcaagggatacgccgagcgccggccgcaccccggcgacgcgcgtgcccggctggtcgtactgaccgcgcgcggccgggcctgcacccgggcggcggaggagtcggccgcggaggccgtgcgggggtggaccgcggcgctcggtgagggtgaggtgcgcgcgctgggggagcggctgacgcggatcgcgccgtacggccccattcgccccacttggtgatggcgcgtcagctcacttatcacggtggctcgttgactggccgagcgtcatgagaattctttactgacgcgtaacttcacacttggactactcgtccgtaacttgacgagtgaacagcatcctggtgatccggatcacagggcgtagtgccgtcgcatcttccgcgatccgcaaggagatcacacgatgctgcccttccagcgcgcccgcagatacctggccgccctgttcctggccgccgccgtcgccgtcgtcccggccaccgccgcccacgcctcagcccccagctcgggctggaacgactacacctgcaagccgtcggccgcccacccccggcccgtcgtcctcgtccacggcaccttcggcaactccgtcgacaactggctcggcctcgcgccctacctccagacccgcgggtactgcgtcttctccctcgactacgggcaactgcccggcgtcccggtgttcaacggcctcggccccatcgacaagtcggccggacagctctccgccttcgtcgacaaggtgctcgccgccaccggcgccggcaaggcagacctggtcggccactcgcagggcggcatgatgccccgctactacctgaagttcctcggcggcgcggccaaggtgaacgccctcgtcggcatcgcgcccgacaaccacggcaccaccctcagcggcctcacccacctgctgccgtacttcccgggcgccgccgacctgctctccgccgccacccccggcctcgccgaccaggtcgccggatccgccttcatcacccagctcaacgcgggcggcgacaccgtgcccggcgtgcactacacggtcctcgccacccagtacgacgaggtggccaccccctggcggacccagtacctgagcggctccgacgtccacaacgtcctgctgcaggacctctgcccgctcgacctgtccgagcacgtgctcatcggcacgaccgaccggatcgccttccacgaggtggccaacgcgctcgaccccgcacacgccaccgccacgacctgcgcgtccgtgttcagctgacccggcgccgcggacgcctcagcggctgtgccggcccaccgcgcgccgccgtacggagaggaacagggccgccgcgccgagcgccagcgcggcggcaccgccgaccgcgaggtacggggt

SEQ ID NO: 1397 - DNA, 1116 bp, Unknown
  Kingdom: Bacteria, Phylum: Actinobacteria, Class: Actinobacteria, Order: Streptomycetales, Family: Streptomycetaceae, Genus: Streptomyces
  misc_feature (883)..(946): n is a, c, g, or t
tctacacctcgggctccaccggccggcccaagggcgtccacgtgcaccggcacggcatggccaaccacttgctcgccaaggtcgaggacctggagctgaccggtgccgacagcatcgtgcagaacgcgtcgatggccttcgacatctcggtgtggcagatgctcgccgcgttcgcggtcggcggccgggtccaggtggtcgacgcggacaccgcgcgtgacccgctgaccctgttcccgcgcaccgccgacgaggagatcaccgtcctggaggtcgtgccgtccctgctgcgcgccgcgctcgacgccatggacgcgggcgccctcgacgtcgaactgccgcagctgcgctggatggtggtgacgggcgaggcgctgccgccggacctgtgccgccgctggttcgaccgcttcccgcacgtgccgatggtcaacgcctacggccccaccgagtgctccgacgacatcacgcacgccctcatcggggccggcgacccgatcggcgacacccgcgtcaccatcggccggccggtccgcaacttccgcctgtacgtcctggacgagcacctggccccggtcccggtcggtgtccccggtgagctgtacgcgggcggcgtcggcgtggcccgtggttacgggggccgccccggcctgaccgccgaacggttcgtacccgatccgtacggtccgccgggcggccgcctgtaccggaccggtgacgtcgtcgcctggaaccggtccggagccgtcgagttcctgggacgcgtcgaccaccaggtcaagatccgcggccagcgcatcgagctcggcgagatcgaggccgtgctcgtcgaccggcccgaggtcgccgacgccgccgcgatcgtccgcgaggacaccccggnnnnnnnnnnnnnnnnnnnnnnnnnnnnnnnnnnnnnnnnnnnnnnnnnnnnnnnnnnnnnnnntccgcgaggacaccccgggcgcccggctcctggtcgcctatctggtgcccgccgaggacagcaccctcgacgtgacggcgctgcgcgccgcgctcaccggggaactgccacccgccatggtccccggcgcctacgtcaccctggacgccctgccgctcaccccgaacggc

SEQ ID NO: 1398 - DNA, 4184 bp, Unknown
  Kingdom: Bacteria, Phylum: Actinobacteria, Class: Actinobacteria, Order: Streptomycetales, Family: Streptomycetaceae, Genus: Streptomyces
cgtgcagcccgaggccgctgcgcccgcgtccggcccggtcgtcggagtggaccagggtgtagcggcctcgggctgcacgtcgtcgacgcctggaccggccgggagcgggacaccgcgaccctgtcgggcggcgagacgttcttcgcctccctcgcactcgccctcggtctcgccgacgtcgtcaccgacgaggcaggcggcgtccgcctcgacaccctcttcatcgacgagggcttcggcagcctcgacgaccagaccctcgacgaggtcctcgacgtcctcgactcgctgcgcgaacgcgaccgcagcgtgggcatcgtcagccacgtcgccgatctgcgccgccgcgtccacgcccagctggaagtcgtcaagggacggaccggatcggcggttcgccagcgcggagcagacgcctgacggttcatcagaatcgctcggctgccgagtcgttggcgttcgtgcgagcatgtgacgggcgcacatcgacgaggacgcgcacctgtgccgatcgggggagtgatgcagggcgaggcgcagcgggacacggtgatcggagggcggtacagactggccggacggctcggcgccggcgggttcggccaggtctggcgggcccgcgacctggtactggccgtggacgtggcggtgaagcaggtccgcctggaactcctggtggccgaggaggaacggaaggaactcctcctccgcgcgggccgggaggcccggaacgcggcgcggctgcgcgaccacccgcacatcgtgacggtgcacgacgtggtcgaggtcgacgacgtcccgtggatcgtcatgcaactggtcgacggacactcgctcgcggaggaactcgccgagcggggcccgctgacggtggaacgggccgcggacgtggcccgcgccctgctgctcgggctggacgcggtgcaccgggcgggcctggtgcaccgtgacgtgaagccggcgaacaccatgctcgccgcctccggcgagatcctgctcgcggacttcgggatcgccgtgcaccaggccgatccgcggctgacggaccccttcatggtcatcggctcaccgggctacatggctcccgaacgctggctgcgcgggccgtacgacggccgggccgacctcttctccctgggggtgacgctgtacgaggcactggaaggggtgctgccgtttcccgcggcgagacccggcgccgtgctgaccgagccgccccgcccaccggtgcgcaccggccggctcaccccgctcatcagcggactcctggagaaggacccggcgcaacgccccacgatcgcccaggcgttggacacgctggccagggccggctccggagggcccctgccgccgacgcgccgcatgccggaggaacgaccggcgaggcgtgcgaggacgttcccgccgagaccctcccgtccggtgacgatcagccacaccggacgggagctgatgcggcggggagctcaggacgcctcctgcctgctaggtctcttcttcctcgtggcaggcggcctcgcgggggtgttctgggacaaccgcctccacgccggggaccactcggagctcacgccgtacctgctgggcgggctcttcgccggcgcggtggtgggcaatctcgtctccggtgccgcggggttcgtccgcgggtacttcctgacctccgacagcgtcaccctcgcccccgagtcgatcaccgtcaccgagtccggcgccggccgctcggcccgggtgcgctgggacgagatgtcgctcatcgccctgaccggtcccgcaggtgggcgcaaggaactcgtcgtctggttcgacgacgaggagaaggggagcagcaggcacctggacaggcgggcggggttcgacaacgggcggggcctcgcccaccgcctgtacaccaccgccgacggggcgaagcggccgcagcagcttccggaggaccggctcgccgacgcgctcaggacgtacgccgccgagctgtactacgagccgccggcccggccggtgtcgaacctggtcggtgcgggcggcggggacttcctggccgtggacgggacggggaacctgtggtggtacggggcgccggactaccagggcttcgagaaggtccgggtcggcaccggctggggcaagatgaaaaggctcgtcgcgatcggcgacccggtcggcgacatcctggccatcagcgtatccggggacatgttccgctaccacggcccggactaccacggctccctgagaagcaaggtcggcacgggctgggacacgatgacccaggtgaccggcaccggcgacggcaccggtgacgtcttcgccgtcgacgcagcgggcaggctgttccgctaccgcggcccgcactaccacggttcgcagcgcgagcagatcggcaccggatggaacaccatgcgtgccatcgtcggcgtcggtgacatctccggcagcggcagtgccgatctgctcgccgtcgacggcgcgggccggctgttccactaccgaggaccccggtaccgcggctcgcagcgcaaacagatcggcaccaactggcacacgatgaccaacctcgtcgcggtgcccggcgccggaaccaccgatctgctcgccaccgacgccgacgtcgagaacctgtaccgctacaccggaccctcctattcgggcgcggggcgccgcaggatcgacatgagctggtgagccgcgggcgtcagggcggtcagggtgagcggggcggtggccgcgctccgggcgccgccccggaccagacaggggggcggaccgggatccggcccgccctcaccttccgcccccaccctccggctcaggaacaggtcacagctgggacagctcgtccagcaggtcgtccaggccgagcgagccctgggagagggccgccatgtgccaggccttcgcgtcgaaggcgtcaccgtgccgcttcctggcgttctcacggcccagcagccaggcccgctcgcccagcttgtagccgatggcctggcccggcatcgacaggtagcggatcagctcgctcgccacgaagtcccgcggtcggctgctgtgcgcgccgaagaactccagggccagctccggcgtccagcgctcacccgggtggaacggcgagtccgccgggatctccagctccaggtgcatgccgatgtcgatgatgacgcggaccgcccgcatcatctgcgcgtcgaggtagccgagccgccgctcggggtcggtgaggaagccgagttcgtccatcaggcgttccgcgtacagggcccagccctcggcgttggcgctgacgatgcccacggtcgcctggtagcgcgagaggctgtccgccacgtgcgcccactgggcgagctggaggtggtggccggggacgccctcgtggtaccaggtcgacaccaggtcgtagaccgggaagcgggtctcacccatcgtcggcagccaggtccggcccgggcgggagaagtcggccgacggcgccgtgtagtacggggccgcggcgccgccgggcggcgcgatgcacgactccacccgccgtacccgctcggccagttcgaagtgggtgccgtcgagggcgtcgatcgcctcgtccatcaggccctgcagccagtcgcggacctcgtccacgccctcgatgtgcgtgccgtgctcgtcgaggtgcgcgagcgccacccacggcgtcccggcacccggcaggaccttctcggcctccttctccatctcgccgaggaggcggtggaactccgaccagccgtacgcgtaggcctcgtcgaggtccaggtcggtgccgttgtagtaacgggagaaacgcgcgtagcgttcgcggccgaccgtgttcggcgtgccctcgatggccggcgcgtagacgtcgcgcatccagtcgcgcagttcgacgacggcggcggtcgccgtccgggccgcctcgtcgagttcggcgcgcaggacctcggggccgtccgccgcgaagtcctcgaaccagccgcgcccctcgcccgtgtccgaccactcggtgagctggccgatgaaggtctccgtcggccgcggtcccgcgtacagcttgcgctccaggccggccgccagggactcgcggtagccgcgcagcgcggccggcaccgcccgcagccgctcggcgaccgccgcccagtcctcgtcggtggcggtcggcgtgatggtgaacgcctcgcgcaccgaatgcaccgggc

SEQ ID NO: 1399 - DNA, 711 bp, Unknown
  Kingdom: Bacteria, Phylum: Actinobacteria, Class: Actinobacteria, Order: Streptomycetales, Family: Streptomycetaceae, Genus: Streptomyces
gtcaccatcgtggccgccgtgcgccgccacatgggcgcgggccgcgtccagcacggtgtcgtccgctcccgcgggcggtccggcgaccaggacgtcgggctgggtccaggccgcgtactgccgcacatggaccacccgcagcggggcccggcggcgccgggccgcgtccagggcccagtccagggcgcgcaggctgtcgtcggagccgtcgaccgctgcgacgaccggcggagcgctcatgagtacctcacctccggagggcggcgttgtcccgagccgggccggcccggccacccgggcactgaggcccgtcccccgcttcggccgggacccccgctcaggtcaggtcgaactccccttcccgtgcccccgagacgaacgcgccccactccgcgggcgtgaagatcagcgaggggctctccgggcgaccgctgttgcgcatcgcgatgaacccctcgacaaaggcgatctggacatccccccggccactgctgctggactgccactcggcgttgctgaggtccagctccggcttgtcccatcccgcgagcgggtgctcctggacagtgctctcggccatgtccttgctcctcccgattccgtcgtccgcgggccagcctagcgagcgggtgacggcgccgacaggccatccgagcgggaccttccgtcgacgggccggccagggcccgccaggagtcggcggggcccggc

SEQ ID NO: 1400 - DNA, 5256 bp, Unknown
  Kingdom: Bacteria, Phylum: Actinobacteria, Class: Actinobacteria, Order: Streptomycetales, Family: Streptomycetaceae, Genus: Streptomyces
gcccgcgcatacggatgcggatccgcccttcggggcccacgatgtcgaggtccacggtgtcgtccgtgccgggccgcagccggatcgccagcacggcttcctcgggcgcctcgccgcagtgcgccaggcacgcggtcgccagcgcggccggcatccgcagacgtggcggacccggcagacgcaccgacgcggtggagaaggctgcgtccagcagcgcggcccacgtgcgcggccgtccggtgggcgcggtgaccacggcgtacgccgattcttccgtgcacaccagttccttgaccgtccaggcgaaccccatggagggcacgcccaggtccgcgagccggccggtcaccagtgacggatcttgcacgagagcctcggggccggggccggtgagcgccggcagcgcgtcgtgggcgcacgaggtggtgtgggcggtggcgtgggtgagccaggcgccgggctcggcaccggtttctcgtgtgaggaggcgcgagcacagccgcagggcaccggactgcagcacgacctggacgtcacggggcgtttccacggagaccgggacggccagacgcacacgggtcagacagccgagatgccccgcgtccgggcttccaccggccagcgtggtggcgtgcgcgagggtgtgcagcagcacggcggccggcaccacctcggtccctgccacgggatggtctgcgggataggggcggttcgcggtctccagacgggtctgccacaggtgcagcgggtcgaggccgggcccggcggtgtgctcgccgagcagggtgtgcccggccgggtcgtggccggcatgggaagagctgcgcgtctcggagggcgccgcccagtgccgtgtccgctgccaggcggtggcgggcaggtcggtgagaccgccctcgtggtgatgggccgtccagtcgagctcgacgcccgcgtcgtacagcgccgccgcgttggcaagaagcgtggcccgctcgcgggcgtcacggcgcagagtatgcgcgacgaccgggttcgggcggccgatggtgtgcgcgcccgccagggtctcgacgaccgagtgggcgaccaccgggtgggtggacacctcgacgaaggcatggtgcccgtcctgccacgccgcctccaccgcgggccgcagccgcacgggggcccgcaggttggtggcccagtaggcgccgtcgcggggagcgtcgtcgcgcggtcgcgacagcgcggtggtgtacagcggcagccgcggcgcacgggtggtcaggaccgtgcaagcagccgcgagcggcgtggtcagcgcgtcgagcagcggggtgtggaaggccgtgtcgctggccaccggccggatggatatcccttgcccggcccaggcggtggtcaggtgggccagcgcggctgcccggcccgacagcacgcagctggtgggcgaggcgtcgatcgccgcccacacgtccgccaccccctcggacgcgatccgctgcgcggcgtcgcggaaggacagggcgaccagagccatggcgccgtctcctgcggcggtctgcaccaacgcggcgcgtctgcaggccagtcgggcggcgtccgcctcgtccagcacccccgcgacggctgctgccgcgatctcaccgaccgagtgcccgatcaccgctgccggccggaacccgtaggagcgccacacggccgcaaggccgagctgcaccgcgacggtgagggcctgaacgcgcccggtgctgccaagctccgccgcgccgagggcttcgcgcggcgagaacccggcctcggtgcggaagatgtcatcgagccggtccagcacggaggcgaaggcgggttcttgcgcgagcagggtccgacccatgccgggccattgggcgccgtgcccggagaagatccagaccgcgtccccgaggggttcggccgccgccgactcccgctcgtcccgcagggccagggcgcgcaacgcggcgagcagctcttcggaggtgtcggcggccaaggcggcccggtgcgggaggtgcgagcggtggacggcgagggtgcggccgacatcggcgagagcgagccccggccgggcggccgcatacccggccagccgttcggcgttggcgcgcaggtggcccgctgacgagccggacagcgggaacaggccgcgggcggtccgatcgggtgcccgatcggctgaggcaggaggctgttccaggatcaggtgggcgagtgtgccgccgtagccataactcgacacgccggccagccgccgcggaccgcgtgcgggccaaggacgctcctcggtgaccagacgcagccccgcggaagcccacgggatcgccgggctcgggccggcgacgcctgcggtcgcgggcagacgcccctggcccagggccaggacgcaggtgagcaggccgacagcgccggaggccgcctccaagtgcccgacgactcctttcaccgacccgatcagcagcggatcgccggcctcacgcaccacgccgtggaccgcggccagcgcctcggcctccaccgggtcacccgcacgggtaccggtgccgtgcgcctcgacgtagtcgagttcgccgggcgcgatcccggccgcgcggcacgcggaacgcagcacggcctcctgcgcaggggcgctcggagccatgatgccggaggtacggccgtcctggccgatggcgctgccgcggatgacggcgagcacgcggtcgccgtcgcggcgggcgtcggcgagcggcttgagcacggcaacgacgcatccctcaccacgcccgtacccgtcggccgccgcgtcgaagggcttgctgcggccgtcgggcgaggtcgctccggcccgggccaggacgacggcgagccctgggccggccaccaacatcacgccgcccgcgagcgcgagccggcactcgcgagcgcgcagcgcctggcaggcggtgtgcacggccacgagcgaggaggagcaggcggtgtcgatgacggcactgggcccgcgcaggtccagtgcgtgcgagacacgattggccgcgccgcacggcgaggcgccgataccgctccaggcatggatgccgggcaggtcctccagcacccggcggccgtagtcgtcggccccgatgccgatgtagacgccggtgtccgatccggccaagtcgcgggccgggacgcccgcgtgctccagcgcctcccaggccacctccagggccatgcggtgctgcgggtccatcatcgccgcctcgtcggacgggataccgaagaagccggcgtcgaaaccagcgatgtcggcccggtacgcgccgcgggacggcgtgctactcagaacacgtcgggcggcggcgccaccttgagcggccgcttcggcccaccggtcagcgggcaggtcccccaccacgggttcaccgttcgacagccgctcccacaattgctccggtgagtcgatgccgcccggaaggcggcaagcgatgccgatcaccgcgatgggctcatgttcgggagttgcggggacgtcgggcatgagccgccattcctcctcgggtcgcgtggacgggcctgcttcggctccttgtgcgggcggctgggagcgcccggccggccggccgcaccaccgtcggtgcggccggccggtgaccggacgggcggcgtcagagcttgacgcgcgtgccctcccagatgtccttctgccagatgtcgccgaacagccagttgcccggcgcctccgggtccgggctggtgtagtactccttccaggcggcgagcagctcgtcgacggacagactgccgtcaccgtcgcggtcgagcttctcgaaggcgatgcggctgttctccgcggaggtaccgaacgccttctggaaacaggcgaactccccggcgtcgacggtgccgtcgtcgtcccggtcgcagatcgcccacagcgcctcggccagcggccggaagccctcggtgaagcctgcctcgtcctccgcgaacgcgcggcgcagtcccgtccgccattccagcggagtgatctggccgtcctggttgaagtcgacggccgcgctgacgtgctgccagaacagcccgaacgccttgaagagagcctgggccttgtcggagccgaacggctcgccgatgtacgccacgatccgggccgccagtgccagagcgtcggcgctttcgaggacaccgtccccgttctggtctccgtgcccgaagcacacgtcgagcttgcggtcgaggagctgggcgacgtcatgaggactcattcgtcagaccttcctgtgccgagggtatttcgggccggaaagcgggcccggacgcgtcatgacgaatctaggtgacgcggcaggtgaggcacacagcaaatgaaaaacgcggcgattttggctgcatggcatctctcaccagcctcgactcgtcacacgctggcaacggagaacacagtccggtcgccgtagatgtccagcagttcacgaggggccaacgggcaagcaggagctttcaataaacctgctggcgtcgatgttttccagtccttcgaacgcgacgctttcatatttttaaatgagagtcttaccggctgctacggcccttgccgtgacgagcggatccatgagggaagcggcccttcaacggggcattcggcggtgcgcgcagggcggactgcgacgacgtcgcgcatggcgattctgctctgtgatagcgggggcggaaggcgctggtcagccggcgggtcgacgcgcaggcgggtctgcacgatccggtgcacggccgcgttcgcttgccggtcgccgccgcggtggaggcgacggtactgccgaccgcccggggaacgctcgactgggccgaccccacagcgccgcgaaggacgcccccagcaggtctcggtatccagccgcggtgaccgggagctcctcggtgtcgatcacttcgctaccggggagagcacagcggccacatgggcgtcccggtgtgtgtcctgtcatcggtactgggacctggggaaacaacaagtcgcttacttcaagcgtgagttcgggtcggcatgcgcaccgggcccggcccgtgcccgcgtgcgccgggcccgcgggccgcggcgtgagacggacttgatcccaccccttgtcccgccgaccgtcggcaccgaagaatgcgcacggcaaccatcggctacagacgtcacacccggcgtcggcaagggggctccacccaatgtcacctgcagcaccgatgatacgcaggacacgtcgctcaccgaggatcggcaaggcgctcaccggcgcggcgttcgcgctcgccctggtcggcgtg

SEQ ID NO: 1401 - DNA, 2050 bp, Unknown
  Kingdom: Bacteria, Phylum: Actinobacteria, Class: Actinobacteria, Order: Streptomycetales, Family: Streptomycetaceae, Genus: Streptomyces
gggcgggggcggccggggcggcatcggcggcggtgggcacgagggcgagcgtgagcgtcgcgaccgtggccagcaggccgccggcgagggtccgtcggatcatggaaacctccgggctgtcgttctgtgaccacgtgacgtgatcacctgccgaccagcgtgtccgtgccatccgtccacgatgccgtccccgcgtcccggggacggcggggacgtccccggggaccgccccgaggggctgcggcgccctgccgcagcaggccggcgaacccaggagcgcggcacgaccggccggcgggatgcttgcactcgggaagaatccgccgcgctcaccgtggtcgtggcgctcaccgcgcgtgcactcgcgaattagttgagtaacgcaacgatatggtaacctgggtgcatggccccagcatcctcgcctcccggaccggtctcgcccgaagtggccgagatcgagcgcgctctcacccggatcacatacctgagcacgcgggcccggcagcacgagaagctgatggcgctggcgggggtcccgctggaccgtgccgcggtggcgctgctgcgccagatcgccgattccgagccgctgcggcccggcgagctggcccaccgcctcggcgtggaggcctcccacgtcacccgcaccgtgcagcagctggagaagtccgggcacgtcacccgcgtccccgaccccgacgaccgcagggcccagcgcatccggctcaccgagcagggcagggacgccatcgcgcgggtccgcgaggtcggcgcccgcggtatggaggctgccctgtccggctggtccgccgacgaactgcgccgcctcgccaccctgttccaccgcatggtcgacgacttcctcgcgtacgcccatgacgtcgacgccgaacaggagcccgccggcgaagccgcctcccgcgcgggcgcccacaccggctgagagcactcacgcgcgtgcggtagtgttgacccgcgcgttcacgcggaacaccgtacggacgcatcgggacgtggcgcagcttggtagcgcacttgactgggggtcaaggggtcgcaggttcaaatcctgtcgtcccgactcgaacgagtcgcgggtcagggccggtgtcggagcaatccgacaccggccctggaccatttctgggggccggtcccgtgtgaaaagctgcacgagcgcggcgtcgggcgagggcggtcacgtcgtcgtcctcggcgcggtcaccgccaccctcagggtcagcatcttccggctggtgcgccacctgcgcgaggagttggggtcctggttccgggcagctcgtcgtccgaagcgtcctgctttcgtcggcaggcgcaccggcgcaccggcgcaccggcgcaccggcgtcctcttccgcgggcgcgggctgcggcgtgccggtgcgcaggacctggttgacgcgtgtggtgtcgagggcttcctcccagcgaccgacgacgagggtggcgacgctgttgccgtcggggtactccggtccccgctcggcagcggtcctctctcggcgcagatcttctctcggtccccgtgtccgctcagccggtgtggaggatccggaagcggtccgggtccgccggatcccggtcgacgacctggaccggcgcccaggtccactgccggacactgatgcccggtgcgcgggagaaccggatcggcccgcgggtgccttcgaccgcgacgtgcggccaggattccgcggtgcgcgcccggtcggtgccgcccgagcgcagcacgtcggcgaggacgacgatcgtgtcgtagccctcgaaggcgacgaaggaaggggccgcggccagccgctcgcgaagagtcgtcgcgacccgtgcgccgagcgggccgaggcgctcgggcaggtagcgcaggaacgggaccgcggcgccgtcgacgcccagcgccgtcgcccatccggcgaactccggctgtccggccggagccccgatcagaacctcggcgaggcgcgggtcgcggcgcacggaccggacgatcgacgccgccggctccgggtggccgaccaggagaaggagggcg

SEQ ID NO: 1402 - DNA, 1772 bp, Unknown
  Kingdom: Bacteria, Phylum: Actinobacteria, Class: Actinobacteria, Order: Streptomycetales, Family: Streptomycetaceae, Genus: Streptomyces
ggcacggcgaccgcgacgagcccgcgcggaccgtggggaccggcttctcgttccgagacctcgaacccgcgctgcgcgccctggcgacccgcgccggagtgccgctgaaggccgtcctgcacgccgcccacctgaaggtcatgtcccagctcaccgaggaggaccgcttcttcaccgggctcgtcggccacaaccggcccgaagcaccgggggccgagcgcctgctgggcatgtacctcaacaccatgccgcacgcccacgaccgcacggccgcgacctggggggaactggcccggcaggccttcgacggcgaggccgccgcctggccgcaccgcaacttcccgctgccggccatccaggcgggcggccgccggctgatcgacgtgtacttcgtctacctcgacttccacctggtcggtgacgaccaggtggtcgacgagggcaacggcatcaacagcagctccaccgagttcggcctcggtgtgaccaccatcggcggcttcctcagcctgcgcgcctcctcgcacgtcctgtccgaggagcacgccgagcggatctccggcatgtaccgggcggtcctggaggccatggccgccgagggcgccgacggcgacgcccgcgcggtacggctgcccgccggggagtacgacctggtggtgcgcggcgctgccgccggaccggccgagtccgtcaccgccctcgcgcatgagttgttcgaggcgcgggtggtggaggcgccggaggcggtggcggtggtcgcgggtggattgtcgctgtcgtacgcggaggtgaacgagcgggcgaaccggctggcgcacgtgctgcgtgcggccggggtcggtcctgaggatctggtgggtgtgcatctggagcggggcgcggatctggtgccggcgctgctgggggtgctgaagtcgggtgcgggttatctgcctttggatccggcgaaccctgtggaccggatcggtttcgtgatcggggacgcgggcgcgaggacggtgatcaccacgtccgctctgctgccggctctttccgctgtgtattccggcagtgtggtggtgctggatgaggagtcgaccgtggcggcgctggcgcaggctccggccggtgatccggtgcgggtgagcgatccggacaacgtcatctacacgatctacacctcgggttcgacggggcgtcccaagggtgtcgtcctgactcaccggaatgtggtgcggcttctggagagtgcgcaggagcattacgcgttcgacgagtccgatgtctggtcgatggcgcactcgtacgcgttcgacgtgtcggtcttcgagatgtggggggccctcgcgcacggcgggcggctcgtggtcgtgccgcaggcggtgacccggagcccggaggagttcctcggcctgctcgtcgaggaggaggtgtcggtgctctcccagacacccaccgccttccgctccctggtcgccctcgcggcggccgacgacccgcgcgtcaccggcctcgcgctgcgcgcggtgatcttcgcgggcgagaagctggaggtctccgaactcaagccgtggaccgaccggctgggcctggacacgcccgcgctggtcaacatgtacgggatcaccgagaccaccgtgcacaccacctaccaccgggtggacgagggagacctcgcccggccggcggccagccgggtcgggcacccgctcgccgatctgtccgtgctgctgctcgaccgctacggccaccccgtgccggtcggcatccccggcgagatccacgtcgccggg

SEQ ID NO: 1403 - DNA, 853 bp, Unknown
  Kingdom: Bacteria, Phylum: Actinobacteria, Class: Actinobacteria, Order: Streptomycetales, Family: Streptomycetaceae, Genus: Streptomyces
tcaaatcctgtcgtcccgactggagacagtcgaaggccagggccggtttcggaggcatccggaaccggcccttgatctatttcggggaccaggtggggaccagcgttccttggcccgccgcagcgggtggggacggtcgggccgggaaggcgctcagcacgctgaggtgtgcgcagagtgccgcaccggcagggaaccggccctgctgtccgatcccgcgccgaccggactgcccccgaaccagggggacgagctgacccggacccgccgctctcctcccgctgaccctcctggtgcgcgggtcggtccagtcggccggtcgcgcgttcgtcgcgtcacactgagccacctcgtcattcgggcgccgacggcgtcatcaccgtgcgcaccgccaggagcggcaagatcgcggtggagccgggcgacccctactaccggttcggcgacggcgtccgctggagcgccggctggagcgacttccccggccgtcccaagggagagctgctcttcgccgacgccgacaacgacggcaaggccgacctgtgggtgcactccacggacggaaaggtcgccgtacgcatcaacaccggcacgtactggcagaccaccgctggggacgactgggtctgagcccccgtccactgccgccgcgcgcgctccccggagcgctgagcgagggccttcccggaccggtccgggaaggccctcgccttcttccgcccgacccgtccctgacgggctacgtccgcacctgagcggccgcgcggcgccgggcgaccaggtcgtcacggcggtggggcacgccgccccggaccaccgcgaccgtgtcgacgagtgtgccgaagtcggtgaa

SEQ ID NO: 1404 - DNA, 3747 bp, Unknown
  Kingdom: Bacteria, Phylum: Actinobacteria, Class: Actinobacteria, Order: Streptomycetales, Family: Streptomycetaceae, Genus: Streptomyces
gtcgtcgaggacaccgcgaccggggtcgcggcggcggaagcggccggctgccgggtgatcgccgtgccctccatcgcccccatcgccccggcgccccggcgcaccgtcgtcacctcgctcgaagaggtcgacctgccgttcctgcagtcgctgatgacgtacccgaccccgccgaccgccgggtaggcaggagccctgaggggagagcaggggagaagccggggccggggcccgagaggaattgccccggtccgtgacgtcgtacgggataatcccgatgacgaacgtgcgaatgaattcgaatcctgccggatgactgaattccggtaccggccacccgagttgacaatgtgatgttcaccacaggattcggggtcgacagggccatatggatatgcagatcacttcccatcggcggtgaaccgggagcctttgtgtcccgattggtgaaacgctgcacgaatccttccagtggcgcgttttcggaacgtccgcgaccggttccgctgcgtgatggcggcccgcctcccgcggcagcgaaccgtccgacggccgcggactagtctcgtcgcgagaacatcgtccttaccccgtgatccgccgcaccacccctctgcatgccgggtacacggacatgacagctctggagaaactcgagcatgaaccgcaagactttggtgttgccggccgtggtcggcctgctcgcgccggtgctcgccgcctgcggcggttccgacagcggcagcaagagcggtgacgccatcgtcgtcggcaccacggaccggttcaccgctaccaaggcggcccccgcgcccctggacccggcgtacgcctacgacatcggcccctggaacctgctgcgccagaccgtgcagacgctgatgatcacgcccaagggcgagggccagccggtccccgaggccgccgagaagtgcggcttcaccgacagcggcaacgagcgctacgcctgcacgctgcgcgagggcctcaagttcgccaacggcgaccccgtcaccgccgccgacgtcaagttctccatcgaccgcgcccgcgccatcaaggcggacaccggcgtcttcgctctgctctccaccgtcgacacggtcgagacccagggcgaccgcgaggtcatcttccacctcaacaccgccgacgccaccttcccgttcaagctgtcgacaccggtcgcgggcatcgtcaaccccaaggactacgacaagaacaagctgcgcgacggcttcaacgtcgacggatccggcccgtacaccatgaaggccgacgtcaagaacaacgaactcgtcgacgccgtcttcaccaagaacccccactaccaggggacgttgaagatcaacaacgacaaggtggagatccggagcttccccgacgccgacgccatgggcgccgccatcgacaagggcgacatcgacgtcatgacccgcgcgatgtcaccggagcagatccgcaagctctccaacgcctccggcgacggcaaggtcgacctggtcgagatgcccggcctggaaatccgctacctggccttcaacaccgacgccccgagcgtgaagaacaaggccgtacggcaggcgatggcccaggtcatcaaccgcagcgacctcgtcgcgaaggtctacggaacccaggccgaggcgctgtactcgatggtcccggcgaccatcaccggccactccaactccttcttcaacaagtacggcgacccgagcgtcagccaggccaagtcgctgctgaacaaggccggcatcaccaccccggtcaagttcacgatgcactacacgaccgaccactacggctccgccaccaagaaggagttcgaggtgctccagcagcagctcaactccagcggcctgttcgacgtcagcatcgagggcaccccctggaaggtcttccacccgacgatgcagaagcgccagtacgacgtctacggcatgggctggttccccgacttcccggacgcggacagctacatcgcgccgttcctggacgccgacaacaccctcaacacgccgtacgtcaacaacgacatccgcaagaacctgctccccgagtcccgccgccaggccgaccggctcaccgcctcctccagcctgaccaccattcagaacctcatcgccaaggacgtgccgctgctgccgctgtggcagggcaagcagtacgtcgccgcccgcgacgacatcacgggcgccgcctacgtcatcaactcctcggccacactgcagctgtgggagctgggccgcggcgtgagcggctgaccccggccccgccccgagggaccacgcaggaaaggcgccccacccgtagaccgggaggggcgcctttcccgtgcggtgtccgtcacccggcgcaggtcactgcgcgccgggccgcaccagaccgctctcataggcgtacaccgccgcctgcacacggtcccgcagacccagcttggtcagcacatgccccacgtgcgtcttgaccgtcgtctcgctgacgaacaggtccgccgcgatctccgcgttcgacagcccgcgcgccaccagcttcagcacctccacctcacgctcggtgagcgtgtgcagggtgtccggcaccggctcgtcaccggagggcagatgcgtggcgtacttgtccagcagcctgcgcgtgatgctcggcgccagcatcgcctcgccgcccgccaccacacggatcgcctgcaccagttcgttggccggagcgtccttcagcaggaagccgctcgcgcccgcgcgcaacgcctccaccacgtactcgtcgagatcgaacgtggtcagcaccagcaccttcgccggcccgtcgcgctccggaccggtgatctgccgggtggcctccaccccgtccatccgcggcatacgaatgtccatcagcaccacgtcgggctgcagggcacgcacctggtccagggcctgcagaccgtctccggcctcgcccacgaccgcgatgtcctgctccgcctccaggatcatccggaacccggtgcgcagcagtggctggtcgtcgaccagtaggacgcggatggccacgtaagtctccttcgctgggaccctagtcccgccccattctgccctgtacctgcaccggtacccgcggctcgggccgcaccacgggcagcgggtacggcggcggagtgcccccgaactccgggcagtgcgcctggtggtcgcaccagccgcacagcttcgtgggccgcggacgccactcacccgtctccgtggccagccggatcgcctcccacagcgccagcagcttgcgctccacccgctccagatccgccatgaccgggtcgtacgtcagcacgtcaccgctgcccagatacaccagctgcagccgccggggcaccacccgcttcagccgccacaccaccagggcgtagaacttcatctggaacaacgcgccctcggcgtactcggggcggggcgccttgcccgtcttgtaatcgacgatgcgcacctcacccgtgggcgccacgtccacacggtcgatgatcccgcgcagcttgagccccgagtccagctccgcctcgacgaacagctcccgctcggccggctcgagccgcgtcgggtcctccagcgtgaaccagcgctccaccagccgctccgcctccgtgagccagcgcgcgagccgcgcgccgtccgcgtcgtcggcgaacagctccaccagctccgggcgcgactcccgcagccggtcccactgccccgggaccagcgccttggcgcggggcgcggtccgctcgcc

SEQ ID NO: 1405 - DNA, 2003 bp, Unknown
  Kingdom: Bacteria, Phylum: Actinobacteria, Class: Actinobacteria, Order: Streptomycetales, Family: Streptomycetaceae, Genus: Streptomyces
tacgacgaagggccgcgcggcgcgcgacgcggtgggcggccgtcgcgggaatcctgctgggagcggcgatggtcacgctgggcggagcgatgctcgtgcgcgccgcgcggcccttcgtcgtacgtgcctcatgcctggctcccgaaaccccggtcacacggtgctgtccgtggggcgcgccggtccgcgggccgcccggtctccatacgcggtgcggccgtacggcgttcagcggcccgcggaccggcctaggatgccccgcatggacgagaacccggtggcgcggctcggggccgccaagtacctgctgatcaccagctaccgcaggaacggaacgccggtggccaccccggtgtgggtcgtgcgcgacggcgcctcgctcggcgtgtggacggccgcggactcctggaaggtcaagcgcatccgcaaccgcgccgacgtgctggtcgggccctgcgacctgcgcgggaacccgaccggcgaccagatgccggcgaccgcggagatctgcgaccgggccaccaccgcacgctaccggggcctcatcgcccgcaagtacggcctgatcggacggctcaccctgctcggcagccggctgcgccggggcgagcgggggaccgtcgggatccgggtggcccccgcgccctgacccgcgcgggagccacccggcgatgtcacgggcgtgttctgcgaggaacggaccctacggggcgtcgaggaccgtgcccgtcatcaccggagcgccctcgcgtgcctctccgtcgtcgtcggtcagctggaagcggaccttctcgggctgctccttcacctggtcctcgaccgtgggcacgctcacctcggtgctcagttcgcccgccggcaccgggacccacaggtacaggctctccacggcggacagcggccgctccgggtcgggcgactcaccggaggtgtcctgcagccactgcgggtcgacgtccttggtggacagctccgggccgtccgtgacgggccggacgacgaagacggtaccgaggtccgagtcggccgccgcggacaggttcacccgccacttcagcggtgctccctcggtgacccggtcggcgacgggcgtcaccgtgaccgtcggcggccggtcgtcgttctcgaccgccactccgccccggtgggcgccgacgaccgcgccgtggaccgccttgacgacgatgtcgttcgccacgtcctggctgtagcgcgtgttgccccgcacccgcaccggtacgtcgatgctgtgcccgccgggccggacgttcaccagccggtccgtcgccttgtacgtcaccgggtcgatgacgtacacccgtacctgcccgctgccgtggccggagatccgcaccggcacgcggtaggtgcgcacgcccgagtcgccctccttgaccgtgagccggccgacgtcgacgcggggcagcgcggccgggcgcaccgccggggtgccgggacgccagccccacgcgtccatgagccaggcctgccccgaccgggtgcgcggggtcagttccagcgccgcgatccgcccgaggtccagatgggtccggacggcggcgctcagcgggacacgcacctcgcgcgcccagtaggaggccgtgcggtcggtgccgggcaggccgtcgacgcggacgcggcccagcgccgcccggtgcccgaaggcgtcggtgacagccacgtccagctgggtgccggtggtgttcggcgggacgaagacacgcagcgccagctgctcggcgcccttcagcgacatcggcgacgcgggacggatccgcgccgtcgaaccggcggcggaccagcgcagcgccaccgcgcggcgaccggtctcacggtcggtgtcccactgcgcgaagtgcggtgagcggccgggtgtgtcctcggggaggcaggcggcggacgcggacgggtcgaccgcggagcacagccgggcggcgccggtcacggtgaccggaccgtcgggcagcagaccgccggtgcggccggcgccgacggcgtgggtg

SEQ ID NO: 1406 - DNA, 3450 bp, Unknown
  Kingdom: Bacteria, Phylum: Actinobacteria, Class: Actinobacteria, Order: Streptomycetales, Family: Streptomycetaceae, Genus: Streptomyces
tggcgcacggccgccgcgcccgaggaggtccgcgaggccgccctgaagacgctcaagcagcgccgcttccgcgcccacctggccggggacgcggtcgccgccgagaagggctacctgcgcgaggcgggcaacctgctcttccacatcgcgctgatcgtgatgctgatcgccttcgcctggggccagttgttcaagaccgagggcaacaagctgatcgtcgagggcgacggcttcaccaacaccctcacccagtacgacgacttcaagtccggcaacctcttcaacgacgacgacctggtgccgttcagcttcaacctgaagaagttcaccggcacctacgagaccagcggccccaacaagggcaccgcgcgcaccttccaggcggctatcgactacagcgtgggcgccgacggcaaggagcggcacaagctcatcaaggtcaatgagccgctggagatcgacgacgccaaggtctacctggtcagccacggctacgccccgaccgtcaccgtgcgcgacggcaaggggaacgtggtgtaccaccaggccgtgccgctgctgccgctggacgccaacgtcacctcgcagggcgcgatcaaggtgatggacggctaccgcaacgcccagggcaagagcgagcagctcggtttcccggcggtcctggtgccgaccttcgccggtgccggcaagggcacgatgttctcccagttccccgcgctggacttccccgtcctgtcggtgggcgcctaccacggcgacctgggcgtggacgcgggcactccgcagaacgtgtaccagctggacaccaagaacccgaacctgaagccgttcaaggactcccagggcaagatcctgaagaagatgctgctgcccggcgagtccctgaccctgccgaacggcgccggctccatcacgttcgacaaggacatcaagcagtgggcgagcttccagatcgtccagcagcccggcaccggctgggcgctgaccggggccctcgccgcgatcttcggtctggccggttcgctgttcatccagcgccgccgggtctgggtgcgcgcggtcaggggcgccgacggcgtgacggtcgtcgaggtggccggtctgggccgcagcgagtcggccaagctccccgaggagatcggcacgctggccgccctggtccacgacaaggcacccacccaagccgacaccgactccggtaccgactccgactccgatccggagccgggcgccgtcacccccgtacccgccgaaggggctgagaagaagtgactcccgccgccaccgtgctggccaccgccaccaacgaaaatctcgcacacctcagcaacacgctgatctactcctcgatggccgtctacatgctggccttcttcgcctacatcgcggagtggctcttcggcagccgcagcaaggtggcccgcacggccgccgcgctgacctccaaggaacagacggccaaggccgcgcgtccggctgtggcggtgaagtccgccggcggcaccaccgtcctggaacggcccgaggtcgtcgtgcggtccgcctccggctcgcgtgacgtgcccgacgggccgggcgcgcacggcggcgacgagcagggcgacctgtacggccggatcgccgtctcgctcaccgtgctcgccttcctcgtggagctggcgggcgtcgtcgcccgcgccgcctccgtggagcgggcgccgtggggcaacatgtacgagttcaacatcaccttctccacggtcgcggtcggcgtgtacctcgcgctgctcgccctgaagaagaacgtgcgctggatcggcctgttcctgaccaccacggtcctgctcgacctgggcctcgcggtcaccgtcctgtacacggcgagcgaccagctggtcccggccctgcactcgtactggctgtacatccacgtctccaccgcgatcttctgcggcgcggccctgtacgtcggcgcggtcggcacgctcgcctacctcttcaaggactcctacgagaacaagctggccagtggcggcgagcccggcgccttcgcgaagtcggtgctggagcggctgccctccgcggcctcgctggacaagttcgcctaccggatcaacgcgggcgtcttcccgctgtggacgttcacgatcatcgcgggctccatctgggccgagtccgcctggggccgctactggggctgggaccccaaggagacgtgggccttcatcacctgggtcggctacgcctgctacctgcacgcccgctccaccgcgggctggaagggccgcaaggcggcgtacatcgcgctgatcgccttcgcctgctacctgttcaactactacggcgtgaacatcttcgtgaccggcaagcactcgtacgcgggcgtctgagcactcgtacgcgggcgcctgaggagctaggccctgtcgtagggggaacacgggtggtatgaccggttccatcgcacagggcaccagccagacccacggcaacacgcacatcctcggcttcctggtccggcttccccggtccatgggggccgtctggccgtggctgtccaccccggaggggctcgcgctctggttcacccccgccgacgaactggaaccccggctcggcggcggggtcagcctgcacggcctcggcagcgggcacatcaccgcctgggacgtcgaccgggtcgccgagtacaccatggacggcggcggccggatccgcttccacctggaacgggacggcgaggacggctccgtgctccgcttcacccacgagttccagggcgagggcgagtcggagcaggcctggcggacccgcttcgaacgccttatcgaaaaactgggtgcgggggagtgagcgccgggggccggtaggcgaccgcccgcgcccgggaagccccttactctccgatgtcctcccgccacagccgcggctgttcgcgtacgaagtcgcgcatcaggcgtacgcactccgggtcctccaggagcacgatctccacgccgtgctccgccagccagtcgtggccgccgtggaaggtggccgcctcaccgacgacgacccgcgagatcccgaactggcggacgagcccgctgcagtaccagcagggcgagagcgtcgtcaccatcgtcgtaccccggtaggaccgctgccgtcccgcggcacggaacgcggccgtctccgcgtgcagcgacgggtccccgtcctggacccgccggttgtgaccccggcccagcagcgtcccgtcggccgcgtagagcgccgcgccgatcgggatgccgccctcggcgagacccgcgcgggcctccgcgagagcggtggcgagccatgcgcgcgcctgtgcggggtccatgtgtgccggtgcggggtccatacgcccactgtgcgggcgcccgcgccgtacggcaacgacgcggcggggctccgggcgtgggcgccgccgccggcggggctcagggcgccagcgagcggcagatg

SEQ ID NO: 1407 - DNA, 2305 bp, Unknown
  Kingdom: Bacteria, Phylum: Actinobacteria, Class: Actinobacteria, Order: Streptomycetales, Family: Streptomycetaceae, Genus: Streptomyces
cacctgatgggcctgcggatgcccgccacgcgcccgcaccgccacaaggtgcccctgcggcggctgacggcggtggccgcctgagcggccgcgcgccgcacgcgacgggtgtcggacatgcgaatctgggagcgtcccctcacgggcctggagagcgacccaccggccgccccgccaggcccggccggccccgacgaacccgaggaccaacgaccgatgagccccgccgacggcgaccgcgaccgtgacgaccgcgaccgtgccacccagcgcatcctgatcgtcgacgacgagcccgcggtgcgcgaggccctccagcgcagtctcgccttcgaggggtacgacaccgaggtcgccgtggacggcgcggacgcgctggagaaggcgggcgcctgccggcccgacctggtcgtcctcgacatccagatgccccgcatggacggcctgaccgccgcccgccgcatccgcggcgccggcgacaccacgccgatcctgatgctgacggcccgcgacacggtcggcgaccgtgtgaccgggctggacgccggagcggacgactacctggtcaagccgttcgaactggacgagctgttcgcccggatccgcgcgctgctgcgccgcagttcgtacgcggcggccgtggacgacgacgtcgacgagggtgacgtgctggccttcgccgacctgcgcatggaccttgcgacccgcgaggtgacgcgcgccggacgccaggtggagctgacgcggaccgagttcacgctcctggagatgttcatggcgcacccgcgccaggtgctcacccgggagcagatcctgaaggcggtgtggggcttcgacttcgaaccgtcgtcgaactccctcgacgtctacgtgatgtacctgcggcgcaagaccgaggcgggcggcgagccgcgcctggtgcacaccgtgcgcggggtcgggtacgccctgcggcagggcggcgcggagtgaacaaggcggtgcgccggatccgttccctgccgatccgctcgcggctggcgctgctggtggcggcggcggtggcgttcggcgtggccgcggtgtcggtgacgtgctggttcatcgtccagggcaagctgatccagcagatcgacgaggacctgcgggcgaccagccgcccggtcagctcgcagagcgtggcgaacctgctcgccgactgcaccaccacgccccgcccctcggacgaccggggccccggctccgccgactactacgtccaggtgatcagcgccaccggcgggacctgcgtgttcaccaactccgtcggcacggtcagggtcaccggcgcggacaccgagatcgcccgggacgccgggcagggcatcgagcggctgcacgacggcaaggacaccaacggcaacccggtgcgggtgctgacctccccgctgctcatcgcctcccccgccggcccccagctgtaccccgggcacgcgctgctgatcgccacgccgctgaaggacaccgacaagaccctcgacgacctggcgctgctgctcctgctcgtctccggcataggagtcgtcggcgccggggccgccgggctcgcggtggcccgcgccggtctgcgtcccgtcgacaagctcaccgaggccgtcgagcacgtggcccgcaccgaggacctgaccatccgcatccccgtcgaggacgacagcgaggacgagatcgcccggctctcgcgctccttcaactcgatgaccgcgtccctggcgtcctcccacgacctgcagcagcagctgatcgccgacgccggccacgaactccgtacgccgctgacctcgctgcgcaccaacatcgaactgctcacccgcagcgaggagaccggccgcccgctgcccgaggcggaccgcaaggcgctgctggcctccgtgaaggcgcagatgacggaactggccgcgctgatcggcgacctccaggaactgtcccgttcggaggggcagcgcggcgagcggatccaggtgatctcgctccaggacaccgtggaggcggcgctgcgccgggcccggctgcgcggccccgagctgaccatcacggcggacgtcgagccctggttcgtccgcgccgagccggcggccatggaacgcgcgatcgtcaacatcctggacaacgcggtgaagttcagcccggagggcggcaccgtggaggtgcggctcaccgacggcgtcctcacggtccgcgaccacgggccgggcatcgcgcccgacgaactcccccacgtcttcgaccgcttctggcgctcacccagcgcccgcgccctccccggctcgggcctcggcctgtccatcgt

SEQ ID NO: 1408 - DNA, 5590 bp, Unknown
  Kingdom: Bacteria, Phylum: Actinobacteria, Class: Actinobacteria, Order: Streptomycetales, Family: Streptomycetaceae, Genus: Streptomyces
gcgcgcgggtgttcacacgcccgcgcgtttctgtgcctcctccaccagccgcaccgcctcctcgacctcggcctcgctcgtgaggacgagtgccagatcgtgtccggcgacggtcacctggtccgccgccgcgaacatcccggcgtcgggcatctcgcgcggctcggccgccggatcctccagcagttgcgcccgccgggcgaactccctggccagccccagcgcctcggcggcgcccgcccgctgcagccggctctgcggcgccgcccgcagacggtcggcgaagtgatccactgcccgggtcagagatgtcgtgtccaccacgccgcgagactacgcgccgcacccggactgttgccaacgcgccgacgctcaggcacggtgacgtgaaggaccggctcgaaagcgtccggaggcgccgatgtcccaagtcttctccgaagagacccaccgcaatctgctcgcccgcatcccccagtgcaccggtcgtgaggtctccgactggctgcgcaccgtcgaagaaggccccgccctctgtttcgaggagcggctcagctggctccggcaggagcacaacctcgcgtacggccacgcgaaggcgatcatccacgagtacgacctgaggagggcggcgcgcaaactgctctagcgggcgcgcacgacgggctcggcacccgctcagccacgcatgagcccgtacacgcggaagggccccggccggagccggggcccttccgcgtgctgtgcccgccgcggcgcggggaccgctagtcgttgctgttgaggatcgcgatgagccgcaggaactccatgtagatccacaccagcgtcagcgtgaggccgaaggccgcgagccaggcctcctcgcgcggtgcgccgtaggcgacaccgtcctcgacctgcttgaagtcgagggcgaggaagcaggcgccgagcaggacgccgatgatgccgaagacgatgccgaggccgccgctgcggaagcccaggccgtcaccgccaccgaacgcggcgaacagcgtgttgaccaccatcagcagcacgaagccgagcgcggccgccatcacgaagccgtagaaccggcggttgacgcggatccagcccgccttgtacgcgaccaggacggcggcgaagaccgccatcgtgccgatcacggcctgcatggcggcgccgctggcgatgcggttgtcgacgacgctggagaccacgccgaggaagacgccctcgaaggccgcgtagctcaggatcagcgcgggcgaggccttgcgcttgaaggactgcacgaagcccagcaccatcgcgatcagcgcggcgccgatcccgaggccgtaggaacggctgatgtgcgcgtcgtcgacaggcagcagcgcccaggcgagcgcggccgtgacgaccagcacgccgagggtggacgccgtacgggtgacgacgtcgtccatcgtcatgcggccggcggcggccggtgcctgcggaggcgtgccgtactgcacgtcctgctgggcgtaggggttctgagcgtaagggttctgcgcgtaggggttgccgctctgctgggcgtacggatcgccctgcgcgtacggattgccctgcgtgccgactgcggggcccccggcctgcggcgcggtgttgaagcccgcgtagccgttgtcgcggctgaacccccgtcgcgagaagaccgggtttctgctcctcatctcactcctccatggccgcacgtcgcggccttggcctaagagtaatggaacggcaaaggatcgaccctactacctgcgaaggatctttccctcgtcctgctgcggaacacgctacgcgggcgggtgattcccggcgacggccgggcccgttccatgaccaacccggtacccggccggaaccggccggagatcacctcggtgacggcgccggcccggatcaccggacattccggttacggcgccggccgggatcagccgagcgggaaaccggtgtagccctcggcgagatccgtcccggcggcccggcaggaggcgatccgctccagccgggccaggtgcagccgctcgtcgaagccggtggcctccggcgaccggtgcagcatcgtcgtcatgtcgtagctgaaccgctcggcctgccagacgcgccgcagacacgtctgcgagtaggcgtccagcagctcggcggagccggtctcccgctcgtgcgtcagcgcccgcgcgaaggtgacgacgtcgccgacggcgaggttcagccccttggcgccggtcggcgggacgatgtgggcggcgtccccggcgaggaagagccggccgtggcgcatgggctcgtggacgtaggaccgcatcggggtcaccgacttctgggtgatgggcccgcgctccaggcgccagtcgtcgccggtctcgaaccggcgctccagctcgtcccagatctcctcgtccggccaggtggcggcgtcggtgccggcgggcacctggaggtagaggcgggacacggagggggaccgcatggacagcagggcgaagccgcgctcgtggcgggcgtagacgagttcgtcgtgggagggggcgacgtcggcgaggatgccgagccagccgaaggggtacgtccgctcgaacacccgggagagcgcggcgggcacggccccgcgcgacaccccccggaagccgtcgcagcccacgacgtagtcgcactccaggacgtcctcgcgtccgtcctgccggaagcggacggcggggcggtcactctcggcgccctccacggccagcgcctccgcctcgaacagcaacgggccgccctcggcgagctggagggctatgaggtccttgcagacctccgtctgcgcgtacaccatcaccgaccgcccgccggtcaggcccgggaagtcgacacggtggcggcgcccggcgaaccgcagctcgatgccgtcgtgccgcagcccctcgcggtccatccgctcccccgccccggccgcgcgcagcacgtccacggtgccctgctccaggatcccggcgcgctggcgctgttcgacgtaggcgcggtcacggccctccaggacgaccgagtcgatccccgcgttgcggagcagccgggccaggagcaggccggccggaccggctccgatgatgccgacggtggtgcgcatcgggcgttcctttcgggcggaggcttgttcgccaggtgaagtttccttcactgagctgacccgagtttccgcccgggcccggcccgtgtcaatggggaaggcggcaagggggcggcgggggaaggcggcaggagggccgacgggaaagaaggtgccggacggcagaaaacggcgccttccggaaaagacgggagcaaaggcgccgttgaggcggttgtgcccggaaccggacttgaaccggtacgcccgcgaggggcagcgaggtttaagctcgccgtgtctgcattccaccatccgggcaggccatgggctccgcgctgagtttccgagcctatcgggaggcatccttcgggcaccgggcaggcggaccgatgttgtcttattttattggcgtctgagggttcatcagcactcggtagcggccatcggcacttgccaacagccttgcggtcgacggacggtcccgtatacggaatgacggaatttcaccgtcccgacaagggcgctccacccgttcctgacctccctcttccggcacgagcgcccgcgcagccctcagggccggactcatccccaggtatgacacgggcgaccgcggtccgaccgcagtcgccccccggaaccggaacagcggctgacttcacgggccggatcggccgggacgatggaaaacgtcccgagaacaccgtcccgacaggagcacccacccgtgaccacctcttccatcgccggacgcgccaccgccgtggccgcgcgcgccacggatctgtcgaagatctacggacagggcgagacccaggtggtcgccctcgaccgggtctccgtcgacttcgcgcaggccgagttcaccgcgatcatgggcccctccggctccggcaagtccacgctgatgcactgcgtggcgggcctggacaccttctcctccggttcggtccgcatcggcgacaccgagctgggctccctgaaggacaagcagctcaccaagttgcgccgggacaagatcgggttcatcttccaggcgttcaacctgctgccgacgctgacggccctggagaacatcacgctgccgatggacatcgcgggccgcaggccggacaagcagtggctggactcggtcatcgacatggtggggctgtccgggcgcctcggccaccggccctcgcagctctccggcggccagcagcagcgtgtcgccgtcgcgcgggcgctggcctccaagccggagatcatcttcggcgacgagcccaccggaaacctcgactcgcgctcgggcgccgaggtgctgggcttcctgcgcaactccgtgcgccagctgggccagacggtggtgatggtcacccacgacccggtggcggcggcgtacgcggaccgcgtggtcttcctcgcggacggcaggatcgtggacgaggtgtacgggccgacggcggacgccgtcctggaccgcatgaagcagttcgacgccaagggccgcaccagctgaaccccgtcggcccggcaacgaaggccgaatcccatcggcccggcgacgaaagccgcaccggccgccccgcctcgcctccacctcgtacccctggactgagacaacccatgttccgcaccgccttgagcaacgtcctcgcgcacaaggcccggctcctcatgaccgtgctcgccgtgatgctcggcgtcgccttcgtgtcggggaccctggtcttcaccaacaccatctccgacgccttccagaacagctccgccaagggcttcgaccatgtcgacgtggccgtcgaggccaagtaccaggacagcaagggcgaccgggtcggcacgacgccggacctgacccagccgctgctggagcggagcgcccgggtgccgggtgcggcctcggcgctcggcgtggtcaagggcttcaccgccatcgccgacaaggacggcaagctgatcggcggcggcttccagtccgagggcggcaactactggggcacgaaggacccccggtacccgctggcctccggcaccgcgccgcacggcgaggaccaggtgctcatcgactccgagaccgcccgccgggccggctacaaggtcggcgacaaggtgcgcatctccgtcgacggcccggtcctcacccccaccgtcagcggcgtcttcaccaccgacgacggcaacgtcgccgccggcggcagcctcgccctgttcgacacggccaccgcccagaagctgttcggcaagccgggcacgtacgacgagatcgacgtgaaggcgaagccgggcgtcagccagagcgccctgaaggcgcagctggacgcggcgctgcccaaggggaagacggagaccaccaccgccgagaagctcgccgacgaccaggcgaaggtgatctcctcctcgatgagcagcatgaagcagggcctgctggtcttcgccggtatcgcgctgttcgtcggcacgttcatcatcgccaacacgttcaccatgctggtcgcccagcgcacc

SEQ ID NO: 1409 - DNA, 2931 bp, Unknown
  Kingdom: Bacteria, Phylum: Actinobacteria, Class: Actinobacteria, Order: Streptomycetales, Family: Streptomycetaceae, Genus: Streptomyces
ggcggcgcgggtcctcctccagctcgatcaggaagggcaggtcggtgaagcggcgcacgtagtcggtgaagtacggcacctggcggcgcacgaagaactcggtgaggatcacgtgccccatggccatcgccagcgccccgtcggtgccggggtgcgggtgcagccactcgtcggcgaacttggtggcgtccgcgtagtccggggagaccacgacgaccttctggccccggtagcgggcctcggtcatccagtgcgcgtccggggtccgcgtcaccggcacgttggagccccacagcatcaggtaggcggcgtcccaccagtcaccggactccgggacgtccgtctggtcgccgaagacctgcggggaggcgatcggcaggtccgcgtaccagtcgtagaacgacaccatgggcgcgccgatcagcgacatgaaccgggcgccgaccgcgtgcgaggccattgacatcgccgggatcggggagaacccggccacccggtcgggcccgtgctcggcgatggtgtgcacatgggcggcggcggcgatctccagtgcctcgtcccagccgacgcgcaccaggccgcccttgccgcgcgccgcctggtagcggcgccgcctgaccgggtccgaggtgatctcggcccaggccgccaccgggtcgcccagccgttcgcgggcctcgcggtacatctccaggagcacaccgcgggcgtgcgggtagcggacccgggtcggcgagtacgtgtaccaggagaacgaggcgccgcgcgggcagccgcgcggctcgtactcgggccggtcggggccggtggaggggtagtcggtctcctgggtctcccaggtgatcagcccgtccttgacgtacaccttccacgagcaggagccggtgcagttcacgccgtgcgtggagcgcacgaccttgtcgtgcgcccagcgctcccggtagggggcgtcgttgacgccctggtcggtgcggaagaccgctcgcaggtcgggagtggtcacggagcgtcgcagtatgcgccccgcctgaagcaactgatcggcggccagggccgccatgcgttccgcttccttttgtgccgcgcgccgtcccactgcgctcacatcccctattgaagtcggcggcacaccggccgcgggtggtcaggcccggcggccggtgctggtgagggaagccttacgcatcggaacggtgcgtgcccataggactacgcagagttgagcagagctatacaagggctttctttgccctttgcaatagttgcacctggcaagggtctggaaagtcatgtttgagatcgcctgccggtgggcacactccggcgaccgcggctgtgcagtgcgacggcgaccggcaccgccgtgaacaccgacgagtacgtcccgacggccagcccgacgagcagcgcgagcgcgaaatcggccagcgagtcaccgcccagaacagccagcgagatcaggatgagcagcgcgcccatcccggtgttcacggtccgcggcagcgtctgcgcgatcgcccgctcggcgacccggtccagcggcgcccgcggctctcgccgcaccagctcccggacccggtcgaagacgacgaccgagtcgttcaccgagtagccgatcacggtgagcagcgccgccaggaacaccccgtccagcggcttgcccagccacgcgaagacacccaccaggatgaccacgtcatgcgcgagtgcggcgaccgcggccgtcccgaacagccaccggaagcgggccgcgagatacagcaactgcgcgcccagggccaccgcgagcgcgatcagggcaccccggcgcagctcgtcgccgaggctcggtccgatcagctcgtcgcgcacggtcttcgcctccccgcccagcgaaccgacggcctcggcgacctcggccgcctgtgcgtcggacagctccccggtccgcacggtcagcccccgctccccggaggactgcacgaccgcccgcgcgaaccccgcgtcggccagcgcggcacgggcgcgctccgggtccacggcgcgcgaggtctcgtaggtgatcatccggccgccggtgaactcgacgccgaggtccgcaccgcgcaccacgagccccgacccggcgagcaccagcaccacgccggagacggccagccagcggcgcggccgacgcatcagccgcggcgcgcgccgcaccagcgcgtcccgcacccggccggtggtggccagcccggtaccgccgggacgccggcgcacccaccggcgggagacggcgaagtcggcgagcacccgggtcaccaccagcgcgctcaccatggacgccagcacaccgatgccgagcgtgacaccgaagccgcgcaccggacccgaggccaggaagaacagcagcccggccgcgatcagcgtggtcacgttcgagtcggcgatcgcgctgaaggcgttgcggaacccggcgcccagcgccgagcggaccgtgggccggtgccgggaggcgtactcctcacgcgcccgctcgaacaccagcacgttggcgtccacggccatgccgatcgccagcacgaagccggccagccccggcagggtcagcgtggcaccgagcgcggcgagggcggcgtaggagatcagcccgtaggacagcagcgccagcgtcgccagcacgcccatcagccggtacacgacgatgatgaacagcgcggtcagcgcggtgccgacgaccgcggcccaggcgctcgccgtgatggcgcgcgcgccgagggtcgggccgacggtgtgctgctccaccgtctcgaccggcacgggcagggcgccgccgctgaccagcagggccagttcgcgtgcctcgcggtcgccgaaggagccggtgatctgcgtggagccgcccgtgatgcccgtgccgcagccgaccgccggatcgacctgcggcgaggagatgatccgcccgtccagcac

SEQ ID NO: 1410 - DNA, 2439 bp, Unknown
  Kingdom: Bacteria, Phylum: Actinobacteria, Class: Actinobacteria, Order: Streptomycetales, Family: Streptomycetaceae, Genus: Streptomyces
ggtgttcggtagtcgggggcggcttcgggtgcccgtgggggcggacgcgtaccggtggagcacctttcagggggaccgggtcctggtcgtcgccgctcggacggtcacctctgccgtgcgggtgctggaggcgctgccctcgttgattcggggcgacagtcgtgtgaccgtcgtttttgcctacgatccgtcgtccgccttcaatgacggagttcttgatctgctgcagggcgccgggtgccgggtcatgccgtgggagcagttgggggagatcgagcctgatctcattctttccgcgagcgagaacatcgacgtgccggagggtgagtgcccggtgctggtgctgccgcacggggtcgggttccagaagttcgtgccggattcgcgtagtgcgcgggtcaggctctccggggtcgtgccggactcgctgctggagtcggggcgggcctggttggcggtgtcgcatcccgcgcaggaggagcagttggtcgccgggcggcccaaggcggccgggcggacgctgctgatcggcgacccctgcttcgacgagctggtcgccagccggcccctccgggcggcgtaccgcgaggcgctcggtgtcgccgaggggcagcggctggtcgtggtcagctccacctgggggcccacctcgctcctcggcactgacccggaggtccttccccggctgctcgcccaacttccctgcgacgagtaccgcgttgccgcgatcacgcaccccaacgtgtggtcggcccacggcgcctggcagctccgtacgctgcaggccgccgcgctcgacgcggggctgctgctggtgccgcccgtccacgcctggcggcccgcgctcgtcgccgcggacctgctggtcggcgaccacgggtccgtgacgctgtacggggcttcggcgggtaagccgttgctgctggccgcgttcggcgatgacgccgtgcccgggaccgccgtgcacgagctggcggcgctcgcgccccggctcgattcccgcggtgacctgcgccggcaggtggaggacgtgctgcgtgagcacacggcggaacggtacgccggagtcgccacgcgtgccttcgccgagccggggctcgccctcgccaagctccgtaccgccctctaccagctgctcaagctgtccgagccggcctccccgccgccttcctcgctgatgctgccggtacccgaggcggaggagcccggctcgggcgtcgcctcttggcgtgttgccaccgaggtcggcggtcccgcggcggcctccaccgtcaccgtgcggcggtttccggccgccgtctccgcgtacgggacgggggccgcggagacgccggagtccttcactcaccttgcctgcgccgacgacgagcgcgatcaccggctcctcgagagtgcctccgtgctcgtacggcggctgcccgcgccgaccgccgtctccgcgctgggctggatcgaggagacgctcgcccggctgccgggaagcctcctcgcggcctcggccgtgcgcgggggctgctgtctcgtcgggctccgggacgggcgggtggtcgaggcttccgtcaccggggcggccgtggatcccggactgcccgccgctgtcgtgtacgcgctgctccgggcggggcgcccggtgggaggggccgcagccggtggccaggtgacgctgcggatcggtgacgtgcgggacgaggacgtcgttcttcgtcttcggccggggtacgcccgtgcctcgcttccctgatcgcttccctgctcgcttccctgatcgctctcctggccgccgtcggcggtctcagcggtctcagccgtctcagccgtcgagttcctccagccgtcgccgcaggccctccgccaggctgctgccggtcgcctcgtggatctcgacggcccggctcaggcacgtgcggaccaggtcctcgtggccgcccgccctggccgcgatgtcggcgaggtgcaccagggcctgggcctcgtagtgcgtggcctgcaccgcacgcaactcccgtgcggcttcgtccagttcgcccatcgctttctcggtctcgccgaggtggccgtgcgcgacgccgatcgccgccgtcacccgggccgccatgcgccggtcgggttcctcgcggtactgcaagtcgtgccgggcccggcgcagggtggccagcgcctccgcgtggtcacccgccgcgtcctgcgcgcagcccaggaagtacgcggcgatggccgctcctcgggtctcccccgcacgttcgttgagttccagggaacgccggtacgcctcggcggcgcgcgccggctcgaaaaggtcccggtagcggcccaggaactcctgcacggaggcgcgcaggaccaggtggccggacgcctcggccagggcgacggcccggtccagttccgcgcccgcgcggtcgttctcgccgaggtccagcagggggcgcgacagcaggc

SEQ ID NO: 1411 - DNA, 2798 bp, Unknown
  Kingdom: Bacteria, Phylum: Actinobacteria, Class: Actinobacteria, Order: Streptomycetales, Family: Streptomycetaceae, Genus: Streptomyces
ctgcgggtcgcggtcatcggcagcggcttctccggcctcggcatggcgatccggctgctgcagcagggcgtggacgacttcctcgtcttcgagcgggccgacgaggtgggcggcacctggcgggacaactcctacccgggcgcggcgtgcgacgtgatgtcccacctgtactcgttctcgttcgcgcagaacccgaactggaagtccacgttcggcaagcaggacgagctgtacgcgtatctgcgcgacaccgccgaccggttcggggtgcgtccgcacatccgcttcgggcacgaactgctcgcggcccgctgggacgaggtgacccggcgctggcacatcgagacctcgcagggtgactacaccgcgcaggtcctcgtcagcggcaccggatacctcagcgaaccgtcggtccccgacatccccgggctcgacaccttcgagggcacggtgttccactcctcgcgctggcgccacgaccacgacctgagcggccgcaacgtcgccgtcatcggtacgggcgcctccgccatccagttcgtgcccaagatccagcccgaggtggggcggctcgacctctaccagcgcaccccgccctggatcggcccgaagaacgacaaggcgaccagcccgctgcaggccaggctgctgcgctcggtgcccggctaccagaacttccggcgcaacttcaacatgtgggggcgggagatcctggccttcgtgatgaagcggcccaaggtcgccgggaagatgcagaagatggcgagcgaccacctcaagaagtcggtcgccgacgagtcgctgcgcgccaggctcacccccgactatgtgatggcgtgcaagcgcctgctgttctccaacacctggtacccggcgatccagcagcccaacgtggacctggtcaccgacggcatcgcgcaggtcaaggcccgctcgatcgtcaccgccgacggcaccgagcgggagatcgacacgatcatcctgggcaccggtttcaaggccacggaccggccggtcgccggccggatcaccgggcgcgaggggcggctgctgcgcgacgtgtggcgcgcgcagggcatggcggcgcaccgcggcacgacggtggcgggcttcccgaacctgttcctgctgctcggacccaacacgacgctcgggcactcctcgcaggtcgtgatgatcgaggcgcagatcggctacgtcctggacgcgctgaaggtcatggacgacaagggcctcgcctcggtggaggttcgagaaacggtccaggacgactggaacaaacggctccaggcccggctcgatggcaccgtgtggaacgcgggcaactgcaagagctggtacctcgacgagcacgggcgcaatccctcgatctggccgacgtacacctggcgcttccgccgccagaccaagcgcttcgacccctccgagtaccgcctcgccaccacggtgggcgccggcctgccggccctgaaccacacctgaccggacaggagacagaccgaatgagaagcagcacctccatcacgcggcgcagcgtcctcgggggcctcgcggccgccaccgtcatcggctggagctcgacgcaccaggcctgggcgcgggagaccgacacgttcgccgccacggcggcggccctgcccgtcctcgacggcacgctggagacgtcggcgagtgccaccgcggtgttcaaccatgacttcgggcacatggtgaacggcgcgtgctgggcggtgctgcgtcccggctcggtgcaggacatcgtcaagatggtgaactacgcccgtgccaacaagctgaagatcgcgatgaacgggcgcggcggccagggcggcgacgaggagtcgcactcctgctacgggcaggcccaggtgccgcagggcggcatcgcgatcgacgcccgcggcctgagcagcatatgcagcatcggctcgtcgagcgcggtggtggaggccggggtcacctgggcccagctcaccgacgccgcgctcgccaagggcctgacaccgccggcgctcaccgactacctgcacctgtcgatcggcggcacgctcagcgtcggcggcatcggttccacggtgcagcggtacggcctgcaggtggacacggtcaagtcgatcgacatcgtcaccggcaacggcgatctggtcaccgcgagcccgaccaggcgcgccgacctgttcaacgccgcgctcggcggcggcggccaggtcggcatcatcgtgcgggccaccctcgcgctgatccccgcgccgccgaaggtcaccgtcttcaccctcttctaccgcgacgtgtcggtgttcctcgccgactccgagaagctcatggccgacaagcggttccacggccaggtcggcgagatcgcccccaccccggactacaccggctggtggtacaagctggagggccaggcctactggtccggcagcaccgccccggaccgcaccaagctgctcgcggggctcagcgacgagcgcgcctcggcgacgatcgaggacctcccctaccgcgactgtgtgtaccgcaccgacgcggacgagacgtggctgaaggagaacggctactggaaccagcccaagccgtggctgagcctgttcgtgccggcctccaaggcgaaggccatggcggacctgctcacctccgagctgaccaccgacgacctgggcgccggcttcctgctgtactacccgtacccgacgtcgaagctgacccggccgctgacggtgcagccggccgagccgaccgcgtacctgtgcgacctgctgcgcttccccgcgccgggcgcggggaagcgcagcagg

SEQ ID NO: 1412 - DNA, 845 bp, Unknown
  Kingdom: Bacteria, Phylum: Actinobacteria, Class: Actinobacteria, Order: Streptomycetales, Family: Streptomycetaceae, Genus: Streptomyces
gctcccgcccggtgatccacggcagcggctcatgggcgagcgcacgccacagccgggtcagcacggaagcccgcgcgccgctcagctcgcgcgcgtaccgtgagaccagtccgggccgctccacggccagctcctcgccgatctcggcctcggcggtcgggaaacggtgcacggtcgggctcctcgggtgcggatcggacgcgcggcgtcacggtagcgcgccgtacagacatactgatcaccttcgcaccgtgtggacgtatggaacgaatggaacgcatggagccgacgccccccaccgacgacgtgccccccaccgacgatgtcgcggcaccgctcaccgccgaggtcacggcaccgcccgctgacgacctggcggccctgcccgatgacgatgacgtcatcgcgcgcgccgacgcctacgccgccgcccccctgctgaactgcctcatccgcgaggtggcccggccgtgccccgacgacgaggggcggcaggtgtaccggctgccgggcggcggacgactgctgcgggtgcgcggcggccggcggcccgccgaacccgaggtgttcacggccgaccgctggcagcgcatcggccatgccgaactggtcaaactcgtcgcggacgaactgcgccgccacaccggtctgtccaacgacgaactgcccgccgagatgctcgacagcagggaggcggtggcggcgctgctggccgtccgtgacctcgcggcgccgcccgcggacccgtacacccgctccgagcagtccctcgtcaccggccacccctaccacccggcgcccaaggcgcgcggcggcggcccggtcgcctcctggccgccgtacgc

SEQ ID NO: 1413 - DNA, 3327 bp, Unknown
  Kingdom: Bacteria, Phylum: Actinobacteria, Class: Actinobacteria, Order: Streptomycetales, Family: Streptomycetaceae, Genus: Streptomyces
gacctgctgcgccggcacggcgtcggttcgctggccctggtcaccgcgggccgcgccgacgtggcggggcgcctggccgacacgtatgtcgccgaggggctgaaggtggcctccgtcacggcgctgggcctgacgtcggcccgtgaggcggcggaggtgccggtcgcgcggctgcgccggcagctcctgcaggcggacgtgcgggacgccgagtgcctggtggtggcggggacggagctgccggtggcgccggtggccgcgctgctggaacgggagctgggcaagccggtgtacgacggggcacgtgtggccgtgcacacgggtctcggcctggccgggctgagtgtcgacgcgccgtcgtgggggtcgctgttcgcgtcggacgcgcacacgggggtgtgctgtgacagccactgagaccggcccgcgccgggcgcaggacctgcggggcttcctcgcggagctggatgcggcgcactcgggtgaggtgctcaccgtcgaggaggaggtcgagggcgaggacctggcggcgctggtggcggagctggccgcccggggccgggaggagatgctgctgtgtccgcgggtgaagggccttggcacgccggtcgtcacgaacgtgttcgcgtcccggcggcggatcgcccggctgctgggcgccgaaccggccggtctgcacgccgcctacagcgaggcctcggcccgcgcggtggagccacgtgccgtgccggacggcccggtcatggaggtggtccgcgagggcgacgcgatcgacctcacggacccctcgcagctgccggtcctgctgcaccacgcctcggaccgcgggccctacatcaccagcggtgtcatcgccgtcgaggcgccgccgtacgcgcccggccgggccggcaacctgagtttccaccgcgctctggtgcgcagccgcaccgagctggccaccagtctgcactcgcgcgggcacctgtggcagttgctgcgcatggcggaggaacgcggaaggccgctgccggtggcgatggtgatcggcgcccaccccctgttcctgctggccgcctccgcgcggctcggtcccggaaccgacgaacgggacatcgcgggaggcctgttcgggtcgccgctggacgtcgtccgcaccccgcggtacggcatccgggtcccggccggcgccgagttcgtcctggagggcgtcatcgacccgggccgcgacgccgacgagggccccttcggagagttctccggctactcctcgcaccgctcgacacgcaatgtgctcacggtcgaaaccgtgctgcgccgacgggacccgctgctgctcgacgtggtcggcggcaacagcgccgaccacctcaacctggcccgcgtcccgcgcgagtcggagatggcgcacaagctgcgcgagcggttcccggaggtggccgcgctgcactaccccacctcgggcacccacttccacgcctacgtggcgctgcgtccgtcccggccgggacaggcgcggcaggtcatgctgggactgctgggctgggacccgtacctgaagacggtggtcgcggtcgacgacgacgtcgacgtcaccagcgacggcgaggtgctgtgggcccttgccacccatctccagccgcatcgggacgtgttcatggtcgacggcctgcccggcagcccgctggacccgtcctccaccccggagggcaccacgtcccggatggcgctggacgcgacccgctcccccggcttcgacggcgagcggatccggatcgcgcaggagcgtcgcacggcggcgcgccgtctgctggacacacgggtgaccggcggagcgccatgcggctgatcgtcggcatgaccggggccaccggagcgatcctcggggtccggctgctggaggtactgcgtccgctggccgaggtggagacacacctcgtcctcagccggtgggcgcgtaccacgatcgagctggagacggaccgtacggtacgggaggtgtgcgcgctcgccgatgtcgtgcaccgtccgggcgaccaggccgccgccgtgtcgtcgggctccttccgcgcggacgccatggtcgtcgtgccgtgcagcatgaagacgctcgccggcatccgggcgggttacgccgacgggctcctcggccgggccgccgacgtcaccctcaaggaacaccgcccgctcgtgctggtgccgcgcgagacgccgttgcacgagatccatctcgagaacatgctcggtctcgccaggatgggcgtcgccatcgtcccgcctatgcccgccttctacgaccggcccgcgaccgtcgccgccgtcgtcgaccacatcgtggcccgcgtcctggaccagttgtccctgcccggcccaccggtcccccgctggtccggcctgccggacggcgccgcgaccgcgcggtgatccggcccggcggcacgcgggcgtcccacgctcccagcgccctgctcaactctctgcccacgacgccccgtaggcacccgccgggcacgaagcggccggcggacaccgcgtcgcgcacgctgccgccggctgcggggctgtacgggggaaaaggcggacaccgcagcgcgccttgtgatcggcccacgcctgccgtcgccatcctgtccacggcaactcgggattcggcaccatgacgacggaaggtcggtcgagtgaagctcaccaagcggttcgccacgatcagtgtcgccgcggcggcagcggttcttttcagcagcgggtgcgcccaggctcaaggcgacggaggaattctgtcgcttctgggcggcaggtcactcaccgacgtctgtttcgcggcggatcaggccgggctcggagacagctgcgccgccgctcggaccaacaacaacaacaataacaacaatggaggcgtgaacaacaacaataacaacaacaacgggaccggcgcggtgaacaacaacaataacaacaatgccggcgccacccagggccaaggcggcgggggactcctgtcgctcctgagccacgtgtcactcgttcaggtctgctacccgatggggcaggtcggcaacggcaacaccttcagcggcacacagaacatcaactgcaatcagagcgcgggctcgtaaatctggcggtgccgcacacagcaagtccggccaggtgacaccacccggccggactgctgaagttcagccgttgttgttgttattgttgttgttcgcccctccgccattgttgttattgttgttgttgttgttgttcgctcccccgccgttgttgttattgttgttgttgttgttcccgcctccgccgttgttattgttgttgttgttgttcgcgcccctgccgccgttgttg

SEQ ID NO: 1414 - DNA, 1173 bp, Unknown
  Kingdom: Bacteria, Phylum: Actinobacteria, Class: Actinobacteria, Order: Streptomycetales, Family: Streptomycetaceae, Genus: Streptomyces
cccccatgccggtgccggtgccagggcccgttccggttccgatcaggtgccaggccgagccgagccggaccaggcgccggtgcagttccgccgggtccgccagttccggcaggcacgcggcgacggcctcgcgggcgtgcatcagccggttcgccgccgccggggtgctcgcctccgtctccgccgcggtctccggcagaccgaggccgacaccgtcgtagaggaccagcgtgcggcggtacgagggcgggagcctcagcagggactgctggagcgcgcggtcggccgggtccgggggcgggtcggggatgcggttgcgcgggatgcaccggtgccagggggacagcgcgcagtcgtacgccgtcgcccgcacccacccggcggggtcgcggtcgtgggccacctccggccagtgctgccaggccagttggaaggcccgctccaccgcctcacgcgcccgctcgcggtggccggtgagcaggtaggcctggcgcacgagggccggggcgcagaaggcgtagagcgcgtcgaaggcctgagcgggtgtcaggggttctttcctgctcccgccggcctgccgggcgacgctcccgccggtcctcccctcgacgtttccgccggtcctccccccgaggctcccgccgctcttcccgccgacgcttccgccggtcttccggtcgacctgagtgcacgtcaatgtggcgtcggcgccgaggtgtcggaccgctgggcgcgcgggcagtgggctcgcttgactgttcgtcaccgtgcgtccctccgtgtgaataggcacataaacgtatattgagcgacacttcggaggttcgcctgttgcgccgggaaagcgtgtgacgttggcagcatggcgggcgtgatccagacgacccctcgacgtccgcccctgccgcgcctgcgcacccgtgtacgggaccgttcacccggactcggcgccggcttcctgggcggtgtggtcgcggcggccctcggtctcggctcgttcgccgtgctcgacatcgtgctgtggatcagttcgccgtaccccgacagcggtccgggcggcgcgctgcacgtcgccgccgcgctgtggctgctgtcgcacggcgccgaactggtccgcaccgacacgctcacctcggtgcccgcgccgatcgggctgaccccgctgctgctgct

SEQ ID NO: 1415 - DNA, 1054 bp, Unknown
  Kingdom: Bacteria, Phylum: Actinobacteria, Class: Actinobacteria, Order: Streptomycetales, Family: Streptomycetaceae, Genus: Streptomyces
cgggatgaccggtccgccggtcatgccggcgcagttgctcgacggcgtacgccagcggctggccgagagcggggccgagccgacgcccgcgcgcgtggcacaggcactgcgggagcagggcagggtgctcggcgacgcggaagtgctcggggcggccgagcggctgcgttccgagctgatcggcagcggcccgctggagccactgctcgccgacccgtcggtgaccgacgtcctcgtgtcggcccccgaccaggtctgggtggaccgcggaggcgggctggagcgggccgccgtcgccttcgccgacgccgcggccgtacgccgtctcgcgcagcgtctggccgcggtggccggacggcgcctggacgacgcccggccgtgggtcgacgcccgcctgcccgacggcacccggctgcacgcggtcctgccaccggtcgccgtcggctgcacatgcctgtccctgcgcgtcgtacggccgcgcgccttcacgctcggcgaactggtctccgcgggcacggtgccgccgggcggagaaaacgtgctgcgggcgctcgtcgaggcgcggctgtccttcctcgtcagcggcggcaccggcagcggcaagaccacactgctcagcgctctgctgggtctcgtcgggccgggcgagcgcatcgtgctcgccgaggactccgcggaactgcgccccgaccatccccatgtcgtccgcctggagaccagaccggcgaaccaggagggagcgggcctggtcaccctcgaggacctggtgcggcaggcgctgcggatgcggccggaccggctcgtggtgggcgaggtccgcggcgccgaggtggtccatctgctggcggcactgaacacgggccacgaaggcggatgcggcacggtgcacgccaacgcggcggcggacgtccccgcccggctggaggcgctgggcaccaccgccggactggaccgggcggcgggcggcggcgcatcgccgaggtgcgggtgctggagcgggacgcgagcgggtgggtgcggacggtcccggcgctgcgctggggcgcacaggcgt

SEQ ID NO: 1416 - DNA, 1705 bp, Unknown
  Kingdom: Bacteria, Phylum: Actinobacteria, Class: Actinobacteria, Order: Streptomycetales, Family: Streptomycetaceae, Genus: Streptomyces
acgagcgtgacaggggccgcgcccggtccctcagtcggtccgggctgggtccccgctggatacgggcgggcccgcgctgactcctggtcgcggcccctgtcacgctcgtccccggctccgtcagtcgcccgtcgccccgtcgatgcgttcgcggagcaggtcggcgtggccgttgtggcgggcgtactcctcgatcatgtgggtgtagatccaccgcaggctgaagggttcgtcggtgaacctgctccggcccttcgacaggtcgtccaggccgacgccggcggcgaggcggcgcgcggcctcgatctcggcctgccaggtggcgtgggcctcggcccaggtgtcggtgtccgtgacgtggaagtcgccgtcggggtcctgctcgtcgtagtagatcggtcccgtgtcctcaccggtcagcaccctgcggaaccagctccgctcgacctcggccatgtgccgcaccagcccgagcagggtgagtccggacggcgcggcggaggcggtgcgcagctgttcgtcggtcaggccctcgcacttccacgccagggtctgccggtggtagtccaaccagccttccagcatggtgcgttcgtcggcattcagggcgggttcgcggcgctcggtcgtcgtcatgcgtagatcgtcgctcaggcgtggccctcacaccaggtgttttccgccgctgccgagcatgccctccagcagctcccgcagccccgcccgcacctcgtcgagctccgggaccctcgcgtggaaggtcccggccacgcacgagaacatcagcccgtccgcccaggcgaccagggacagtacgtgccgctgagggtcgttggagcccatcgcggtgaccagtacgccgagctggtcgcggaagcgggcgcccgccgcgtcgaagggggcgcgcagctcggggcggcgggtcgcctccagggccagttcgtagcgggcgagggtcagctcgcggttgccggtcagcgcgcggtgggtggcgagcgcgagcccgttcaccagcgcgtcgaggccgccggtgcgcggatcgggcatctcgtgcagggccaggacccgtgcctcccggtcggccagccggcggacggccagctccaggagggcctggcgggtgcgggcgacgttcgacgtcgaaccctgcggcagcccggccgtctcgtcgacggcccggtgggtcacaccgcgcatcccgcgtgcggcgagcagggcgagagcggcgtcggcgacgcggtcggcacgcgagagggcgggttcggcggttccggcgggtccggcgtgcggggcgggggcatcggcagcgggcatgggggtcaacctacccgtttgactacgcctgtagtgcatgacactacaggcgtagtacggtcgggtggtccgcgcgtcactacagatgtagtctcgacattctcggaggaagccatgtccccgtccctgtctccgtccgtctcctcgtccccgaccgccgtcgtcatcgggggcggtatcgggggcctcgccgcggcggcggcactgcaccggtccggccgccaggtcaccgtggtggagcgagcccccaccctggagcccgtcggcgcggccatctcgctctccccgaacgccctgcgcgccctggacgtcatcggcatcggcgaccggatccgcgatctcgccgcctggcagggcgacggagggctgcgcacgccggcgggccgctggc

SEQ ID NO: 1417 - DNA, 4016 bp, Unknown
  Kingdom: Bacteria, Phylum: Actinobacteria, Class: Actinobacteria, Order: Streptomycetales, Family: Streptomycetaceae, Genus: Streptomyces
gcgggggaggcggcgggggaggcgggggactgtgcggccgtcatggggccattgtccggcatcgggcgccgcacgcgcacggccgccgcccctgcgggtgcggcggccccccgggggctatccgtgctggtaggcgacgagtgagatgcccacgtagtgcacggcgaaggcggccagcgtgaaggagtggaagacctcgtggaagccgaaccagcgcggggaggggttcgggcgcttgatgccgtagacgatgccgcccgcgctgtagagcaggccgccggcgatcaccaggacgaggaccgcgatgccgccggtgcgcatgaagtcgggcaggaagaagaccgcggcccagcccatcgcgatgtagcacggggtgtagagccagcgcggggcgccgacccagaagacgcggaagacgatgccggcggcggcggccgcccagatgccccagagcagccactcgcccttgccgccgggcaggagcagcagggtcagcggcgtgtaggtgcccgcgatgatcaggaagatgttcgcgtggtcgaggcggcgcagcaggccgccgaggcgcgggccccagttgccgcggtggtagagcgcgctcacgccgaagagcaggcaggccgtgaggacgtagatcccgcaggcgatccggccccgggtcgagtcggccagcgcggtgagcaccaggcccgctatcaggacggccgggaacatcccgaggtgcagccagccgcgcagtttcggcttgacggggtgcgggagggagagcgctgcctgaccgcggccaccggccggcgagtccaggggcgcgtcggaggcggacgcagtcatgcgccgcatggtacccacgtcaccgtaagtggggcgtcagcgcacagggtgagcacggtgatcacgggaaatccgggcgaacgcaaaaagtccttcagtcgaggtcaacgcggacgcaaagaatcgcggaaaccgtgggattcctcaccctgctcacctgtgcggccctctggacagatgggcgctcgcgtcggatgatcaaatgagtgcggtcggcaccggatgagcggctacgaagcatccgggtcgcagcccccacggggcgacaagacaaaaaacccctcatttaggagcaatcgtggcgcgcgacatcgcggctccccccgtcctcccgaccaaccacaaggacctgatctcgtgggtcgacgagatcgcggaactcacgcagccggacagggtggtctggtgcgacggatccgaggccgagtacgagcgactgtgcgaggagctcgtccagaagggcaccttccggaaactcgacccgatcaagcgccccaactcctactacgcggcctcggacccctccgacgtggcccgcgtcgaggaccgcacgttcatctgctccgccaaggaggaggacgccggcccgaccaaccactggaaggcccccgccgagatgcgggagatcttccggggcaaggacggcaagggaggcgtcttccgcggctcgatgaagggccggacgatgtacgtcgtcccgttctgcatgggcccgctgggctcgccgctctccgcgatcggcgtcgagatcaccgactccgcctacgtcgccgtgtccatgcgcaccatgacccgcatgggacagccggtcctcgacgaactcggtgacgacggcttcttcgtgaaggccgtgcacaccgtcggcgccccgctggagcagggccagcaggacgtcccctggccgtgcaactccaccaagtacatctcgcacttccccgaggaccgcgagatctggtcctacggctccggctacggcggcaacgcgctgctcggcaagaagtgctacgccctgcgcatcgcctccgtcatggcccgcgacgagggctggctggccgagcacatgctgatcctcaagctcaccccgcccaccggcgaggccaagtacgtcgccgccgcgttcccgagcgcctgcggcaagaccaacctcgccatgctggagccgacgatctccggctggagcgtggagaccatcggcgacgacatcgcgtggatgcggttcggcgaggacggccggctgtacgcgatcaaccccgaggccggcttcttcggcgtcgcgcccggcacgggtgagcacaccaacgccaacgcgatgaagacgctgtggggcaactccgtcttcaccaacgtcgccctcaccgacgacggcgacgtgtggtgggagggcatgacggaggagaccccggcccacctgaccgactggaagggcaacgactggacgcccgagtcgggcaccccggccgcgcaccccaacgcccgcttcaccacgcccgccgcccagtgcccgatcatcgcgccggagtgggaggaccccaagggcgtgccgatctcggcgatcctcttcggtggccgccgggccagcgcagtgccgctggtgaccgagtccttcgactggaaccacggtgtcttcctcggcgcgaacgtcgcctccgagaagaccgccgccgccgagggcaaggtcggcgagctgcgccgcgacccgttcgccatgctgccgttctgcggctacaacatgggcgactacatgggccactggatcgaggtcggcaaggacaaggaccagtccaagctgccgaagatctactacgtgaactggttccgcaaggacgaccagggcaagttcgtctggccgggcttcggcgagaacagccgcgtgctgaagtggatcgtcgagcgcctggagggcaaggcggagggcgtcgagacgccgatcggcatcctgccgaccgaggcggcgctggacaccgacggcctggacctgtccgcctcggacctgaagttcctgctcaccgtcgacaaggacgtgtggcgcgaggaggccgccctggtccccgagcacctgaacaccttcggtgaccacacgcccgcggagctgtgggagcagcaccgcgcgctggtcgagcgcctgggctgaaccgcccgcgcccagaactccgcggccgatcgcgacctgccctgacctgcaacgtcgctccggtcggccgcggcagcacccggtcaggggccggtcccgcacaacggcgtgcggggccggcccctttcgctgtcctgccgggcccgcccgctggccgtgtgcgcgcactccttgcgcgcactcgtccggcgtagccgagcgtatggccggggcggcggtgggtactcgggagtcctcccggtgaaggagggtgatgagggcatggctggagacggtgacttctacaagcacgaccgtccggagaacccggacctggccgaggaccgcccgcgcggcggcggcccggaggagccccaggggcgcggcaactggccggtgtggtgggtggtcctggcgatcctcgtgctgttcgtgctcttcgtcgtgatcttcggttgagctcctggttgacgcgaacgcgtcaccgtatccacccgtgcggattcacagcgcacgctggagcagaagggtgtcgagccggcggccgtgcttgtaccccacggcggtcagccgccccgcctcggtgaaaccgaagcggcggtgcagcgcggccgaggcgtcgccgcccggctcggcgatcaccgcgatcatgcgctgcgccccggcgcgggcgcagccctcgatcagctcgcccagcagcgcggcgccgagcccgcggccggtcgcgtccggggcgaggtagacggtgtcctccacggtgtaccggtaggcgggcttggggcggtagggcccggcgtaagcgaaccccgtgacgcgtcccgcctcctcggtgaccaggaacggcagcccgcgcccggccaggtcggcggacttgagttcccagtccgccagggagcggggcgtctcgtcgaaggtggcgacggtgtgcagcgcgtagtgcccgtagatggcggcgacggcggtgagatcggcggggcgcacgggccggacggcggcgttatgaacggtcacgtcttctctctcgcccgggcgcgggcacgcagggtgtggggcgcccggtccgcgcgtcgctgcg

SEQ ID NO: 1418 - DNA, 975 bp, Unknown
  Kingdom: Bacteria, Phylum: Actinobacteria, Class: Actinobacteria, Order: Streptomycetales, Family: Streptomycetaceae, Genus: Streptomyces
cggctgaaccggacccgctggaccggaccggccggatcggagcgggccgattcagccggaccggacccgccggaccgccccggaccgtccggcgggcgaccgtcagccgccggtgggggtcccgtgcagtcgcacggtgccgaggatcttcatgatggtcgccttgggaacctcgtcgcggacgcccttcacgccgtagaagttccaggacacgaagtcgccggcggagttcttgaagccgaaggtgaccgccttgccgtcggtcgcgcacttgcccttcatcggcgtcttcgtcgactgggcccaggcgatgctgccctggatgcccgacgtggtcttgaagggctgggccttcttgtcgaaggtgatgctcttcttgtcgggctgggtgaagccgccgtacacccaccacggcacggtgttcaccgcgacctcgtcggtgtccttcgccccgctggcgcccttgacacccgccgaggccagtgacgtgtcctcggtccggccgtccttgtcgtcgtcggacgtgcaccacttcgacttgtcctgagcgaccccggacatgatcgcgagcaccttgctggtcttgttgtcctcgaacccgatctcgagaccgggcgacttgacctcccagtccgcgggaacgtcgtaggcgacgccccacttcgggttgacgacgaccttccagcccgcgatctgcggcttctcggtctcgttgccacgggggttgtcctccgaggcggagtcggagggggccgtcccggtggaggcggacgccgacgtggacgcggagaccgacgggctcgccttggagtccttcgtaccgccgtccgccgagtcgtccttcttcccgccgaggaccaggaacccggtcacgccggcggccaccaccacggccgccgccgcgatgatcgcgacgagcttcgtccggttgccgccgccaccgccgttcccgccgcctccgccgaccggctgctg

SEQ ID NO: 1419 - DNA, 2756 bp, Unknown
  Kingdom: Bacteria, Phylum: Actinobacteria, Class: Actinobacteria, Order: Streptomycetales, Family: Streptomycetaceae, Genus: Streptomyces
gtctataccgcctcgatatccggtccccgtgcaggtggacggggcttcccgccggccctcagccggccgcgcccatccggcgcaccgccggggtcgccagggcggccagcgccagcagggccatgccggcggcggccaggacgctccagtacgcccccgcggccgccagcaggaagccgcccgcgagcgcgcccagggagttcatgccggagccgaccaggccgaagacgctcgtggcccggccctgcatcgcgtccggggtgacgcggacctgatgcacccccgccgcgacgttcagcagcgccccggcccagctggtgcccgcgcacagggcaccgagggcgacggggtgaccggtcacggcgatgcccgccatcagcgccgcccacaccacgagcgccccgacgagcaggacgggcagcggcatccgcttcatgaaccaggacgcggtgagcgcgcccgcgatgccgccgacgccctcgatcacgccgatcaccgccatgtaggacggggcgtagccgccctccttgacgatcaggaccagggccaggttcaggatctggaacagcaggttgctgccgcccacgacgatgatcgcggcccgcatgaagcgctgccgccacacccaggcgatgccctcgccgatctccgcgcgcatcgacggcttcccgcccgcggcccgctcgtcctggaacggcttggggatcagcaccagcgtgaccagcgcgaagagatgggtgaccgccgccaccccgaacggcagccagcggaacgcctggaagaggaccgcaccggtgggctgcccgagcagcccggcggcctgaccgcgcgcctcgttctgcgacagcgccgccgccaggtggtcctcgtgcacgacatggcgtacggcggcgcgctcggcgagcttgtagaagatcaccgcgccgccctccaggaaggcggcggccatcacgtgcggcaccgacagcaccccgaaccagagcgccgcggccaggctgcccatcgaggcgaggcccaccgcgtcgcacaccaccatcaggcggcgccggtcccagcggtccaccagagcgcccgccggcagcagcaggagcagttgcggcagcagcgccgcgaacccgaccaggcccgcgctggacggtgagcccgtgtaccagagcatcagcagcgggtaggccgacaccgcggcccgcacgccgaactgggagagtccggcgccggaccacaggagcaggaagtcgcggttgcgggagagcggcgcgggcttcgccgcctgctccgccgcctccggctggccgaggagggtcaccgggccgccgccacggcgaccgggcccgcgccctcggcgaggtccacggcgcccaggcggcaccactccaggaccgccatcgcgctgtgcatcttgttctccgcctggtcgaaggcgatgctgtgccgcccgtcgaggacctcggccgcgacctcctcgccgcggtgggcgggcaggtcgtgcatgaacacggcgcgcggactggtgtgccacagctcggccgtgacccggaacggcaggaaccggtcgcgccacagcgggtccgccttggtggtgcccgtggtctgccagcgggtggtgtagatgacgtcgaagtccccctccacgtccttcgggcctgccatgtggtgccgctcgtgcaccacggatccggtgcgcgccgcctgttcgtgcgcccggcgcagcaccgccgcgtcgagtccgtacccctgtggtgtgcgcagttccagggtggtgccggtgtaccggctgaggccgagggccagggcggcggccgtgttgttcccctcgccgaggtagaggacccgcagtccgtcgacgcggccgaactgccgcagcagcgtggtcagatcggtgagcccctgcgtggggtgctcgtccgcgctcatcgcgttgacgaccgacatccgctgctgtgcggcccagccgcgcagctccgaggggtcacccgcggtccgggcgaccagcacgtccagcatgcgggagaagacccgtccggtgtcctcggtggtctcgccggtgttcagctgcaggtcgtcgggcccgtacgacacgatctggccgccgagtctgagggcgcccgccgagaaggcggtgcgggtccgggtggacgtcttgcggaagtagatgccgctgaccgtgccggccagcgggtcgccgtggacggcggtacccgcgctgaacccggcgcctcgcgccacgatcgcccgcagttcggcgtcggagaggtcgtcgagggagatgaggtggcgaggggacatgtgtgctcctggagttcgggggcggccggtccggcacgggggtgccctggccggaccggccgcggtgaaggggcggggcctgttcccggccccgctttctcaggtcgggggcggcgtaccgggaggagtcggtcagccggcgtccatggccgcggcgagggccttgacgacgtgttcgccggcgtcgccgttggtcagcaccacgaggccggtgcccgcggtgagccgggtcaccgacaccccgtggtagccggtcggggtgccgccgtggccgaactcggtgtcggacgccgtggagtcgaccaccgtgcccaggccgtagaacgtgtcccggtgcggtgtgagcagcgcggtcgccgtttcctcgcggagcagggccagcggacggccgagcgcgccgcggcgcacctcgagggcgaggcgggccaggtcgggtgcggtcgaccacaggccggccgccgccgcgtcgg

SEQ ID NO: 1420 - DNA, 2278 bp, Unknown
  Kingdom: Bacteria, Phylum: Actinobacteria, Class: Actinobacteria, Order: Streptomycetales, Family: Streptomycetaceae, Genus: Streptomyces
ctggagacctcgacgaccgcgcacgcagcggtcgtcgtcggtctgctgccgctcaccacggcgctgctgtcggcgctgcggatcggcgtccgcccgtcgcggatgttctgggcggcggcgctggcgggcgcggctgccgtggtcgccttcaccgtgcagcagagcggtggcgcgctgaccgccgccgacgggtacctgttcggtgccctgctggtatgcgcggcgggctacaccgagggcggccggctggcccgcgtcatgccgggctggcaggtcatcggctgggccctggtgctgtgcctgccggtcgccgtgccggccacggcggtcgcgctgtcgtacgagccggtgcacctgggcgtgcacagcgtggccgggctgctgtggctggcggtgggctcgcagttcctcgggctggtcgtctggtaccggggcatggcggccgtgggcatccccaaggccagccagttgcagctggcccagccgctgctcacactggtgtggtcggtgctgctgctcggcgagcatctgactccggccgccccgctgacggccgccgccgtgctcgtctgcatcgccgtcacccagcgggcgcgcggctgaccggcctcaccggcgccgaccgcacacccggttccggccgcaccggttccggccgcgctccgcgccgtagactcgggaaccgaggaccgctgctcccccgcatggtgaggaggccccgcagatgcgcgcagccaaaggcgaccagctcgtgcagcacggccgggtggtcggccagcacgaccaggtcagtgaagtcgtcgaagtgatggggacggagggcaacccgccctaccgtgtccgtttcccggacgggcacgaggccgtgatgtcacccggccccgactgccaggtccgtcatcacgaggaagaacggcaacagcaccggtgatccggcgcggtacccggtcccacaggggcactgggtaccgcgggcaccggccggccacgacgacgtacggcgggcaagccgatttaccgcgggcaccgcacggccacgacaaggtaccgcgggcaccgcacggcagacggtcagcgcggagggcgcgcgggctgccggtagtggtcggcgaccacgcgtgccatcgcgcccgccgggtccgccgcgacctccttggccgcgaagaagacgtgcccgcccacctgcgggtacttcttcgccagggtgaggtgccgggacagctcgtccgggtcccgccacgctttgccctggctcgcgtcaccggccttgtacagcgcctcgcccaggtacaggcgggtgcggctgccccgcgccacctcggcccaccagggcacgagcttggcgtagtcggcggcgctcaggccgatgttccagtacagctgcgggacgatgtagtcgatccagcccttgcggacccaggtgcgggtgtccgcgtacaggtcgtcgtaggactgggcgcccgccttggtgtccgatccgcgcgcgtcggtcgaggcgttgcgccacacaccgaacgggctgatcccgaactccgtgccgggccggacccgtgcgatgcccgccgccgtctcccgcaccagccggtcgatgttgtcccgccgccaggcggcccggccggtgaagccgccgccgtagcgggcgtaggccgcgtcgtcgccgaaggagtggccggccaccgggtacgggtagaagtagtcgtcgaagtggacgccgtcgacggggtacctgcgcaccgcgtcgagcatcgccttctgcacgaaggcccggacctcgggcaggcccgggttgtagtagagcttcccgccgtagggcaccacccagccggggtgcttgcgggccgggtgcgaggcggcgagccgggacgggtcgtcgtgcagggcgacccggtaggggttgaaccacgcgtgcagccggaggccgcgggcgtgcgcctcctggacggcggtgcccagggggtcccagccggggtccttgccctgggtgccggtgaggaactgcgaccagggctcgtacggcgagggccacagcgcgtcggcggcgggccgcgcctggaagaagaccgtgttgaggcggcggcgcaccgccgcgtccagcagcgcggtcagttcgccgcgctggcgggccacgctcagtccggtgcgcgagggccagtcgcggttggccacggtcgccagccacatgccgcgcatctcggtggcggcaccgtcgccgcgcgccctgtcatcgtgtgtccggtcgccgggcgacccgtcgccgcgcgcccgggttcaccgccag

SEQ ID NO: 1421 - DNA, 1699 bp, Unknown
  Kingdom: Bacteria, Phylum: Actinobacteria, Class: Actinobacteria, Order: Streptomycetales, Family: Streptomycetaceae, Genus: Streptomyces
ctcgcccgctgacggccggcgtcgcgccggccgtcagcgggcgaggcgggggaagagggcttctgcgctcttgcggtcgatggcctccgcctggccgggcgcgaagtccgggtaggtgtccaggaagtggtcgtagtaggacccggcttcctgcggggcgaagggccagtcgctgccgtagaggacgtggccgggttcggcgaaggccagcagggccgggagggcgctggggctggcggacagggcggtgtcgaagtagaagcgcctgaggtcgcgcaggatgtcctcggccttgcggtcccggtcgacgacggtggaggtcaggccggagaagcggtaggcggcgtacggcaggaagccgccaccgtgcgagaggatcacccgcacgttcgggtagcggctcatgacaccgctcagcaccaggtcgagagcgctgcgggtggtgtcgaagacgtagtcggcgagcggggccggcgtgccgtgcagcaggggcatcgggggctgggcagggtggatgaagacgttcgccgcgcggcggtccagctcggcccacagcggctcgaagacggggtcgccgaggtagcgtccgcgggcgttggacatcaggacgacgccgtcggcgtgcagggtgtccagcgcgtgcacggcctcggtcacggcggcgtccgcgtcgggcagcgggacgctggcgaaatgaccgaagcggccggggttgtccttgacgacctcggcgccgtactcgttgacggcgcgggcgagatcccgggcctgggcgtcgtcgccgaggtggacgccgggcgcggtgacggagaggacgccggtggcgatgccctgctggtccatcatcgcgatggcgccccgcgggctccagtcggggatggcccagccgcctgagtcgaggccctgcgcggcgagcgtcgcgccccagaccggcggaacgatgtgctggtggacgtcgatgcgagcaggggaagtcatggtgcttcgcctcctaatagttagcttactaagtgacgtcgtttagtaagctaacattcatgagggagacgagcaaacgggcgatcagcggcacccctggcggcccgcacgcggagcccggtatcgaggaactggcccaggccgccgaccggctcttctacgccatgcgccgttcccggtccgctacggtcggccagtccgaaggcggcctgtccgtgtcacagctggcgctgctcaccgcactgagcgagccgggcgtccgcgacgagggcctgccggtcagccggctcgccgccaacgcggaggtcagtgtgcccaccgccacgcgcatgctgcagcaactggaggccaggaacgtggtcacccggcgccgcgcaccgcacgacgagcgccaggttctcgtacggctcaccgaggagggtgcggaacgcctggccgccatgcagacggagctgcgcgcacgccagtacgccgcgctgtcgcagttctcgccccgggagcgccacgaactcgcggcgcagttgcaccgcctcgccggcctcgtcgacgagaccgtgcccggcacgaccggaccggcggccggacgggcgggcaacggacgcaccggagccgcgcggacgaacgacggacgcaccgggggcaggccgaccggggccgcagagccggcgtgacacatcccgtcggcacgggcggcggtcgtggccggtaccggccacggtgc

SEQ ID NO: 1422 - DNA, 918 bp, Unknown
  Kingdom: Bacteria, Phylum: Actinobacteria, Class: Actinobacteria, Order: Streptomycetales, Family: Streptomycetaceae, Genus: Streptomyces
gtgacgcccggatccgggcgggcgggcggcgtacgggtcacaggcccatgcccaggccgccgctgacagggaggaccgcgccggtgatgtaaccggcctcctcaccggcgaggaagcggatcgcggcgaccacgtcgtccacggtgccgggccggcccagcggcgtcatgcgcatgacctcgctcctgcgccggtcggacagcgtggcagtcatgtccgtggcgatgatgcccggcgccaccacgttcacggtgatcccccggtcccccagttcccacgccagggagcgggccaggcccggcagcgccgccttggaggcggcgtagttggtctggccgggagagccgaggaaaccgagcaccgaggagacgaggacgatccgtccgcgccgggcgggcagcatgctgcgcacggcggccctcaccgcggcgaaggcaccggtgaggttggtgcgcagtacgtcgtcgaagtcctcgtccgtcatccgcagcatcggcgtgtcccgggtgatgccggcgttggcgaccagcacttccacggggccgtgttcggcctccgcctcccgcagggcgcgttccagcgcgcccggttcggtgacgtcggccttgacgccgagcacgccgtccggcgggctgcccgtccggtggctgacggcgaccctgtcgccgtcgtcggcgaaggcccgggcgacggcgtggccgatgccgcggttgccgccggtgacgaagaccgagcggttcatcgttgtctccttctgcgggaacgtctcggatgtctcacgcgcagtgcggacgccgcgcgggaaaggggcggcttcgaagcccgggcggccgccccgcccgagggggcggggcggccgtccggcgggggggtcaggccgcggtgaagacgagcgcggcgttgtggccgccgaagccg

SEQ ID NO: 1423 - DNA, 3910 bp, Unknown
  Kingdom: Bacteria, Phylum: Actinobacteria, Class: Actinobacteria, Order: Streptomycetales, Family: Streptomycetaceae, Genus: Streptomyces
ggcgcgggggccttcgccgagtcggcgtcgcccggctgccagccgcgcacgacgggcagcgccttgccggagtcggtgcgcagcagcgtcaggacgtagtacccgcgcttgccgtccagctcgcggtccgggaccagcagttgcttgccgtagcggccggtcgcggtggcccgcatgcccgaggtccgcttgtcgacgggcagcagctgtgccagcgggcgcggcgcctccgtgcgggcggtggcggcctgcttcgtcaggttccggtggtcttccacgcgcgcgtcgaaccggctcagctgccacgagcccatgaacacgcagaacgggatcgcgagcagcacgaagacgttgatgccccaccagcggggcgtcagaagaaaccggtacacggctcaacggtacggtgcccgccgggcgcgacaggccgcggggtcggagttttccacagggaggggaggcggacgggggttccacgccgtcggttttccacaggctggggaacggggcggcgcgttgtcggccgggccaggcactatggggccatgactgagagcaacgggtccggagcgcagaccggagtgccggagacagcggtggtgccggggacatcggcagcggtgtcgggagtgtcggaggcatcggcggtgccggggaagccggacatgccggactgggagaagcgcttccgcgcaccgcgggtgtccctgccggactgggcggaggacgcgccggaccgctccctgttcgtgtcgaacgcgacggggacgtacgagctgtacgcctgggaccgggcgagcggcgcccagcgccaggccaccgaccggcccaacggcaccacggacggcgtgctgtcgccggacggcgagtggatctggtggttcgacgacaaggacggcgacgagttcggcatctggcgccgccagccgttcggcggcggtcccgacgaggccgccgtaccgggcctggacccctcctacccggccggcctggcgctcggccgggacgggcgtacggcggtcgtgggccgctccacggacgaggacggcacgacgatccacctcgcgcgcgtgggctcgggcgaggccccggccgagatctaccgtcaccgcgagtcggcgggcgtcggcgacctctcgcacgacggcacgctgatcgcgatcgagcacaccgagcacggcgacgcgatgcactcggcgctgcgcgtgctgcgcccggacggcacggcggtcgccgacctggacgacaccaagggcggcacggtcgagctgggccttgaggtgctgggcttcgccccggtcgacggggacacccggctgctcatcggccaccagcgcaggggccgctgggagccgctggtctgggacgtggcgacgggcgaggagacggacctggccctcgacctgcccggcgacgtgagcgccgagtggttcccggacggcagcggtctgctcgtcgcgcacagcttcgaggcccgcagcgaactgttccgctacgacccggcgacccgcgaactgaccaggatccccaccccgcccggcacggtctcgggcgcgacggcccgcccggacggcagtgtggaatacctgtggtcgtcggcggccgagccctcggcggtccgttcgaccagcggccgggtggtcctggacccgcccggcatgaagtccccggggtcggtccccgtggaggacgtctgggtggagggccccggcggccgcatccacgccctcgtgcagaaaccggcgggcgccaccggcccgctccccacggtcttcgacatccacggcggccccacctggcacgacagtgactccttcgccgcaggaccggccgcctgggtcgaccacggctacgcggtggtccgcgtcaactaccgcggctccacgggctacggccgcgcctggacggacgccctcaagcaccgggtcggcctgatcgagctggaggacatcgccgcggtccgcgagtgggcgatcacctcgggcctcgccgacccggaccggctgatcctcaccggcggctcctggggcggctacctcaccctgctcggcgtcggcacccagccggacgcgtggaccctgggcatcgcggcggtaccggtcgccgactacgtcacggcgtaccacgacgagatggagggcctgaaggccatggaccgcacgctgctgggcggcaccccggaggaggtccccgagcgcttcgaggcctcgtccccgctcacctacgtggaccaggtcagcgcgcccgtctacatctccgccggggtcaacgacccgcgctgccccatccgccagatcgacaactacgtcaaacgcctcgaggcccgcggcgccgtccacgaggtctaccgctacgacgcgggccacggttcgctggtggtcgacgaacgcatcaagcaggtccgcctggaactggacttcgcagcccgccacctgccgaagtaaccgctccggccgtcggccgccggcgggggcggtgaaggtggcgccacggccggggcgccgtggcctcctacaccgtcccctcccgcccccgccggcccagcagttccgcgagcccgcgccgggtcgccgccaggacgacccggtcctccttgcgcaggacgtacgtgtcgggcaggttccaccggggcccggccgccgggccggccccgggtcccggctcctccgccgccgcctgggcggcgggctcgcgccgctccccggcaccggaaccgccgcccgcaccgcccggcgcgcccgcctccagcgccagcacccgccagtaccccgcccggaacgcctcggcgaccgtcctgccctccagctgcggatgcccgtccacgtccacggacgcgaacagcagcacccgccgctccaccggcaccgcgcccaggatctgccgcccgaacatcgccccggcgaacgcgggcgccgccagatgcgtcacgctccggctgcgcgtcagcgcccgcggatgcgcggcccgcagcgtccggtacaccgccgtcgcgaagtcgtcgtcgtacagccgcagaacggcccgcaggtcgggccgcagcgagcgcgcgtacagcacggcctccaggttcgtcgtgtccgcactggtcaccgcgagcagcgcgtgcgcgcggtggatcttcgcggcctccagcacgccctcctgcgtgacgtccccgagcaccaccggcacccgcagccgccgcgccgtcgcgagcccccgcgcgtccggatccgcctcgacgcacaccaccggaacctgcagctcacgcagccgcgtcagcacccgcgtgccgaccttgcccagcccgaggagcaccacgtgcccgccgagcccgcgcggcggcttgcgcagcgcggaggccgaccggaaggtccccagcgcctccagcaccgccgcgaggagcaccggcagcagcagcaacccgaccagaccggacagcagttggagcacctgccgccccaccgtctgcccgatcgccggatcgtcgatggcgaacaggtcgagcagcgtcagatagagcgcgcccagcggacgcacccccgtcaccagccacaacgccaccgcgagcgcgaacacgcacgccacgagacccgccaccgaccaccgcaggcgccgcgagaacagcgacgtgagcggcgggacgacaccgactccgcgcccggacggcaggtagggcccggcggcgtacgacacctgctcaaggaccacggtgccgcgcccggtggcctcccgtacggccgccgcgtccggcagcagccggggccgctgctcgccgctgacctcggacccgtccattccggccggatcgctgctggtcgccgagagcagggccagcgtgcacagcccggggtcggcgacctgtcccggcgcgggcggcggccgttcgaccgcgtgcagcagcagcccctcggtctgcacgaccttgctg

SEQ ID NO: 1424 - DNA, 3973 bp, Unknown
  Kingdom: Bacteria, Phylum: Actinobacteria, Class: Actinobacteria, Order: Streptomycetales, Family: Streptomycetaceae, Genus: Streptomyces
gagcagcagcgtggaccggccgcagtacgtgccgacctccagcagcggcagcccgagccgtccggcgtccaccgccgccgcgtacagcgccagcccctcgtccgtgggcatgaaccccttcgcggcctcgaacgcggccaggatgtcgggcttcggtgccgcggtcatgcagcgggtccttccggtcgtacgggcgtccagggggcccatgctgccgcacccgctgccgggcgggcgacagcgggtgcggagaaggcgcggggcggggtgcgtcaggcgctgaccgtctcgcccggcagggacaggtcgaggtcgaccgggcggtcgtcgcccgtgtgggtcgcggaggaggcgtgcgggccgtgtcctgcggcgcgcgcggcgagcacgtagggaccctgggccgggaccgcgagggtgtagcggccgtccgccgcggagagcgtggcaccggcctggcggccgtgccggtcgatcagcgtgaccttggcacgggcgaccggggcgccgctggcgtccaggacccggccgcggaagccgcgcagcacctcctcggcgtgcgccaggttggcgtcctcctcactgctggcgcgcagttgcgtggtcgtcgaacggttcggccggggcaggcacagcgcgagcaccagaccgagggcgaccgcggcggtggcgatcaggaaggagacgcggaagccgtgcatggtcgggatcgcgacgccgttcacgtggtgcgcggtgttggccagcaccatgccgatcacggcgctggacaccgaggtgccgatggaccgcatcagtgtgttgaggccgttggccgcgccggtctcggaggccgggaccgcgccgacgatcagcgcgggcagcgaggagtaggcgaggccgataccggcgcccagcagcaccgaggtcaggacggtctgccaggccgcgttcatcaggccgagtccgccgccgtagccgatcgcgatgatcagcaggccgatgatcagggtgaccttggggccgtagcgggcggacaggcgggcgtagacgggcgcggtgaacatcatcgtcaggcccagcggggccacgcagaggccggcgacgaccatcgaccggccgaggccgtagccggtggcggcgggcagctggagcagctgcggcaggacgagcgagacgacgtagaaggcgacgccgaccatgatcgaggcgaggttggtcagcaggacctcgcggcgggccgtggtgcgcaggtcgaccagcggcgccttgctgcgcagctccatcaggccccacagcagcaggacgacgagcgcggcggcgaacaggccgagcgtggtgcccgacgaccagccccagtcgctgcccttggtgatcggcagcaggaacagcaccagtccggcggacagaccgagcgcgcccggcaggtcgaaggagccctcggcgcgcatgggggactcggggacggtgagcagggtgaggacgatggagaggacaccgagcccggcggcgccgtagaagagggcgtgccagtcggtgtgctgggcgaccagggcggcggcgggcagcgcgagtccgccgccgacgccgacgccgctgccgatcgagtagagcacggtggtggagaacaggccgcccatggacccgagcgaaccgagggccgagtcggtcatccgggtcacccccacgatccgtggggctggtagccgtgggccatgaggtcctccaggcaggctatgggggcgtgcggcacgacgcggtggtcgggtgcctccgcgaacacctcgctggacagcacacggccgtcgacgccgttgacctcgcgcaccgaggtgaccatgcgctgcagtcgtccgccgacggagaagttgttgcgccgctggatgaagacgacgaagttgaccgcgccggcgatcagcatctggctggcctcgatgggcagccgttcggaagcctgcaacgcgtaggtggagatgcggttgaagacctcggaggagctgttggcgtggatcgtggacagcgagccgtcattgccctgtgacatcgcgttcagcatggtcacgatctcgtcgccgagcacctcgccgacgatgacgcgggacgggttcatgcgcagcgaccgccgcaccagctcggccatcgatatcgcgccctgaccctcggagttgggcagccgctcctcgaacgccacgacgttggggtggagttcggggaaggtgtcgaggccgagttccagtgctcgctcgacggtgatgaggcgctcgtgcggcgggatctcgttggcgagggcgcgcagcagcgtggtcttgcccgcgttcgtcgcccccgcgatcatgatgttcttgcgggcgcggaccgcgcaggacaggaagtgccccacctccggggcgagcgtgccgttgccgaccaggtcggagacgaacaccttgcccatccgggcccggcggatggacagcgcggggcggcgggccacgtccatgacggcggacaggcgtgatccgtccggcagccgcaggtccagttgcgggttcgcggagtcgaaggggcgcgacgacagaccggagtacgcgccgagcacctggatgagctcgatcagctcctcgtcggtctcggcgaccggctcgcccttggcctcacgcccgtcggcgtacccgacgaacacctggtcgcagccgttgatgtcgatgttctcgacctgcgggtcgtccagcaggggctggaggcggccgacgccgaacagcgccgcgtgcacggcggcggcgtactgctcctcggtctcggcgtccagcggcgtacggcccgcgttgatctccgcgcgggcgtactcctccaggatctgcgcgatgaccgcgcgggcgtactgccgctcgtcctcgctggacatcggcgtgacgccgttgatctggtcgaggcggcgctgctcggcgatccggtcgccggcctcctgacggaaccgcttgaccagctgatggtcgacagcggtcaccgtccggctcctgtgtgaccggtcatcgggttctggtggccgccgccctggccgccgccctgcccgccgtcatgcggctgctgcgggtagtgggactgctgcgggtactgggccgactggtgcgtctgctgcgcgggctgctggtactgggctgctgctgcctgaggcgcctgctgggactgctgggcgtgctgcggctgctgggcttgctggggctgctgtccgagcggggtgtgcgggacgtgcgggacgtgcggggtgtgcggggactgccgtacgtcgtgctgcggccgggcggcggaggccgccgcggtccaggctgccccgtactgctggtacaggtcccccgcgaccttgcgggccgaacggatcagcagcgacttgtcgaggcgcccgcgtttgcggccggccaactgctcggccccggcctggtcgtcggcgatggttccgaccacgcgggcaccggtctgggcgtgcaccagcatgtcgttgacctgcccggagaccttgccggcgccgcccggctcggtgaccaggacgaccccgatcagcggggtggccaggctggcggcaccgcgcgagccgccgtggagcttcgccgacagcgcggcggcgcggtcccggacccgggcgatggactccggctcggtgcgcgagacgaggagtaccagatcggcgtgccggaacagctcgaccgccgggacgtccccgctgacccggccgcagtccgcgatcacgtcggcgggtgcgttcggggagtcggcgagcgcggcgaaggcgcgtccgagcgtgggccacagtccggcgagcccggcggcctgctcggcggtacccagtccgacgagcacctcgaggccgccgctcagcggctgcacgtggtcccagagctggtcgggcacgagtccgcggcgcgcggtcgcggcgatggagagcatgccgacgttcgggttgagcggtccgccgtgggcggcggtgctgcggtagacgaggtcgccgcccacggcggac

SEQ ID NO: 1425 - DNA, 3396 bp, Unknown
  Kingdom: Bacteria, Phylum: Actinobacteria, Class: Actinobacteria, Order: Streptomycetales, Family: Streptomycetaceae, Genus: Streptomyces
tgcctcaccgtggcgagcggccggtcagccctgcggacccggccggccctcgtcctgctcgccgccggccggcgtgtcgtgccagcgggggtcggtctcccactggaggttgcgctcgcgggcggtgtccatcgcgtgctgcgcctcctgccgggaggcgtacgggccgaaccggtccttggccgggcactccgggccctcctcgaccttctggtgctccaggcagtagaaccactctcccggcttgcccactgtgcgctttttgaacagggccatgaccagctcctctcgccaccgacatgttcccccatcggcgctcgatagactcacccgcatgtctggccagtcgctgctcgcccccggggagctgtcccccgcccgttccgtgcccggaaacatccgccgccccgagtacgtcggcaggcccgcgccgaagccgtacaccggtccggaggtgcagaccccggagaccgtcgaggcgatgcgcgtcgccgggcggatcgccgcgcaggcgatggaggaggccgcgaagcacatcgcgccgggcgtcaccacggacgaactggaccgcgtggcccacgcctacatgtgcgaccacggcgcctacccgtccacgctcggctaccgcggcttccccaagtcgctgtgcacctccgtcaacgaggtgatctgccacggcatcccggactcgacggtgctgcgcgacggcgacatcgtcaacctggacgtgacggcgtacatcggcggtgtgcacggcgacaacaacgccacgtacctcgtcggggacgtcgacgaggagagccgcctgctggtggagcgcacccgcgaggcgctgaaccgcgcgatcaaggccgtcaggccgggccggcagatcaacgtcgtcggccgggtcatcgagtcctacgccaagcgcttcggctacggcgtggtccgcgacttcaccggccacggcatcaacacgtccttccactccggcctgatcgtgccgcactacgacagcccgcacgccaccaccgtcatgcggcccggcatgacgttcaccatcgagccgatgctgacgctgggcaccatcgagtacgacgtctgggaagacggctggacggtcgtcaccaaggaccgcaagcgcacagcccagttcgagcacaccctggtcgtcacggagacgggcgcggacatcctgacgctgccgtagggactgacgctgccgaagggcctgacgctgccgcagcacctgagggcccgccgtcctgccgtcagcgttcctgcccttcgagtgacacccggccccccacctccacccacccctccggctgaggtgccgtcaggatctgggagcccgctccctgggtgatgttcagggcgcggccgagccgggccgtcagcagcagggccgccgcgccggtcgcctcgtcctcgtcgatgccgtcgtcgcggcccgggaaggcgcgggcgcggatgcggccggcgggctcgtcctcccaggaccaggcgtagatccactcccctggcggcgggacggggaggtcgtcgacctcggccggggtggcgtactggcgcagggtgcggggcggggcccactccgggcgggcctcgatccaggtgaactccccgtccatgcgcgtgccgacccggcctgccggagtgactagttccggtacgtccaggagccaggcggtgccgacgcaggggtggccggcgaagggcaggcgcagggtcggggtgtagatgtcgatgacgccgcgctcggggtcgtcgacgaacaccgtctcgctgaagcccagttcggcggcgagcgcctgccggtcgtcgcggccggggagcagggcaccctcgcggaccacacccagttcgttgccgtagccgccgcgaggtccgcagaagacgcgcagcacgtcgtagtcagtcaccggggaattgaagcatcagaggggccgcccaccgtcaccgtgtcgacattgcccctgcttgggcattcattgactttcgctttgcgttgccgagatcaagccgtgtctgtgatctttccgtacgggccggtgcgagcgggatcacggcccgggtgggtatgagtgaggtaagcctcaggtaagttagggcagcctcaccaatcattctcacctggagcctgcatgcgagccgtccgactctccgtcgtcaccgccgccgcgaccgcggccgctctgaccgccgtgacggcctgcaccgccaagagcgacgccaaggacggcgaagcgatccaggtgaccgccgccgactccacctgcgagacctccacgaagagcgtcccggccggtcaggtcacgctgaggatagagaacaaggggtcccgggcgaccgaggtggagatcctcttcccggacgaccggatcgtctccgagaaggagaacatcggccccggcaccaagtacacgctgaccgccgaggtcaaggcgggctcgtacgagatcgcctgccggccgggcatgaagggccacggcgtacggcagaagctcaccgtcaccggcaagggcgccgccgccgcgcgcgacccgcggctggacaaggccgtcgccgactaccgccagtacgcgcaggaccaggccgacgagaccctgccgcgcgtcgagacgttcgtgaaggccgtcaaggccggggacgtggccgccgccaagaaggcgtacgccccctcgcgcctgggctgggagcgcaccgagccggtcgccgagtccttcggtgacatcgacccgaaggtcgacgtccgcgaggacggcctggaggacggccagaagtggaccggctggcaccggctggagaagtcgctgttcaaggacggcaagatcggcgcggaggagaagaccctcgccgaccggctcgtcaccgacctcaaggactggcagaagcgggtcggcaccgccgagatcaccccgacctccatggccaacggcgccaaggaactcctcgacgaggtcgccaccggcaaggtcaccggcgaggaggaccgttacgcccacaccgacctggtcgacttcaagggcaacgtcgagggcgcgcagaaggcgtacgacctgctcaagccggtcgccgcgaagaacgacccggcgctcaccaaggaactcgacaagcagttcgccgcgctggacgccctcctcgacacctaccgcgccaagggctcggacaggacgcagtacgacttcgtctcgtacgacacggtcggcaaggacggccgcaaggcgctgtcggacgcggtgaacgcgctcgccgagccgctgtccaagctcgccgccgccgtggtgaagaagtagggggaggggccatgacagaggaacaggctcagggcggcaccacgccctcccggcgggctttgatcggctggggcggggccgggctcgcgctcggcgccgtcgcggccggcggcgc

SEQ ID NO: 1426 - DNA, 1960 bp, Unknown
  Kingdom: Bacteria, Phylum: Actinobacteria, Class: Actinobacteria, Order: Streptomycetales, Family: Streptomycetaceae, Genus: Streptomyces
agcaccgacgcggtggcactggccgccgcagcaccgacgcggtggcactggccgccgcagcaccgctggtgacaccgcccggcggcaccgccatacgcacgtgaggaggggctccacccggacatcgggtggagcccctccttcggcgttctcacggagtcactccgcgaggacggcctccgcctccagcgtcacgccgacggcctggatgaccgaggcgatcttgaaggcttcctggacgacctcacggtcgacgcccgccttgcgcaggacctgctcgtgcgagtccaggcacatgccgcagccgttgatcgccgagaccgcgaaggaccacagctcgaagtcggtcttgtcgacgccggggttgccgatgacgttcatccgcagaccggcgcgcagggtgccgtactcgtggtccgacagcaggtgccgggtgcggtagaagacgttgttcatcgccatgatcgccgccgcggacttggccgcggtgtacgcctccggcgtcaggttcgccttcgcctccggctccagctcacgcaggacgatcggcgaacgcgaggcgatggccgtggccagcaccgtgccccacagctgctgcgccggcaggtcgctgttgccgatgaccgagcccaggttgagcttgaggtccttggcgtagtccgggacggcggacttcagggagtcgagggacatgcctcactcaccagccagcagcgcgaccgggtcgagggtctcgtcgcccttgctccagttgcacgggcacagctcgtcggtctgcagcgcgtccaggacccgcaggacctccttggggttacggccgaccgagcccgccgtcaccatggagaactggatctcgttgttctggtccacgacgaagaccgcgcgcttggcgaagccctcctcgtcctcgatgcccagctcgcgcatcagctcgtgcttggagtcggccatcatcgggaagggcagctcgagcaggtccgggtggtccttgcgccaggcgtggtggacgaactccgagtcaccggagaagcccaggatctgggcgtcacggtcggcgaactcgtcgttcagcttgccgaaggccgcgatctcggtcgggcacacgaaggtgaagtccttgggccaagcgaagatcaccttccacttgccctcgtaggtcttgtggttgatcttctcgaactccttgcccttctccagcgagacgcaggcggtcagttcgaactcggggaacttgtcaccgacagtgagcacacgctctccttgcagcgaggaaacaccggctttgcccgtgtttcccatgggttggaccttgatgatgttggcacagagtcaattgattacggaaatagctacactcggtcgtgttgatcggaggtagttatcagtgaccgtcggtaatgccgcgaggcgcaggaccctgcccagcctctcccagctccgcgccttcgcggccgtcgccgagcacctgcacttcagggacgccgccgccgcgatcggcatgagccagccggccctctccggtgccgtctccgccctggaggacaccctcggcgtgacgctcgtcgagcgtacgacgcgcaaggtactgctctcgcccgccggtgagcggctcgccgtacgggccaaggcggtgctcgacgaggtcggcgccctcatccaggacgccgaggcggtccgggcgcccttcaccggcgtactgcgcctcggcgtcatccccaccgtcgcgccctacctgctgcccacggtcctgcgcctcgtccacgaccgctaccccgacctcgacctccaggtccacgaggagcagaccgcgagcctgctcgacgggctgtccgccggacggctcgacctgctgctgctcgccgtgccgctcggcgtgcccggcgtcaccgaactcccgctcttcgacgaggacttcgtgctggtcacgccgatcgaccaccgcctcggcggccgggagggc

SEQ ID NO: 1427 - DNA, 1057 bp, Unknown
  Kingdom: Bacteria, Phylum: Actinobacteria, Class: Actinobacteria, Order: Streptomycetales, Family: Streptomycetaceae, Genus: Streptomyces
  misc_feature (540)..(541): n is a, c, g, or t
caggggctgaccgggcggcggatcggggtgctgtcgggggccgcgttgttcctggtggccgcggccgtcgtggcctgcgtgcggcgccgccgctacaccgcgctcgcccacggcgccgcccgcgccggacggtacgacgtgctccaggaccgcgcggtcagcgcccgcgcctggcgccgggggcaccgctggtggctgctgctggcgttcgtggccgcgctgggcagctccttcgcgctgccggcggccggcggcatgctcctcgcgggcgccgggacgggactgcggctcaaggccgcctggctcggacggcgcgaacgcgccggggacgcgctgctgtgggtgcgggtggactggctcgcggcgaacggcgggcggcccgcgggcaaggcggtcaaggcctaccgcagcacgggcatcgcggcgggcgacgcggccccgggaggcgcccgccgccgcaccgcggcgctcgtctagtacggccagtaccgcgtgacggcacgtctgccacggcctgccggtacgtctgctacgtccagnncgtccagtacggcctcaccgttgctacgtccagtacggcctcaccgtacggctcagacctccaggtcctcctcgatgcgcttgagctggtggcgggccatcgccaggttggcccgcttcgcgtccagcacgaggtagaggaagaggccgttgccgctgcgtccgctgatcaggcggatcacgtggtactggtcggtcagggtgatcaggatgtcctcgatctgccccttgaggccgaggtgttccatggtgcgcatcttggcccgtacgacatcggtgttgccggcggcggcgacgttcaggtcgaaggtcttgctgccgcccatcgtgcccagcgccataccggtggtgtagtcgacgagcgcgactccggtggcgccctcgatggaggcgagtgcttccttcaggcaggtctcggtgttggccatggccggtctctccttcttgttcctgtcagctttcggtggtggccgtgccggcgggcgcgtggctgcccggcggggtggcctgggtggtg

SEQ ID NO: 1428 - DNA, 1266 bp, Unknown
  Kingdom: Bacteria, Phylum: Actinobacteria, Class: Actinobacteria, Order: Streptomycetales, Family: Streptomycetaceae, Genus: Streptomyces
tcgtcggtgtcctcggcgcggcctctctcgccctcgcgggcaccgcgatggcggccaccgccgcgtcgcccgccgcggcccccgccgccgtcacgcagacggctgcgcccgccaaggccggcatcaccgccacgccgtcggtgtcctcggtccgcgcctggcagctcttccgggtcacgggccacaccaccggtctcaaggcgggcagcaaggtgaccctccagcagaagcagcacggcaagtgggtcagtctgccggcgtccatgaacacctcgcgcagcggctcctactcgctcggcgtcaagctcggcctgaagggcaagaacgacctgcgcatcgtcagcggcacgacggcgtcgcccgtcttccacgtgacggtccgctgagtcacggcgcggaaacgcgcccggggcccggccgtcaccggccgggccccacccgtctgcgcacccgcgccacgcgctaccagcggtaccagcggccacgacggccgccgccgcccgcgggccggaccacgaagcccagcagccacagcaccagcacgatcactgcgatccaccagagcgccttcagggcgaagcccgcgccgaagaggaccagagcaagaagaagaaccagaagcaggggaaccatcgatatcaacctcctggcgaccggatgcccttgcttcacccgcgcaagcgcgcagaacgcgggttatttcctcacgatgcagggcatccgcgcgcctgacgaccgccgccgcgcatccggtccggcgcccggccccgggcgacgctcacgcgcatgcggatcaccaagtacacccattcctgcgtccggttggagcacgagggaggcggcacactcgtcatcgatcccggtatctggagcgacgtccgggcttcggacggtgcggcacggaagtacagggaccggtgcggcacggcgtgcgggggcggtgggtgctcagttctggcggtcgcgagcccggcgaaagcgctccagcccttcgggcagttccaccaccggatcagggtagtcgagtgctgcacgggccggggcggggagtttccacggttcgtgcaccgacggtgcgtccagggcccggagttcggggacccagcggcggacgtagctgccgtcggggtcgtagcgcttggcctggatgacggggttgaggacgcggttgggccggctgtcggtgcccgtgcccgccatccactgccgattcagctggttgttggccacgtcgccgtcgaccagccagtgcaggaagtgggcggc

SEQ ID NO: 1429 - DNA, 620 bp, Unknown
  Kingdom: Bacteria, Phylum: Actinobacteria, Class: Actinobacteria, Order: Streptomycetales, Family: Streptomycetaceae, Genus: Streptomyces
gaggtgtccgcgaccgggcccgccgggtctgccgaggccgccgggtctgccggggccggcggagccgtcgtgcgtggccggcgcgtggctttcgtgccgttggtcggaggtggtgccgagtggtgcttggcgggcatgaccgctcctgtccgcgtcaacgagggtgtgggcggatgtctgtggggaggttggtcctgcggggtggttctgctgtcggtgtaccgcaggagccttcccattcttttcgggtgagcaatccgggactttgttaactactcgcgtgtatgtccacacacaaagttggccttgtcttggtccacccggcggcgcagcgcccagcggcacccgcgctcccacgggtacggtgctgtgtgacggggcgcacagtgccgtgcgtcctgccggcgaagcgcaccgtgccgtgcgtccatcagcgaacgcgccgaggtggaactgtgaaggcgatccgtcggttcaccgtccgtcccgttctccccgagcccctacgacccctcagcgagctggcccgcaatctgcgctggtcatggcatgcggagacgcgtgacctcttccagtccgtcgacccggagcagtgggccgccggcggcccactgctccgg

SEQ ID NO: 1430 - DNA, 1523 bp, Unknown
  Kingdom: Bacteria, Phylum: Actinobacteria, Class: Actinobacteria, Order: Streptomycetales, Family: Streptomycetaceae, Genus: Streptomyces
tggcgctgccgccgcgcaccgaggcgaccggcgtgcgcagctcgtggctggcgtcggcggcgaagccgcgcagccgttcctcgctcgcgtgccgcttggtcagcgcgtcctcgacgtggtgcagcatgcggtcgaaggcggcccagacccggcccacctcgctgcgcggatcgatgtcaccggtgcgcggcggcagcgccacctcgccgctggccagcgggagttcactgacgcgggtggcggtggccgcgacccggctcagcgggcgcagcgaccagcgcacccacagggcgccggcgacgcccgtgacggcgagcgcgagcccgaagacgcacccggcgaccagttccagccggtggaccgtggcccgtaccggctccatgggcagaccggtgacgaggacgtcgccgtcgcgtcccgggcacgccgccagccggtagtcgccgagtgccgacaggtgcgccgtgtggccggtgcggtccgcggggagggccgccagggccgcgcggtcggcggcggtcagggacacgtcgaacgccgggtgggagcgggaggggaccacggccgcgttggtcatccggccgccgaccagccgggcgccgaaggtcccggcggcctggcgccgggtgtcgccgtgttcgtcgccgtcgtggtccgacggcttgacggtctcctcggccccccgggttccgttcgccgtgtacggcccggtggtgccgtgttccaggctctgggcgaaacccgtgccggtctgccgcagctgttcgtcgaggcggccggtgaggaagccgtccagttccagcaccgccgccaccccgacggccgcgcagctcaccgcgagcagcacgacgagaccggcggtcagccgggcccgcagcgtacgcggccggggcaggcgccgtatccacccggacgcggcccgcagacggccgctcacgacgccggcttcaggacgtaccccgccccgcgcaccgtgtggatcatcggctcgcggcccgcgtccaccttcttgcgcaggtaggagatgtacagctcgaccacatgggcctggccgccgaagtcgtaggaccacacgcggtcgaggatctgcggcttgctgagcacccggcgcggattgcgcatcaggaagcggagcagctcgtactcggtcggggacagctctatcagctccccggcccgcgtgacctcccgggcgtcctcgtccatgaccaggtcgcccacggtcagccgcggcccgtccgcctgctgccgggccatgccggcccggcgcagcagcccgcgcagccgcgcgaccacctcctccaggctgaacggcttggtcacgtagtcgtcaccgcccgcggtgatgcccgcgacccggtcctccacggcgtcccgggcggtgaggaagagcacgcagacgtccggccgcaccgcgcgcaggtcccgcagcacggcgaagccgtcggagtccgggagcatcacgtcgagcaccacggcgtcggggcgcagcgcgcgggccccggccaccgccgcggcgccgt

SEQ ID NO: 1431 - DNA, 2698 bp, Unknown
  Kingdom: Bacteria, Phylum: Actinobacteria, Class: Actinobacteria, Order: Streptomycetales, Family: Streptomycetaceae, Genus: Streptomyces
ctcgccctgcgcgagggcgagctgcgcatcaggttcgcgccggaccccgcgctctggccccgcgacaggtgaaccggcgccccgcgttcgggtaacgtcggaaggacgaaccgtagtcaggagtgcgccatgagcgaagagcgcccaccgtccgacgacgccgcacgggacgacgccgctcaggagcggaccgagcaggagtggcgggccgcggacgccgacgcgtgggccacggcctgcgcggaggacctggaggcggagaaggcccggcgccgtgcgcagtacgggccgcccccgggctcggccgccgaggaactgcgcaagttcgtggacaccgtcgccgacaagctgtcctcgctgcgttcaccgctgctcggcgcggtcgccggacccgccgcccaggagatggtgcggcaggtcgtgcagcaggccagggccgcggtggaaccggtccgcgaacgcaacccggacgtcttcgaccacctcgcggcggccggcggcgaactgctcgccgcctaccgctccgccgtcgagaaccaggaacgtcgctggacctcgcgtacgggcggagccgaggacgactggcgggacggcggtctgaacaacggcccccacgaccgtccccgcgaccgcccgcacgacgccccgaagagtcccgacgaccgccgtgaccggggcgagggcaccggcggcggcgaacgcatcgacttggactgacggtccgctcgggtacggttggccgtagcggggctcgaccggaactgagggattcatgggactcaccatcggcgtcgacatcggcggcacgaagatcgcggccggcgtggtcgacgaggaaggcaacatcctctcgaccttcaaggtgccgacccccaccacacccgaggccatcgtggacgccatcgcctcggcggtggagggcgcacgcgcggggcacgacatcgtcggcgtgggcatcggtgccgccgggtacgtcaaccggcagcgctccacggtctacttcgcgcccaacatcgactggcgccaggagccgctcaaggagaaggtcgaggcgcgcgtcggcctcccggtcgtcgtggagaacgacgcgaacgccgcggcctggggcgagtacaggttcggcgccggcaagggccaccgcaacgtcatctgcatcacgctcggcaccggtctcggcggcggcatcatcatcggcaacaagctgcgccgcggccacttcggcgtggccgccgagttcgggcacatccggatggtcccggacggcctgctgtgcggctgcggctcgcagggctgctgggagcagtacgcctccgggcgcgccctcgtgcggtacgccaagcagcgcgccaacgccaccccggagcgagccgaggtgctgctcgccctcggcgacgggaccccggacggcatcgagggcaagcacatctccgtggccgcccgccagggctgcccggtcgccgtcgactcctaccgcgagctggcccgctgggccggtgcgggcctggccgacctggcgtccctgttcgacccgtccgccttcatcgtcggcggcggcctctccgacgagggcgacctggtcctcgacccgatccgcaagtcgtacaagcggtggctggtcggcggcaactggcgtccggtcgccgacgtgatcgccgcccagctcggcaacaaggccggcctggtgggcgcggccgacctggcccgggagcccgaccctgtcatgtgaggcacctgccgctgcgagcgcccaccgtccccatcgtccgggccggtgggcgccgtcgttgcctcgtcacccgggggtacccgggcttgtgagggtgccggccagaccgccgtacggaagcggtcccgtccccgcgtatgttgatcgtcatgcagctgcccaactcccgcaccgaacccgacggttccgccgtcgtccgcgtcctgaccctcaacatccggtcgatgcgggacgacaccgccgccctcgcccgcgtcatcagcgcctgcgcgcccgacctcgtcctcctccaggaggcgccccggttcttccgctggcgcaagaagctggcgcggctggcctcggcgtcggacctggtgatcctcaccggcggtgcgacggccgcgggaccggcggtgctctgctcgctccgggccacggtcgaacgcaccgaggacgtcctgctgccgctcaccgacggtctgcaccggcgcggcttcgccacggccgtggtccggttcgggggcgcgcggctcggcgtgctcggctgtcacctctcgctcgacaaggacgagcggtacgaacagagcggcctgctcctggaccggctggccgggatgggtgtggagcacgcgatcgcgggcggcgacctgaacgaggggccggaaggaccggccttccgccggctggccggcgagctccaggacggctgggccacggcgccatggggcggcgagcacacctggacggcccgcgatccgcaccggcgcatcgacgcggtgttcgcgacgccgggcgtcgaggtcctcggctgcggagtgccgcacggtctgccctcggtgacggaggcggacctgaaggcggccacggaccacctgccggtcctggcggccttccgcgtcccggcggacgcgtagccacggaccacctcccggtcctggcggccttccgcatcccggcggtgctacgcgtccgccgggaggcggacggccg

SEQ ID NO: 1432 - DNA, 3091 bp, Unknown
  Kingdom: Bacteria, Phylum: Actinobacteria, Class: Actinobacteria, Order: Streptomycetales, Family: Streptomycetaceae, Genus: Streptomyces
  misc_feature (2824)..(2825): n is a, c, g, or t
cctccggggcaccccacccgcgaaccacccgtgatccacccgcggtccacccgtgcccacccgcggtgcgcccgtgatccatccgcggtccgcccgcgggtcagctgttcgtcccgccggcggcggctcggactccggcagcctgcgccatgtcgtaggtgtggacgtagtcgaacgtggcggtggctcctgcggtgttcatggacacgaggccgatgcgcaggtcgccctggtcggacagcgaccacgtaccgccccactcccagcgttcgccgtcggtgctcgacgccatgcgcacgtcgtactcgtcgtgaacgacgtcgtgccggacgtacaaccgcagccaggtcgtccccgcgggggctgccccgaacatcgggccgttcgccacggcgaccggcccagcggccgtcgggcgttccgcttccttgccgaactccgtctggtgcagaagctggccgggcttgcggttgagcggcaggacggagtgcgccagcttcaggtaccggtcgtcgttctggtagagaaccaggccggcctgctgggaggcgcgggtgccgtcgaagccgagcttcgtctcgacgaggtagtcctgtcggggagcgtcccggagcagcaccgaggcggtgttgttgcccgtgtacagctcggcggcctgggtgggccatacgagccggccgtcctccagccgcggccccgtcgcgggctgccgcacccacgaccacggggagccacccgtccccggcgtaccggtcccttcgaagtcgtcggagtatccggggagcagtcggcccggcaccgggtcgggaacgcgttcggtgacccgtcgagccgccggggcagcgctcacgttgtcgacgtcgccaccccgacgcgcgctcaccgcgatcgcgccgctcgccgtcgcgttcccgggtgccgtcaccgtcgtcaccgccagcgggtcgatgaggttgtcctccgacaccgacgccgtgacgtgatcgccgacccagtcgagcgtcagcaccttccaggtgctcgggtcgaacgtcgtcggcagcggagtggccgagcggacggtcgtgccaccgtgcgtcacgtcgacgcggagctcgccggcccgggagtcgagccacgccacggcgccgttgcgcccgttgacgccggcacggagcccgatggtgccgcccgccggtgtccgcacgtccgcctgtgcgcgcagatcgccctcgacgcgaaccctgctcgtgagtgtggcgctatcggccagacgtgcgaagtgcccggcgtccgtctcgtcgccgacgacggcccggccccgggacacccaggcaccgagtccggaggcgaagctgtcgtcgacgggtccggtcgtcacgggggccgctgctccaaagacgcttgcgcccgcccccgcgttggcgacgggccagccgtcgatccagtccagccgatcgatcagcatcgggcgcttggagagcctcagttcgcccgcgcgtgaccgcaccggggggaagtcggggtccgcgttcgagatcccgtggtagacgatccagtcctggcccgacagatcggtctggaccgcgttgtgcccgacgcccgtgaacccgttgccgttcggggcgagcacgaagccgcccttgctcgacaggctcatcaggtcggttccctcgtcgtcctcgaacgggccgtaggggctgtggctgcgccccaccttgacggtgtagccgctgaacgctccgtcgcagcatccgccgtcggagtacatgaggtagtagaagtcgccatgcctgacgacgaacgcgccttccatgcgccgcccctgggcgacctgggtgaccgggcccgtgagtgcggtcgcgtcggcattcgtcttcgagacgcagaggacgtcgtagctgccccagtagaggtagtgcgtgccatcggtgtccgtgaacaacgcctggtcgatgttccccgtcgggcagccggccaccgcggcgctcgggacgaggaggccgtgctgagtccacggacctgtaggcgtcggggccgtcgccagcgcgatgcccccggtcgagagggcgtacgtcaggtggtactgcccgtcgacatagcggatgtccggcgcccaggcgcgggagttgccctgccagaaggggggaatcgcgtccggcgggacgacgtcccccacgtacgtccagtcgaccatgttgtcggagcggagcacggggaggatgtgttcgccctcctcacccgcgctgttgaagatcgggttcgtggtgccgtacgcgtaccacgagccgtccttgccccggatcatcgccggatccgggaacgtgtccaccacgccggcggtcaccgggttggtgtaggccgcggaccgcgacccggctccgtgcgcggtcaccgcgccggccggtgcgacggccgagagcccgccggccagcaacatgccgacggacaatgccgccgcagccgtccgcgccggccttcctcgcaatcccatgaagtattccctccccattgaagaacccgcgccttgggcgcagcgagggcaggaacgaccgaagccgccccgcactcatgcaacggatcccggatttttccgtcaaggggtcggcagaacagaagtcgtgatgagcgtctttcggggaatgcggtcaatcaccggaacaccctcgaacagccgggttgtggagactccgcagaccgctgccgcacctgatccaccgccgctcctcgcccgatccaccgcgcggaccctgctcggatgacggccgcggggcgtaccgtccagggttcctcggggcgaccggatcggtccggatgaattcatccggaccggtccggatgaatnncggtccggatgaattctccgacctgttgacgaaaatcagaaaggcttcgcatgctgggctcagtgcattcagaagattttctgtgcgggctcctgcgtgcgccggtgccggcgtccggaacgacgaaggagagtgcgattgatgagcgccggttcccagaaagggacgcccctcggccgacgggcgctgttggcgggcgtggccaggacggccggtgcggtgggcctcgccggggcggccggatcgctgggcgcggtggcgcgggc

SEQ ID NO: 1433 - DNA, 4888 bp, Unknown
  Kingdom: Bacteria, Phylum: Actinobacteria, Class: Actinobacteria, Order: Streptomycetales, Family: Streptomycetaceae, Genus: Streptomyces
gatcactccgcacgccccgcccggccttcgacaccgccggggcgcgcggagtgatcggcaggatggtcccggcctggtcgtccaggatcgaactggcgacctgcgcccccgccgacgaccggggccgggaacgggaacggttctcgatcacccggcaccagggccgggtgcggatctcgggaagttcaccgtccgccctgctccagggggtcggccgctacctcaagtacaccgcccacgtcgacgtctcctggtcctcggacgcctcggcggagccgctccacccgaagggcggaccgccgctgccgtcctcggcggtcacccgcaccgccgaggtcgcccaccgggtgctctccaacgacaccgccgacggctacaccaacgcctactgggactgggaccgctggcagcgcgagatcgacgtggcggcgctgcacggggtcaacgagttcttcatgcccgtgggcgcggaggcggtctaccagcagaccatgcgccagttcggctacagcgacgccgagatgcgcgcgtggatgcccatgcccgcgcaccagccgtggtggctgctgcagaacatgtccaacaccacggccgaccaggagagccaggcgctgatcgcgtcccgcgccgcgctcggccgcaggatcgccgaccggatgcgcgcggtcggcatcgagccggtcctgcccggctactacggcaccgtcccctccggtttcaccgcccgcaaccccggcgccgcggtcgtcccgcagggcacctggagcggcacccggcgccccgactggctcgacccgcgcacgccggtgttcagccggctcgccgccgccttctaccggacccagcagcacctgttcggcagcaccggcgccttcaagatggacctgctgcacgagggcggcaaccccggcggcgtaccggtcggcgaggccgccagagcggtgcagaccgcgctcgaccaggcccaccccggcgcgacctgggtgatcctcggctggcagaacaaccccaccccggccctgctcggcggcgtcgacaagtcgcggatgctcatcgtcgacggcatcggcgaccgctacggcgacaccgaccggaccgccgatcccaccgggcagttcggcggcaccccgtacgccttcggggcgatctggaacttcggcggccacaccaccatcggcgccaacaccgccgtgtggaaccggcgcttcttcgcccagctggcacagccgggcagcgcgctggacggcatcgcggtactgccggaggccgacgacaacaatgacgccgccttcgagttcctcaccgagctggcctggcagcccgccccggtcgacctccccgactggttcgcccggttcgccgacgcccgctacggcgccgacccgcacgccgaggccgcctggcggatcatcggcgagacggcctactcgctcccggcggacggctggagcgaggcccaggacggactgttcgccgccgaaccgagcctgaccgcgacccacgccgccgcgtggtccccggggagcatgcgctacgacccggtcgtcttcgagaaggcactggacgaactgctgcgcgccgccccgccggtccgccgcaccgcgctctaccggtacgacctggtcgacgtcgcccggcaggtcctctccaaccgcagccgcgcctggctgccgcggatcaaggccgcctacgacgccggggaccggccgctgttccagcggctcacccggcagtggctcgacgcgatgggctccctggaccaactgctcggctcccgcccgcagttcatgctcggtccctggctgaagtacggcgccgacgccgcggacacccccgccgaccgggccgccgtccagcgggacatgcgctcactgatcacggtgtggggtgaccgcgccggagtggaggcgggtctgcaggactacgcgaaccgtgagtggtccggcctgatcgggggctactacgagggccgctggcagaagtacttccggtcactggacaccgccctggcacagggcaccgcacccgccgccatcgactggtacgcggtcggcagcgcctgggccgacggcaccgcaaccctcccggccctccccctgaagcccagcggcgaccccgtggccctggccaccgccctgcgggaccggctcgcaggcgacggactcgccgacaccgtctccctcaagacggaccacccgtacctggccgccggaacgtccgcgacggtgaccgccaccgtccggggcggcaacggcctgtcggccaccgactcggtgagggccaccctgctcccgccctccggcgtcaccgtcaccagcccgcccacggcgaccgcgggaccactcgcccccgggacgtcggccaccctcacctggaccgtacggacggacgcggacgcggcccccgggacggcccgcctgcgggccaccgcagaggtggtccactccgggcgtacgacaccgctgacggccgtcctcgacgtaccggtggtgacggcgccgaaacccggcaccgactacctcagcgacctgccgttcctcgacccgcacggcggctacgggccgatcgagcgggacatgagcaacggcgagcaggccgccggtgacggccacgccctcaccctgctgggccggacctacgccaagggcctgggcaccaactccgatgccaccgtcggtttctacctcggcggccggtgctcgtccttcaccgtcgtcgccggcgtcgacgacgacatgcgcggtcccgccaaggacccacgggtcaccgtctccgtcctcggcgacggcgaactcctcggcaggagtggcgagttgaacaagacggacaccctctggcagccgaccctcgacgtaacgggcgtcaggctgctgaccctcaccgtcgacaaggtcaaggacgtcaactggtacgaccacaccgacctcgccgacgcgaaggtggtctgcggcggctgacggtcgccaccctggtcccgtccaggacgtcccgatgcagggagaggacttctggacagtgcggcacgaggcagcaccgcgctacttggtcgtgtgcgtggggtagacctggacgtcggtgtaggcgcccttgatctcccccgcgcccgcgggccacttcaggctgatggtgtgggtctcgttcgggggcgtcaccaggatgttcgtcggggacgagaggctgttgccgctgttgtcgatgtcgtaggcgatgtcgaagacagcggcgtcaccgggcttcaggatggtgacacgcggctcggcgtggccgcgctcgatggggttcgaggtgtggtcggcgtccttgatgtcgacgcccgggaagcccgtcgccgagcaggtcaccggacctcggttgaccatggtgacgtcgatccggccggactccgtgtcgggagcggcgttccttgcgtcgatggccaggttcgccgtcttgcagaacgtgaccttgccgccggtcgccgacgtgccgctcgcggctgtctgcgctccggtgcccttgccggagcccgacttcgcggcgttgccggcctgtgagccgccgcccgaaccggtctccgattccgacccgccgtccgacttcgcgccacctcccggctgcgagccgtcctgcggcgagccctcctgctgcgagccactgtccgaggccgaagcagacgaggacgaggagcccttggacgacgtgtccgtcccggagccgttcatgccacaggcggtgagcgagagcgaggcggcgacaccgatgacggcgagagcggtgatgcgggtgtacttcatggtggtcccccaggggcatcgcggtgcaagcggtcggaagtatttgtatctcgcaccgagtcacaggcggtgccccgtgacgtcttcgttctgtcacaggccggttggcctcacggcccgcaggtcggtcccggcacgccctcgcaacgcctgcgcctccagcgttcttccggcagccacacggtcaggcggaggggcgccgtcgcgtgccgccgtcgcttccgttcgcaaacagcggcgttcgggcggctgcggcccctaggttgggccccatggcctcatccgtcggttctggagaccgaagtgccgaggcgcggccacgtctggtgacgcgccccctgctgttgcgctgtgtgacggtcgtcggctcctcggcgagcttctatctgctgctgtcggtcgtccccgcgtacgcgcagagcgtgccgggtggaggcagtgacaaggcgggcctggtcaccggtgcgctgatgctggccacggtggccggcgaactgatggccccgtggttggccgcgcgctgcggctaccgcgtgctgctgggtgccgggttgttgttgctgggtgctccggcactggtcctgtccgtgtcgcggagcatggcgtacatcgtggcggtgtgcctggtccgggggctcggcttcgccttcacgctggtggcgggtggagcgttgacggcgtcgctgatcccgccggaacgccgcggtgagggactggccctgatcggcgtcatggccggcgtgccctcgctggtgggcctgccgctcggggcctggctggcactgcacacgggatacggacccgtctgctgcgcggcggcactggtcgccctggtctccatcgccgccgtccccggcctgcccggccgggaagcgctgccggggccgcaggtggggatcttcgccggggcccgttccggcgcgctgggccgccccacggccgtgttcgcggtgacggcggtgggcgcgggcatcgtcgtcacctttctgcccctggccgtggctccgggcgggtccggtgtggtcgccgccgcgctcttcgtgcaaccggcggccgcgaccgcatcccgctggttcgccggccggcgcgccgaccggcgcggagccaccggactg

SEQ ID NO: 1434 - DNA, 1961 bp, Unknown
  Kingdom: Bacteria, Phylum: Actinobacteria, Class: Actinobacteria, Order: Streptomycetales, Family: Streptomycetaceae, Genus: Streptomyces
tgccgggcagccagccgcccaccagcacgtcctcgctgcgcatgttgcggatcttgatccacgcgcgcgaacgcgccccgggctcgtacaccgagtccagccgcttgcagaccagcccctcaaggccgtgctccctggtcgcggccagggcgcgggcgccatgaccgaccacggcggcgggcgtggaccagtacggcccgttcagaccgagcgcctcgagccgctcgcggcgccggacgtagggcagcgcgagcaacgggtcaccgcccaggtgcaggacgtcgaacagcacgaggtggacggggacccgcgccgcccggcgcgcggcgagagcgggcgcgtgggccaggcccatccggccctgcagcaactggaaactcgcacggccctcctcgtccagcgccagcacctccccgtccaggaccgcgggcgtggcgccgaggggccggccgagcggtgccagctccggataggcggccgtgatgtcctccccggaccgggcgcgcagcagcaccgacccgtcgccgggcaggtacaccaccgcccgctgaccgtcctgtttcgtctcgtacgcccagcgcgcgtcctgcgcggcgggcggcagcgtaccgggcgtggcgagcatgggcgcgatcagtggcagggtcacggctgaggtgtcgacgcaggcgccgcgcgccacgcaccacgaggactgctttcccctgatcgggcgcggccccgccccgccccgggtcgggcgcgccctcctggccgtaggggtccgcccgggtcgggcgtggcctcctggccgtggtggtccttccgggtcgggcgtggcctcctggccgtgggggtcctttcggttcgggcgtggcctcctggccgtggtggtcctttcggttcgggcgtggcctcctggccgtagcggtcctcccgggtcgggcgccgcctcctggccgtaggggtcctttcggttcgggcgcggcctccaggccgtggtggtcctcccggggcgggcgcggcctcccggccgtggcggtccttcccggtctggcgcggcctccccgccgtagctactgtccagtaggatcgcgccgcagatctgccgcggacctgcggcaggtctccttgcggacccgccgcagatctcctccaggaggaaccgtgtcccgctcagaacgctcgccaggctcgcccctgctgctcgccggcctgctggcgaccgcgggcgccgcccacttcgccgctccccggcggttcgacgcgatcgtcccgcgcgccctgcccggcaccgcccgcgcctggacctacgccagcggcgccgccgaactcgcgctggccgcgggcctcgccgtgccgcggacccgcaaggccgccgcgctggccacggccgccttcttcgtcggggtcttccccgccaacgtgaagatggcggtggactggcgccaccggccggcccggcagcaggccgcggccttcggccggctgcccctgcaggtaccgctcgtgctgtgggcccgtggcgtcgccaagggcgcggagcgcgccgcgtgagcggacgcggcgcggtgcaggcgggcgacaccgtcgaggacttcgcgctgcccgacgagacgggcaccatgaggagcctgaccgcgctgctcgccgccggaccggtcgtgctgttcttctacccggccgccctgacccccggctgcaccgccgaggcctgtcacttccgcgacctcgccgccgagttcgccgcggtcggcgcgcggcccgtcggcatcagcggcgacaccgtggaccgccagcgggagttcaccggacgccacggcctcggcgtgcccctgctgtccgatcccgacggcaccgtgcgcgaacggttcggcgtgcggcgcgggccggcgatcgccccgaccagacgggcgaccttcgtcatcgccgaggaccgcaccgtcctcgcggtcgtccgcagtgaactgcgcatgcacacc

SEQ ID NO: 1435 - DNA, 1728 bp, Unknown
  Kingdom: Bacteria, Phylum: Actinobacteria, Class: Actinobacteria, Order: Streptomycetales, Family: Streptomycetaceae, Genus: Streptomyces
gaactggccctcgacctcggcgcgcacgtcgtcgaggccggagacctcgtgcccacccgcgacggccacctcgtgtgccggcacgagccggagatcggcggcaccacggacgtcgccgaccacccggagttcgccgggcgccggaccaccaaggtcctcgacggcgtgcccaccaccggctggttcaccgaggacttcaccctcgccgagctgaagacgctgcgcgcggtcgaacgcatcccggccaaccgcccgcacaacaccctctacaacggccgctgggagatccccaccttcgaagaggtcctgaagtggcaggacgagcagacccgccgccgcggccggcaggtctggatctaccccgagaccaagcaccccacctacttccgcaagctgggcctcggcctggaggagcgggtggcgaagctgctgcgccggcacggcaaggaccggaaggactcgccggtcatcctccagtccttcgagccgaccagcatccagcggctgcgccggctcgtcggcaaccccatggccgtgctcctctccggcgccgacagccgcccgtacgacttcgtcgaggcgggcgacccgcgcacggtcgccgacctcatcaccccgaagggcctgaaggagatcgcctcctacgcgcagggcatcggcccgaccctggacctggtcatccccaaggacgcggacggcaacctcggcagcccgagcacgctggtgcgcgacgcgcacgccgccggtctggtcctgcacccctacacgatgcgcaacgagaacccgttcctgccgccgaagttccgcaagggcagcgccaaggacgcctacggcgactccttcggcctcttccaggcctacttcgccaccggcatcgacggcatcttcaccgacaacgccgacacgggcctgctcgcccgcgaggacttcctgagcggccgtgccgtcaaccgctgacccggccccgccctcgtcggtgtgaaccgcgggccgtcccggcaaccccgtgccgggacggccgcgtcgtgccgcatatgacacccgacatgctcaccaccctgcgcccgctgctcgccgcggaggcctcggcggaggcacatgcctgcggaacggagccgggcgacctggaacaggcggtctggctgcggctgctggagcgcctggaggctgacgggccgccgcacgacccgcagggatggctgcgcagggccgtgcgctccgaggcccgccgcacccgacgcaccgtcagcatcgagcggccgtacggcctggagcccgccgacgacagcgccctgcccacccgagtgcggcagggaaccggactgctgctgctgcacggctccaactacggcacctgccgcgacttctcggcccggctggcggacatggccgccgagatcggctgcggcaccgccgtcgccccgctggacgcccacacccgcgccctgcccaccgaccggcccgtcgtcatcaccgccgcctcgtacaacggccggcccacggacgacgcggccgccttcgtccagtggctccagaccgccgaacccggggccgccgacggcgtcacctacgccgtcctcggcgtcggcgaccgcaactggtccgccacctaccagcgcatcccgaccctcatcgacgagcggctggccgccctcggcggaacccggctgctggaacgcgccgaggccgacgccgcaggggacctggccggcgcggtcaagtcgttca

SEQ ID NO: 1436 - DNA, 3305 bp, Unknown
  Kingdom: Bacteria, Phylum: Actinobacteria, Class: Actinobacteria, Order: Streptomycetales, Family: Streptomycetaceae, Genus: Streptomyces
ccagccagccctcgcgctcgggaggggcgcggtgtgcggtgaagatcgcctcgcggggcgcccgctaagcggaatcaatgcctctatattgcgtatgcgttacgcagtgtcacgcgaaaaaaatggaagatccaattcagcgatgggcgagaacatcggcgatgggcgagaacatcggcgatgggcgagaacatcaatgatgggcgagaacatcggcgatgagtgagaacatcggcgatgagtgagaacagaggagaacaggtgagaagaggtgagaacaggacttcgggggcggtctgccggatcgcccccgtttcgcgtcagttcgtggccgggacctgttcggcgtccgccggccgcacatcgcgcagcaggcaggtcaggcgtgcgctgcacacccggcgtccctgttcgtcgctgatgacgatctcgtacgtcgtcgtggagcgtccccggtggaggggggtggccacgccggtgaccaggccggagcgcacgccgcggtggtgggtgcagttcaggtcgacgccgacggcgatcttggagctgccgccgtgcagcatggcgccgacggagccgagggtttcggcgaggaccgcggaggcgccgccgtgcagcagcccgtagggctgggtgttgccctccaccggcatggtggcgacgacgcgttccgcggaggcctcgaggatccggacgcccatgcgcgtgcccaggtgcccggcggagaacagggcgggcaggtcgacgccgagggcggcgtactcgtcgatgacctcttgcgggaacttcacgtcgtgctgctcgcccatgggcccggctccgttcgtcgtcggtcggcactgcttgcctgagcgaacgctcagtcggcggccgattgttccagacgcactacgacggacttgctggccggggtgttgctggtgtccgcggtggcgtccagcggcaccaggacgttggtctccgggtagtaggaggcggcgcacccgcgcgaggtggggtagtgcacgacgcggaagccgcgggcccgccgctcgacgccgtccttccactcgccgaccaggtcgacgtacgacccgtcggcgaacccgagggagcgtgcgtcctcggggttgaccagcaccacccggcgtccgttgctgatgcctcggtagcggtcgtcgaggccgtagatcgtggtgttgtactggtcgtgcgagcggagcgtctgcagcagcagccggccctcgggcagctcggggaactccaccggcgcggcggtgaagttggccttgccggtggctgtcgggaagcggcgctcgtcgcgcggggcgtgcggcagtgcgaagccgctggggtcggcgacgcgggcgttgaagtcctcgaaaccggggatcactcgggcgatgcggtcgcggatcgtggcgtagtcgttctcgaactcctcccagggcacgacgctgtcctcgccgagtacccggcgggccaggcgggcgacgatggccggttcggacagcaggtgccggctcgcgggctcgagccggccgcgggaggcgtggaccatgcccatggagtcctcgaccgtgacgaactgctcgccgctgccctggacgtcgcgctcggtgcggcccagggtcggcaggatcagggcacgcgcgcctgtgacggcgtgcgagcggttgagcttggtcgacacgtgcacggtgaggcgggctcggcgcatggccgcctcggtgacgtcggtgtcgggggaggcggagacgaagttgccgcccatggcgaagaacaccttcgcctcgccgtcgcgcagggcgcggatggcgcgtacgacgtcgtagccgtgctcgcgcggcggtgcgaagccgaactccttctccagggcgtcgaggaaggccgggtcggggcgctcgaagatgcccatggtgcggtcgccctgcacgttggagtggccgcggaccgggcagacgccggcgcccggacgcccgatgttgccgcgcagcagcaggaagttgaccacctcgcggatggtcggcacggagtgcttgtgctgggtcaggcccatcgcccagcacacgatggtgcgccgggaggcgagcaccatctccagcgtgcggtcgatttccgcgcgggtgaggccggtcgcggcgagcgtctcgtcccagttggcggtgcgggcggcggcggcgaactcctcgtagccgtgggtgtgttcgcggacgaacagttcgtcgaccgcgccgtcggtgtcgaggatcagcttgttgaggaggcggaagagggcctggtcgccgccgatgcggatctgcaggaacaggtcggtgagcgcggcgccggtggcgaggcccttcggggtctgcgggttcttgaagcgttccaggccggcttcgggcagcgggttgacgctgatgatcttcgcgccgttcgccttggccttctccagggcggagagcatgcgcgggtggttcgtgcccgggttctggccggccacgatgatcaggtcggcctggtagaggtcctccagcaggacgctgcccttgccgatgccgatcgtctccgacagggccgagccggaggactcgtggcacatgttggagcagtcggggaggttgttggtgcccagctcgcgggcgaacagctggtagaggaacgccgcctcgttgctggtgcggccggaggtgtagaagagggcctcgtcgggggaggagagggcggcgatctcctcggcgatgatgtcgaaggcccgctcccaggtgaccggctcgtagcggtcggcgccctcgggcaggtacatggggtgggtgaggcggccctgctggcccagccagtacccgctgcgggtcgccaggtcggcgacggggtgctcggcgaagaactccggggtgacccggcgcagggtggcttcctcggcgaccgccttcgcgccgttctcgcagaactcggcggcgtgccggtgctccggttcgggccaggcgcagccggggcagtcgaagccgtccttctggttgacccgcagcagggtcagtgcggtgcgtttcacacccatctgctgctgggcgatgcgcagggagtggcggaccgcggggagtccggctgccgcgtgcttcggcctgtctacctgcggtgcgtcctggaccggatcacctttgggcggcttggtggccatcgcacgctctccttcgactgcgcgagtgctgttccccgggacgggttccgcgggcgcgcaccggagcgggcgccgcggacgtgtgtcccggacgcctccgatcctcgcacggggcagtgacagtggtgtcggccggggatgccggagagggggaagaaggggagga

SEQ ID NO: 1437 - DNA, 1458 bp, Unknown
  Kingdom: Bacteria, Phylum: Actinobacteria, Class: Actinobacteria, Order: Streptomycetales, Family: Streptomycetaceae, Genus: Streptomyces
ggcgagcacaccggccgcgggcgcctgcgggcggcccacgcgcaccgcgcggacgtgacgccccgcgtcctggagtgccgccgaggcgaaccggccggcgaggacgtccgcgatcacgtcgtcggccaggggtacctgggccccggcgaggagggtgccgtcgccgtccaggaggcaggccgtcccgtcggcggcgccggcgagccaggccacgaccttgcgtacgtcgcgccccgtcggccgtagttggtcgaggagttcctcggcccacgtggcgtgcccgccgcctcgctcgtgcgccgggacggctccgtcctgtccgccggccatgtcggccctctcctcccgcttctcgtacaccgcactgacctcggcgttctcggtccgggacgttaccagcggcggccgtcgccgtcctgtgcgaggctgccgcgcgagcgagccgcggaccgcgaggtacggggcgtgggcgaagcggggcggcttcgccggtggatcacaggggggggtggtgagcgaccggcgaagccgcgcgcccgggggccggggggacagcgcccgagcggtatacagctctcgttccccgcctttcgccgagtacgcccgcggaccgcgatgaattcccggaccggcaccggcatccccacggaccggaccgcgtcccccgcacccgcacccgcacccgcacccgcacccgcacccgcacccgcacccgcaccgactatggcggcagcagcgggccgtgcccgacggcccgtccctgcggcggcggccgggcgcacggcataagctcggcggatggcgaagtacttcgacgtgcaccccgacaaccctcagccgcgcgcgatccggcaggtcgccgacagcctgcgcgaggaggcgttgatcgcgtatccgaccgactcctgctacgccctcggctgccgcctgggcagccgcgacggcgtcgaccggatccgggcgatccgccgcctggacgaccggcaccacttcacgctggtgtgccaggacttcgcgcagctcggccagttcgtacggatcgacaacgacgtgttccgcacgatcaaggcggccacgcccggcagttacaccttcatcctgccggcgacgcgggaggtgccgcgcatgctgcagcacccgaagaagaagaccgtcggagtgcgcatcccggaccacgtggtcacccaggccctggtggcggaactcggtgagccgctgctgtcgagcaccctgctgctgcccgacgaggaggagccgatgacgcagggctgggagatcaaggaccggctcgaccacgtgctggacgcggtggtcgactcgggcgactgcggcaccgagccgaccacggtcgtcgacttctccggcggcgaggccgagatcgtgcggcgcggggcgggcgacacctcacggttcgagtgacacgcagccgcccgcggccactgcgggccggtccccgcc

SEQ ID NO: 1438 - DNA, 3799 bp, Unknown
  Kingdom: Bacteria, Phylum: Actinobacteria, Class: Actinobacteria, Order: Streptomycetales, Family: Streptomycetaceae, Genus: Streptomyces
tcgccctccagcagccgccggaacagcgccagcgcgtcggcccggccgaagcccgggatggcgccctcgtacgtccgccggatcacgaagttcgcgccctcgcccgtgccgatctcctcgcgcagcacccgcccgacgatccgcgcgtactcctcgtcaccgacgtcgaaaccgccgccctcgacgcggacctcgtgcgcgggcagctgcgccagcgcctcggcgagcgggagggcgtacctctcctcgggggtcagcacggtcagcggggtgccgtcgtcacggacgtcgaagccgcgctcgcggatctgccggaacggcaccagcgccaggccctcgtcgggcaggtcggccaggcgctcgcaggtggacaccgggccgaggagcacctcgaccaggtcctggtcgtgcccgggcgtgcggcgccgcagcagggcgaaggggcgggggtcgtgcaggagccgtgccaggtccatgggttcctcttccaacggtggtctcgtcggtgccggtgaggaacggccaggcgcccgaaacgccgaaggccgcccctcgggcggccttcgcgaagtctgggatacgcgcagtcagcgggccgccggagaagcggtccaccaccagttctggatctgggtcgagtgcgcgaacatgccccgcaccctaccgcaccgggggcccgtgcgggggtcgcccggacgcaccacacaccggtttccggcacatccggcaggtggaaggagggcgggcgtcacccctgccaccccaccgaggagcacgtcatctccgcactacgcccgccccgtccgcgccgccgcccggcccgtgcgctgaccgcgctgaccgccgcgctcaccgcctgcgccgccctcggcgcggcatccccggccgcagcccggtccgcctccgacgacgccacccggaccgtcacctaccggggccacagcttcaccgtccccgccggctggccggtcgtcgacctcgccgcgcacccgtccacctgcgtccgcttcgaccggcacgccgtctacctcggcgacgccggcgcgcagcaggactgccccgcccacgtcaccggccgcaccgaggcgctgtgggtgcagccggcgtccggcgccgagaaggccgccgtcaccgagaaccccacggcccgcctcttccgggccaccgcgcccgccgagggcatcgccgtgacggccccctacggcaccgaccgcgcgcggatcgaacaggtgctggacagcgcagggctgcccgtctccgccgccaagaccggcccgatcgggccggccgactccgcgcccgccgtccccgcgctccccgccgacgtcaccgcgcaccagggcaagggcttcgacacctgcgccgcgccgggccagagcgccatggacgcctggcgggccggctcgccctacggcgccgtcggcatctacatcggcggagtcaaccgcggctgcgcccagccgaacctgaccgcgcagtgggtgcagacccagtacaccaagggctggcgcttcttcccgctctacgtcggcccgcagtcctcctcctcggccggcagctgcggcggctcctgcgcggccatcaccgacccggcacagcagggcagggccgccgccgaggacgccgtcgcccaggccgccgccctcgggctgggcaagggctctgtcctctacaacgacctggagcagtacacccccggcggcgccctcaccacgcgggtgctggactacctggcggcctggaccgggcggctgcacgaactggggtaccgctccggcgcgtacggcagcgtctcgtccctcgtcgccgacctggtctccaacgccgcgaagaccaccctgcccgacgtgatccacttcgcccactggaacgaccaggcggccaccaccgacacggcgctcccggacgcactgtgggcgaagggcgcccgcgtccaccagtacgcgggcgacaagacggagacgtacggcagcgcccgcatcaacatcgaccggaaccagctcgacgtgggcaccggggcgtagccggtaccggggcacggttcagtaccgggggcgtaaggagtgactcgggacgccgggtccccgggatccggcgtcccacagtttgggcacggggccggcagcgcacaggcagcccgtagtctgggtgcgtgaacgcaaaagcctccatcatcgacatgaacacctggcgagacctccctgcggcccagcagccggagtatccggaccagggcgctctccgtaaggtgatcaccgagttggagagcttcccgccgctcgtcttcgccggcgagtgcgacaacctgcgcgcccggatggcggccgtcgccaagggagaggccttcctcctccagggcggcgactgcgccgaggcgttcgacgcggtctcggccgacgacatcagggcgaagctcaagacgctgctccagatgggcgccgtgctgacgtacgccgcctcggtgccggtggtcaaggtcggccggatcgccgggcagtactccaagccgcgctccaagccgaccgagacccgcgacggcgtgaccctgccgacctaccgcggcgactccgtcaacggcttcgacttcaccgaggccgcccgcgtcccggaccccgagcggctgaagcggatgtaccacgcctccgcctccacgctgaacctggtgcgcgccttcaccaccggcggctacgccgacctgcgccaggtgcacgcctggaaccaggacttcgtgaagtcgtccccctccggccagcgctacgagcagctcgcccgcgagatcgacaacgcgctgaacttcatgcgggcctgcggcaccgacccggaggagttcaagaccgtcgagttcttctcgtcgcacgaggcgctgctgctcgactacgagacggcgctcacccgcgtcgactcgcgcaccggacagctctacgacgtctccgggcacatggtgtggatcggcgagcgcacccggcagctggaccacgcgcacatcgagttcgcctcgaagatccgcaacccgatcggcgtcaagctcggcccgagcacgacggccgaggaggcgctgcagtacatcgagcgcctggacccggaccgtgagcccggtcggctgacgttcatcgtgcgcatgggcgccgacaaggtccgcgacaagctgcccgagctggtcgagaaggtcactgcctcgggtgcggccgtggcctgggtgaccgacccgatgcacggcaacaccttcgaggccgcctccgggcacaagacgcgccgcttcgacgacgtgctcgacgaggtcaagggcttcttcgaggtccacaaggagctgggcacccacccgggcggcatccacgtggagctgaccggtgacgacgtcaccgagtgcgtgggcggcggcgacgagatcttcgtcgacgacctgcaccagcgctacgagacggcctgcgacccgcgcctcaaccgcagccagtccctcgacctggcattcctcgtcgcggagatgtaccgcgaccagtgaggcaccgggctgcatgaaggggtggggcgcggatcacacacggtccgcgccccgcccactttcacggacccggagctgaaggtaaggttaggtttgcctcaacgagaagtcggggcggcaccactgatcgatcccggcgggaggtgagcgaagcgtgttcgtctgcagttgcttcggcatcaccgagcagcaggtcaagcagcacgcggagaacggcgcctgcacgccccgccagatcgcctcggcctgcaaggcgggcacggactgcggcggctgcgtccgccgcagtccgtgcccgcc

SEQ ID NO: 1439 - DNA, 2899 bp, Unknown
  Kingdom: Bacteria, Phylum: Actinobacteria, Class: Actinobacteria, Order: Streptomycetales, Family: Streptomycetaceae, Genus: Streptomyces
  misc_feature (994)..(995): n is a, c, g, or t
ggggacgggtcctcgtcgcggccggtgcgctcgggcgcgttccgcggaccggtgcccggccggggcccggcggggtggcgcggggccggctcgttcgtctgcggccgggacggcgggcgcggccggaacagcccgccgcgttcgctgtcctcgtcgccgagcgcgccggggaactcctcgaactccccgatggcgtccagaccgaccggcgcctccagttccaccggcccgtccagcaacgagaccggcaggccgggaagttgcaccgggttctgggagagggcgttcctgcggctctcccccggttcggtcttcgcggcgggccggtcgagacggaacccgaccccgttggtgtcggggacgtcctcggtcagcagcgcgtccgggatgaagacgaccgcggtggtgccgccgtacggggacggctggagcgagacgcggacgttctgccgctgggcgagccggctgatgacgaacaggccgagccggtcggtgtccgacagttcgaactcgggggtctcggcgagccgcaggttggcgtccagcagcgtttcggcggccatgcccaggccccggtcgtggatctccagcgtgaacccgttggcgacgcgttcaccgacgacctgcaccgcggtgtgcggcggcgagaacacggtggcgttctccaggagttcggcgacgagatgggtcaggtcggcgacggcgggcccggtgagggcgactctcggcagcctgcggacctcgatgcgttcgtagtcctcgacctccgcgacggcggcgcgtacgacgtccatcagctggacgggtttgcgccactgccgggacggggccgcgccggagaggatcaccagtccctcggcatgccggcgcatccgggtggtgagatggtcgaggcggaagaggtcggcgagttcctcggtgtcctcggtccggcgttccatggcgtcgaggagggtgagctgcttgtgcagcaggacctggctgcggcgggcgnnatgcgggtggcgaggtggtcgacgtggaagaggcccttgagcaggtcggggtcctcgatctcgttctccagttcgtcgaggatggagatctcgcggtgcaccagggactgcaggcggcgggcgaggttgacgaagacctcggagacgccggcgcggagttcggcctgcttcacggcggcttcgacggcggcccgttgcagggtgttgagggcctggccgacctcaccgatctcgttcttgtcgtactccaggcgcggcgcctcggtctccacgtcgacctgctcgcccgccgacagccggcgcatcacgctgggcaggcggacaccggacgcctcgtgggcctccaggcggagttgcctgaggtcgcggatgagcccgcgcccgatgcgtacggacaggaagagggagaccagcagggcgagcagaccgaggatgccgactgcggctgcctgcaggatgacgtgcatggcgaccgggtcggcccggtcctggaagcggtcctgggcgcggtcttcgagggtgccgaggtcgtcgagcccgttggcggcggcgctgtcccagctcttcgcactcacgccgcgcggtgtgccggacgaggtggagacggcggcccgctcggccacccggagcggggcggaggccgcgttcgcccagaagcgctggtagcggctgcgttcggcggcgggcagcagcggcaggttcacgtcgtacagcagggaccgctgggcgacgagtgccgagatgtcgaggctctcgtcgcgggtgagcgtcccgacgaccagggaggagccgagcagcgcgtcctcgcgggagaggagttcacgcgcccgggagaggttgacgagggcgcggtactgcttgtcgagttccgcgtcgtcgacgacgcgcaggccggcgagcaggccgtagcaggggtcgaccaggcggttgtagaggtccagtgcctgggcgcggcggacggtgccgtcctcgacgctgcggcgcagggagtcgaggccgtccagagcgtcgagcaccgcggtcagccgtccttcgccgccgctgccgagcgcgtcgcgggtgccgctgtcacccgcgttccggcggagcgtggcgaccgcccggtcggtggcggtccggctgcgccgcagtgcggcgagggcgtccgcggcgcggggatcggcgaggtggacgagggtctgccggcgctcctgctgcaggacgcggacggtgtcctcggtggggtagacgatcttctccaccacggaggacgagttgaacagccggccggcctgccgtcccgtgatcacagtggcgaaggcccagacggccgtcagggacagcagcggcacgagaaggagcgccacgatcttcctgcggatggacttcccgcgaaagcgcatggcctcccccagctcgccccctccgtcagggggtacacgtgtacgtcaacaaacggcgcgagcctactaccgacgcacaggtaactcgaaggggcgcccggagggcgaacgtccgcagcggcggcgagagatggcgagttgtccgggcatggccggagatggcaattccgggcaccgacgtgacggtccgccggaacgggccggtcgcaccggtcggttggccgagatcatgcgtctgccgggaatcttcacgatgtgtcgttcgtcctcttccatgggcggggaggcggaatcggtcactggagccgcatcccgcacccgtgcggcgtaaaacagcgcaagccgggcagccaatggggagccggttcttcggacaccggggcgagcggcctgccggcggtggggagtgacgggttgatggacacgacggggcggcgcgagagggccgtcgggagcggcacggcccaggtgacggcggtgggagggaccgtaccgggggcacgggatcacgacattccgcgg

SEQ ID NO: 1440 - DNA, 569 bp, Unknown
  Kingdom: Bacteria, Phylum: Actinobacteria, Class: Actinobacteria, Order: Streptomycetales, Family: Streptomycetaceae, Genus: Streptomyces
cgccgtcggacgggtcggcccccgtaccctgctcgccgccggttcctccctgtgcctgtacgaggccggcatggccctcaacgactgggccgaccgcgccgcccacagcgccacgccccgccttcactgccgctcctcgggctgttcctgcggccgttcctccggccgtccgtccggcgttcgcaggcggtcggccaggcgggtcaggtcggcgtactgctcggtgaggcctgccgggccgtcgcccagcgggtccttgaagtagaagccgagttcgcgcaggggcccggagaggcccgcctcgtgggcccgcgcgacgatgcgggccaggtccaggacgaggggggccgccagcgccgagtcgcagccctgccagatggtctggagcaccatgcgggtgccgaggaagccgtcgaaggcgatgtggtcccaggcggtcttccagtcgccgagcgcggggacgtcgtcgatgtggacctcgccctgcggggtgtgcccgagggtgtcggcgaggacgcgttccttgccggcgttcttggccgcggcggcggcggggtcggccagggcgg

SEQ ID NO: 1441 - DNA, 860 bp, Unknown
  Kingdom: Bacteria, Phylum: Actinobacteria, Class: Actinobacteria, Order: Streptomycetales, Family: Streptomycetaceae, Genus: Streptomyces
cccgctgctgctgccgctcgcgcgggccctggtgcgcacggcgagagcccggccctggcacgcggccgtggtggcctgcgccctggccgggctctcgttcgcttacggagcgtatctgctcgtcgtcacgcacacgccgctgtaggcgggagggcgactgtcacgcctcgccctcgccctcgccgtcctccggctcgccggccccgtcgacctcgccctccaggccgagctgctcgatgagccagcggtcgaactccagagcggcccgcacccagctgaccgtcgaggagacgaagtgctcgatgctcacgcccatgccgatcagcatctgcgcctcgccgatgaggcggacggtgccgtcgtcgtgggtgtgcgtgtagaccttgggccacagggtgcgccggttccagtcgtcgatggactccaggagctgcggcttctcgtcgatcttgtgcggccggtcgtagaacgtccgcaccgagaagacctgctggtcgtcctcgccgcggaacatgaagtacgtgcggaactgctcccacggcgcgacgaggtcaccctcttcgtcgacgaggtgcttgagttccatctggtccaggagctgcttcacgagatcctgatccgggacgacggggcccgccggtccttggggctgcggctcgggctggcccccgaagttcggaatcgaggacgggtcgatgctcaccgtgtttttcccttcgtacggatcctgccatcctcccccatgcggggaggggggtggcaagccccgacgggccctgtcagccgacggctgacatgatccggccggtagggcccgtccggcggacacaccccaggggccaccgctgcgggaaacgggg

SEQ ID NO: 1442 - DNA, 1938 bp, Unknown
  Kingdom: Bacteria, Phylum: Actinobacteria, Class: Actinobacteria, Order: Streptomycetales, Family: Streptomycetaceae, Genus: Streptomyces
gcatcggcggcacccgcgccgtgtgcgacggcgccgagcacacctgggccaacaccggcacgcccgcgaacgcgctggagccgggcgcggcccacgtcgaggccacgatcatggaactcacgacccagggcggcctgccgctcatgccccgcttccacgcggtcgccgagcaggacgtcaccctgacccgggcctgaaccctgtcagactccgcggacccagaccggttgccgccgcccgccccgcccgccgacgcgagcggggcagccacccgccgggcggcggacggtccatgacatcctgtgacgccacaggacgtcacagggtgccggacgacaagcgcggggcgcccggcggttacggggaagatcgatgagactctgctttctggtggaggagcagtaccgccacgacggcatgccggtcgaggtgatccgccaactgctcacctggggacaccgggtggacgtggtgcggcccggcggctccctgctggacatgtcggaggcggtccgtgcgggcgcccatgacgcctgggtgctcaagacggtctccggcggccccgggctcaccctcctggaagccgcggccctcgccgggacgaccaccgtcaacgacgcccggtccatacgcggcgtacgggacaaggcactcgcggcggccgtcggccgcagccgcgggctcccactgccgccgacctacgcggcggcccgccccgaactgctcgccgcgatacccgactcggcgtacccgctcgtcgtcaaacccgccgacggcagctcgggccgcgcggtgcacctggtctccgcaccggaccggctcgccgcgctgctgcccgaactggccggcgagggcatgctcatcgcccagccgtacgtgcccaacccgggcctcgacatcaaggtgtacagcgtcgccggcgacctctacgccaccgagcgccgctccccgctccaccccgaacacgccgtacgcgaacgccgcgtaccgctgtcggccgaggtggccgcgatcgccgcccaggtcggtgtcgtctacggcctcgatctgtacggcgtggacgtggtgctcggacccgacggtcccgtcgtcgtcgacgtgaacgacttcccgagcttccgtcaggtcccggacgccgtcgcccgggtggcgcgcgccgtactggaactcgcggcccgccccggcggcacgccatcaccggtcaccgccaccgctcccgacctcctccccgcggcgatccggcccgggccgcagaacggcaccgtcctcgccccgcccctgccgccccacccggaacaggtcccggtgaccgcgggcaagaacgcatgaggacgggcctgatcacagccgaccccggccatccgctgctggccgcggccaccgcgctgctcaccccggagcaccaggtcgagaccctggacccgcgcacggcggcggaccccaccggaccgctcgccgacgtctacctgctgaaggcccgtacaccgcgcgccctcgccctcgcccgcgccctggaacgacgcggcgcgcccgtggtgaactcggccgccgcgacggagctgtgccaggaccgcacggcgatggccgcgcacgcccggcgggccggcctgcccttcgcggccacccgcaccttcaccagcctcgccgcgctggccgccggcccgccgccggccgttcccgtggtggtcaagagccggcacagccggcggcacgacgtggtggcccgcgtggacggtgaggcgcagctggcacggctggccgccgaccacccccaggagccggtcgtcgtccaggacttcacgccgaacgacggctgggaccgcaaactgtgggtcatcggcgggcggctcttcgccgcgctgcgccgctccgaactctccgccgagggacggggcccgacgctgcccctggccccgggcgcccagccggacggcaggg

SEQ ID NO: 1443 - DNA, 2479 bp, Unknown
  Kingdom: Bacteria, Phylum: Actinobacteria, Class: Actinobacteria, Order: Streptomycetales, Family: Streptomycetaceae, Genus: Streptomyces
acgctgggcacggacatccgggccgtgcactcccggccgcagcgggccgccgccctgtggggcggctcgctcgccttcgcggcggcgcactccctggtcctgatctccgttgtccaggccgtcggactgcccctgccgccggtccgggtggcactgctctacctcgccgccagcagcgccgcggccctgctgcccacacccggcggcctcggctccctggacgccgcgctcgccttcgccctcaccacctccggcgccccggccgccacggccgcctccgccgtcctcggctaccgcctcctgacggtctggttgcccctggtaccgggcctgctggtcctgggtctgctgatccggcgcagggcggtctgagagccgcagggcggtctgtgagccgcggggcggtgtgagaggggggcgagcgggtcgaccgtggcggcccggtgacctcaggccgagcgggagcgctccggccggcccggagggtcctggtccggcggcacggccgggtccggctcacctggaacacgcgtcgtcagcgcggtgacgaagcgcgggggcagccacttgacggccgcgcacaggaacaccccgaaccagcccgcggcgaacagccagccgccgacgacgtcggtgaaccagtgcacccccagatacacccgggtcagccccaccagcgcgccccagcagcccaccaccaggcccaacgccgtccggccgcgcggagcgcgcaggagcaccacgaggatgagcaccgcggcggtcagcgccgacgtggtcgtatgaccggacgggaacgaccatcccgtggcgtgcgtcgcccagtcctggtgcggcggacgcggacgggcgacgagctccatcatgccctggcgcgccgcctgccccagggccagacaggccacgcacacggccgccgctgccgtacgctgccgcgccgtgcggccgaggaccaccccggccagcacgaccagcacgtacgggacgacgcccgtccccgtggccgtcagcccgcgcgccacggccaccgccacctcgggacggtggccgagcgaccaggacagcagcgtcccgtccactcgcaacggcgcgccgtgcccgcccacgacgaccagggcgaccacggtgaaggcggcccaggcgccgagcgcggcactgcccgcgaagtccgccgtgtcccggcgcctcatgagaccagcagcggacgcagcggtgtcgccgcgatccgccgggccagaccctccggacgccgcagcagcaccttcatcaccacgaaggccaccagcgcgccggccgcgagcccggccaccacgtcgtgcgggtagtgcgcaccgacccagaccctggaggccgccatcgccacggcggcgacgaccgcgatcagcccgaggcgccgcgacacgaagaagagggccaccgcggcggcggcggcgatcgccgcgtggttgctggggaaggaccagtcggtacgcgccggacacgcctccagggtgaccgcgtgcagggtccggcagggccgcacctcgtgcacggccgacttcaccagggagttcacgacgtaggcgaggaccacggccaccggcaccgccagcgcggtcacggccgccgcggcgtccacgcgccgcgcccgccaccagcccgcgagcatcagcacggcgaacacggccagcccgtacgccgaccacaccgacaccgtgtcgtcccaccaggcgggggagcggtgggccaggtccaccaggtccgtgtagagcgagccgtcgaccgacgcgcccgacagggcgagcatcatccgcgtgcctccttcgccttcgcggcgcgccgcgagcgcagcacctcggcggcgagcgggatcagcgacaccaccacgatcagcgcgatcaacggcagcaggtacttgtcgatgttcggcaccgaggagccgagcgcgtaccccgcgagggtcagtcccacgctccatacgagaccgccgacggcctgccagagcgtgaacgtgcggaccggcacgcccagcgcgccggccatcgggttgagcacggtccgtaccaccggcacgaaacgggccagcacgatcgccttggcgaacccgtaccgctccaggagctcctcggcgcgctgcgcgccctcgtgcaggcgctgcgagcggctgcgggcgagcagggcgcccccggccttgcggcccagcagatagccgcactgggacccggcgagcgcgcccacggcggcggctaccagcagtggcgccagcgacagccgcaccccgcggtcggcggtgcccgtgcacagcagccccgcggtgaacagcagcgagtcgccggggaggaagaaaccgaccagcagtcccgtctcggcgaacatcaccaccccgacgcccagcacgccgaaggcggccagcagcgactgggcgtccagcacgttgacagcgagctgtgacgacaggagcgggggtgtgatcatcggcgcgggctctttccgtcggggg

SEQ ID NO: 1444 - DNA, 4161 bp, Unknown
  Kingdom: Bacteria, Phylum: Actinobacteria, Class: Actinobacteria, Order: Streptomycetales, Family: Streptomycetaceae, Genus: Streptomyces
agggacgggagggatgcaccggccgcccggacaggcccgtgtagtgcccggcgttcagggagacgtgcacgggtgccgccgtcggcggatggccgtgtccgagtgtctcggagggccggccggggtggtggatctccacctggaggccgaaggtgtcggcgagcagcggcaggaacgcctccccgtgacccgcctccgcgttccagctccggttccagttccggacggcggtctggatctcgtggaagaggatctcgccggtgccgaaggcgtcgaagagggtcgtggcggcgttcggatgccgtgccagcagctggaccaggccggtttcgccgagcgtgtcgaggtggtcgctcacgcggtcgcggacgtgctcgacgaggtcgaggagcccggggtcgtacgtggtgcgggtacgtgcctcggcgaaggcggcgcggagcagggcgggacgggcgagcaggtcgcgggcctgcggggtgaggtcgggcagcgcctggagcatgacctcagggacgctgacgaggaccgagctgatctggcagtagccgtcgccggggacggggtgttcctggaggacggggtccgcgggcgcgggcgggtcctgggagggcgtcccgaggtggtcctgctgctcctgcggctgctgctcctgggtctccggttccggctcgtggggtgtcggaggcgtggtttgctgctgcgctgtcggcggggccggctgggtctggggttccgtcagggggcggtacaggccaccctccaggagtacggtcagctcgtcgccgtgtgtgtttccgttgtccccgggcagcgggtcgccgcccggcgtgaacgtgtgacggcgtccctcggtgaggacggtcaccgggcggtcgaggaggacggcggcgagggccgggaagaggtcggcggcggcgtgctcgcggcgctgggccgtctcggcggtgaggtcgcgggaggcctggacctgggcgaggccgagtcggtgccgtggcgggaggacggacgtgtgctcgggggtcggcacgccttccgacatggggacgatgtgcaggtcccggtactcgcggccctcgttggagtcgtccgtgagcaggtgaccgagtccggcctgttccacctcggtgtcggtgaacacgtcggtcgcgtcggggtggtaggtcgcgaggatctcggcgagccgtgcggcgcgggggtccgggtgtggtgtgccgaggaccgtggcgtggatctccgtgtcccggaacacccgcaggatgtcgtcgcggatggccgcggcgcggacgtcggtggggtcgccgagcgcgtgggccagggcgtggaagaggccgttgccgtcggtgcgggacgggccggcctgccacgtcgtgccgtccagggtgacgccggtgacctcgccggcgtcgtcgaggacgagggcgtagtcgtccgggagcttcggcttctcctcaggggcggggaggacgggcggggccggcagcgggccctgtaccgcgtcctgggcccgggcctgcgcgaagtgggtgaggttgagggcggccgccaggacctcctcgtaggtggcgcgggccgactcgaacttctccttcagggcccggagttcctcgcccttggtctccttcagctcgcgcagttcctgtgccgacacgtcgtcgtggagggcccgcacggcgaggtcggtgaacggccggcgggcggcgtcgtaggcggtggaggcgtccttgaaggcctcctccgcctgggcgacggtgccccacgcctcggagatctcctgcgggaaggtgtggtcggtgaggatgccgagggcgcgggccttgtcctcgctgatccacatctcgacgcggatctcggtggagccggtctgcggtcccgcgggctcgtagagcccgaggggcgccgcgaggtgctggacgaaggagctgtccttcatgtcgcggtggacggcggcgtgcgcgaggacggtggtggggaccgagaccagcacggcgcggccggtgttgggtttgtcgttgcggcggctctggtcggcttccgtgtcgacgtgcgtcaggttcgcgctgcggcccgtgccggcctgcggctggacgctcccggtgccggggtcgcccttcacggtgaacggcaggcccgcggtcatgttcaggccgcggtcgctgccctgcgcggtgtcgcgggagaggccgccgcccttgaggttctccaggcggaccttgtcgctgacccgcaggatctgggcgttgcggtgctggaccagcatgtgcagcgtgagggtaccctcggagccgccgacgaggctgtcctcgaagagcccgggaacgctgtagccgcccggtcgcagggcgctggtgtcgctgagggcgccggccagggcgatcgcgttggtgccggtggtgagcgcgtgcgcggctgccgcgccggggtggacgagtccgctgcgaccgcctccgccggcccgggtcaggagctgctgggcgagtcggcgcacctgctcggcgccgtgcacgcccttgatgtggatgccctcgcccggggtcagctccgtgtggttggcgcggtcctggtgggtgaggtgggcctgcagcgcggcggggtcggtcagcccgggatacagggtgacggtgcccgacggcttcttcggttcgaaggtcactccgggcgggtcgagcaggatcatcggggcgtagtcggtctgcttcccggcccgccaggacaccgggccgccggtgccgtccggtcccgcgagcaggctgcgcccgcgggcgtcgacgaggtcgacctcgatgtacgcgtccgactccacggagacgatgccgccggacaccgccgtgaggtgggtgacgacagtcgtccgggagttggtcgtggagctggacgaggagcgggtggcggaggcggggccgaggttgccgccgaccgtcagcgggtcgcggctcgcgcgttcggaacccggcaggccgagtgcgttgccgtgcaccttggacacgccggtgtcctgggtggtgttgacggtgtgggtgctctcgatgtcgccgaacccggtgaactccaccaccttgggcgcgcggcgctcgtgacggacccgcagttcgacgttcttcccgccgagtcgcatcccccgggtgaggttgaggcggccggcgcgaccgcgggccacggcgtcgacgcccgcctggacggccgcccggacggcctgctgggacaggagtgtgtgcagggtctgcacgccggtcgcgtcgacgccctgctgctcgatctggtgcagcaggtcgtcgagcacctggaacgcgtcgtcggtgaggtgggtctgggttccgccgagcgggtagaggccgatggcgtcgtcgacggtccactgcggcacggcccaggtgccggtgctgttctcacccgggttcaccgtggtgttcttcagccccgggtacggtcccaggtggtcctcgaccagacccaggcggtgcgcctcgcgtgcggtcatcaagcccttgaacgcacctggggcgtgcaccagttgtccggcggtcgtcgcgcccggacggaaggccttgaggacggctccgatgatgcccgccggatgcccggacacctcgatccggaagtcggtgtcaccggtcaccagcaggaagtgaccggagttctgcaccaggttggtctcccgggacacgctgcggccgctgccctgcgagtgcgacgtcgtgtgctgcaggagggtgacggtgagcgggtagccgccgagggaggggccgcccggcccgtcctgggtcagcacggggttgaagccggccgtcacggcatgggtcctggacgccgaggtgctccccgagacggtgacctccatgccgatgttctgctcgggttcgaagtgcagggtgaggctggccagccggaggttgccccgccggccgctgaggcgcagggtgccgtcgaagcccaggaaccagcgcagcgagcgcagcccggtgagcaggatgccgcccggcgagtacagctggtcggcctgcgcggacaggacgaggtcgctgagcagccgcgccgctcgtggtgcgggccgccgggcagggacagctcccgccggtggccgcccgccgcgcggtcgagcgcggtggtgaaggcggtgacgagttccgcgggcgggtggaccttcacggtcagcagcggtgt

SEQ ID NO: 1445 - DNA, 1265 bp, Unknown
  Kingdom: Bacteria, Phylum: Actinobacteria, Class: Actinobacteria, Order: Streptomycetales, Family: Streptomycetaceae, Genus: Streptomyces
gcctcgacgaccgagccgagcaccttcgccgggtcggcgtcgacggtctcgcagcccggcgcggtcgccacgatccggccaccgagccccaccagcgccgcccggaagccgtcggcgtgcacctgggcggccagggccacggggccctcgtcggcgaccgcgagccggtgcgagggccgtccctgcgaaccggccgccgcaccgggccgggcgtccacccggatcaggcccagcgcctccagttcggcggccaccgcgccggccgtcgcccgggtcacccccagttcggcggtgagcacggcgcgggtcggggcacgtccggtgtgcaccagctccagggcggggccgagcgcgccgcgcccccggtccagccgcgtcctcgacgtgatcccttcccccgccgtccgggggtccgccttgccgctcatgagggcgagtctcccatggtccgcgagtcggcaggctctacagcccgctcacccggagcgtgacgttcagccgcccggtcaggcccaactcgcgtggggcggtgcctgggtggatgcgcggcacgccatggtacgcaagccgcgacgggccgccgaacacgaacaggtcaccgctgcgcagttcgacgtccgtgtacggcttcgcgcgggtctcggtgttgccgaagcggaacacgcaggtgtcccccaggctcagcgacaccacgggggcgccggacttctcgtcgctgtcgcggtgcatgcccatgcgggcgtcggcgtcgtagaagttgacgagcgcgatgtcgtacgcggccccgctgccccccgcgtcgggtccgagcgcgtccgacaccgcgcgccggcccagctctccgagccaggccgggaagggtttgaccggggcgccgtcgccgtcgaccgccgtgcgggcgtagccgtaggggtaccagtgccggccgaggcagacctgccgggcggtcatcgtgccgccgccgggagtgcgtaccgtgcgcaggccggccggcgggcgggcccactcccggcaggcggcgagcagctcgcgctgccgggccgcgtccagccagtccggcacgtgcacggcgcccggcgcgatctccgtacgggagcgggggaacagctcggcgtccatacgtcccatcctgcccgagcggtcgtgagctgcggctcggctagcctggacgcacgatgagcgaccgtatgacgactgcctggggcgagccggcgctggcccgttttcccgaggatccccgcgaccggctgcgcgcctgggacgcc

SEQ ID NO: 1446 - DNA, 500 bp, Unknown
  Kingdom: Bacteria, Phylum: Actinobacteria, Class: Actinobacteria, Order: Streptomycetales, Family: Streptomycetaceae, Genus: Streptomyces
gcacgggcagccacggccggatgcggtccacgaccgccacgccctcctcgtccgagtcgacggccacgtgcacgtgcatgccgcagaccagctgctcctgggtcgcgatgccgtactgctcggccagccactggtagcggtggttcatgccgatggtcgggctcaccggcagcggcgaggtggccagcgcggccaccgcgcagccgatctccccggcgtgccgggccgcctccttgcggcagcgcgcgatctccgcgccgagttcggccatgtccgtctgcggatgcgtggcgaactccagcatctgcccgtacagctctttctcgaagacgtcctgccccgcgtcggccgcctccgcgcgggcgagcaccgcagccgacagggccttcggctcgccgctgtccgggtcgaccaggaggagttcctcctccactccgacagtccgcacctcacgccgcccttcgtccgcagacaccggccgggcgccgggtcgtacgacc

SEQ ID NO: 1447 - DNA, 3667 bp, Unknown
  Kingdom: Bacteria, Phylum: Actinobacteria, Class: Actinobacteria, Order: Streptomycetales, Family: Streptomycetaceae, Genus: Streptomyces
  misc_feature (3366)..(3367): n is a, c, g, or t
ccgaccaggagaaggagggcggtcgcgccctcccggacgagttcgtcgcacagcttcgcgggcgtgagcgcgcccatgtcgaattcgacgacggagccgccgcgtcgggtgaggtggtcccgcaggatgcgcgtcccggacgcccagtagacactcggcacgctcgccaccgcgatacggcggtggcccgcgccgaggaggaagtccgcgtagacctgccagccgtgggactgcgccggggcgagccgcgcgacccattccgtcggctgttcggtgagcgcgtcgagcaccgccgacgagcacaggaacggcacgcgcagtgcgtcggcccgggcggcagcagcccgggcgacgacgctgtggtactcgccggccagtgcggccacgcccaggtgggccagttcgtccacggccgcggcggcccggtggggatcggccgcggtgtcgcggaccacaagctcgagcggtcttccggcgatcccgccggtctcgttgacgtcgcggacggcgagttcgagtccggcgagcaggtgccggcccgcctcggtccagccgggccgggtgagcggcacgagagcgccgatccggacggacgacccgtcagtccgctccgctcccggtgacgatggtggcgtgttcatgcgtggcgtctcgcctcttccgtatgacgatccggcggcagctcgggcggccggttcgcagagtgaacgtcggcggcgccgacattagccgagccgggaacgcccggctccggtgccccttcggagggctccggtccgctggacgcccccttgactgcggctccgggtggaccgacactccagagaggaatcctagtgaacaggtagggaaggcggaaggcatcatgaggcgccctgagccggtggtcggcagctggtgccgtacgcgtcggctctcgtccgcgcccagtgtgtgcaccgcgcccagtgtgtgccccgcgcccagcgtgcgcaccgcgtccggcgtgccctccgcgtgcgtcgcgcctccgaccgcctcgcccacgaccgtctcgcccctgctcacctcgcgccgtcacatcgacctgctgcgcgtctgcagcgcactcggcgcgcccggcgccttctgcgccgtccgcgccgtccgcgctctctgcgtcatcagcaccttcagcgccggcgccctcggctgagccgggcggcgcctcaggcccgcagggcctggcgtcccggccccaccgctcaggtaccgcttccgcggcgcgtggcacgtgccctcgcgcgccccttccgggccacccgacaacttcctgggccacccgacaacttccgggccacccgacaacctacggagacccatgtccgtcacaccgcaggccgcccacgtcgccacccgccccgcgcctgccttccgggggcgtatcggccgggacgcgcgcagcggccactacgccgtgcccggccgctaccgcctccacctgtccacggcctgtccgcagggactcgccatcgccgtcacgcacagcctgctcggtatcggggacggctgtccggtgacgttcctgccggccgtcccggacggccccgacggcgggtacacggccctgcgcccgctgtacgaggcgagtgcccaccgccacccgggaccggccctcgcgccggtcctcagcgacggctggtcgggccggatcgtcagcacccacgcccccgacatcacgcgcgacctggaccggcacttcggcgacggcagggccgccctgtacccgtgcgacgccgaacccggacccgaagccgcatccgccgccgggaccgccgccgggaccgacgccgggaccgagacggaggctgtcgagcggctgtgcgcgcggggcgtcgaggaggccgcccagcgcgccggacgggcggacggcgaccccgcggaacgcgcctccgcactcgacgtcctgctcggcgccctggacggactggagcaccggctgaggggcaacgaccacgtcgcgggcccacggctcaccggcgcagacgtgacgctgtgggtcaccctcgtccagctcgacaccgtgcaccgtcaccacctcgacgcccgtgccgtgcaccgcatcgccgaccaccccgccctctgggaccacgcccggcgcctcaccccgcacccggccttcggcgcccacctcgacctggccggcatcgcccgccgccaccacgcccgctgccgcggtctggaggccgccggcgcggccgtcccgatcctcgactgggccgcccacgcggacggcacccggcggctccaccggccctgaaccaccgcgcccgccggtccacctgacggaccggcgttgactttcgaacgaccgactgacttaacttacggcgaactcacggtccgggctgaactcacagtctggacccacctcacgggccccacagcgacgagcgacaggtgacggacatggacgcagctccccggacggccgcaggccgtgcccagggccgcgtaccggcgtccgcgcagcgcctggtcgccgaccgcgccgtcgacctgctccgggtcagcagcgcgctgtgtaccgcgccgggccgcgcccgcagccggggctgacgactttccgcagccccgcctcccgcggccccgcctgagagcccgaacaccgctgccgcggtgatccgtcgtccgcccgccccgataccgcgcgccaccgacccccgcaccgcccgcacagcggtccaccaccccgctgtgcgccgccggtgcggccgtccgtgaccgtcggcgtggtccggggcgtccgactcagccggagcccaccatgagtgaaccccctggcgccgccgtctccctcgccgaggcacccccggccggcccctctcccgcacccctccctgcccagcggattcggcccttgcgccgccccggccggtggatcgccaccgccgtcgtgctggtcctggtcgcccagttcgcgcacggcctggtcaccaaccccttctaccagtgggaccgcttcgggtactggttcctgcgcccggcccttctcgacggtctcctcgtcaccctcgaagtcaccgcgctcagcgccgtgtcggggctgctcggcggcctcgtcctcgccctggcccggctctcccgcagccccgtgctgcgcgcggtgagctggacctacgtgtgggcgctgcgctccgtaccgctcatcgtggtgctgatcttcctctacaacttctccgccctgtaccggacggtcagcatcggtgtccccttcggcccggccttcttccggttcgacgagtcccggctcgccaccgacatggccgtcgccgtggtcggactcagcctcaacgaggcggcctacgcggccgaggtggtccgcggcggcatcctctccgtcgaccnncggatcgtcctgccgcaggccctgcgctccatcaccccgaactacgtcaaccagctcatcggtctcgtcaagagcacgtccctggtcttctacgtctccctgctcgacctgttcggcgccgcgcagaccatgggctccacctatcccggcgacatcgtgccgctgctgctggtggtcaccgtctggtacctgatcctgaccagcgccgtctccgtcgtccagttccacgtagaacgccactacgcccggggcgcgctgcgcgaactgccgccgaccccgctgcagaagctgcgcggcacc

SEQ ID NO: 1448 - DNA, 1140 bp, Unknown
  Kingdom: Bacteria, Phylum: Actinobacteria, Class: Actinobacteria, Order: Streptomycetales, Family: Streptomycetaceae, Genus: Streptomyces
ctcgccggggccgggcccggggccgggtccggcgccggcaggggtgtcgtccgtggtgagggacgaggcgcggtagtcgatcttcaggccggacatgccgccgaggaccttgcgctggatggcgcggcgcagcggggtcagccggcgcacgacggcgaagacgacgggcaggaccgcgccggcgagcaggttcctgagctggacgaggacggtggcggtgcgggtggagtcgagcagggcggcgccgatcggcacccgttcctcgctgtagctgtcgagcagcgcccgtgccgcgtgcccttgttcgacctgggcgagtttccaggcgaggttgtacgcctcctggatgccggtgttcatgccctgaccggatgcggggctgtgcacgtgggcggcgtcgccggcgacgaagacccggccgtcctgcatccgctcgaccatgcgctgctggaaggtgaacacggaggtccactcgctggcgccgacggtcacctcacggcccagccccttggacagtttcgcgctcagccgttcctcggcgccgtgcggatcgcgcgcgggaacggtgtcgagaagccgccagtggccctcgcgggcgtaggggaccatcatcagggcctgtcccttggtgtgcgcccagtagatggtgtcgggcggcaggtccatggtgacgggagcgtcggcgagcatccaggtctcgctgctgacgccgaggagttcgaggccgagcagcttgcggacggtgctgtgtccgccgtcgcagccgaccagccacgacgtgtcgacccggtgccgggtgccgtcggcgtcctgaagggtgacgtgcaccgtgtcggcgtcctgctcgaggccggtcagccgcacaccccactcgatgtcgacaccgagccgggcgacggcgtcgcgcagcacggcctcggtctcggtctgcccgatgacgagggtgaacgggtaggcggtgggcatcgacgcgtagtcggcctgcagccgcaccaggcggcggccctccgcgtacatggtgaaggcgcggttgcggcggccccgcgcgagcatggcgtcgacgacgcccatctggtcgtacgtctccagggtgcgcgggtgcgtggccacggcgcggctggtgcgcgcgggtccgggggc

SEQ ID NO: 1449 - DNA, 754 bp, Unknown
  Kingdom: Bacteria, Phylum: Actinobacteria, Class: Actinobacteria, Order: Streptomycetales, Family: Streptomycetaceae, Genus: Streptomyces
gtctggtgcccgtgccggccctgcgcccgctgtccgtcggctgggcggtccgccgctgggacgcgctcagtccgctggcccgcgcgttcgcggagacggtggtggactgctgccggggcctcgccaccgcgccggaaagctcgccgccggggcccctcagcccccgtacagcccctccacctcccgggcgaagtcgcgcatgatcgcctgtctgcggagcttcatcgacggggtcaggtggcccgcgtgctgcgtgaagtcgacggggaggacggcgaagcggcggatcgactcggggcgggagaccagcttgttcgcctcgtccaccgcccgttgcaggacggccgccaggtcggggtcgtcggtgaggagttcggcgggcaccggatgcctgccgttcatccggcgccagtgcgtgatgccctcgggatccagggtgatcagcgcaccgacgtaggggcggccgtcgcccaggaccatgcactgggagatcagggggtgcgagcgcagccagttctccagcggtgccggggccacgttcttgccgcccgcggtgatcaggatctccttcttgcggccggtgatcgtcaggtggccctcgtcgtccaggcggccgatgtcgccggtggcgaaccagccgtcccgggtcgccgggaccaccccgcccgcctgcggctcccagtacccgcggaacacctggccgccgctcagcagcacctcgccgtccgcggcgatccggacccgggtgccgggc

SEQ ID NO: 1450 - DNA, 2115 bp, Unknown
  Kingdom: Bacteria, Phylum: Actinobacteria, Class: Actinobacteria, Order: Streptomycetales, Family: Streptomycetaceae, Genus: Streptomyces
ctgggctgggctgggctgggccgtcagggccgcgcggacatcgacgttcccgccggccacgagcactgtccgggcctccaggaacggggccgcgatcgggaccgtgggcagggcgaggaggtcgtagccgcgcagcaggtccaggagggcggcacgggctcgccgtcggacgagcattgtccccctctggaaccaacccattgggtagggatggcataggtacccaatcgattgggtgcttgcggatcggtcggtcggatacgtgcgtgggcgggagcgtgggcgaccgtggccgccgaagtgtgagcgaggtacgacgagcgttcacccaatcgtttgggtttgtcggtggttatgatgaaaggcgccgggtgaggtggttgtcaatagccccgtgaagaaccggcgtggagaggggaggggcggcacggtgagccaaggtgagggacagcgtcctgccactttgcgtacggtggcgcagttggcgggggtcgatgtgtccacggcctcccgggtactcaacggcacctcggaggacgccaggagggcagcctcgcgggagaaggcggacgagatccgccgcgtcgcgcaggagctgaactaccgctccaatcctcatgccgcaagtctgcgtacccggcgtaccaagttgatcggtgtgatcgtcccgcggctgtccgatctcgtgctcgccacggtctacgaaggcatcgaggacgcggccacccgcctgggcctgtcgacgttcgtcatgaacagccatgacgatccccgcgagcagaaggagcggaccgatgtggcactctcccgccgggtggacgggctgatcttcggtgacgcccacatcgacggccgcttcatcgacgagatcgccgaacgccggatcccgttcgcgctcgtgaaccggcgctcgggcgatcacccctcggtgacctgtgacgactaccgtggcggccgactggtcgcggagcatttcctggaactcgggcacgaacgcgtggcggtgatcgccggcgaacggtacgccagcaccggcatcgaccggacagcgggattccgcgaccgctaccgcgaggcagggatccggctcccctcctcccgggtcgtccactctcgcttcgatgccgcgggaggccgccaggcggccgaacagctcctgcgggggcggacacggcctaccgccgtcttcgccgtcaacgacttcgccgcgatcggcgtcctgggcaccttgcgcgaccacggactccgcccgggcaaggatgtggcgttggccggtttcaacgacacgccgctggcgcaggagctgcccgtcccgctgaccacggtccgttccccgatgcgtgagatgggggaacgtacggtggatctactcgtccggcttctcgacggcgaacaggtgaagtccgaacggctggcccccgccctggtggtgagggcctccacggaccccgccgggctctccctcgccgccacagagttctgagggcggttactgagcggtgcagccgtcctcgaagcggagggcgactccgatgacgaagccggcgccgtcgctgcacagccacaggacggccacaggacggcctgggccatctcctcggcggcgccgaggcgtccgatgggctggttggcttcggcctcggcgcggtcgagttctcccttggcgatcaggtcgctgaccatgggcgtctcgatagttccggggcagatggcgtcgatgcggatgccgcgcggcgcgtattcgagggcggcgctggtggtcaggccgatcacgccgtgcttggaggagtggtaggaggcccggccggggatgccgaccagaccgccgagcgaggagcagtcggcgatggcgccgctgccctggccgcgcatggggcgcagctcatgcttcatcgcggcccagatgccgcgcaggttgacggcgtggaccttctcgaactggtcgaggggctcgtcgtcggcgtcggtgggtgggatctggtggtcggcgtcggtgagggccttggccgcctcgctcaccgcggcctcgtggaagtcggcgagggcgacggcggcgccggaggcggcgaaagcccgggcggcggctaggcccatgccggagccggagccggagcc

SEQ ID NO: 1451 - DNA, 3670 bp, Unknown
  Kingdom: Bacteria, Phylum: Actinobacteria, Class: Actinobacteria, Order: Streptomycetales, Family: Streptomycetaceae, Genus: Streptomyces
gacggcggcaccgccctgcccgacagcgtccgcacggtcgtcatcggcggcgaggcgaccagcagggcccggctcggcgactggcgcgcactgcccggcaccggccggatccggctcgtcaacacctacggctgcaccgagaccaccctggtcacccacgccggcgacctgcacggcccgcactcccgggcgcccgaggacggctccgccccgatcggccgcgccctgccgcacgtacgggagcggatcggcgaggacggcgaactcctcgtcggcggccccgccctcgccctcggctacctgggcctgccggaggccaccgccgaacgtttccccgtcctcgacggcgtccgccacttccgcaccggagaccgggtcaggcgcggcgagcggggcgaactgcaccacgagggacggctcgacgaccagatcaaggtccgcggcatccgcgtcgacccggccgaggtggaggcccagctgtgcgcccaccccggcgtcgcctcggccgccgccaccggtgtcacggtcggcgaccgcaccgtggtggtcgcctatgtgacggccggccgcacggacgacggcaccgctctcgccgccgaactgcgcgcccatctgcgccggcacagccccggccacctgcggccccaccgcatcaccgtggtgccggaactcgtccacaccgcgagcggcaaggtcgaccgccgccgcacccaccaccgctacaccaccggcgcctgagccggcgaacgcgaggagaacacacatgtcgaccccacaggccagcaccgtcgaccaggtgatcgggatctaccgccgggtcctggagacggacgacgtcgcggccgactccgacttcttcgacctgggcggggactccctgctcgccacccgggtgatcagcgccatcgcccgtgacctcggccccgaactgaccatcgacacattcctcgacgcccccacgccccgggccgtggccgagctgatcgcgagcgtgagcgcgtgagcaccctcatcgtcggagcaggactcgccggactcaccgccgccaccgaactcgccgcccacgggcggcaggtgacggtactggaggcccggggccgggtgggcggacgtacccatggcatcgaggtggccccgggccagtgggcggacgccggagccgcctacctcggcgagcggcacaccgaactgaaggccctcatcgccgggctcggcctgaccaccgtgcccaccaccaccgacggacagagccggttctccgtcggcggcggcccgcagggccgcgacggccggttcccgccgctgagcgcggtcgccctcgggcagctcttcgacgccctggaggaggtgaccagcaccgtgcgcgccgacgcgccctggctcaccccggacgccgggcacctggaccggatcagcgccgcggaatgggtcgggcagcgcgtcgaccaccccgacgcccggctgttcttcccgctcttcctgggcgaaatgatggcagccgacccggccgacgtgtccgtcctgcacatggccttctacctcaggtcgggcggcggcatccgcttcctcaacgccttcgccggcggcgctcaggaggaccgggtcgacggcggcgcccaccggctcagcgagctgctcgccgccgagctgggcgaccgggtgctgctcggcgaacccgccagggtggtggaggagaccgggtccggggtgcgcgtgcacaccgaccgcggcgtccacgaggccgactcgctgatcgtcgccgtaccgccgctgctcgccgacgccatcgagtaccgcccgggactgccgtcgcgccgcgcgggctccaccaccgtgcccggctgcgccgtcaaggtgcacctggtctacgagcggccgctgtggcgcgagtacgggctgtccggctggtcggtcagcgccgacgggccgctgctgtccacggtggacgactccccgtccgccgacggcgtcggcatcctcaccggcttcgtcacgggacgcgaggcccgcgagtacgccgccctcgacccgcgcgagcagcgggaggcggccgtctcccaggcccggcggctcttcccggaactgcccgagcccatcgcccaccacgtcacggactggatcaacgaggagtacagcaggggctgttacgccgcgctgttcggcatcggcgactggaccgtcctcggcccccacctcaccaccccgcacggccgtgtccactgggccggcaccgagaccagcaccgagttcttcggactcatggagggtgccgtccgttccggccggcgggcggcgaccgagatcctcaaggcctacgatgactgaggagtcgtcacagaccacggggggcacacaggtggacgaaaccccgctgggccgcgcggaggccatgtaccgcgaggaccgcacctgccaggacctcggcatcacggtcgacggcatctcggagggcagggccaccgcccgtctgcgtctcgcccccacgatggtcaacggccacggcacggcccacggcggctacctcttcctcctcgccgacgtggccttcgcctacgcctgcaacacccggggcgcgacgacggtcgcgcaggccgcccaggtgacgttcctgcgtccggccagggccggcgacgaactcgtcgcggaagccgtcgaacgctcccggttcggcgccaacggcatctacgacgtcaccgtccgccggagcgacggcacggtgatcgccgagttccgcggtcagagccgctcccttcccaagtgagccgaacagagatgagtgcgatgactgacatccgtcccttcgaccgccgggcgctcgaggtcaccgaggccatcgtcgaccaggtcaagccggaccacctgggcctgcccacgccctgcgcgcagtggtcgctgcggcagctgctggcccacatggcagggcagaaccacggattcgcggccgccgccgacggcgaggtgtccgacgactccgtctgggccgaccggccggtggacgacgatccggcgggagtcttccgtgcctccagccggcgggtcaccgccgcgttcgcccgcgagggcgtgctcgacggcgagttctggctgccgcaggtgcgcggcggccagatgttccccgcgcgcaccgcgatcgggttccacttcgtcgactacgtcgtgcacggctgggacgtcgccgccaccctcagcatccccgcccccttcgacgaggagacgctcacggccgtactgccctacgtggaggaggtgccggacggagcgaaccggcgggcgccggacgcgtccttccggcccgccctgccggtgcgggacggcggcccgctgctggaccgtgtcctcgcgctgctgggccgctcaccgaagtggcccgcatagccgcgtgacgcccaccgggccggcggacggcacgacgaccgccccccgccggcccgggaaccccttccgccggtcggccaaccgtcctccaccggtccgccaaccggcccgtccagcaacacacttcaccggccccggcaaccggcccgcccggcaaccgtcctccgccatcccggcggccggtacggtcccgtggcggttcttcaccggccggacagccgggccggtccggcaaccccttccgccggcccgccaaccgccctccaccggtccgccaaccggcccgtccagcaac

SEQ ID NO: 1452 - DNA, 1610 bp, Unknown
  Kingdom: Bacteria, Phylum: Actinobacteria, Class: Actinobacteria, Order: Streptomycetales, Family: Streptomycetaceae, Genus: Streptomyces
atcccggtcggcgtcgaccccgcactgccccgccccgaccacagccgcgcactgccgtgggcgagcaccctgctgctgttcaccgatggcctgatcgaacgccgcggccaggacatcgacaccggcctgcggcagctggccgcacgcgcggccaccctcgccacggccccgctgcacgccctgtgcgacgcgctgatcacccggcaggacgcctacgacgacgatgtcgccctgctggcgctgcgggtgccggacggaccggaggagcgcccgagcacatctcaggaaggacagccggggtcgtgatcccccggatccgggtcgtcaccgctgcgggcgtgcgggggcgggtcgaagtgcacggtgatcttctcgaaccccttgaacgactcggtcgtcgcataggaccggtaggcccgctggtcgcccgcgctgaggtggacgcggtcggtgaacgggctgagcaggctccgcggccacagccgcatgcaccgcaccgcgccgacctcggccgtgaggacgtagaccagtgcgccgaggtagatccaggcgagcaggccgagcacgatgccgaacaggccgtacgtggccgtggcgccctggagcacgtggtcgacgtagtaggtgccgccccacagcagcgcctgccaggcgcaggcggcgcccagcgccggaccgtacagcacgcgcagcggcagccggcgccgggtcagcagccggtagctggcgatcagcagcgcggcgttcagcaggacggccagcgcttcggcggcgaccccgacgccggcggccagccgggcgccgaacaggcccgacgcccactgcgcggcggtggacaggacggtggtgacacacaggccgagcgcgagcagtgacaggaacttcagccccttccagcgggagcggaacgggtcgggccgggcgtgccggggcacggcgaagatcttgttcagcgcgtgctgggcggcctgggcgatgttcagcacgccgtagaggctgccgaccacgccgaccgcgacggcgatcgcgttgccctggaacgagtggatgttgtggacgagctggtcaccgatcacggggaactctctgagggccgagttcaggaccgcgtgctggaggtgcgggctgctgctgaggacggcgctgagcacggcgacgaggaagagcagcagcgggaagagcgccaggaagccgtagtacgtgagcagggcggccaggtaggccgcctggtcgtcgtagaacttgtagatcaccgccagcggcagccccgcccagcggtgccgtcgctggtaggagtccacccgggccagcactcccatgcgctctcccacacggtcggccgtggctgggctgccgcgcacaccgccgctggttccaagtgccctggtcagggcgttccatgcaggacggctaagtggggtcccggtccgaggccggccacacgtacggcaggtcgtccggcacacccgggaacaggacggcgtaccggccggggtccttgcgcaccagcgccgagcggtgactgcggtgcagggattcgtcgccgagccatggtggcagctcacccgcggcggccagctccggctgctcgcgtaccggggtgccggggc

SEQ ID NO: 1453 - DNA, 2234 bp, Unknown
  Kingdom: Bacteria, Phylum: Actinobacteria, Class: Actinobacteria, Order: Streptomycetales, Family: Streptomycetaceae, Genus: Streptomyces
tgcaccgcggccaccgcctcgtgcgccgagcggacctgtgcgaggatccgctccgcctcgccgagcagcgcgcgcccggcctcggtgagcgtcacccggcgggtggtgcgcacgaacaaaggcgcccgcagctcccgctccagcgcccggatcgaggccgacagacccgactgcgagaccatcagccgctccgccgcccgggtgaagtgccggtcctcggcgacggcgacgaagtgctggagatgacgcagttccatgattgagcaccctagccgttgaatccgatcggattctcctgttggaccgctgcccgccgcccgcgccagagtgggagaccggttccggatgcgacggaaccggtcatctcgtgccccacccctcatggagtcgcgttgtacaccgcccaccccgaccgttacgccgacctgccctaccggcgcaccggccgcagcggactgaagctccccgcgctgtcgctcggcctgtggcacaacttcggccccgaccgcccggccgccggccagcgagccatcctgcgccgcgccttcgacctcggcgtcacccacttcgacctggccaacaactacggcccgccgcccggcgccgccgagaccgcgctcggcgaggtgctgcgcgccgacttcgcgccgtaccgcgacgaactggtgatctccaccaaggccggctatctgatgtggcccggcccgtacggcgaatggggctcccgcaagtacctgctgtcctcgctcgaccagagcctgcaccgcatgggcctggagtacgtcgacatcttctactcgcaccgcttcgacccggacactcccctcgaggagacgatgggcgcgctgcactcggcggtgcagcagggcaaggcgctctacgtcggcgtctccaactactcggcggagcagacccgtgaggccgcccggatcctgggcgagctgggcaccccgctgctgatccaccagccccgctactcgatgctcgaccgccgccccgaggacgagggcctgctcgacgcgctcgacgaactccaggtcggttccatcgcctactccccgctggagcagggcctgctcaccggccgctacctggacggcatccccgaggactcccgggcggcgagcgacagcccgttcctgaactccgagacgctgaccgcggaactggtcggcaggctgcgcgcgctggacgagatcgccaagtcccgcggccagtcgctcgcgcagatggcgctcgcctgggtgctgcgcggcggccgggtcacctcggccctggtcggggcgagcagcccgcagcagctggaggacagcgtcgccgcggcccgcaacctcgacttcgacgcggaggaactggccaggatcgacgcggtcgtacggccgtagagggtcgtacggcgcgcggaccaggcgcgccgccggcgcgaggcggtcgtccactccccgcaggtggacggccgcctcgccgtgtgccgggtcggatccggcccgccgctcacgccccggcaggcacccggtcgaggaagcccagcacggaccggatccggccctcgtcgtccagggtgatcacatcgaacccggcgaccggcgcggaaccgtccgcctcgctcaccagttcccaggagaaacgggccgtgtcgtggtgcccgtcgacggcaccggcgagccggaagacgaacccggggaactgctcgtgcgcccccgcgatcagctcggcgatccggtcgtggccgccggcctcggcgagagggtccgtgtagcggccgtccggcgtccaggcggcggccaccgccttgcccagggcgtcggcgccgcgggcgttccaggcctccaggtagcgggcgacggcactctcgtaacggtcggtctgtgcggacatgggaaatcagcctccatcgagggcgtcggttccggacgggatccggatctccgtcaccggcgatccgatggctccaccctgcctgggctgcggctgccgggtcgattacccccggggtcatgccgacgcggcggcggggccgcgcgttttcggccatacggcgcgcggaatatgccaggagactggccagaaagtcatggtgacactgtttcaggagtcaacatactcgacctcaggggcgcagcaccgcacaggagccgtacgggccgcgagggagctgaaggggcgcgccggtgtcgagacggcgaacgcgcggaggcgcgcagcgctgagcacgttcgccgtctcgacaccgg

SEQ ID NO: 1454 - DNA, 8109 bp, Unknown
  Kingdom: Bacteria, Phylum: Actinobacteria, Class: Actinobacteria, Order: Streptomycetales, Family: Streptomycetaceae, Genus: Streptomyces
caccaggagcaccaccctgcggccgtagacccgtccgagcaggtccgcgcaggcggcagcgagcccggcggcggcgcgctgcatgagcgcgccgccggggagccgcgccatgagggcgcgctcggctgacctgaccgtctcgacgctgtaggcgatacgcatgccgtcgagtctgccccgcatacgtccgccgccgcacgggaacccggtggtcgcggcctcccacgcgggccacgctggaagaccggtggacgaagcggaccggacccagggagaaggcgggagcgcatggcggacgaaccggcgggctccgacgggccgcgcccgtggccggtgcccggcgacgatgagggcactgcccgccggacccggctgcaggccctggaactgctgctcaccgagcagcggttcaggatcggccggcacgcgagcgcctttttcgacgccggaccgcagcgaggcggcacgggcgcgctcccgcaccccgccccgcccgtggacccgccggtgcgggcgctgctcgactcgctcccggtccccgtcacggtcgtccgcccggtacccggcggcacacaggaccaggaaccgcagttcctctgcatcggccagaaccgggccgcccgggagtacaccgcccggcaccttccggtcggcgcgctcccgccgtggaccggcccgacgccgctgttcgaacgcttcccgaccctggcctgcacggctgtgccgcgcctgctcgccgaggcccaccgcaccggggacccgcagggccccgagtccgccgagtggccgctgccgggaccgggcggcctcaccgtccgggtgagcagtgaggtgcgggtcacgcccgccggaggtctgctgctgctcagctgggagcgcggccacgaatccctgctggcgcaggaggcgcagcgcctggtggaggtgtgctgggcggagtggagcctgggtgacgggaccgtcgatgcgtcgtcggaatgcggccgcgtcctcggtctctcggcgcaggagccgctgcccggcctgctggaactgggccacagggtgacgacggacagcctggaggcgctgtaccggtcggtccacgacgtgctgctgggcgcgccgatggcggagtgcgacctgcacctcacccggccggacgagcggatcctgcggttcgtcgccgcgccggtgcggctgtcctcggggccggtgtgggcggtgcgcgcggtgctccacgacgtcaccgccgaccggcgcagccgcgccgtggccgagcaggcgacccgggaggcgcgggcgcagcgggagcgcgcggacgccgtcgccgaggtggccgcacggctgcgggacgccgtactgcccgccttccccgcggaactggcccgtcacggcgtcgaggcggccgccgtctaccgccccgagtcgggcacggcacgggtgggcggcgactggtacaagacccgtgtcctgccgtcgggcaggctgctcatcgcgctcggggacgcccgcgggcacggcctcgaagcggtcacgctgatggcgaagctgcggtacgcgctggccggtctcgcgtacaccggcgagtgggtggaacggctgaccggctggttgaacacggtcgcctgcgacgacggcgacgagtccaccgccacggcggtcatcgcccgctaccaccccgaacgcggtctgctgcgctggacgtgcgcgggccacccgccgccgatcctggtccgcgacggcaagcccgtcctgctcgacccgccgccgggcggccccggcatgccgctgggcgtcctgccggacgagagctacacggcggccgagacctggctgcgcccgggcgacgtgatgctgctctactcggacggcctgatcgagcgccgcggttcggacctcgaccgggacgcgtcgcggctgctgcgcgccgtcgcggaccgcgccgccggcggcatcccgccgggcggcgaggcgctcgacgcgttcgtacgggatctggtcgaccggctcacgggcccgcacacggaggacgacacgacggtgctggcgttccgcgtcctgaacacgggcgcaggcgcgacgggcacgggcacaggcgccacaggcacgggcacaggcgccacaggcacgggcacaggcacgggcacgggcgccacgggcgcgggcacgggcacggactgaggccgcgcagggagccgcgcctcggtcagccttccgcgatcacgaccgcggaggccaccccggcgtcgtggctgagcgagaggtgccaggaccgtacgccgagttcggcggcccgcgccgccaccgagcccttcacccgcagccgggggcgcccgctgtcctcgacgtacacctccgcgtccgtccacagcagcccggccggggcgccgagcgccttggcgacggcctccttcgcggcgaaccgggcggccagcgaggccatgccccgccgctccccgctcggcagcagcaactcccgttccacgaagagccgtcggaccagtccgggcgtgcgctccagcgacgccgcgaaccggtcgatctcggccacgtcgattccgaccccgatgatgctcatggagggaccctacgggcccgcgctcaccgggcggtcacttgccgctgtcctcggccagggtgtgcgccaccagggcgttggcgtggccgtggccgaggccgtgctcggacttgagccagttgaccagttccatgtgcttggtcagcggcgaggaacggacgagttccttccactcggcgatcggccggccgtacttcttctcgatggacgggaagtagctggcggggcccttgacgggtgcggtcatggcgggaacgtccttccggtgcctggggcgtcaacgtccgtacgagtatcggctgtatgactgacaccggcccggaaactcatcgctcacctgtgacttccgcacagggggaaacggctcggcggggctactccaccgtcaccgacttcgcgaggttgcggggctggtccacctcgttgccgcgggcggtggccagttcgcaggcgaagacctgcagcgggaccgtcgcgaccagcggctggagcagggtcggggtggcggggatgcggatgaggtggtcggcgtaggggacgaccgcctcgtcgccctcctcggcgatcacgatggtccgcgcgccccgggcccggatctcctggatgttggagacgatcttgtcgtggagcagggaccggccgcgcggggacgggacgaccacgacgacgggcaggtcctcgtcgatcagcgcgatcggcccgtgcttcagctcgcccgccgcgaagccctcggcgtgcatgtaggcgagttccttgagcttgagggcgccttccagggcgacgggatagccgacgtgccggccgaggaagagcaccgtgttcttgtcggcgagggagcgggcgagttcccgtaccggctccatggtgtccaggacacgctccaccgcgccgccgatctgcgagaggtcgcggatgacggcgcggatctcgtcgccccacttggtgccgcgcacctggccgaggtagagcgcgacgaggtagcaggcgaccagttgggtgaggaacgccttggtggaggcgacggcgacctccggcccggcgtgggtgtacagcaccgcgtcggactcacgcgggatggtggaaccgttggtgttgcagatggcgagcaccttcgcgccctgctcgcgggcgtggcgcagcgccatcagggtgtccatggtctcgccggactgggagatggcgacgacgagggtctgggcgtcgaggatggggtcgcggtagcggaactcgctggcgagttcgacctcgcaggggatgcgggtccagtgctcgatggcgtacttggcgatcatgcccgcgtggaaggcggtaccgcaggcgatgatgacgaccttgtccatctcgcgcagttcgggtgcgctgatccgcacctcgtccagggtcagggagccggcggcgtcgatgcggccgaggagggtgtcggcgacggccttgggctgctcggcgatctccttgagcatgaagtagtcgtagccgcccttctcggcggcggccgcgtcccagtcgacgttgtaggagcggacctcggcgggccgcccgtcgaagccggtgacggtgacgccgtcccggcgcagctcgacgacctggtcctggccgagttcgatcgcggagcgggtgtgggcgatgaacgcggcgacgtcggaggcgaggaaggcctcgccctcgccgacgcccacgaccagcggggagttgcggcgggcgccgacgacgacgtccggcgcgtcggcgtgcacggcgacgagggtgaaggcgccctccagacgccggcacaccagacgcatggcctcggcgaggtcggcgcaggaggagaactcctcggcgagcaggtgcgcgacgacctcggtgtcggtctcggaggacaggtcgtgtccgcgctccaccagctccgcgcgcagcagggcgaagttctcgatgatgccgttgtgcacgacggcgacgcgtccggcgttgtcgaggtgcgggtgggcgttcgcgtccgtggggccgccgtgggtggcccagcgggtgtgcccgatgccggtggagccggtgggcagcggccgttcgaccagctccttctccaggttgaccagttttccggccttcttggccgccgccagttggccgtccgcgaggacggcgacgcccgccgagtcgtacccccggtactccagccgtttcagcccggccatcacgacgtcgagagccgactgcgaacccacatatcccacgattccgcacatggctccgcagcctacggcccgtcagccgacgaaacccgcctctccgtgcccgaaatcggaaattcccaccggggtacgaagggttcacgggcgggcacgcccacgtgacccaccccaccccccgccccgtccgaactccgttaacaatggactgtgatctctccggtcccctcgatgccccggagcgcccaccggcccaggccggaggcgactccctatgtcgacctcacccgcgccgaatggagcgcgctgcgtgacaagacgccgctgccgctcaccgccgaggaggtggagcgggtgcgcgggctcggtgacgtcatcgacctcgacgaggtgcgggacgtgtacctgccgctgtcccggctgctcaacctctacgtcggcgcgaccgacggactgcgctccgcgctgaacacgttcctcggtgaacagggctcccagtccggcacgccgttcgtcataggagtggcggggtcggtcgccgtcggcaagtcgaccgtggcccggctgctgcaggcgctgctgtcgcgctggcccgaacacccgcgcgtggagcgggtgaccacggacgggttcctgctgccgacgcgggaactgcaggcgcgcggcctgatgtcacgcaaggggttcccggagtcgtacgaccgccgggcgctcacccggttcgtcgccgacgtcaaagcgggcaaggcggaggtgaccgcgcccgtctactcgcacctgatctacgacatcgtgcccgacgagaagctgaccgtgcgccgccccgacatcctgatcgtggagggcctgaacgtcctgcagcccgcgctgcccggccaggacggccgcacccgggtcgggctcgccgactacttcgacttcagtgtgtacgtcgacgcccgcaccgaggacatcgagcgctggtacctcagcaggttccgcaagctgcgcgacaccgccttccaggacccctcctcgtacttccgcaagtacaccgaggtctccgaggacgaggccctcgactacgcccgcacgatgtggcggaccatcaacggacccaacctggtggagaacatcgcccccacccgcggccgggccacgctcgtcgtgcgcaagggccccgaccacaaggtgcagcggctgcgcctgcggaagttgtgagcgcggcgggccgtctacgctgccctgcatgctgcatctgcgactgatcacccccgccgaccgcaccgacgaggtggcgggtctgatccagaggacggtcggcaccgcgcacctcgtcgtgctgccgggcgcggcccgcaacccgtcgggtgacgtggtgatgtgcgacgtcgcccgggaggccgccgacgaactcctcggcggactgcgagggttgggcatcgaccggtccggctcgatcgccgtcgagtccatcgacctgtcgctgtccgcgcgggccgacaaggccgaacaggaggcgccgggcgaggccgcggacgcggtgctgtgggaggagctgaccgacgccacccacgaggagtcgacgctgtcgatcacctatctcgcgttcatcacgctggccacgatgatcgccgcctgcggtgtggtgctcgacaacgccatcctgatcgtcggcgcgatggccgtgggaccggagttcgggccgctggccggcatctgcacggccctggtccggcgggcgccgggactggcgctgcgctcactgctcgcgctgctggtgggcttcgcgctggcgatggccgtgacggtgggcttcagcctgttcatggacgtcgtcggcctgttcagcaaggcgaagctggagggcccgcggcccaacaccaacttcgtgtacgcccccgactggttctccttcgtggtggcggtcctggccggcatcgcgggcaccttgtcgctgacctccgccaagtccggcgccctggtcggcgtcgccatctccgtgaccaccgtcccggccgccgccaacgcggccgtcgcgttcgcctacggcgacaccgcccagacctggggctccagcaagcaactgctgctgaacctgctcggcatcgtcctcgccggcaccctcaccctgctcttccagaagtggctctggtcgacgcagcgggcacggatgcggaagacggcggcatagccgcacatacgtacgaaccggagcgggaccggtgctcggccccgcccgccgtaccgcgagcgggcgggccggtgctcagccccgcccgcggtcaccgcggtcccgcgctcagcccagtgccgacttcaccgcgtccgcgagccgccccgccaccgaacgcgcctgctcgatgtccgcggcctcgaccatgacgcgcaccagcggctcggtgccggaggggcgcagcagcacgcggccggtctcgcccagctcgcgctcggcctcggcgaccgccgtggccaggtccgcggaggtcttcacccgggacttgtcgacgtcggggacgttgatgaggacctgcggcagacgctccatcacacccgccagctcccgcagcgtacggccgctgccgacgacccgggccgccagcatcaggccggtgagcgtgccgtcgccggtggtggcgtggtcgaggatgatgacgtggccggactgctcgccgccgagggcgaagccgcccgccttcatctcctccaggacgtagcggtcgccgacggcggtctgcacgaggtggatgccctcgcgctccatggccagcttgaagcccaggttggacatcacggtcgcgacgacggtgtcggagcgcagcgcggaacgctcccgcatcgccagcgcgagcacggccaggatctggtcgccgtcgacctcgtcgccggtgtggtccacggccaggcagcggtcggcgtcgccgtcgtgcgcgatgccgaggtgggcgccgtgcgcgacgacggccgccttcagctggtccaggtgggtggagccgcagccgtcgttgatgttgaggccgtcgggttcggcaccgatggtgatcacctcggcgccggcccgggcgaacgcctcgggcgagacccaggccgcggcgccgtgcgcctcgtccaggacgatcttcagcccgtcgagccggttcggcaggacaccgacgaggtgggcgacgtacttgtcgaagccctcgtcgtagtcgcggacccggccgacgcccgcgccggtcggacggtcccagggcgcgccggtgcggtgctcctcgtagaccttctcgatgctgtcctcgagctcgtcggcgagtttgtggccgccgcgggcgaagaacttgatgccgttgtccggcatggcgttgtggctggccgacagcatcacgccgaggtcggcgccgagcgcgccggtcaggtacgcca

SEQ ID NO: 1455 - DNA, 2467 bp, Unknown
  Kingdom: Bacteria, Phylum: Actinobacteria, Class: Actinobacteria, Order: Streptomycetales, Family: Streptomycetaceae, Genus: Streptomyces
ccgcgggagcctcccccgtccacgccttcgtcctcgcgcacaccctcgccgacgcgaccgtgcgcgacctggccgccgccgagccggagcccgtctcggtggtccacctcggccaggacatccgcatcgaacacccggtgcggcccggcgagccgctcaccgtcaccctggacgtgcagggcgcccgccgcgaaccgcgcggcacccgcgtcgccgtccgcgcccgcctcaccggctgaccccgcagtggatcagcggctacgcccacgcctccggcgacctcaacccgatccacctcgacgacgaggccgcccggaccgcgggcttcccctccgtcatcgcccacggcatgagcgtcctcgccctggccgtcgaggagatcgccgaccggtacgcaggcggcgacatcacccgcgtacgggccgtcagcgggcgcttctccgcacccgtggtgcccggcgtgccgctgaccgtcgaactcacccccgacgccacccgcaccctgatccgcttcacctgccgcacccccggcggcatcgccgtcaagagcggctgggcccacctcaccggccctgagtcaccgggaggcggccatgactgaccgcgccccgatcaccggtctgctgcacggcttcctcacccaggtccgtgagcgccccgaggcgcccgccctgatctggcacggagaagcgaccagctaccgcgagctgtacgacatggcgggccgcgaacgcgagcgcctggccctcctcaacctgccggccggccagcccgtcggcgtcctcgccgccaagtcaccgggcacggtcgcgctggtgctcggctgcctgctcgcccaccgcccgttcctgctgccctcgccgcagctcgcggacagcctgctcacccagctcttcgaccaggccggctgccgccacgtcctcgccccgcaggacgaggcgcagtgcgtcctgccgccggcccgctcggcgggccggccggtgcccgcggacaccaccttcatgctcaccacgtccggctccaccggactgcccaagatcgtcccgctgggccgcctggccgtggaccgcttcaccacctgggccgcggcggccttcggcatcacgcacggcaccaccgtcctcaactacgccccgctcaacttcgacctgtgcctgctcgacgtgtggagcaccctcgcccacggcggccgcgtcgtcctcgtcgacaccgacaaggccgtcgacggacgccacctcctggacctcctgctgcgccacgacgtcgagatcgtgcaggccgtgccgatgttctaccggctcgtcctggacgccgcccgccgggccggcgtcatcctgccctcggtgcgccgcgccgccttcaccggcgacgccctgcccgagcgcaccctcgccgaactgcgcgacctgctgcccgccgcacgcctgaccaacatctacggctgcaccgagaccaacgacagcttcacgtacgacctcgaccccaccgccggcgtcctcgcgccggtgcccatcggcaccccgctgcccggcgtcgccgcgctggtcctggacgccgacggccgcgaggtcaccggccccggatccggcgagctgtacgtcaggacacccttccagtccggcggctacctcgaccgcgcccgcaacacgggcaggttcaccggccacccgctcggccacgacgacggcccctggttccgcaccggcgacctcgtgcgccgcgacgccgacggcctgctccacctcaccgggcgcagcgacttccaggtcaaggtgcgcggcgtcgccgtcaacaccgccgagatcgaacaggtgctgctgcgccaccccgccgtcctggaagccggcgtcaccgcggagcccgacccgctcaccggcaaacgcctcgtcgccgcggtacggcgcaccgccggcagcggcctcaacagcctgctgctcaaggaacactgcgcccgcgccctgcccagggccgccgtgcccggggtgctgcgcatcaccgacgaggcgctgcccaagaccgccaccggcaaggtcgaccgcaccgcgctcgaccggctgcgcccgcccgccgtgccgccgtccccggacggctcccgcgaaccggccggcgccgtcaccgtcgccaccgcagaaggaaggacgtcatgagcaacacggccaccatcaagcagttcatcgtcgaggagttcctgcccgacctcagtcaggaccaactcgccgacgaccaagacctgttgacgaacggggccatcgattccctcggtctgctgaagctgatcgcctgggtggaggaccgcttccagctcgccgtcgacgacacggacctcgaccccgacaacttccgcagcgccgccgccatcgacgcgttcgtcgcgagcgcccgccagggggtgaccagctagccatgcacgacgcgctcaccggcctgctggcgcggcgctcggtggccgagcgccgcgccagcaggc

SEQ ID NO: 1456 - DNA, 1742 bp, Unknown
  Kingdom: Bacteria, Phylum: Actinobacteria, Class: Actinobacteria, Order: Streptomycetales, Family: Streptomycetaceae, Genus: Streptomyces
ggttcggtgcgcccggcggcttcggcgacgctcctccctcgctgcggtaccggacgccgatggtgcaggcccggcggcgggtggcgcgggcgctgcgcgcgctgcgggacgccgtcgacgagtccttgctcgtcgacgggctggtggatgtcggccgctggctggaggagttccacccgcgctccctggtggagctggactacggcggactggtgcacatgctgccggccggtgagctggagggcgaccactcggcggcggacgtggccgaagggatcgcggcgctgcgccagggcgacgagacggccgcggcgcaggcctacggacggctcgtggagcgctggcgcgcggtgcgggaccggcgctcggccaactgacgatgcggtgacgattcctcagcgagtgacctgcatcacggctcgaacggcatcgaacagcgtacggtcaagcgtcttcagcggagctgatgggacgtagggcccgatccgggcgtttgtgtcaagggtgatggaccgcacttaccagacccttgccttggttgcccctcctcatgccaaaataggacaaggagtccggggagggctccttccgcctacttgtgctccgtcttgggcggaatctctgcattgcacgctttggggggtctggtgacttcctgatcaccctgtgactgatcgtcacagcggtgtgactgtccgctatggcatggtccatcggcttccgtcgctgatgaacacctgggagggcaattccatcggtttggccgacgcggctggacagatggtgtagttgtagtgccgaggacaagccgttcgtcctataaccgactcgactcgcgtccgccatttcgggcaacgcgggtcaaggtgcagaatttagaggaaagaaccgagaaggttcggttctcccgaggaggccgctcatgaccgctcgcacccctgatgccgagccgctgctgaccccggctgaggtcgccaccatgttccgcgtcgaccccaagacggtcacgcgctgggcgaaggccggcaagctcacgtcgatccgcacgctcggcgggcaccgccgctaccgcgaggccgaggtccgcgctctgctcgcgggcatcccgcagcagcgcagcgaggcctgaacaactccatatccggacaaaccggctggtcccccaaccagtcagggcgtccgggcccaacagctccaagcgacgcgggtcctgccccaacaggccccacgcccaagccgtcagagctcttcaggcaagtgaacagggtgcgtcgtcgatcgcgctggactccgccgggtccagcgcgatcttttttgtgcggtcggcgaggtcttgcgggtgggtccgtgagcgggcttgtccgagcctggggaggggtgtcggctcccctgggggcagctccggagagcagtgcaattgcacatattaaattgactgcttgtaggaggggtgtaaggacagggttttcaaaaactagtacggtgacacccgtcacattgcgcggcgcttgttggctgccgccggcgtgcgctaatggaggttccggttccatcggcccctgcagggacgggagttcgggatccgggcgacgcgctcacgcggtcgaggggcggtcggtgtcggcggcctccagcgcttccagggctttgagcgcctccagcggctccagagtgtgcccgagcgcctccaaggccgtcacggcgccaccccggggctcctgcgcggcgcccggaggctgcgc

SEQ ID NO: 1457 - DNA, 687 bp, Unknown
  Kingdom: Bacteria, Phylum: Actinobacteria, Class: Actinobacteria, Order: Streptomycetales, Family: Streptomycetaceae, Genus: Streptomyces
cgcgcccgggttcaccgccagggtcgacagggccgccaccgtgaacgcccgtcgtgtcactcggcccatccgggcacccccagtacgccgtggatccgcactgtcacggatcgtgcaccgggccagcatgcacgacccggcgggccgatccgcgtcacgacgggggtaacgtgctcgatcggagcaggcgccgcacacatggaccgcctgccacagccgtagatcagcagcgaaagggacgatgtgaccgacatcgaacgcgtcggagtggtgggctgcggccagatgggcgcgggcatcgccgaggtgtgcgcccgggccggactggacgtgaaggtcgccgagaccaccggcgaggccctggagatcggccgcacccggctgttcaactccctggccaaggcggccgagcgcggcaagatcaccgaggaggagcgggacgccacccaggcgcggctcaccttcaccaccgacctcggcgagttcgccgaccgcgacctggtgatcgaggccgtggtggagaacgagcaggtcaagaccgagatcttccaggtcctcgaccaggtggtgacccggccggacgcgatcctggcctccaacacctcctcgatcccgctggtgaagctggccgtcgccaccgcgcgccccgaccaggtcatcggcatccacttcttcaacccggccccg

SEQ ID NO: 1458 - DNA, 807 bp, Unknown
  Kingdom: Bacteria, Phylum: Actinobacteria, Class: Actinobacteria, Order: Streptomycetales, Family: Streptomycetaceae, Genus: Streptomyces
gtgcgccgccggtgcggccgtccgtgactgtcggcgggtcgccgagcggtgccttacgggggcggcacccggcctttgcgccgcgcccgccgaacgagcagcgcgcggacgcgaaacaagttaggtgtatgatacatctacatgacttcgtacggacaggagtgtgggcccatggcctgggcggcatcgctggcgcacgccgttcgcaagggtttccggacggagcgcgtcttcgccgatcgctggaccctggcgcgagcagtgctcgcggtggccgccggtgccctcatcgggtgggccacgggaaacgtcctggccaccacgatgatgagcgtcggcaccttcatctgcggtatcggcaccctgctcacgcccatgcggcaccgcttcgtcaacgccctcgccatggcgctggccttcagctgcgcggtcgcgctgggcgtcctcctccaaccgctccactggtacttcctgatcgtcctggcccccgtcgccttcctcggcggactctggtgggcgctgggccgtgcggtcggcatccgtgcctacctggtggtcatcggcctgctgatcacggcggacatctcgccgggcacgaccgcgggcttcggcatgaccaagtggatcgccgcgggctgcgccctgaccgtcctcgcacagctgctgcccccgtacggccgccggtacgccgcccagcggggcaaggtcgcggacgtgtaccggttcctcgcctcgtacgcccgcaaggaagccgaagcggcgggcacggcgcggccggcctcggcctccttctccgcggcgcggtcg

SEQ ID NO: 1459 - DNA, 2714 bp, Unknown
  Kingdom: Bacteria, Phylum: Actinobacteria, Class: Actinobacteria, Order: Streptomycetales, Family: Streptomycetaceae, Genus: Streptomyces
ggcccccggcagcgccttggtgacgttctccgcggggagcgccttgctgacggtgcccagcgcctggccggcgtccgggacggccggcgcggcgttcgcggcacccgcaccggccgcggcgaacgcggcaccgagggcggcgacgccgagggtcttgacggcagactgcttcatgaaaatgcgtccttgactggaagacggggggactgagcggtcctcgaccgtaaacatgccgagtgtcgcaccgcaaacatcaaaatccggacgggtgacaaaaccgtttcaccccgaccgccccgcacttcccggtcgttcagccttgcagagtcgtagaaccgctggtggacgcggtctggcggaacagccattcggatttcagggccgcgtatccgggcttgatcacgtcattgatcatggccagccgttcatcgaaaggaatgaacgctgatttcatcgcattgacggagaaccactgcatgtcgtcgagcgtgtaaccgaatgcgtcgattagatgctcgaattccccgctcatgctggtgtgggacatgagccggttgtccgtgttgaccgtggcgcggaagtgcagccgccgcagcagaccgatcggatgctccgcgtaggaggcggcggcgccggtctggaggttggagctggggcacagttccagcgggatgcgcttgtcgcggacgtaggcggccagccgcccgagttcgaccgtgccgtcctcgcggacgtggatgtcgtcgatgatccgcaccccgtgtccgagccggtcggcgccgcaccactgcagggcctgccagatggacggcagcccgaaggcctcgccggcgtggatggtgaagtggttgttggcccgcttcaggaactcgaaggcgtccaggtgccgggtgggcgggtagccggcctccgcgcccgcgatgtcgaagccgacgacccccgagtcccggtaccgctcggcgagttcggcgatctccagggagcgcgcggcgtgccgcatggcggtgagcagggcgccgacgcggatgcggtggccgtccgcgagagcggccctctccccctcccggaacccctcgttcaccgcctcgacgacctcctccagactcaggccgccctccaggtgctgctcgggggcgtagcgcacctcggcgtagacgacgccgtccgcggcgaggtcctcggcgcactcgcgggcgacccggacgagcgcgtcgcgggtctgcatcacgccgaccgtgtgcgagaaggtctccaggtaccgctccagcgagccggagtccgcggcctcgcggaaccacaggccgagcttctccgggtcggtgtcgggcagttgggagtagccgcaggcgcgggccaggtccacgacggtcgcgggacgcagcccgccgtcgaggtggtcgtgcagcagcaccttgggcgcccggcggatctggtcacggctcgggacgctccccggatggacagggacgttccccggtcgggcaggctggctcgtcatttcggcactctaacgcctacgcgcgtagagagcgccgtacatgccgtacatacagccgtacgtacgtcgggcggacgcgggggcgtacgcgacgggtgcggccgtaggtgtcccgcgcgtgtggccggtacgcgcctgtacacctacgccgatacgtaacggtgaccgcacgggcgggtcgcgtacaccgggccttctgacactgttctgccatggcacagcaagcgacgccggttcgcacggcccggctggcaaggacgctcggcccggagccgacggcggtgagcggagcggtgctgctgctcccggcgggccgggaggtgtccgcacgcaggccctccgcgctggccgccgcctcggtgcgcgccctgggccgccggctggcccgcgcgggccgcgccgagggcctggcgacccacgtggtgcactaccgctaccgcggctggaacggcggcgaggcgcatctcgcgcacgacgccacctgggccgtcgaggagaccgtacggcgctacggagacgtccccgtgtgcctggccggcctcgacatgggcggccgggcggcgctgcacgcgggcgggcacgaggccgtcaactcggtggtggcgatcgccccctggctgcccgaggacgacgtcgccgcctcgcccgaaccggtgaagcagctcgccggccggcaggtgctgatcgtgcacggcacgaacgacgaacgcaccgaccccgagctgtccttccggttcgcggagcgcgcgaagaaggcgaaccgggacgtgtgccggttcgaagtccacgccgacggccacgggttacggcagtaccgcgacgaagtggccgcgctcaccgcgaacttcgtgatgggcgcgctgttcggccgtgtcctggcacggccggtgcaggacgcgctggcggcaccgccgccactggggctgcggatgccgctggcggcggggttcgggaagacgctgcggcggtgaccgtcgcggcgggaaccgcccgccgctgccgcagtggcccgccgccgcagtgatccggccgacggcagtgatccggccgacggcagtgattccgtcgcggcggcctgccaggatctcgctgacctggcctacggcagcagtctgccccgccgcgagagcaggaacttcttgaaggccgccaccggcggtgtgtccgggtggccctccagccaggcgacgccgatctcgcgcaccgcgcgcggtgc

SEQ ID NO: 1460 - DNA, 1511 bp, Unknown
  Kingdom: Bacteria, Phylum: Actinobacteria, Class: Actinobacteria, Order: Streptomycetales, Family: Streptomycetaceae, Genus: Streptomyces
cctccagcgagcggggcgcggtgcgcggcacgccgagtgtctccgcctgccgcaccggcaccgcgcgcagcccggtgagcagccccgccaggtcgtcctcgccgagggcggagacgtcgtgttcgtcggccgtgccgccggggatcctggtgtccagggtgtacgccagtccgggcgcccagtcgccgtgcgcgacgctcgcggggacggccacgggcaggtgcgggcggaccaggtcgcgcaggcgcagttcgcggcgcccgcgcagggaggcgtcgcggtcgggggcgaggcgcagcacatggcgggcgccgacccaccaggtggagtgctcgccgccctcggtgacgggccggacctcgggtccgcccgggtccctcaggccgttgtcgagcagggtgcggaccagccgccggacggtgtccgcggtgggtgtcggtgcctgggtcatcgtcgcgccgtgtcgttcgggtcgggggtgggggctgccggcggtcagtccactatgaccatctcccgggtcgtgtcgttgaggcggcggcccccgtcctcggtgaccgtcacgatgtcctcgatccgcaccccgaagcggccgggcaggtagatgccgggttccacggagaagcacatgccgggcacgaggggctgctcctccccttcgatcatgtacggcggctcgtgcgtggtgacgccgatgccgtggccggtgcggtggatgaagtactcgccgtagcccgcgtcggcgatgaccgcgcgggcggcccggtcgacctcctggcaggcgacgcccggacgtacggcacaaaagccggcctcctgcgcctcgcgcacgatgtcgtgcacccggcgctcctcgtccgtgggttcgccgacgtggaccgtgcgggtggtgtcggagccgtagccgtccttgaggccgccgaagtcgaggacgaccatgtcgccgcgctcgatgacccggtcgcccatctcgtggtgcgggttggcgccgttggggccggagccgacgatggtgaagtccacctgggagtggccgaagcgccgcagcagggcggcgaggtcggcgccgacctcggactcgcggcgcccggcgaagcggaccgtgcggatctcctcgaaggcctggtcggcggcggctccggcggcggcgaggaggccgagttcggcgctgtccttgacggcgcggagcatcggcagggcctcggtgagggaggcgtaggaggtgccgggcagggtctgctggaggcccagcaggtgcatggcccacgcgttgtcgctgatgccgaagcggccgcggtcgtcgaggagggcggcggtgacggcgtaggggtccttgccgtcggtccagtcgcgcagggtcagcgcgggggcgccggtggcccgtgcggcgtccggggcctccagggtcgggacgacgaggacggggtcctgtccgtcggccaggaccagcagcgtgagccgttcggtcgcggcgggcggcgcgtaaccggtgagccacacgaggtcgggtc

SEQ ID NO: 1461 - DNA, 3589 bp, Unknown
  Kingdom: Bacteria, Phylum: Actinobacteria, Class: Actinobacteria, Order: Streptomycetales, Family: Streptomycetaceae, Genus: Streptomyces
cctcctacgacgtgctcagcggcaccggcaccgtcgcgaccgtcagcggcacctcggcgaccgtcaccggcctgacgccggcgacgagttacaccttcaccgtgcgcgccgaggacacccgcggcaacaccgggccggccagtgcgccgctgaccgtcgagacggtggacccgtccaccgacccgacgccgccgaccgcgccgggcaacctgcgctccaccggcaagacgtcctccagcgtcagcctggcctgggagaagtccaccgacaacgtgggcgtggccgcctacgacatctaccgcggcgccacgctggcgaagtcggtcggcgcggacaccacgtcggccacggtggacgggctctcccctgccaccgcctacaccttcaccgtcaaggcccgcgacaccgccgacaacccgtcgcccgcctcgaacgcggtgaccgtcaccaccgacgacgtggccgggcagggcaagcagctcaaggtgggctacttcgtgcagtggggcatctacgggcgccagtacttcgtgaagaacctggacacctcgggcgccgccgcgaagctggacgtcgtcaactacgccttcgagaacctggatgcgaaggacctcacctgcaaggcgggcgtgaccaagggcacttccaccgatccggaggaccccgaccagggcaccgacgcgggcgacgcggacgccgactacgcgcggcccatgtccgccgaccagtccgtcgacggggtcgccgacgacggctggggcaaactgcgcggcaacctcaaccagttgaagaagctcaaggccaagtaccccaagctgaagatcgtcgcgtcgatcggcggctggacgtactcgaagttcttctccgacgccgccgccacgcaggcctcccgggagaagttcgtcaagtcctgcatcgacgtgtggatcaagggcgacctgccggtctacaacggcgcgggcgggccgggcaccgcggccggcatcttcgacggcttcgacatcgactgggagtggccgggctccgagggccacccgggcaaccactacggcgcccaggacaaggacaacctgaccgcgctgctcgccgagttccgggggcagctcgacgcgctcggcggcgagcacaagctgctgaccgcgttcaccccggccgatccggcgaagatctccgccggctgggacctgaagcggatcttcgactccctcgactacgccgacgtgcagggctatgacttccacggctcgggcagcgacaactcctgggaacccgggcgcaccggtgacgcgtcgaacctgtacaccgacgcccaggacccgtacccgttccacttcagcgtcgagaacgcgatccaggcgtatctcaacgcgggggtcaacccgcgcaagctggtggtgggtttcccgttctacgggcgcggctggcagggcgtcagcgacggcggggccgccggcgagtggcaggacgcgaacggcgccgcacccggccagttcgacacggaggccggggtccgcggctacaacaacctgatcaccagctatccgtcgatgacggtccaccacgacgagcagtcggtgtcgacgttcggctacaccggggcgaacggccagtggtggtccttcgaagacgcctggtcgatcgggaagaagacggcctggatcaagtccaaggggctgctgggcggcttcgtctgggagatgtccggcgacacgccgaacggtcagctgatgaccgcgctggacggcggactgaagtagcgcggcgcggcccggcagcttccgggccgcggtggactcccgggcgggcggccggcggaccgcccgcccgggtcaccgtctcggccggccgcctcagcgggcggtgtgggtgtgcacgtactccacgagccgggtcagcgcgtccgggtcggtggacggcatgacaccgtggccgaggttgaagacgtggccctccagaccggcggcggcgtccagcacctcgcgggccttggcctcgacggcctcgcgggaggcgaacagcacggtcgggtcgaggttgccctgcaacgccttgccggggcctacgcggcgcgcggcctcgtccagcgggacccgccagtcgacgccgacgacgtccgcgccggcctcgcccatcaggcccagcagctcaccggtgccgacaccgaagtggatgcggggcacgccgtacccggcgacggcctcgaacaccttcgcggaggccggcagcaccgagcggcggtagtcggcgggggccagggcgccggcccaggagtcgaagagctgcacggcgctcgcgcccgcctcgatctgcaccttcaggaaggcggacgtgatctcggcgaggcggtccagcaggtcggcccacagctccgggtcgccgtacatcatcgccttggcgttctcgtacgtccgcgacgggccgccctccacgaggtagctcgcgagggtgaagggagcgccggcgaagccgatcagcggggtcgcgcccagctcgcgggtgagcaggccgatcgcctcggtgacgtaggagacgtcctcgggggtgaggtcgcgcagccgggccaggtcctcgcgggtgcggaacgggcgctcgaccacggggccgacgccgggcttgatgtccagctcgacgccgatggccttcagcggcacgacgatgtcgctgaagtagatcgccgcgtccacgtcgtgccggcggaccggctggagcgtgatctcggcgaccagctcggggcgcatgcacgactccagcatcggaacgccctcgcgcaccttgcggtactccggcagggagcgcccggcctgccgcatgaaccacacgggggtgtgcggcaccggttcacggcggcacgccttgaggaaggcggagtcgtaggtggccgtcggcggctggtggctggcgggcgtctcgttggcactcacggtggcaagtctcgcacgccgccgggggcgcgcgggccgcggtgtgcggccccctgggccggggagccggcggcgctctggcctgcggcggggtgtcttgccctgcacaaaggcccgcttccccttaatcttcccggcatggctgcggctcagggacgactgtcggacggcgctggcggaatggacgacgcgaagggggcgaaggagggggacgggaatgcgggcagggcggatcaggtgccgttgccgttcagggctgccgtcgacgcgctgagagccgcgcggctgcggccgcaggtggagatcgagcaggtaccgccgccgcagcggctggctccgtacgcgtacgcgctggaggccacggtcgtcgacggtgagcaggacctcgccgacggccgtctggtgctgctgcacgacccggccgggcacgacgcgtggcggggcacgttccggctggtgaccctggtgcgggcggagctggagccggagatggccgccgatccgctgctgccggaggtgtgctggtcctggctgaccggggcgctgcaggcccgcggtctgacgtacggcgagccgagcggcaccgtcacgcgcgccggctcgcactacttcggcgggctctccgcgcgcccgccggcgtcgcagatcgagatcagggcctcctggac

SEQ ID NO: 1462 - DNA, 2151 bp, Unknown
  Kingdom: Bacteria, Phylum: Actinobacteria, Class: Actinobacteria, Order: Streptomycetales, Family: Streptomycetaceae, Genus: Streptomyces
accggacaccgtgcgacgcggccggccggccggactacgcccgccgcatcctctaccccgccctcatccaggcggtcccgcgcccgcgcacccccctctacggcgccttcacgcagaccttcaccaccgaactgggccgcctgttcaccaccgacccgccgagcgacgcggccctggccgacagcctggacaaggcactgcgcaaggtgctgccggaccgttcgtagcggcggtccccggccctgctagcggtcctggacggcggcctgccggacggcgccggggccggggtcggcggtggtcggtgcggggcccgcgttggccgccgcgaccagggcggcgacggcgacgagtgccgcgccgaagcctctgacgtgacgtgcacggatgtgaccagggcgcgcgacagggcgtccgagcacggcgaccgacctcacagcggcagggaacgacagtggggggttaagcatgtttaacgtactccccaacctaggggggtgggagcgctcggccggaagaggggcagggcacgaacacgagctgggaaaggcggagttgggagtgagtggccggccggtgggaagtcggtcgtcagccgctgtgtaagcccgcttactggcatgatgaaccgcatggcgaagcgggacgacccggagaccatcgggcgcagggtgcagcggctgcgacgtgaacgcggtatgacgcagcggcagttggcggagcccgcctacacgcccgcctacgtctccacgctggaggccggccgggtgcgtccctccgacgacgcgctgcgccacctcgccgagcggctcggcgtcgccttcgaggaactggccaccggccgccccgcccacctcgccaccgacctgcgcctgcggctgaccgaggcgcagcggaccctggccaccggggagaccggcaaggccgccgatctgtacgcccggctgctcgccgaggccgaggagcacgaactcaccggcatcgaggccgacgcgctcctcgggctcggcgagtgcgccctggagaccggcgaactggagaccggacgccagtacttcgagcggtccgaacgggtgctggccgacgcgccgctgaccgcccgcgtcccggccctgcgcggccgtgccgtctcccactacctcgccggcgaactgcgctacgccgtctacctcttcgagtccacgctcgacgaactcaaccgcgccgcactgcacgaccccgacgccctgctcctgctctacgcgagcgtcatcggcccgtacatggacatgggcgcgcacgcgcgggcggcgcaggcggccgagttcgccctcgcgctggccccgcgggccggcgatcccgcgctggtggcccgtatgcaccgctcggtggcgcgcaccctgctcgccgagggccggatcgccgaggcggacgcctcgctcgccaaggccgccgagctgtaccggcacctccagctgcgcaccgaactcgccaactgccactggatgcgcggctacgtctgcgcacagaacggcgaactggagcgggccgaggcggagttgcgtgccgcgctcgacatgctgaccgccaagcgggccgggctctacacccggcaggtcgccgtcgagctggccgacgtgctgcaccggcgcggccggtcgcgggaggccgcggacctgctgcgggacgtgctcggcgacctctcctccgaacggggcgccatgcacgccgccgccgcgcaccgcctgctcggcatcatcgccgaggacgcccgcgatccggagaccgccgaggagcactacgtccgcgcgctgagcctgctggagcgggccggcgccgccggtgacctggccgacctgtgccggctcctcggtgacctgctgcgccgcaccggccgcatcgaggcggccctggacgcctaccgcaccggcctcggccaccgtacggcgccgggcacgaccacactgggcccggcaccggcgcagcccctgctgtgacgcggccggcgccggtgctcaggcctgggcgcggcccccgcggcggacggccttcaggcgctccacgccccgctggagtgcctgcgcggtggcgtcggacgggagcgagccggggacaccgtcggtgagggtgaacgcgtcgccgccgacgcgtacggcgacgacgtcgagggtg

SEQ ID NO: 1463 - DNA, 2770 bp, Unknown
  Kingdom: Bacteria, Phylum: Actinobacteria, Class: Actinobacteria, Order: Streptomycetales, Family: Streptomycetaceae, Genus: Streptomyces
gcgggagtgcggggcaggccgggcgcgtggcgaccgtcgccgcggcctgccccgtgcgatgccgcacctccatccctctacatccctctccacccctctccatccctctccgtgacccgcccggcgcgtgccgggcgggcgctcacggctgccctgcggcggctttctgggcctggctcccttgacgcctttcgggcgcccccttacattgcttccagatcgtagaaactactttccgctatacggaagtacggaagaagctcaccgcggggcgcgacggagtgcgaatccggcagccgagacagcagaagacagccgaagcaggagtactcgatggctcgtatgaccgctgcccgcgcggcagttgagatcctcaagcgcgagggcgtcaccgacgcgttcggtgtgccgggcgcggcgatcaaccccttctacgcggcgctcaaggcctccggaggcatcagccacacgctcgcccgtcacgtcgagggcgcctcgcacatggccgagggctacacgcgtacgcacccgggcaacatcggcgtctgcatcggcacctcggggccggccggcaccgacatgatcaccggcctgtactcggccatcggcgactccatcccgatcctgtgcatcacgggccaggctccccgggccgtgatccacaaggaggacttccaggccgtcgacatcgcctcgatcgccaagccggtgaccaagatggccgtcaccgtcctggaggccgcgcaggtccccggcatcttccagcaggccttccacctgatgcgctccggccgtccgggcccggtcctcatcgacctgccgatcgacgtccagatgacggagatcgagttcgacccggagatgtacgagccgctgcccgtctacaagccggtcgcgacccgcgcccagatcgagaaggcggtcgccatgctgaccgcctccgagcgcccgctgatcgtcgccggcggcggtgtcatcaacgccgacgcctccgagctgctcgtcgagttcgccgagctgaccggcaccccggtcgtgcccaccctgatgggctggggcatcgtccccgacgaccacgagctgaacgccggcatggtcggcctgcagacctcgcaccgctacggcaacgcgaccttcctggagtcggacttcgtcctcggcatcggcaaccgctgggccaaccgccacaccggcaagctggagacctacacggcgggccgcacgttcgtccacgtcgacgtcgagcccacccagatcggcaagatcttcgcccccgacttcggcatcgcctccgacgccaaggtcgcgctggagctgttcgtcgcggtcgccaaggagctgaaggcggccggcaagctgcccgaccgctccgcctgggccgcctccgcgcaggagcgcaaggccaagctccagcgccgtacgcacttcgacgacatcccgatcaagccgcagcgcgtctacgaggagatgaacaaggccttcggcccggagacccggtacgtctccaccatcggcctctcccagatcgccggcgcgcagatgctgcacgtctaccggccgcggcactggatcaactgcggccaggccggcccgctcggctggaccatcccggccgcgctcggtgtcgccaaggccgacccggagtccccggtcgtggccctctccggcgactacgacttccagttcatgctggaggagctggccgtcggcgcccagcacaagatcccctacgtccacgtcctggtgaacaactcctacctgggcctgatccgccaggcgcagcggaacttcgacatcgactaccaggtcaagctcgagttcgagaacatcaactcgcccgagctgggcgtctacggcgtcgaccacgtcaaggtcgccgagggcctgggctgcaaggcgatccgggtgaccgacccgaacgagctgggcgccgccttcgaggaggccaagaagctggccgccgagttccaggtcccggtcgtcgtcgaggcgatcctggagcgcgtcaccaacatctcgatggccgcggccgagatcgacaaggtcaacgagttcgaggagctcgccaccgagccggggcacgcgccgacggcgatcaaggcactgaaggcctgacggcctgcccggcggtcgtccgccgggtgcggagcggtacaggggcggcccgcccgagaggggggccgccccttcgcgctgcccgcgcgcacgtgtccgtctcaaggcccccgtggtcagccgcggtgcgatcgggccacggggcccgccgcccccgtgccggcgggccccgggtgaggcggtgtgcccgcccgcgggggtgccccacgcctgcgggggcggggttcagagccggatctgggcatgccgtagcggccctgcgccgcgtgccgtacccggcgtacggaccggagacgggcggcctcaggcctccccgtgctccgacatgccgggccagtcgtccgggccgccgccctgccactcgatgaggtcgctctcctcgacctcgacgcggtccaggtcggccagccggaggatctcgatgacgtcgtccaggtgggaggcgagcccgagggtcacgtcgtcctcggtgacccgccgggaaccgtccagcgcgggggagtgcacgacgatgtgcggatgctgggtgctgtgctccatgcccccagactcctgcggcccgacccgcaccgcaccccggagcgcacggggagcccgcgcagccggacggcaccggccccgtggacgcgcgacgggcagccgcccgccaccggac

SEQ ID NO: 1464 - DNA, 1383 bp, Unknown
  Kingdom: Bacteria, Phylum: Actinobacteria, Class: Actinobacteria, Order: Streptomycetales, Family: Streptomycetaceae, Genus: Streptomyces
cgagcgtgcgaaaatttccttcacgtcctgggtcacgtatgaaagatattttctgtccgggtccgcggtcaagggcgcgcgcatgcgcacccgggcgcgggcgcgcgcaccccggcacgggcgtgcgcacaatggagccatggaatccctcagcccgctggagcaggccctgcacgccgcccgtgccctcgtgctcgccgatctggtcgccggtgaggtcgccgaggcggacgtggtctcgctcgtggaggactccgtcgtccagcgccgctggtgggtggagcaatggccggacggggcgcggtacgtggccggtctggtcgcgcaggacgtccaggacgccctgctggagcggtacggccgctggccgctgtgcccggtgtgcggctacggcgacccgcacgccctcgacgtcgagcccgaactgggccccgatccgcactgggtgtgcgcgcaggcgggcgtgaaggtcgcgccggtgggcgcgctggcgcgggcgatcggcgggaagacgtcgtcgtgagggccgcccgtggcacggtggcgccgtgaccgtctacatcgacccgccgacctggccaggacacggccgcctgtggtcccacctcgtcagcgacgcctcctacgacgaactgcacggtttcgccgccgcgttgggcgtgccggagcgtgccttcgaacgcgaccactacgacctgcccgcccatcgctacccggacgcggtcgcggccggcgcggtcgaggtcagcagccgcgaggtggtgcggctgctgcacgcggcggggctgcgccgccgcaaacgccgtcttcaggggcgcagttcgtaggcgagcaggtctccggcgtcctccacccggacgaaaccggtgcgggtcaccacccgctgggacggcacgttggcccggtccaccttcgcgaacagccgccgtacgtcgtcgcgggccagcgcccacgcggacagcacgcgcagcgcctcggtggcgtagccgtggccgcgggcggatgcgacgaggttgtacccgacctccgcacgcccctccccgtcgggtgcgccgtggaagcccatggctccgaccgcgcccccgtcctcgcgccgtatcagcacgaacatcccgaactcgggccggtgggccccgctctcgtacgccttcacgaccatgccggccgcgtcctgcgtgccctcgtacgggccgctctcgatccacgggaacccgccgtccccgcccgcggccaggtcgcgtgcggcggccggggtgacgccctccaggacgagccgtccggcggggagcacgagcgggttgctccaccgccactcggtgaccggcgcccggccgggcagctcgccgcgcccggtggcccacagcagggtcggccaggcggcgg

SEQ ID NO: 1465 - DNA, 585 bp, Unknown
  Kingdom: Bacteria, Phylum: Actinobacteria, Class: Actinobacteria, Order: Streptomycetales, Family: Streptomycetaceae, Genus: Streptomyces
gagagttccgcgacgccgccgcctccgccgccgtacgcctgcggcaggttgacgccgaggtagccgagcttgccggcctcggaccagagttcggtgggagggcggccttcggcgacggtgcgggtgatgtactcgcggccgtagcgccgacccagtgcggcgactgcggcgcgcaggcccttgtgttcttcggattcgatgacggaggtcatgggtcgtctcccgggtgcgggttgagtgtggttgctcgcgcccacgcggcgcagccgcatgttcgctgcggtctcgcgcccctaggccggttccaccaccgccagcagcacgcccggctcgacctgttgtcccggggctgcgtgcagggctgtgagggtgcctgtgacgggcgcggtgatcttgtgttccatcttcatggcctccagccacagcaggggctggccggcctgtacggcggctccctcggtcagtccgtcggcgagacgtacgacggtgccgggcatgggggcgagcagggacccgggggcgcgctgggcggccgggtcggggaagcggggcagggaggtcagcgcgatgttgccgacgtgcacc

SEQ ID NO: 1466 - DNA, 1344 bp, Unknown
  Kingdom: Bacteria, Phylum: Actinobacteria, Class: Actinobacteria, Order: Streptomycetales, Family: Streptomycetaceae, Genus: Streptomyces
ccggatggggcgtccgggcggcgccgcgggcggacaggaactcctcggcccgcggccatcgcgccggggccggccgcctcatcaggccgcccgcttcgcggactgtgccacctcggcgaccagccgggcggtggccgggacggcgatgccttgggcggctccgacgcgtaggacggctccgccgatggcgtcgagttcgagcggacggccggcctcggcgtcgcgttgcatcgaggacctcatcgtcccggggacacggtcgaagaaggagagcagctcctcagcggtgaccggcgcaccggcggcgcgggccacggccgcgatctcgtcgaggacggtgagcagctcgggccggtgccgatcacggacggcccccacgtcggcctggtagcgggtggtcagcagggcgaacggggcgaggaaggccagcttgtcccagagcatcacgctctcgtcctcgcgtacggtcacgctcagaccggcctgtcgcagcagctccacgaagtcgtccgggggcgcggcgagttggagatcggcgaacgggctggtgtgggcgatgcggccgggtgccgtgcgggtggcctcgatccggatggtgcccgcgacgacccgggcagaggggaagcgctctcggagcacggcgagatggtcaaggccgttgagcaaggggaccacgaccgccgtgccgagcctgtcggccgggatgcggtcgagcgcctcggcgagcgcggtctgcttgaccgtcacgaagacggcgtccaccggctcgcgcaactcggtgtcggactccaccgccgcggtgaactccccgtaacggttgctttcgacgcacagcccgtcctggcgcagcacggcgacggtctgttccctcgccaggcagacgacgcggtgtccggcacgggcgagcagcgcgccgaccacgccgccgacgccgcccgggccgagtaccgccacggtcgtcctggttgtgctcatgtgtgctcctgtccgggaaaccaatgcgtcgagaggccgggcggctggggccgggaagccggtcgggccgtgccgggtcggcacccgcccacctgcaaaaccgcgtccggatctcgggagagacagcgggcaggttgccgccctgggcccggaaccatgctcgaacctggcgcgacccaagtcaatccacggctttgctgtgcaacaccccagctacagcttggtgcatggcccggaagacgcaggcgcgcccgcccgtcacgcccctcctcgcagtacggctcctgcgagccgaaggcccggccggccgggccttcggctcgcaggagccgtactgcgagctggggcgtgacgggcgggcgcgcctgc

SEQ ID NO: 1467 - DNA, 505 bp, Unknown
  Kingdom: Bacteria, Phylum: Actinobacteria, Class: Actinobacteria, Order: Streptomycetales, Family: Streptomycetaceae, Genus: Streptomyces
gtgggagtaccgtcggccgggtggtcggggtaccgtcggagggctgtgcgtgcggggtgcgtattcgatcggcgctgctttgaattccgtcctgcttacggctgctgttatttccctcacgacgcggacagaccggaattcaagggctggttgcctagaatttggcccggacacgacacgaggggagcggtgaccgtgctacgggacttcaagggccctgcgggctgccgctccgagctggtcatcggccggcaggagccgtccgcggcggcgcgcgagcagctcggccgcggcggcagtgtgctgctgcacgggccggccggaataggaaagtcgaccgtgctgcgggcatgggcggcggaatacgccccggcggcccgcacggtgttgcgctgctccgccaccgagtccgaatcgcacctgccgttcctggccctcgccgacctcttcggtctggtcctcccggaggtggccggcgagttgcccgccgcccagcgcaccgccc

SEQ ID NO: 1468 - DNA, 5981 bp, Unknown
  Kingdom: Bacteria, Phylum: Actinobacteria, Class: Actinobacteria, Order: Streptomycetales, Family: Streptomycetaceae, Genus: Streptomyces
ccctcgttgaagatcaggtagatgacgtcgagcaccgagccgagccgggcctcgcggtcgggtccgtacggcacctcgaaggcgacgttccgcgtggccagggtgcgtttggcgcgcacgatccgctgggccacggtcggctcggggacgaggaaggcgcgagcgatctccgccgtggtcagaccgcccaggagccgcagcgtcagggcggtgcgggcctcggcggacagcaccgggtggcaggtggtgaagaccaggcggagcaggtcgtcgtcgatgtcgtcgggggcggcgatctcctcgggggcgaccgccgtctccagggagcggccgatctccgcgagtttgcgggcgtagttctcgcggcgccgcaccaggtcgacggcgcggcgccgggccgtggtcatgagccagccgccggggttgtccggcaccccgtccctgggccactgctccagggccgcgaccagggcgtcctgggtgagttcctcggcgatcccgacgtcccgcacgatccgggcgacggcggcgacgacgcggggcgactccagccggaagacggtctccagggcaccggagggctgggcgggctcggggggctgttctgtcacagcccccatcgaacacggccggcggcgggcgggccaccggtcacgggcgcccgccctttcggtggcgtgctcagccctcggcgatctgccgcacctcgcagctcatcgtccagtggtcctcgtggaccttgacgaagcggtgggcccactccagggcctcgtccatgtccttgcactgcatcagggcgtagccgccgacgacctccttggactccgtgaacggcccgtcggtgacggtggccctgccgccctcccagtgcacccgcttgccctggctcgacggcatcagcccggcggtgtccagcatgacgccggccttggtgatctcctcgatcagctcacccatccgccgcatcagctccgggctggggccctcggcgggggcggtgctctcgtcgatgcgcacgatcgacaggaaacgcggcatggtgactcctcgggtccggtggtgccggcggggcgtttccccgcctctcaccccgtacgtcgaacggggtgagccgggatcgacacgctgccgcacatttcccgaagttttctgggcgcggttttctgcccgcgttcccggcttcgaaagtttcgaaggccggggttggccagggtcggtcagggtcgggggttcggcggccggagaggggggccgggggcccggtgggaccggtgccgggggcccggtggcccagacccggggtcaggccgccggctccgccgtgctgctgcgcaccaccaggctcgtcgccagctccacccgggtggccgcctgcgactcctcctcccgtccgaggtccagcaccagccgcgccgccgcctccgccatctccgtcagcggctggcgtacggtcgtcagcggcggccccacccagcgggccaccggcaggtcgtcgaagccgaccacgctcaggtcctccgggatgcgcagccccagctcgcgcgccgcctcgtacagaccgagcgcctggaggtcgttgcccgcgaagacggcactcggccggtccgggcggcgcagcagcttcagtccgaggcggtagccggcctcgtggtggaagtcgccggtgacgatcagcgacgggtcgaccggcagccccgccgtctccagcgcggcccggtaaccgtcgacccgggcgcggctgcacatcatccgtgacggcccgctgatggcgccgatgcgggtgtggcccagttcgacgaggtgccgggtggcggcgaggccgccctgccagttggtcgcgccgatcgagggcacgtcggtgcccgggtcgccggccgggtccatcaccacgaacgggatcgaacggctggtcagcagcgcccgctgggactcgtcgagcccggacaggacgagcaccacgccgtgcgggcggcgggcggcgacctggtccgcccaggtccgcccgggggtgagccggcccgcgctctcggagagcacgacgctcaggcccgcgccccgcgccacgttctccacgccccggatgacctccatcgcccaggcgctctccagttcgtggaagaccacgtcgatcagcggcgagcgggtggcctcggcgcgcctgcgccggtagccgtgggcgcgcagcaggtcctcgacgcggctgcgggtcgccggggcgacgtccgcgcgcccgttgaggaccttcgaaacagtcggagccgacaccccggcctcgcgggcgatctcggcgagggtggcagtgcgggtttcatggggcttggtcgacttcatgggcgggatcgtatctctgcgcgacctcttgacgaaccccccggcacgccttacgttcccggaaaattcggaatcacttccgaaacattcgagttcggctgtccggcgtcacgggtgccgtcggcaccgcgtccggcccgagcgatccttcgtgagaggtgccgtcacatggagtcctacagcaggcgctggttcctcggcgccggcgccaccaccctggtctcggccgccgggctcacggcctgcggttccggcggcggctccggcgggtcgggcggcaccgtcacggcgatggtgtacggcgacgacgcggtgaagatccagaccgcgcaggtcaagcggttcaacgccgccgcggccgccaggaagaccacgggcgagatcaggctccagaagatccccgcctccgactacccggccaagctgcgcacggcgatgggttcgcccaacgcccccggcatcttcttcaactggggcggtggctcgatcaaggactaccaggaggccggccagctgatcgacctcaccgacaccatcacgtccgacgccgtcctcaaggacggcttcctgcagaccgttctcgacgcgggcgccctgaagggcaggatgtacggcatcccgatgcgcggcacccagccggtggtcctcttctacaacaagacgctgttcgcccagcacaagctgcaggcgcccaccacctgggaccagttgctcgacgtcaacgccaagctgaagaaggccggcgtcacccccttcgcgctcgggggtgccgacatctggccggagctgatgtggctggagtacctggtcgaccgcatcggcggcccggaggtcttcgccaggatcaaggacggcgacgcctccggctggggcgacccggccgtcctcaaggccgcccggacggtcaaggagctcatcgacgacggcgccttcggcaagggctacagctcggtgtcgtacaacaaccacggggcgtccgcggccttcgccaagggcaaggcggccatgcacctgatgggctcctgggagttctccacgctgctcggcatcttcccggacttcgccaggaaggacgtgggctggtgcgccttcccggagttcgacggcggctcgggcgacatccgcaacgtcgtcggcaaccccaacaactactggtccgtgaacgcccgtgtctccgacaaggacgcggccgtcgccttcctgcgcgactgcgcgtccgaggcgtacaccaaggccctgatcgccaacggtgacgtcccgaccaccaccatcgcggccaggatgctggacgcctcccccaacccggagttcgccaagtaccagtaccagatggtgcagcaggccccggcgttcacgctgagctgggaccaggcggtcgacccgggccggcagcagccgatgctgacggagatcaacaagctgttcgtgggcaagtcctcgccggagcagttcgtgtccgcgctcaaggggctgaagtgagctcgtcgatcaccaccggggtgaaaggcaggcccccgggcggcgtgcgggcgggccgtccgcacgccgcctgggtcctgcccggcgtcctgttcttcacgttcttcgccgtcgcccccatggcactggccttctacctgtccttcacccagtggaacggcctgggcgacccccggccggtgggcctggccaactggcaaaaactggtccacgacccgcggctgacccagtccctgacggtgaccgtcctgctgaccgtggtcagctgggccttccagacggtggtgtcgctgctgctcggggtctgggcggccggccgccggcgcaaccgggcgatcctgtccgcggtcttcttcgtgccgttcctgctgtcctccacggcgatctcgctgctgttctacgccctgctcgacccgaacttcggcatcatccacggggacacgctcggcaccacctccggcgccttcctggcgatcgtcttcgtcggcggctggcagttcatccccttccacaccctgatctaccagggcggcgcccggcagatccccgacgtgctgtaccaggcggccgcgatcgacggcgccgggcgctaccgccagttcttctccatcaccctgccccagctgcgcaccacggccaccacgtccggcgtgctgatgaccgtcggctcgctgacgtacttcgagacggtgctgatcctcacccagggcggcccgggcaccgacaccgcgatcctgccgtacctgatgtacgaggcgggcttcaagaactacgacttcggctacgcgagcgccgtcgcgtccttcctcgtcgtggccgccaccgcactgtcgctcgcgctggtcaggctgtccggtttcgggaccatgcgcagcaccagggaaggaatgtgacgcagtgtcacacgatacgttgcgacgtccgcgtcccgtgaagaccgccggacgaccgagcctccgcgactccggccgccgccgtcaccggacccggcgccccaacccgctggccgggatcgggtcggtggtgtggctggccgtggtcatcgtcccgatctacgcgatgatctcgtcgtcgctgacccgccaggacaaggcgctcggcaagaacgccctcgtgccgcccagcgaccccaccctcggcaactacgacaccgtcctgcacaacggcttcggccatctgctgctcaacacggtgatcgtggcggcggcggtcgtcgtgatcgtcctggcgctgtgcgtcccgctgtcctacgtggccgtgcgctcgcgcaccttctggtcgggcgccgccttccggctgttcctgctgggcgtggccatccccgcacaggcggtcgtggtcccgctctacctgatgatcgccgaactgaacctctacgacagcctgctcgcgatcatcctgcccaccgccgccttcgccatgccggtgtcggtactgatcctcaccggcaccatgcgggacatctccgaggagatgtacgaggcgatggccctggacggcgcctcgaccacccgcatgctcctccagctggtcgtcccgctgaccaagggcggaatcagcaccgtcgtcatctacgccgccctgcaggcctggaacggcttcctcttcccgctgatcttcacccagtccgacggcccccgcgtgctgacactcggcctgttcgattacgtcagccagttcggggtgaacatccccgccctgctcgcctccgtcgtcctgtccggcatcccggtcttcgccgtgtacctggtggcccgccgggccctcgtcagcggcctgatgggggtgggcggcaagtgacctcaccctccaccgacgcctccgacaggagttccatgaccccccgttcctggcaggacccggccctgtccgccgccgcccgcgtcgacgacctcctgtcccggatgaccctggaggagaagacggcccagctgtacggggtgtgggtgggcgccaccacggacggcgacggcgtcgccccgctccagcagcacatgaacaccgaccacgactgggacgagctgatcacccaggggctgggccagctcacccgctccttcggcaccgcccccgtggagcccggggccggtgcgcgcgccctgacccgcgcccagcgccgcatcgccgaggcgggcaggttcggcatcccggccatcgcccacgaggagtgc

SEQ ID NO: 1469 - DNA, 2229 bp, Unknown
  Kingdom: Bacteria, Phylum: Actinobacteria, Class: Actinobacteria, Order: Streptomycetales, Family: Streptomycetaceae, Genus: Streptomyces
ggctgcggcaccggacgcacccggcgtggtgcggccccgccgaggacggcacggcaccgggggcagagcaccgtgcgcggcctgccgcagcctccgcactcggccggcaggaccaggtcggtgaagtcctgccaccacccgcgcatgactccactgtgccgagaccccgccacctcggccacccctgtggacaaccggccgcgcccccccctgtggacaactcggcccacaccgatcagagcttcacccacacgagcgaacacgagtgaaggagagcgcgggcggagaagacggagaagcgcgggtggagaagacggagacgaaggcggaacccccggaagccgtactcacccgggatagacgggcgccatcccttccttgaccaccttctgccactgcgccacggacgacatccgcacgagcccgtccgccgccgagtacgccaccagcggcagccgctcgtcctcggacgcggcgaccgacttcacctcggtgagcgcggcgggcgccggaatgtccggcgtggaaccgtcgacctggacgtaccgcatcgtctgcacgcccccctgctcgcgcccggccaccaccagccggctgtcacccgcccacgacatggcgctgacgtcctccatgtcgggcgctgccgaacgcagtccgagcaccgacaccacgggccgctcaccgctcctgccgtcccgctcgatccgcccgacgagcagggactcggtgcggtccttgtgctgcacgagcagcgcgacacgcacgccgtcggcggccacccgcaccgcctcgacacgcccgtccagacccggcaccgccacctcgatcggctctcccgctccgtgttccagcaccatcagccgcggccgggccggatcccggtcggccacccacaggtcgccccgcgcgtcccaactcggcgccgtcagccggtcgtcctcggtcttgccgccgctgtgcagcaccgcgttcccgagcgccccgccctgcgcgagcgacccgacgtacaggtccctgcggtcgttgctcactcccgcggcggtgcgctcgtcccacgacaccgcggccgagctgagcctctgcacgccctcgcccagcccgcccggcaccggttccacactcgtcccggcactgccgcccaggatccgcaccagcctgcgcttgtcgtcgaggaagtacaggtactccgggcgcttgaccggcccgcgtgtggcgacggtccgggcccggtccgcgccgagcgtgcacagcgtgctcccgtcggcccgctgcaacgccaccgtctccacggtcggcgtcaggttctgcaccgtgaacagcacctgggcggccatctcctggcagcgctcgccgccgaccgcggacgccttgccgttcagcggcaccgtcagtctgttctggtcgtcgggcgccagcgcggtgacgtcccggcgcagcgccgacccggtcgggaagctcgacctgaccacccggtccagccagtgcgtcggcccgctgatgaccgagcggaccacccgggtcatggcgtccacccgctggcgtacgtagaccggatcggcgaccgccgtcgccgggccgcccgccccgcccggcgtgttcgaagcgaagtagtacttgttgacgggcaggtagttgcgctggaagtccgaccggcccatgaggacgcccggcggcggcgtgtcgatgcgccactgaccggacttcttgtcccgcgccaggtgcaccgactggctgtagcggccgtcgagcggcatgtacgactgctgcgagtccacccgggccaccttgctgccggtcagcgtgaacgcgtagtcgccactgtcctcgtgcgccgtggcacggtccacctcgatgtcccacccgtcggcgagcacggtcgtggacgactccggcttccagtgccgggaggccgccgccgtcagatactggcgggccgtcgcgtactgcgggtcgtcgctggtcagcgcctccaggaagccctgcacgatctccgccggcggggcgttctcccggggcggcatggcgaacacccgtacctcggtgtcctggcgcggagtggactccacgtcccgcaggtccccgctgtcgggcatcgaggcgcatcccgccagcagcagcatcccccaggcggcgcacaccaccgcgcgcatcggccgacgccgcgcgcccccctcgcggtcagcgcccacgaaatgcctccccttgctccttcatgccccgtgccccggc

SEQ ID NO: 1470 - DNA, 3826 bp, Unknown
  Kingdom: Bacteria, Phylum: Actinobacteria, Class: Actinobacteria, Order: Streptomycetales, Family: Streptomycetaceae, Genus: Streptomyces
  misc_feature (3444)..(3556): n is a, c, g, or t
cctcgcggccgcgaggacaacaccccgcctaccagctggtcttgcggtacaactcccacatggtcatgatcgtcgacgggtcgagcgcgcgctcgccgccggagatgtcgtcgctcgcggccacgtactgcttgccctgccacagcggcagcagccgggcgtcgtccaccaggacctgctgcgcctgctccagttgtttcaccaccgccgcccggtcgctctcgcgccgggactcgggcagcagcaccttggtgatgcggggtgccgggtagggcgtaccgagcgcgttctgctgtccgacgaagggggcgatgaagttgtcggcgtcggggaagtccggggaccaaccgcgcccgaacaccgggtactcgcccttctggtagcccacgacgtacgtcttccagggccggctcctgagcgtgaccgtgaacaggccggagccgtccagctgccgcttcagctcctggaactccagggccgtctcggagccgtagcggtcgctggtgtaccagagggtcagcgggaccttccgggtgatgccggccgcggagaggagggcgcgggccttggtgacgctggggtcgccgaagtcgtcgaagaagcccgtggtgtggccggtgaggcccttggggaccatggagtacaaggggtccacggtgtccttgtagaccgtgtgcgcgatcgccggccggtcgacgatctgggcgacggctctgcggacggccgctttggcggcccacgggtccttgggattgaacaccaggtagctgatgtcggcgcccgcgccctcgacgagctggaggtccttggtgccgctgcgctgcaggtcgatgatgtcgtcggcggcgagcccccggtaggtgacgtcgatccgtccgtcccgcagcgccttgaccatggcggcggagtcctggaagtagcggatggtcaccgcatcgtttctgcgctcggcgtacccctggtagttgctgttcttcaccagttccgcctgccggccgtcgtcgtacgacttcagggcgtacggtccggagccgaagaccttgccgtccctgcgcagggagtgggccgcgtagtcgtcggggtcgacgatcgacagggcgggggtggcgagcacgaacgggaaggtggcgtcgggcttgttgagccggaagacgatctgcttgtcaccgatcgtctgcacctggtccaggctgccgagcaggcccgccggaccgccgggcacgttgatggccctgatgcggtcgatggagtacttgaccgcgtgcgcgtcgaggatgtcgccgtcggcgaacttcatgcccgagcgcagctcgcagcggtaggtgcggttgccggcgtcggtgaacgcgcaggaccgcgcggcgtcgggctggggcgtggtggcgccgttcggataggccagcagcgtctggtagatgttgcggaacagctcccaggaaccgtcccaggccgcggccgggtccagtgtgctgggtgcactggtggtcccgaccacgatgggcttctcgctgtccgggttgccgccggaaaggacgccgcatccggccaccagggacagggaggcgatcgccaccgcaggccgcaggcatcggctccgtctgaacacgcgcacgctcctcgatcagccgtaccaaggtcggcagaccctaccgcagcgtcacgcgctgtgaacccccttcgcacatgcctgttgatcagggcttttatgactacgttgtcatcacggcgaccaggtccgggccgcctgcgcaggggcgccgatccggtcagaaggccgccggaggatttccgcccggcccggagaacgccgaggggccgccctgttcaggacggcccggcagcaggaacggaacggccccgccggcccggcgggccaccggcggaccgctgaagcggctcatcgacctgccggtggagacggagtcatgtgcgcgccggtcagcccacgccggcgttgaggaagatgccgccgtcgacgacgagcgtctgcccggtgatccactcggactgcgcggaggtgaggaacgccgccgcgccgccgatgtcggagggaacgccgaggcggccgagcgggtaggccgcggcggcctcctcctcgcggccctcgtacagggcctgggcgaacttcgtcttgaccacggccggggcgatggcgttgacccgcaccttcggcgcgaactcgtgcgcgagctgctgggtcaggttgatcatcgcggccttgctgatgccgtaggcgccgatgaacggcgagggggcgaggccggcgacggaggagatgttcacgatggcgccgccgtggtccttctgccaggcgtgccaggtgcgctgcgcgaagccgagcgcggagacgacgttggtctcgaagaccttgcgcgccacgttcaggtcgaggtcggcgatcgggccgaacaccgggttggtaccggcgttgttgatcaggtggtcgacgcggccgaacgcctccatgacgcggtcgacggcctccgcctggtgggcctcgtcgtgggccttgcccgcgacgccgatggcccggtcggcgccgagccgctcgacggcctccttcagggcgtcctcgttgcggccggtgatgcacacccggtcgccgcgggccaccagcgcctcggcgatgccgtagccgatgccgcggctggcgccggtgatgagggcgaccttgcccgacagctcggggggttccacggaagtcatgtgcgcgtttcccttagttgagcggtccgccggcgacgtagagcacctggccggagacgaagccggcggcgtcacccgtgaagaaggcgatcgcgttggcgatgtcctccggctcgccgacgcgctgcaccgggatctgggtcgcggcggcggccttgaagtcctcgaagcccatgccgacgcgctcggcggtcgccttggtcatctcggtggcgatgaagcccggggcgacggagttggcggtgatgccgaacttgcccagttccttggccagcgtcttggtgaagccctgcagacccgccttggccgccgagtagttgacctggccgcggttgccgagcgcggaggacgaggagaggttgacgatccggccgaagcccgcgtccaccatgtgcttctggaccgcgcgggtcatcaggaacgagccgcgcaggtgcacgttcatgacggtgtcccagtcggagacgctcatcttgaacagcaggttgtcacggagcacgcccgcgttgttgacgaggatcgtgggcgcgccgagctcctcggtgatgcgcgcgatcgccgcctccacctgggcctcgtcggagacgtcggcgccgatcgcgagggcccgcccgccggccgcggtgatcttctccacggtgtccttgcaggcggcctcgtcgaggtcgatcacggcgacggcgcggccctcggcggccagtcgtacggcagtggcggcaccgatgccgcgcgcggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacaccgggtgcgtgtgatccattacctcaccagaaggtccagcaaccgctccgtctccgcggccgggtccagggtgagcccggtgtggaccgggccgggctggacgatcgtggagcggggcgcgaccagccagcggaaccgccgcccggcgtcgtcgcccgccgcctgcccggcggcgctcccgcccgcgcacacgctctccacggcggcgagggcggcccgcacgccggccacgtcggcccgcgggtcgagcgccagcagccgggcc

SEQ ID NO: 1471 - DNA, 2419 bp, Unknown
  Kingdom: Bacteria, Phylum: Actinobacteria, Class: Actinobacteria, Order: Streptomycetales, Family: Streptomycetaceae, Genus: Streptomyces
ctcgcgccgccgcgcggcggcctcgtcgtcctcctgtgcccgcacgatgccggtgcccacccgcgccctcgcttccccgtcccggtcgccgcacgggccctgcgagcggatgccgccgggctcagacccagactccccgctcctccaggaccttgcgcagcgtgtcgatgtgatcggtcatgatgccatcgacgccgaggtccaggagccggtgcatctcctgcggttcgttgatggtccacacgtgcacctgcagggcccgcgcatgggccgcgcggaggaacagccggtcgaccaccggcacgcccgactgcgccaccggcacctgcacggcgacggccgaccggcgcagcacggccggcacgccccaggagcgcagccgcagacccagcaccccgcgcgtgccgtacgacgtcgccaggcgcggccccgccagctgctgcgcccgggcgacccgtgcctcggagaacgacccgacgcacacccgcccccaggcgtccgcccggtcgagcacgtccagcaggggccgcagcgcgggctccgccttgacgtcgacgttccaccggacctcgggaaacgccgtcagcagctcctcgaagagcggcaccggctcactgcccgccacgcgcgcgcggcgcacctcgtcccacggcaggtcggcgatccgtcccgcgccgtcggtcacgcggtcgagcgtcgcgtcgtggaaggcgaccagatgcccgtcggccgtggcgtgcacatcggtctcgatgtaccggtaaccgagttcgaccgcccggcggaactgggccgccgtgttctccagcccgtcggccgccccgccgcggtgcgcgaaggcgaggggcccgggatggtcgaggtacgggtggcgtgcgagcgtggtcacggacgcagtatcgctcttgcgggtgtaccgcccgcaacggccggaccgccgcccggggccgcgggcacggcgaacagccgcaggaagagctgggccagcgggccgatcgagacggcgtacagcagggtgccgacaccgatcgtgccgcccaggaggaagccggtgaccacgaccgccacctcgatcgccgtgcgcatcatgcggatcgaacggcccgtgcgccggtggagccccgtcatcaggccgtcccgcgggccgggaccgaagcgggcggagatgtagagaccggtggccacgccgttgagcaggatgcccgccagcagcacggggatccgtacggccagagcacgcgcgtcgggcaccagggccagggtgccgtccatggccagcccgaccacgaagacgttggagaccgtgccgagtccgggccgctggcgcagcgggatccacaggagcagcaccaccgcccccacgatgatcgacacgacgccgatggtgagaccggacagttcggccaggccctggtgcaggacgccccagggttccagtccgagtccggcctcgacgaggagcgcggagctggcgccgtacagcacgagaccggcgtagagctggacgagtcgccgcccgaggcggtccggtatggacaaggcgtccccctggtggtggccccgtcgggggccggtggtgaaagtggcctgacccgtgccactctgtggcgtggggaagcgccccatccatggccaattcggggaaggtggactggtaatcatggcgcagtggacctcggcggtgggcgccgcacagctcgcccggctgctcacctcccagcaggagcgcccggcgggccccggcacgcgccgcccgcccgcctaccgcgcgctcgccgacggcatccggctgctggtcctggaaggccgggttccggtcgccgcccggctgccggccgagcgcgaactcgccctggccctgtccgtcagccggaccacggtcgccgccgcctacgaggcgctgcgcaccgagggctgcctggagtcccggcgcggcgcgggcagctggaccgccgtcccggccggcaacccgctgcccgcgcgggggctcgaacccctgccgccggaggccctgggctcgatgatcgacctgggcaccgctgccctgccggcccccgaaccgtggctcacccgcgcggtccagggcgccctggaagaactgccgccctacgcccacacgcacggcgactacccggcaggcctgcccgcgctgcgctcgatgatcgccgaccggtacaccgccaggggcatccccaccatgccggagcagatcatggtgaccacgggcgccatgggcgccatcgacgccatctgtcacctcttcggcggccggggcgagcgcatcgccgtggagtcgccgtcctacgccaacatcctgcagctcatgcgggaggcgggcgcccggctcgtgcccgtggcgatggccgaggggctcacggggtgggacgtggaccgctggcgccaggtcctgcgggaggcc

SEQ ID NO: 1472 - DNA, 769 bp, Unknown
  Kingdom: Bacteria, Phylum: Actinobacteria, Class: Actinobacteria, Order: Streptomycetales, Family: Streptomycetaceae, Genus: Streptomyces
ccgccggcccgccccggccggtgggcggaccggacccccaccggcggcgccccgcccgttcttccgccgccgcccacgggcgcagaagcccccggagcaggaggaagaccgctctgtacggtctttccgatgtgccgttaaggtgcgggcatgagcgatcaggcccccaccttggaggacgtcgcccgggaagcaggggtgtcccgggcgaccgtctcccgggtcgtcaacggcgtccgcaacgtggaccccgcgatccaggagctggtgaaccgggccatcgagcggaccggttacacccccaaccgggccgcccgagcactggtgacccggcgtgcggagaccatcgcgctcgtcgtctccggagcgggtgaccccccgcaggacagccaggacgccttcgccgcccgggtcttcgcggaccccttcttcggaagggtggtcgcaggtgtcgtcggcttcctgcgcccgcgctccatgcatccggtgctgatgttcgccgagtccgccgaggaccggcacgaggtgctcacctatctgcgtcagggccgcgccgacggcgcgctcgtcgtctccacccacgccgacgacccgctgcccgcgcaactggccggggccaggctgcccaccgtgttgttctcccgcccgacaccctccgtcccgctgagctacgtggacctggaccaccgccgcggcggccggctcgcggcggagcacctcctggcccgcggctgccgcagaccggccaccgtggccgggccgctcgccg

SEQ ID NO: 1473 - DNA, 1606 bp, Unknown
  Kingdom: Bacteria, Phylum: Actinobacteria, Class: Actinobacteria, Order: Streptomycetales, Family: Streptomycetaceae, Genus: Streptomyces
gtcaccatcagcggacccggcgacgccggcgtcttctacggcacccggaccctgaaacaggaagtgcgcgcgggcggcacggctcccgagggcgtcgtcgacgacgcacccgccaagccgcggcgcggcttcatgctggacatcgcccgcaaaccgttcaccgcggactggatcgaggaccgcatacgggaactgggcgacctcaagtacaacgagctgggcctgcacttctccgacgaccagtccttccgcctccagtccgacacgcacccggagatcgtctccgaggaccacctcaccaaggcgcaggtcaagcagatcgtcgacctcgccgccggccggcacatcaccgtcgtgcccgagatcgactcgcccggccacctgggcgcggtgatcgccgcccaccccgatctgcagctgcgcaacgcgcagggcgtggccaccaagggcgccatcgacatctccaaggcgggctcggcgcggatcgtcgacgacctcctgaacgagttcgccggcgtcttccccggcggctactggcacctcggcggcgacgagtaccaggcgctgaccgtccgcagccccgcgacgtcctacccgcagctggccgcagccgcgcgcaaggcctacggctccggcggcaccgtcgccgacctgacgaccggctggctgaacggccgcgccgccaccgtccgcgcccacggccgcgccccgcgcgcctggaacgacggcttcttccgcaccacctccgtgcggccggaccaggacatcgaggtcgcctactggaccggcaaggaactgggcgcccgcccgcccgccgagtacctcgccgccggccgcaaggtgatcaactacaacgacgagtacctctactacgtcctcggccagccgcagaccttcgtctacccgaccgggcagcggatctacgaacagtggaccccgcgcgtgctgcgcggcaccgacgccgtgcccgcccgctacgactcccagatcctcggcggcagcttcgccgtctggtgcgacctggcgcactcccagacccaggagcaggtggccgccgggatccgcatgccgctgcgggcgaccgcgcagaagctgtgggacccggggaagccggcactgtcctggacggacttcaaggccctggcgggacggctgggctgaggccggtccggtccgcgccggggatctccacgaagtgcggcggttggccggaatcttttcttctgcgctcactctcgactgcgtgtgacgaccgtgtgacactacggggcggccgcacgcagtaccggacagtgcggcctttgctgaggtcggcgccctgccgaggaggcgtggatgagcctggtggaactgatcgcgcgggccgacgagcgcggcctcgccgccagcgggctggcttgtttggaccggtgccttccgctgctcggcggagacgacgacgtgctgcgcccgctgtggggcgcgctcacggacgagggcggcgactgggcggagcggctggagcgcgccgcgcggcgcgctcggcgccacgggcgtcggcggccccgacgggagcgaggcggcgctgctggcccgccggatgctcgacgccgcaccggccgcccgg

SEQ ID NO: 1474 - DNA, 2005 bp, Unknown
  Kingdom: Bacteria, Phylum: Actinobacteria, Class: Actinobacteria, Order: Streptomycetales, Family: Streptomycetaceae, Genus: Streptomyces
gggtccggcgggcccgtcgcacggccgcgtcgagcgcgtcgccgtccagcgaggagccggcgtgggcgtcgccggcgccgtccgcctgcgcggtggcgagcgtcagcgcgtcgtggaccgacggggcgccgatcatgtccacggccaggaaaccggtgccgaccgcgtcgtcgagcgacaggtcaccgccctcccgccagcgggcggccgcctccgggcgtgcctcggccggcgtcagcaccttcaccgagcggtgcgggccgggcaccgtgtcggcggcgtcgacggtggtggcgtcctgggtgccgtcgtgcggtgtgagcaggctgaccggcaggagttcgcggagcactcccacgtcgctcgtcagcgggctctccagcagcggttcaccgctcccgtcgacgacctcgacggtcagctcgtagcgggtgacgagttccgcgtgcgactgggtggtggcgatgttggggttgaccgccctgccgctgacgcgccccttgctgctctgcgacgttccgcccgcgccgccccggacggtggggccggcgccgagcagcccggtgccgcggtccaccgcggggctctcggagaccgccagtgccgcgtccccgccgctgtcccgggagctgctgctctcacggtcggtgccggtcggccggtagtcctcgacctcgtagccgttgcgcagccggtccaccgtggtggtgacggggcgcagccgcaaccgcacctgggcggggctgcctccggtcggcaggtcgaagggacggctccacacctggtaccggaccggcacggccacgccgtccgtggtgaggtcgagcagctggccgcgcaggaagtcaggggacagcagcctgagcacgtcctcccggtcgtgcgagggcacccccagccgtcgcaggtgcggcatcagtttcccggcgagcgcggcggcgtcgagctgaccggtcgggtggccggtgaaccggcgccgctgcaggaacggcggcacccggtagccgccggccaggtggtgcggggtggtggtgcccagcccgtccggggcgaggccggtctcgatggcgtcctgcatcggtacgtgcaggatcaccgcatcgggtacctcgtgggtgcgggaggcgtccgggcgggggctgggagccaggtgcgtcgccgcccacgtcgagacctgcccgctccaccggcgcaccgtggacgccgcacgggtgccggccaggcccacggcggcgctccaccggtcccgtacggccacggtctcggtgaggtcgcccaccaccgggtacgtgcgtccgctgtagctgaggatggtgttgcggccgttgctgaccgtcacggaggaggactctccccgggtacgcgccaggtgcccgcccgccgcgtagccgccgtgcaccggatggtgcccgtcgacctgctggagggacagcgagttctgcagcccgaaggtgtccgtggtggaactgccgccgctgcccacggtgttgcgggcggcaccggtggtcacctcgaagctcgcgctgttgggatcgccggccgtgcgcagcccgtgcaaccggccgtgcaacgcggccttgatgtgatgggtgcggaaggaccccttggcctccaggccggtggtccgcaggccgaacgggctcaggatctggccgaggtggcccgccacggtgaggttctccgtcgcccggcgcagggcgttgcgcaccggggtgccgggggcgctgacgtgccaggactcaccggtcgcctgcccggcggtctccatcatggcctgttgccgctgcttggcgccctccgcgctgagcacggcgaaggggcggctgagcaggtcgcggacgagggactgctccgggtcggacggcgccgggggcgaccaggtgccgtcgaggaactcgtgcacctggtcgtcgggcaccggcgtgtgcgcggcgccggtggagggtggggtcccgtcatggtccgtgggcgacgcgggctccgggtcctggactgccggcgtccg

SEQ ID NO: 1475 - DNA, 1466 bp, Unknown
  Kingdom: Bacteria, Phylum: Actinobacteria, Class: Actinobacteria, Order: Streptomycetales, Family: Streptomycetaceae, Genus: Streptomyces
cgaggccaacgcgaaggacgtcgccaaggcccgcgcggccggcaccgccgaggccatcgtcgaccgcctcacgctcacccccgagcgggtgcgcgccatcgcggccgacgtgcgcgacgtggtggcgctgcccgacccggtcggcgaggtcgtccgcggctccaccctccccaacggcctggacctgcgccaggtccgcgtcccgctcggcgtggtcggcatcatctacgaggcccgccccaacgtcaccgtcgacgccgccgccctgtgcctgaagtccggcaacgcggtgctgctgcgcggctccgcctccgcctacgagtcgaacaccgccctggtccgggtcatccgcgacgcggtcggcggcgccgggctgcccgccgacgccgtccagctcgtacccggcgagagccgcgagagcgtgcgcgagctgatgcgcgcccgcggcctggtcgacgtactgatcccgcgcggcggcgcctccctcatccgcaccgtggtcaacgagtccaccgtccccgtgatcgagaccggcaccggcaactgccacgtctacgtcgacgcccaggccgacctcgacatggccgtcgacatcctgatcaactccaaggcgcagcgccccagcgtctgcaacgccgccgagacgctcctcgtccaccaggacatcgccgccgagttcctgccacgcgccctggacgccctcgccgacgccggggtcaccgtgcacgccgacgaacgggtcatggcctacgccaaggactcccgggccacggtcgtcgaggccaccccggaggactgggacaccgagtacctgtcctacgacatcgccgccgccgtcgtcgactccctggaccgggccgtcagccacatccggctgtggacctccggccacaccgaggcgatcgtcaccacctcgcagcaggccgcgcgccgtttcacccagttggtcgactccaccacggtcgccgtgaacgcctccacccggttcaccgacggcggccagttcggcttcggcgcggagatcggcatctccacgcagaaactgcacgcccgcggccccatgggcctgcccgagctgaccagcaccaagtacatcgtcaccggcgacgggcacatccggcgctgacccgccgcccgcggacggccgctgccggccgtctcacctggcggatgaatttccgtaccgtctgcccaaattgaccccccaggtctactctggatccgtgccggaggacgtggggggcacgccgttccctgacggctgggagcccgacgacgaccacgaccgcggggtgtcggacgaagagttcgcctccgtggtcttcgacgaggccttcgtacgggcggccgtgatccacgagccgaccgccgtcgaacgcctccttgccgccgcggaggcaagagccgcggcctccgaggccgaggcccgccgcgcccgcacgaggggcgagcacccaggcgacggg

SEQ ID NO: 1476 - DNA, 1787 bp, Unknown
  Kingdom: Bacteria, Phylum: Actinobacteria, Class: Actinobacteria, Order: Streptomycetales, Family: Streptomycetaceae, Genus: Streptomyces
ccgtcggtgacggcgccgcaccgcgagggatcaggtcacggtcacggcatcgcgtgcacgtgcgcgcccaccgagttggaccaggcgttgcccgccgccgcgtcccagttggtggaccaggtcatcgcgccgcgcacgtccgggtaggccttcgagggcttgaaggagccgcagttggtcagcttcgccaggcagtccagggcgttgtcgaccactgtgggggagacgtagccgccgccggcgccgctcggggaggcgggcaggccgaggccgacctgggagggcgcgaggccgccttcgagctggatgcaggcgagggcggtgaggaagtcgaccgtgccctgcgagtagaccttgccgtcgcagcccagcatggagccgctgttgtagtactgggtgttgacgaccgtgaggatgtccttgatgttcagggccgtcttgaagtagccggcggacgtcgactgcatgtcgatggtctgcggggccatggtgatgaccagcttcgatccggccttcgcggacagggcgcgcagcgcctgcgtcatgtaggtcgggttgaggccgttctccaggtcgatgtcgacgccgtcgaagccgtacgtctgcatcagggagtagaccgagttggcgaagttcgtcgccgatgtcgagtcgccgaccgataccgtgcccttctcgccgccgatcgagacgatgaccttcttgccggccgcctgcttggccttgatgtccgccttgaactggtcgaccgtgtagccgttcaggccggccgagtcgaggttgaaggtgaccgcgccgggcgtcgtcgtggcgtcggcgaaggcgaccgcgatgatgtcgtaggcggaggggacgtcggagatcttctggacggtcgcgccgttgttgaagttctgccagtagcccgtcaccgcgtgcttgggcaggccgctgccgccgccgtcacctcccccgccggtcgcggccgtcgtggccgtcacggccgcggacttcgccgactcgcccgccgcgttggtggccgtgacctggaaggagtacgcggtggaggccgtcaggccggtcaccgtcgccgaagtaccggtgacggccgtgaccttggcgccgtcgcggtagacgttgtagccggtggcgttcgagacggggttccaggacagcgtgaccgaggacgaggtcgtggcgcccgccgtgagaccggccggtgccgccgggacggtcggcgccgggtcaccgccgccgcccccgtcggggccggagacggacacgtcgtcggcgtagtaggccgcctggccgtaccagccgtgcaggtacaccgtcaccgaggtggtcgaggagccggtggtgaaggtggtggacaactgcttccaggccgtcgtgtccggcgtccacgtcgagacgtcggccgtgcccgtgcccgtggcgcccaggtaggcgtacccgccctggacccacgcgctcagggtgtacgtcgagttgggcttgaccgccacggtctgggtgcactgggcgttgtcctgcccggccggtgtggccttcagcgcggccgaaccggcgtgcacgggcgaggagacggtcgtaccgctgcccgccgaacaggtccagttgctcagacccgcctcgaagccggcgttcttcgcgttgttgacgtcggccgccgatgcctggccggtgcccgcgagggagagggcgagggcggcggtgacggctccggaccagatgccgagcggccgaagccgtctggtgccgggcgtgctggggacgcggtccactggggcctccggggagaggag

SEQ ID NO: 1477 - DNA, 2503 bp, Unknown
  Kingdom: Bacteria, Phylum: Actinobacteria, Class: Actinobacteria, Order: Streptomycetales, Family: Streptomycetaceae, Genus: Streptomyces
gtcggcgacggtcgcggcggtggcccgccggccggacaccgccgcgaccgtcgccgactgcctcgaccggcgcctgcggcacggaccggccgtccgctcggtactgttcccactggtcagcggccttctggaggacagccccacggccctgcggtcggcgctcggcggcacactcgcagcccccggcgccccggcctcccgtgcgctgcgccgggaactcctcgacctcctgctcgcccacgagacggacccggcagtactggacaccgtcctgcgcaccgcggcgccgagcgccgacgaggacctgcggcacctcgtgcaccggctcggactgctgctcgtccgcaccccggacggcgcggccgtgttcgaccgcgcgctcgtggagctgggccggcacgtccccggtttcgccgcacgggtggccggctggctcaccggctccccgtacgactgggccgccgtggtgggccccagcgcccgccggacgatcgagaacctggcaggggcgccggtccccgtctgacgacgtccggggcccgtaagtgcgccgggtcacagcgcccatgccgatgcgggcacgcagcgccgggcatggcacccttagacctgcggacaaggcagcaaggcgacctagacaacggcatctaggcacacggacacgggttcgacaaggagcggtcacagtgcagcgctggcgtggcttggaggacatcccccaggactgggggcgcagcgtcgtcaccatcggctcgtacgacggagtccaccgcggccaccagctcatcatcgagcacgccgtgaaccgcgcccgcgagctgggcgtgccctccgtcgtcgtcaccttcgacccgcaccccagcgaggtcgtccgccccggcagccacccgccgctgctagccccgcaccaccgccgcgccgagctgatggcggagctgggcgtggacgcggtcctggtcctgccgttcaccaccgagttctcgcagctgtccccggccgacttcgtcgtcaaggtgctggtcgacaagctgcacgccaaggccgtcgtcgagggcccgaacttccgcttcggccaccgggccgccgggaacgtcgacttcctcgtcgaccagggcaagctctacgacttcgaggtcgaagtcgtcgacctgtacgtcaccggtgacgccggcggcggcgagccgttctcctcgacgctgacccggcgtctggtcgccgagggcgacgtcacgggcgcccgcgagatcctcggccgcccgcaccgggtggagggcgtggtcgtccgcggtgcccagcggggccgtgagatgggcttcccgacggccaacgtcgaaacgctcccgcacaccgcgatccccgccgacggtgtctacgccggctacctccacgccaagggcgaggcgatgccggccgccgtctccgtcggcacgaacccgcagttcgacggcaccgagcgcaccgtcgaggcgtacgcgatcgaccgcgtcggcctggacctgtacggcctgcacgtcgcggtcgacttcgtggccttcgtccgcggccaggccaagttcgactcgctggacgccctgctggagacgatgtccgaggacgtcaagaagtgccgcgagatcatcgcggcggaggaacagcaccgctgacaccccgcccggccggcgcacccaccggctgcccggcgggcgccgcagggccgggcgtcgcacggggagtgccggacacctggtggtccgccgtcccggtggtcgggcgctagtcgggggatgcgagcgggcctccctgccggtcagcccgtttgtgccgccaggcggcccggttgttcccgcggcccggtggcccggtggtcggttggctggcgggcgtcgcacagccgggcggcgcccgggcgcccgccggaagcgcgcgatcggtcctgcccgccggtcagccccctggtgtcgccgtcccgggaccgtccgccgcccccgcggctcccggcgccgccccctccgtcctcgcccgggcccagtggcaggcgacctgcgtctcgtcgccgccgtgcaggatctccaggtcttcgctccggcacgcgtcggcgacaccggcgcgttccgcctcgccgccggccaggatctggcagcgggcgtggaagcggcagccggcggggatacgggacgggtccgggggttcgccggtgaggacgaccggggtgcccggcgcttccggcaggacggacagcagcgcctgggtgtagggatgccgcggcgcggtcagcacctgctccacgtctcccgtctccacgatccggccgagatacatcaccgccacgcggtcggcgatgttccaggccagccccaggtcatgggtcaccaccagcgcggacagaccgagttcggtgcgcagccgcagcagcagcgcgaggatctcgccgcgcaccgacgcgtcgagggaggccaccggctcgtcggcgacgagcagttccggttccaggaccagcgcgcccgcgatgacgacccgctggcgc

SEQ ID NO: 1478 - DNA, 6354 bp, Unknown
  Kingdom: Bacteria, Phylum: Actinobacteria, Class: Actinobacteria, Order: Streptomycetales, Family: Streptomycetaceae, Genus: Streptomyces
agggtggtgaagccgtccgcgccgccgatcgccgcggacggcttcaccaccctgtcggccgccgaactcggccgggccttctgcaacgacatcgcccaggtcttcctcctggacaagtggtacgcgggcctgatcctcctgctgggcctgctcgtcgcctcccgcgccgccgccctcgcggcggcctgcggcagcgtcgtcgcgatcctgacggcctgtgcgatgggcctgcccgccgaccggatcagcgacggactctacggctacaacgcggtgctggtcgcgatcgcgctgggcgccaccttcctgacccgcaccccgtggaccgccgggtacgccacgctcgccgccgtggcctcggtccccttcaccgccgcctggcaggccttcgcccagccgaccggcgggtcccccttcacctggccgttcgtcgtgacgacctggctcttcctcgcagccgttccagccctggaccggcccggcatctcgttcgagaaagcgaagtgacgccatgaacctcgcaccgcgcgaaatcgacaagctccacgtctacgtggtggcggacctggcccgccgccggcgcgcccggggcaccaagctcaactacaccgaagcggccgcgctgatcaccgaggcggtcctggaggccgcccgcgacgggcacaccgtcgccgagtgcatggaactgggccgcaaggtcgtcgccggcgacgacgtcatgcccggcgtgcgcgagatgctcaccgtcctgcaggtcgagacggccttcgtggacggcacgaagctggtcacctgccacgaccccatcagcgcctgaaccccgcctgattcaccgcctggaactaggagacaacgatgtcgggtggagcccactacctctacggggacgaccccgtggagctcaacgccggccgggcgacggtcgcactgaccgtcgccaacaccggtgaccgtgccgtccagatcggctcccactaccacttcttcgaggtcaaccgcgcgctgctgttcgaccgcgaggccgcgtacggcatgcacctggacatcccgtccggcaccgccgtgcgcttcgaacccggtgacacccgcgaggtggagctggtcgccttcggcggcacccgccgcctcgtcggcttcgccgggctcgtcaacggcggcctgaacaccgacgacacccggcgtgccgccctgcgccgcgccgatgagctgggattcgccaccacctcggccaccgccggggccaccaccgccgccgacggcgacgccgacaccgagaacgagggggccgaccgctgatggcgatcatcccgcgcaagcagtacaccgacctgttcggccccaccgtgggcgaccggttccacctcgccgacaccaacctggtggtcgaggtcgagtacgaccacaacgccggctcgtacggcgacgaggccgtctacggcggcggcaaggccatccgcgacggcatggcccaggacccggcggcgctgaaccgcgagggcgccctcgacctggtcatcaccaacgtcgtggtgctcgacccggtgctcggcgtcgtcaagggcgacatcggtgtccgcgacggtctgatcgtcggcgtcggcaaggccggaaacccgcacctgcagaacggtgtcgaccccaagctggtcatcggcccgggcaccgaggtgatctccggcgagcacctgatcgccaccgccggcggcgtcgacacgcacatccacttcatctcgccgcagcaggcccaggagggcctgtcgaacggcatcaccaccttcttcggcggcggcaccggccccaccgacggcagcaacggcaccacctgcacccccggcccgtggaacatccaccgcatgctggaggcggtcgaggacctgccggtcaacgtgggtctgctcggcaagggcaacggcagcctgcccgaggcgctgcgcgagcaggtcgaggcgggcgtgtccggcctgaaggtgcacgaggactggggcgccacgcccgccgccatcgacaacgcgctgagcgtcgccgacgagcacgacgtgcagctcgccatccacaccgacaccctcaacgagggcggcttcttcgaggacaccctgtccgcgatcgacggccgcaccatccacaccttccacacggagggtgcgggcggcggtcacgccccggacatcatgcgggtggcgggtgagccgaacgtgctgccctcctccaccaacccgacgctgccgtacaccatcaactcggtggacgagctgctggacatggtgatggtctgccaccacctgtcccgcaacatccccgaggacgtgtcgttcgccgacagccgggtgcgcgcggagaccatcgcggccgagacggtgatgcacgacctcggcgtgatcagcatcttctcctccgactcccaggccatgggccgggtcggcgagtccttctcgcgtgccttccagaccgcgcaccactgcaaggacgtgcggggcccgctggccgaggacagctcccgcaacgacaacgcgcgcgtgctgcggtacctggccaagctcaccatcaacccggcgatcgcggtcggcgcctccgacgtgatcggctcgctggagcccggcaagctcgccgacatcgtgctctggccgatcaactccttcgccgccaagcccaagctgatcatcaagggcggcatggtgaactgggcgctgatgggcgaccccaacgcctccctgccgaccccccagccggtctactaccggccgatgttcggcagcatgggccgggcccggcagcgtacgtcggtcaccttcatgtcgcaggcgtccatcgccgccggcgtcccgggcgagctgggcctgcagcggcgcatcgagccggtgcagcgctgccgtaccgtcggcaagcagcacatggtccgcaacgacgcgctgccgcgcatcgaggtggacccggagacctacaaggtcaccgtcgacggcgagcccgccaccatcgagccggccgagcgcctcccgctcaaccagctcttctacatcgtctgacctacccatgacggtccgcagggcacctggcgtgccctgcggccccgacggccggccccggcgcacggccacccggcaggaacggaaacccggcgtgaacgacccgatgccgatcccggcgctgctgaccgggctccagctcaccgactcggccttccccagcggctactacaccctctcccacggcctggagggcttccagcaggcccgtacggtcaccccgcgcaccctccccgccctcctgaacgacctgctccgccacagcgcgggaccggccgacgccactgccctcgccctcacccaccgcgcggtcagcgcggacgactgggacgaggtggtggccgtggaacggcggttgcacgcgaccaagttgggccgggaggcacggcaggccgccgtgcgcaccggacggcagctgctcgacctggccgacgaggtctacggcacgaagccgatcgagcggtaccggacgctgtaccgggacggcgcggtgcgcggctgccagccgatcgtcgccggtgtcgtccacgccggcaacggcctcaccgcacggcaggccgtcacctgtgagctgttcgccttcgccgccagcttcgtcggcgccgccctgcggctgcggctcaccgaccaccggcgggcccaggtcgtcctgcacggcgccgccccggtgatcgaggagaccgtcgaggcggcgctgcaccgggacctggccgacatcggcggatgcgtgcccgtggccgacgtcatggcaggccgccacgaacgcgccgaggcgcggctcttcgccagctgagccacggcacccaccccccaccgagaaccaccacgtctgacaaggagcacggatcaccatgcacgaccccacacaggtcaagggctcccaccaccacgaccacgacgagttcgtccggcgccccaaggacggcgtgctgcgcgtgggcgtcgccgggccggtcggctcgggcaagaccgcgctgatcgaggcgctcgtcccggtgctcatcgagcgcggccggacccccgccgtgatcaccaacgacatctacacctccgaggacgccgcgcacgtgcggcgcaccctggacgggatcctcgccgccgaccgcatcgtcggcgtggagaccggcgcctgcccgcacaccgccgtccgggacgacccgacgatgaaccaggccgcggccgacgagatcctggagcgtttccccgaggtggacacgctgctcttcgagagcggcggcgacaacctgacgctcacgttcagcccggccctcgtcgacctgttcctgttcgtcctggacaccgccgagggcgacaagatgccccgcaagcgcggcccgggcatcaccgagtgcgagctgctcgtcatcaacaaggtcgacatcgcccagtacgtacggtgcgacctggcgcagatggagtcggacgcccacaccgtccgggagggccggccggtggtgctcaccaactccctgaccggtcagggcctggacaccatcgccgacttcgtactggcccacgaggccgcccagccggccggcaccgcggcggcgtccgcatgacgaaggcgcccgcgcggctggaccccgcacactacgaaccccggcgggtaccgtcccggatgaccgacctgaccgtcgccgcggacaccctggccgccgggcgccccggcaaggtgggcctgctcgaactgcgctacgcccgcgtcggcgagcgcaccgaactcgtcgaccgctaccagaagtcgccgctgcagatcatgcggccgctgtacgtggacccggagcggccggacatgccggtgacatacctgatgtccaccggcggcggcatcgtccaggccgaccgcaaccgcatcgacatcgactgcggtcccggcaccgccgtgcacctgacgacgcaggcggccacgaagctgcaccgggtggagttcgaccacgccacgcaggtcgtccacctcaccgccggcgcggacagctacgtcgagtacctgcccgacccgctgatcccctaccgcgacgcccgcttctaccagcagaccctggtgaccgccgacccgacggccaccgtcctgctgggcgagacgatcacggccggccggctggcgcgcggtgaacggcacgcctaccgcatgctcttcagcgacctggagatcacccggcccgacggcgacctgctggtcctggacaccgtacggctggatccgcacgagcccggctcggtcaccggtccggcggtcttcggcggccacgacctgatggccatgctgttcgtgctcacgccgctcgccgccgccggcgaggtcgccgacaccttgcacgaggcgttgcgcaccgccggtcaggactacggtgtgagcgtgctcccggacgactgcggagcgtgggtacggatcatgggcagcgacccgcccgcggtcgcccgcgcccagcgtgccgcctgggacgcggtgcgccgcctgctcatcggcgttcccgcacccgatctgcgcaagacctgacgcgaccgctccccacttttcggtggctgccggttttcggtggctgccgcggtccggcggacgcgtccgctcagtccgtgtcgcggtcctgggcgcggtggcccagggccgcgctgcggccggtcgcgaggtgctgcaggacgagggcctccacgcgctggacgtcgcgttccgcgatcgcctggtagagggcctcgtgttccagggccacgcccagcaggtcgtcgtgctggccccggaaccaccgcatgcggctgctgaggccgcggtcgagctcgttgagcagttcgttggcggccagggtggtgacggtctggtggaagtcggccgccgcccggcgggcccgcacggcatcgccggtgcgggccgcttccagttcggcgtccaggtccgcgcgcagccgtcgcaggccgtcgcgtgtgtggcgctgtgcggcgagccggaaggagagggtctccagggccgaccggacctcgtcgaggtcggccacgtcgctggcggtgaactcgcgcaccacggcccaggtccgcggacgcggcgtcaccagcccctcggccaccagtgtcttgagtgcctcgcggacgggcagccggctcacgccgagcgcctcggcgagttcgcgctcgaccagacggctgccggggccgcgtactccgtcgaggatctcgtcgcgcaactgccgcgtcacccgctcggactccggcacgtagtcccctgacgccgtcatctcggtccttcgtctcccgtcacgtcccgttccggcaccgtctgcgtccgtgcggcgaagcaggcgggcggcccgtcaggataccccgcggcccgggacggcatggcgcc

SEQ ID NO: 1479 - DNA, 2923 bp, Unknown
  Kingdom: Bacteria, Phylum: Actinobacteria, Class: Actinobacteria, Order: Streptomycetales, Family: Streptomycetaceae, Genus: Streptomyces
gtcccgccgctcgtgcagtcgcccgaaccacccgacgtgacgccctgcgcctggctgccggagatgaaggagccgccggagtcaccgggttccgcgcacaccgaggtgcgggtgacaccggagacggtgccctcctggtaggtcacgctggtgttcagctgctggacggtgccgcagtgccacccggtcgtcgacccggagcggcacaccgaggcgccgacggtcgccaccgtggacccggtgacctggaggttctggccgttctgggtgacgtagggcgtcgctgtccaactggagttggtggccacccacgacatgtcgttgccggggaagaccgacgcctggaaggtgccctgcgccacctggttggcgccggtggtggtggagccggcccgcccgcagtgcccggccgaggcgaagccctgctgggtgccgcgggtgaccgggaagccgatcgaacagcgggtgttgccgttgatgtagtacgcgtccccgccccgcaggtcgtacagcgggcgcgggcgctcggccgacttgaccaccttggcgagcgaacggtccaccccggcggacgacagcagctcacgggccgcggcgggccgtacggcctgcacgaccagcgtgttggtgcggacgtcgacgtaccacacgggcgtgtcggtggtgtcccggtgcgtggcggcacggtccaggcgggccttggccgcgtccagcgcggcgagggagtggcggacgacgacggcgtcggcggtctccagggccaggtcggagccggcccggcccatggcgatgccggtgtgcgcggcggccagcgctggggcgtcgttgacgccgtcgccgaccaccagcaccttccgcccggcctgctccatctcccgtacggcggtcaccttgttctgcggcagcatccctgcgcggacgtccgcgatgccgacctcgccggccaaccgggcagccgcgcgcgggttgtcgccggtgaccagcaccggggcactgccggtcagctcggtgagggcggtgacggtggcggcggcctcctcacgcagccggtcggcgatcccgagtaccccgactggggtgccgtgcagggcaaccagcacggcggtgcgtccgtcttcctccaggcccgcggccacggcgatggccgggtgcccggtgtggtggtccagcaggcgggcggggctgccgaccgcgaccgtacggccccgcacccgggcgctcaccccggcaccaggggtggacgcgaagtcctccgccggcggaatgtccagaccgcggctgcgggctgcgtcgacgatcgcgcgggccagcgggtgctcactggggtgctcggccgccgccgccagccgcagcagctccgcctcgctcaggccggaggagaccagcggccggatgtcggtcacccgcggggtgccctcggtcagcgtgccggtcttgtccagggcgaccgcgttcacctgcccgagccgttccatgaccacggcggacttgaccagcacgccgtggcggccggcgttggcgatggcggacagtagcgggggcatggtggccagcaccaccgcacagggcgaggcgacgatcatgaacgtcatggcgcgcagcagggtgggctgcagctcggcgccgaagagcaggggaagcgcgaagagcgcgacggtggcggcgaccatgccgaggctgtaccgctgttcgaccttttcgatgaacagctgggtgggcgccttggtctcggaggcttcctcgaccatggccacgatccgggcgatcaccgagtccgccgggtcgcgctcgaccttcacccgcagcgcgccggtgccgttcagggtgccggcgaacacgtcgtcgccctcctgcttggccacgggcaggggctcgccggtgatggtggcctggtccacctcgcttacgccgtccaggacgcggccgtcggcgccgatccgctcaccgggccgcaccaggatggtgtcgcccgctgtcagctgctcggtggggaccgtctcctcggtgccgtcggcggccaggcgggtcgcggtggcgggggcgaggtcgagcaagccgcgcaccgagtcggcggtgcgggcggtggcgatcgcctccagggcaccggacgtggcgaagatgacgatcagcagggcaccgtccaggacctgcccgatcgctgccgccccgagcgccgcgacgaccatcagcaggtccacgtccagcgtcttctcccgcagggcctgcagcccggcccagccgggctcccagccgccggtggcgtaggtgagggcgaagagcggaccccacgaccacgccggcgccccgagcaggtcgagcggcagcgcgatcaggaacagcaccagggcagctgccgcccagcgggcctcgggcagcgcgaagatcctcgtgcggcgccggggcgcgaccgcgtcacgcacggccgcgtcaccggcgggcgccgggcgggtgagggtggaagacatcgaagcgggggtccttcgcagcgtgagcggacggcgtccaaccccaccaccgtaacaggaacgaatgaacatcgattcatgtgttcatggcgcgtcgtaccatgggcgcatgggtcacggagccaaaccgccagccgacagcgttccgcgtacgcgcctggacgcagccagtgccgcccgggtggccaccaccctgcaggccctggccaccccgtcccggctgctgatcctcgcccgcctgcgggaggggccgctgccggcgaccgagctggccgccgaggtcggcatggagcagtccgcctgctcccaccaactgcgcctgctgcgcaacctcggcctggtcaccggaacccggcagggccgctccgtcgtctacgcgctctacgacaaccacgtggccgaacttctggatcaggctctgtaccacgtcgagcacctgcaactgggcctggccgaca

SEQ ID NO: 1480 - DNA, 4456 bp, Unknown
  Kingdom: Bacteria, Phylum: Actinobacteria, Class: Actinobacteria, Order: Streptomycetales, Family: Streptomycetaceae, Genus: Streptomyces
ggccgcgggtgtgtggtgcggtccggccgcggggttcaggcgtacgcgaggctgggggtgtcagccagcagctgccgcgtgtaggcgtcctgcggccggtcgaggacgtcgtcgaccgctccctcctccacgatccggccgtcgttgagcacgacgacgcggtcggcgatggcgcgcacgacggccaggttgtgggtgacgaacagcatcgtcaggccgctgtccgcgcacagtctcctgagcagcagcaggatcgcggactgcacggacacgtccagcgccgaggtgatctcgtcgcagaccaggatggacggagtggtggccagggcacgggccacggtgacccgctgccgctcaccgccgctgagctgggagggatacttgccggccgtctccggggccagcgccacgtcggccagcaggctcgcgacccgctccgggagggtgcctccggcgccgccgagcacacgcagcggctgctcgatggaacgccccacggtcttgcgcgggttcagcgcctcggaggcgttctggaagatgtactggagcgtgcgccggtcggcggcggaccgcctgcgcgcaccgaagcccagccgccggccctcgaccgtcacctcgccggacgcctcgtcgtggaggccgccgatgcagcgggccagggtcgtcttgccgcttcccgactcccccaccagcgccatgacgacgccgcgcgcgacggtgaggtcgatcccgtgcagcacctccttgcccccgtaggaagcacgcaggtcgcgtacggtcaggtagccctcgccggggtcgccgccgggcgggaccgccgcggccggggccgtttcctccttgggccgggccggcgccgggagctcgtcggcgcgccggcacagagccgtgtgaccgtcgtccacctggacggcctcgatcgcctgcgtgtggcacgccggttccgcgaagtcgcagcggtcggcgaacacgcagccgtcggggcgctcgtgcagcggggcgacacggcccgggatggtgcggatctcccgccgccggtgcgggtcgggcacgacgtcgagcagcgccctgctgtacgggtgcgccgcccgccaggtcacctcggccgccgggcccgcctcgacgaggcggccggagtacatgaccgcgatgcggtccgcgagatcggcgacgaccgcgaggtcgtggctgacgtacacggcggccgtccggtgcgagcggcacagctcgcgcaccgtgcgcagcacgtgtgcctgggtggtgacgtcgagtccggtcgtcggctcgtcgaggacgacgaccttgggccggcacaggaacgacagcgccaggacgacgcgctgctgctggccgccggagagttcgtgcgggtagcgcctcaggaagcggtcgtcgcccggcagtttcacctcggcgagcacctgccggatccgctccaggcggtcccgcttgctcgccacgccgtggacggcgagggactcgtgcagttgcgcgccgaggcgcatggcggggttcagcgaggcgcgtgggtcctgggggacgtaggagaccacgcggccgcgacagcggcgcagctccttggggccgagcgagagcaggtcgacgccgtcgacgacgaccttcccgccggtgatgacggtccccgggcgcgcgtggccgaggagggccgagcccacggtggtcttccctgagccggactcgccgatcaggccgaggatctcgcccggtgccagggcgaagccgatgtcctgcaccacgttgacggcgttgtgctccaggtcgacggtgagtccgctcacctcgatggcgtgcgcgtcggcgcgcgggccggtgctggtggtcatggtcacccctcgcggccgagatcgatgccgacggcccggccgaagctgtcggtgaggagattggctcccacggtgacgacggtgatcgcgagcaccgggagcaggacgggcagggggctgccgaccacgttggactggttctggttgatcatcatgccccagtccaccgccgggtcctggcggccgaaaccgaggtaggcgagcgaggcgatcaggctgatcgagtaggtcaggcgcaggccgaactgcacggtgagcggcgcgacgacgctcggcaggatctcgccggtgaggatccggcggcgcggaacaccgatcatctcgcagtactggacgaaaccccggccggtgacggccagcgtggagctctcggcgatgcgcgccacgtagggcacgtgcgagaccgccacggtgagcaggaccagccaggggctggtgccgagcagcgacatgaacagcagggccagcagcagcggcgggaaggagaggacgacgtcgagggagcgcatgatcagctcggcgcgcacccctcggcggtagccggccaccagcccgagcagcgtcccggcaccgacaccggcgacggtggccaggagcgccatcagcaggatcagggtcccgccgctcaggaagcggctgaggacgtcgcgcccgagcatgtccgtgcccagcggtgcggtgccgcccggtggtgcgtagggtgcgccgatgaccgccgccggatcgtgcgggccgaacagcgggcccaggaaggcgacggccatcaccaggagggtgagggccaggccggcctgcgcccctcgggtgcgcagggtacggcgcaggatggcgcgggggccgtcggggcgcgtctgcctgcgatgcgggaccggctcgcggtcctcggcggtcttggtgggcgcgctcgccgccggagcgagggccacctcgtccggaggggtcatcgtgctcctcctcgcatggtcggtgtcatggcgaccgtgccgatgtcggccagcagattgacgaagatgtagaaggcggcgagcagcatcgcgaaggcctggatcaccggcaggtcgcggctctgcaccgaggcgacgaaggcctggcccacgccggggaactggaacaccgactcgaccacgaccaccccgccggccaggtaggccagcgactgcgccaccacctggaaggtgggcccggccatgttcggcagcgcgtgccgcaggacgacgcgcagctcggagatccctttgagccgtgccatcgtcacgtactcgctctccagcgcctcgaccatgcaggcgcgcacggtgcgcaccacgtagggcagcacgagcaggacgagggtcagcgtcggcagcacgagcaggtccagctgccggaacaccgaccgggccggatcgacgggcgagaccgccggcagcacgtgcaggacgttggtcgcgaacaggaggacgagggcgacaccgaggacgaactccggcagcgcggagaccaccagcatcaggaccgacgagacctggtcggcgggacggtccctgcggatggcggtgaggatcccgagaccgagcgcgaggggaatggcgatgaccgtcgtggcggcgatcagcaccagcgagttggtcacctggtggccgatcagcgagccgacggagaacccggaggcgaaggagaccccgaggcggccgtggaggaggttgtcgagccagtggacgtattgggcgggcagtgactcgttcaggtggtagaggtgccggaagctctccagggccgccggcgaggcgttcttcccgagcttggcgaccgccgcgtcaccgggcagcgcctcggtggccgcgaagacgatgacggacaccacgaacagcaaggccaccgaatagaccgagcgccagaagatcattttggtcatcagccacgctcccacctccatagatacagaccagtcggtctctcgcagcgccgaccgtagccacttctcaaatcggctgtcaacgcttccgacacgcaaaagagaccggagggtggcaaggcaatcgacccggccggcagagaggggactcttgactcggagcgacacacctggctcacttgataccgaccagtcggtagatccggtagatcacgcaccgatcccggccggtccaccgacaccacagcgagcgacgtctcggtcctgcccagggggcgcacatgaacagcacagagcccggacatccggcggcacaggaacccgcactgatcgtgaccggcacagtccggcacggcgacgggcgcggccggctgctggggtttccgaccgccaacatcccgctggactccggcccacgccgtgacggcgtctggtgcgccgtggtggtcacagccgacgacggtctcgcccggccggcggcggtgtccatcgggcgcaggtccaccttctacggccgcacgggcccgcggctgctggaagcacacctcgtcgacgtcgagggcctggacctgtacgaccgggagatctcggtccacctcttcgaacgcatccgcccgcagcgccggttcaccggcgcggacgacctcgtggcccagctggccagggacgtggaggccgtgcgcgcctgggcggcgtcggtcgctcccgcgggtgcgcg

SEQ ID NO: 1481 - DNA, 2350 bp, Unknown
  Kingdom: Bacteria, Phylum: Actinobacteria, Class: Actinobacteria, Order: Streptomycetales, Family: Streptomycetaceae, Genus: Streptomyces
  misc_feature (1830)..(1831): n is a, c, g, or t
gctgcggcgcgaggaggtcgcggtgctcgccggggtgggcgcctcctggtaccagtggctggagcaggggcgggacatctccgtctcgccgcaggtcctggacgcggtggcccgggtgctgcggctgagcaacgccgagcgccgccatctgtaccggctcgccgggctgaacccgcccgcgcccgaagtggcgccggagaagcgggacatgtgcgacgggctgcggcggctgatcgacacctggatgccgtatccggcgcacatcatggacctgtactacaactgcgtgatgtacaacgacgccgccgcggtcgtgctgggcatgcgtccggacatcacgcagaactgcctcgtcgacttcttcaccgacccgctgtaccgctcccgctcgcagagctgggagcgcaacgcgcgcacggtcgtcgcacagttccgcgccgcgtgcgccgcccgtcccggtgacgaggggtacgaggcggtcctggcccgggtctccgaggccagcgaggagttcacggcgctgtgggaggagcgggacatcgaggagccggggcaggtccgcaaggaactcgagcatccgctggtgggtctgctgtgcgtggagtcgacggcgatgaaggtgccggcccggccggacctgacggtggtgctgcacacgccgctggacgaggcgaacaccgcgtcgaagctggagtggctggcctccccggaggggcggcgcggggcgatgtatccggtggcgggatgagcggcggggagaggggcacggccgcgggtgcgggtggaaggcacccggccgcgggtgcggctccgggtgcctggatgccggccgggctccgtatgctcgggtcatgaccgacagcaacgcgctcgacgccgaggaccgcaagatcatcaccctggcccgttcggtacgggcccgcaacggcgtgccggagggcgcggcggtacgcgacgagacgggccggacctacgccgccggttccgtgcacctcgcctcactgaagctgagcgccctgcagacggcggtggccatggcggtggcgtccggggcggcctcgctggaggcggcggccgtggtcagcgaggcggaagggctggcgccggaggacttgtccgccgtcggtgacctgggcgggacggggactccggtgctgctggcggggcccgacgggagcgtacggctgacgctgccggcggggccggcggagtagccgtcggcggtccgccccagggggcgccggtgtgcttctgtgcgggcgggccggggccgggcgtgcggcggggcgtcgtggatcagggacaatgggcgccatgagcgttcgtacccagtcatccgagcagtccgccgaggctgcccaccgcgccggcttcgcctgcttcgtgggccgccccaacgcgggcaagtccaccctcacgaacgctctggtcgggcagaaggtggcgatcacctccaaccggccgcagacgacccggcacaccgtgcgcggcatcgtgcaccggcccgacgcgcagctgatcctcgtggacacccccgggctgcacaagccgcgcacgctgctgggcgagcggctgaacgacgtggtgcgggcgacgtgggccgaggtcgacgtgatcggcttctgcctgccggccgaccagaagatcgggcccggtgaccggttcatcgccaaggagctggccgggatcaagaggacgccgaaggtcgcgatcgtcacgaagacggacctcgtggactccaaggcgctcgccgagcagctgatcgcgatcgaccagctcggcaaggagctgggcatcgagtgggccgagatcgtgccggtctcggcgacnnctgctcgccgacctgctgatcccgctgctgccggaagggcccgcgctgtatcccgagggcgacctgaccgacgagcccgagcaggtcatggtggccgagctgatccgcgaggcggcgctggagggggtgcgggacgagctgccgcactccatcgccgtggtcgtcgaggagatgctgccccgggaggaccggccggcggacaagccgctgctcgacatccacgcgaacgtcttcatcgagcggcccagccagaagggcatcatcatcgggccgaagggcaagcggctgaaggacgtcgggatcaagtcgcgcaagcagatcgaggcgttgttggggacgccggtgttccttgatctgcatgtgaaggtggcgaaggactggcagcgggatcccaagcagttgcgtcggctggggttctgagagggttcgcccacccgcccgctcgactgggcgggccgagaaagtccgccacggggctccgccgcgggccccggcgaggacgtcgtccccggcgcccct

SEQ ID NO: 1482 - DNA, 793 bp, Unknown
  Kingdom: Bacteria, Phylum: Actinobacteria, Class: Actinobacteria, Order: Streptomycetales, Family: Streptomycetaceae, Genus: Streptomyces
cggcaggtcctcgaccgcctcgatctccttcagccgccgcctggccgcgcgcgccgcccgcaccgccagttccttctcgaactccttctctcgttcggtgtcggcccgcaccccgagccgcttcaccagccagggcagggtgagtccctgcaccacgagcgtcaccatgatcacgccgaaggcgatgaacacgatctcgtcccggtcggggaacggcgcgccgctgtccgtcttcagcgggatggccagcgccagcgccaccgaggccacgccgcgcatccccgaccaccacatgacgacggtctcccgccagctcgtcgggatgtcctcctccaagtcgcgtcgggcatgcaggcgttgggtgagccaggtcgccggcagcagccacagcagccggacgaagacgaccacgcccacgacgactccggcccagcccagcagctcgccccagcggcccgaggcggtccggatggcgttgtgcagctccaggccgatcaggccgaaggcgacgccggtgacgagggtgtcgacgacgtcccagacggtgtgcccggccagccggctcatcacgtcgtcggcgtcgtaggcgtactcggccaggaacagcgcggtggtcagcacggcgaggacgccggagccgtgcagttcctcggccagcacgtaggacgcgtagggcacgagcagggtcaggccgatctgcagagtggcgtcctccagcaggtcgagcagtttgttggcgccccagccgagtgccacgcccacgacgacggcgaccacggcggacagcaccagg

SEQ ID NO: 1483 - DNA, 1516 bp, Unknown
  Kingdom: Bacteria, Phylum: Actinobacteria, Class: Actinobacteria, Order: Streptomycetales, Family: Streptomycetaceae, Genus: Streptomyces
cgtctacgccgcctggctgaccggcggcgatctgcacctccagctcgcccagccgtccgggaagccgcccgcgccctggcggccgggccaggacgagaccttctgggtgctggcgagcggcgacgccgagcagtacgaggacgccgacaccgccgccccctacccgggcctcgtcagcctgggcaccatggacggctcccggctgctgctcaacctggaggccgtgcccggcatcgtctccctgggtggccgtgaggccgaccgggcggcggtcttcgcgtccgtcgccgccgagctcgccaccaacggctggtccgaccgtatgaccgtcaccctcgtcggtttcggccaggacctcaccccgctcgcccccaaccggctgcgccacctggacggcatcgaggcgctcctggagaccatggaggccgagacccggcagcggcgcggcgcgctcggcgccgccggacacgactcggtgctcaccggacgcaccggccccgcccagcacacccgttgggccccgcacctggtcctgctggccgcccagccctcggccgccgacgcccgcaagctcgccgaactcgccgccggcgccgcccagctcggcatcggctacctcgtcggcaccgagtcgggtgaactgcccggcgccgcctgggagatggagatcaccagccagggcaagctgctcgccccgctgctcggcctcgaactcgacgcccagatgctgcccgccgcccagcagcgggccgtcgtcgaactgttcaccgacaccgacacggaccccgagcacggacccgacggacccacgaccaccccgcccttcctcgtcgacatcagcgaacagggacggcccgcggtgtacgcccggctcgtcggctcctacgaggtcatcgggctcgacgccccggacgatgagcgcagcgcgctgctccacgaggcgctggctctgctcctgctgcaccgcgagggggtgcacccgcgcgtcctgtcctccgcgctgtggccgcgcggcgtcaccgacgacgtacgcgacgcgctcgtcgaacggctgcgcgcctggctcggcaccgaccccgacggcacgccgcggctgcgcagcgacgacgccggccggctcacgctcgccaagtccgtcgtctccgacctggacgtgctgcgctcgctctactacgaggccacccagggcaagggcgccgacaaccgtgccgtacgcggccggctcctcaccgatgccctggtcgtggtgcgcggaccgctcctcgcggaccggccggagggccgctaccgctggctcacccacgaactcgtggacgtccagctcccgctgatcgtcgccgacatcggactcgccctgtccgcgttccacctggagaaggaccgcgcggagaaggcgatcgaggcgctgaacgcggctctgcgcaccgcgccgtccgacgagcgcctggtgaacgagctgctgcacgccacccacgccaccggcgacaccgaacgcctgcggagcctggccgcggag

SEQ ID NO: 1484 - DNA, 953 bp, Unknown
  Kingdom: Bacteria, Phylum: Actinobacteria, Class: Actinobacteria, Order: Streptomycetales, Family: Streptomycetaceae, Genus: Streptomyces
cgccgaggtgcgggccctggcgaagggcctgatcgcggagggcctggcaccgggcgaccggatcgccgtgatggcgcgcacgcgctacgagtggacgctgctcgacttcgccgcctgggccgcaggcctggtcaccgtcccggtctacccgacctcctcgctcttccagatccgctggatcctgcacgactcgggcgcggtggcgctggtgaccgagacggcgggccaggcggcggcgctcggcccggagcgcgaccgcctgctcggactgcgccacctgtgggtcatcgaccacggccacctggaccggctggcggagctgggcgaggcgaccgtgccggaccaggagaccgacgtacgccggggcgtcctcgggcccgacacgctggcgaccctcgtctacacctccggcacgaccggccgcccgaagggctgcgccctgacccacggcaacttcctcgccgaggtcgacaacgcgatcgaactcctctatccggtcttcaaggcgaaggacggcaaggcgaaggacggcaaggcgaaggacggcaaggcgaaggagacgaacgccaaggacaccggaaatggcaaggacgccaggaacgtcaaggacgccaaaggctcgggggagcccgcgaccctgctcttcctgcccctctcgcacgtcttcggccgcatggtggcggtcgcctgcgtacgcgccggcgtacgcctcggccacgcgccgagcctcgcggcggaggacctgctggccgacctggcgagcttccggccgaccttcctgctggccatcccgtacatgctggagaagatctacaacaacgcgcgggcgaccgccgagcgcggcggcaaggcgtcctccttcgaccgcgcggccggggtggcccgccgctacgccgaggccgtcgaggcccgccggcacggctccggcccgggccccacccgctccctcaagg

SEQ ID NO: 1485 - DNA, 698 bp, Unknown
  Kingdom: Bacteria, Phylum: Actinobacteria, Class: Actinobacteria, Order: Streptomycetales, Family: Streptomycetaceae, Genus: Streptomyces
cggcagccgggccggatcggcgggcggcgcggagacgacgtgcgccccggcctccggctcgggcgcggaacgcaccagtgagcgcagccagccgcccagttcctcgaagtcgagccgctcggtggggtcctgacgcagcagcgactccaccaccggacggagcgggccgcactcctccgcgaaggcgggcggctcggcgcacaccatctgcaccagctcggcggtcgactcctccggatagggagcgtgcccctgcacggcccggaagagcagcgcgcccagcgcccacaggtcggtggcgggcccgatcggcgcggccagctgccagttcgcgtgcaccggcccggcctgctcgggcgcccagcgctcggtcaccggccccaccacggtcatccgcgcctgccgcgcccgctcggcggccaacgcggtcccgggtcctcgccgtgcagcggccccggtgacttcggtgacctcgctgccgtcagcggggtaaccgtcccagcgggcagcggaggtggccccggtgggcgggccgccgggggatggagcgacagcggatggaggaacggcgggccgtcctccggcggagcggtcgggaactgccgggccgagggcaggcgggtcgaagacggaccgggccggggcggacgcgtccgtccgggcgccctcgggtccggccgcaggaagcgccgtacgcc

SEQ ID NO: 1486 - DNA, 2654 bp, Unknown
  Kingdom: Bacteria, Phylum: Actinobacteria, Class: Actinobacteria, Order: Streptomycetales, Family: Streptomycetaceae, Genus: Streptomyces
  misc_feature (2182)..(2247): n is a, c, g, or t
ccggacacccgggtcaccgggccggtcgcgccgcctccgcccgctccgcaggccccgcccgcccccggcaccgggaaggtcaacctcgacaagggccgggtcagcctccagaagaaccagacggtgtccctggtcaagggcggccgtccgctgctgtcccaggtcaagatgggcctcggctgggagcccgccttccgcggcgcggacatcgacctggacgcctcggtcatcgcctacggcccgcagcgcaaccacatcgacagctgctacttcggcaagctgtccatcctgaacggcgcggtgaagcactccggcgacaacctcacgggcgagggcgcgggcgacgacgaggtcatcgtggtcgacctcgggcgcctcccccaggaggtcaccggcctcgtcttcacggtcaactccttctccggccagaagttcacggaggtggccaaggcgtactgccgtctcctcgacgccgccaccgaggaggagctggtccgcttcgacctcacccacgccgaggcccagaccggcgtgatgatggccaagctcatccggcagtactccggcgagtgggagatgacagccatgggcgacttcgtcaaggcgcgcacggtacggaacatggtgaagccggcggcgcagtcactgtaggcgcggcggcagcggcgtgggcgctcccggcaccgccggggcgggggtgcccacggccggccgccacgctcacggcgccgcccgcaaaccctccagcagcagggtcagatagcgccggatatgcgcaccctgcccggggccccgtccgtcggccagttcggccgccgtcgccacgccgtgcgccagccgcagcagttcgagcggttccagatctgcccgtacggtcccctcccgctgcgcggcctccaccagccgggccgcggcgcccttgagcgacgtaccgcacaccgtgaccgccgccgtgctgccgtccgtgacggccgaacccagcagtgccttgagtccgcgcgcctggatcgtccaggcgcacagttcgttcagccacgccgtcagtgcgtcgcccggcggcagttgctccgccagctcgcccgcgcgggcggcgatcgcctcgatacggtcgacgtaggccgcctccagcagggcctgccggttcgggaagtgccggtacagcgtgccggagccgaccccggcgcgcttggcgatgtcgtccagggacgcgttctccccgcgctcggcgaacgcctgggccgccacctggagcaaccgctcgtagttgcgccgggcgtccgcacgcatgggcctgacccgcgtcatccagatactcctcctgaaccggagaccgtctccgtaatttaccggagccgaaccgggcccgaccggggcccgggcccgaccggggaggggccccgaatccggcccagttcccggtcctggccgagccccggacccggcccaggcgtggcccggatccggcccagtttccggtcccggccgagccccggacccggcccaggcgtggcccgaatccggcccagttcccagtcccggccgagccccggacccggcccgggcctggctccggatccggcccaggtcctgatcccgggcagggcccgatcccggtcccggaccacgcctggatcccggtcccggacaaggccccggcctcggtcccgggcaaccgtgatcccgggccgccccgacgaggaaccgccccgcggccggggaccccggtcccggacggggaacccgcccgggacccgggccatgggccggcggtcgcggtcctcagccggcccaaggccagtccgcgtcccggccggcctcgatcagccgcaccatccggaaggccgcgtccgacaggccgccgaacgtgtggcgcccgtcccggccggaggggccgtggcccggccggtacccggcgaggttccaggtgtacaccggcacgtgcggcgggatctgctcggtcgggtcgccgtgccggctcgcggcgtactgctcgtcggtgacgatcagcacccggtcgtgcccccggtagtgacgccgtaccgcctcggtggtgtcggtgccgccgaggtcgccgaagcgctccaggatcctcagcaccgactcaccccgctggaacggcacccgttcgctcgacgacccgaactcgacgaggtccgcatgggccgcgcgcagcgccagcgcnnnnnnnnnnnnnnnnnnnnnnnnnnnnnnnnnnnnnnnnnnnnnnnnnnnnnnnnnnnnnnnnnncgcgaccagaacatggaacccgagcggtccacgagcaccagcgtccggcccggcagcgagggcacgttggccagcgagtggccgagcgcctgctccagcgggtacgcccagcgcagcgacggcgcgtgctggtaggcggccaggtaccggaaggggaactgccgcgagcgcgccacctgctccgggtcactgatcttcgccgcgacccgcgcggcgacctcgtccgagacacccgcctcgtcgaagttgcgcaggttgcgcacgagcgccatcacgcccatggacgggatcacggcctcccaggccgcccggtccatcggtccctgcagccagcccgccagggcctcccaggtcaggcccgccgcggccagccgctcggcgccgccggcggaggtgaccaccgcgcg

SEQ ID NO: 1487 - DNA, 1352 bp, Unknown
  Kingdom: Bacteria, Phylum: Actinobacteria, Class: Actinobacteria, Order: Streptomycetales, Family: Streptomycetaceae, Genus: Streptomyces
ccggtccagcagtccggccccgtacagctcggcgacggccagcgccgcgccaagcagcagcgtgccgttgcccaccggcagcacgagcacgtccggcagccggccgcccaggtcctcccacagttcgtggacgtaggtcttggtgccgtgcaggaagtacgggttgtacacgtgcgaggcgtagaacgtctccggctcgtccgccgcccgctgcgccgccgcgcccgccgccgcacggtcgccgtcgacgatctccaggcgggcaccgtgcgcctcgatctgctccagcttcttcgcggacgtgccgagcgggacgtacaccgtgcagggcaggcgtgcgcgggcgcagtacgcggcgatcgccgtgcccgcgttgccgctgctgtccgcgaccacccggcgcggtccggtgcgctgcgcgagctgggccagcagcaccgcgccccggtccttgaacgacagcgtcggcatcaggtagtccagcttcgccgacacctcgtccgtcagcgtcaccagcggcgtgcggccctcgcccagggacaccgagggcggcgccagcggcagcgtctccgcgtaccgccacagcgagttcacccgcccggcgagggacttcaggggcgccggggtgggcgagaagtcgaggtccaggggaccgtggcaggacggacagcaccaggcgagcgagtcactggggacacggacgccgtcggtggggcagtagcggtccggcagacttgtcatgaccgcaggttagagcaggttggatcgggcgccgggtgtccgctgcccgctgcccggcgggtgtcaccgcgtgcgagggtctgggcccgggcgggggcggttcccgcggcggccggggcgccggcgggagtacgggcgcgtcagatggcgcgggtcggcaggtgtgaggacgcccatagcggggagaaagtgcctgggtaaagccccccgaccccagaagtcatcacatcgagtgattctctggccttcacttgcacggcccaacctacggttgccacgctgttgctgtctgtgcaacctgatgggagtggccagtgactttcggtgagcagccggcgtatctgcgggtggcgggtgacctccgcaagaagatcgtcgacggcctgctgcccccgcacaccaggttgccctcccaggccaggatccgcgaggagtacggcgtctcggacacggtcgccctggaggcgcgcaaggtgctgatggcagagggcctggtcgagggccgttccggctcggggacgtacgtgcgcgagcggcccatgccgcgccgcgtggcccgctccgggtaccgcccggcgggcggggccacccccttccggcaggagcaggcc

SEQ ID NO: 1488 - DNA, 3907 bp, Unknown
  Kingdom: Bacteria, Phylum: Actinobacteria, Class: Actinobacteria, Order: Streptomycetales, Family: Streptomycetaceae, Genus: Streptomyces
tctaggccggtctcgtgggctcggagatgtttataagaggccgccccgccccggtgcgtgttcccccgtacgcaccggggcggggctttttgcgttccgcccgcacccccggcccctgctccgcttcccttcgcctcccgttcgcgtccccgccaccccaccctttgttccgagatggaacaatgcgtaccgtcaccctgtccacgggacggtcggtcggccgaccggcggcccgggacggttaggctctagtcgcaaggcacagccgcaaggcagaccgccccgcactttcagcgtcacatccacgaaggagatgctcgtgccgtccatcgacgtcgtcgtagcccgggaaatcctggactcccgaggcaaccccacggtcgaggtcgaggtcggcctcgacgacggcagcacgggtcgtgccgccgttccgtccggcgcttccaccggtgccttcgaggccatcgagctgcgcgacggggacccgaaccgctaccagggcaagggtgtcgagaaggccgtcctcgccgtcatcgagcagatcggcccggagctggtcggctacgacgccaccgagcagcgcctgatcgaccaggccatgttcgacctcgacgccaccgacaacaagggctcgctcggcgccaacgccatcctcggcgtctcgctcgccgtcgcccacgccgcctccgaggccagcgacctcccgctcttccgctacctcggcggcccgaacgcgcacctgctgccggtgccgatgatgaacatcctgaacggcggctcgcacgccgactccaacgtggacatccaggagttcatgatcgccccgatcggcgcggagtccttctccgaggccctgcgctggggcgccgaggtctaccacaccctcaagaaggtcctgaagaacaagggtctggccaccggcctcggcgacgagggcggcttcgccccgaacctcggctccaaccgcgaggccctggacctgatcctggaagcgatcaaggaagccggctacgcccccggcgagcagatcgccctcgcgctcgacgtcgccgcctccgagttctacaaggacggcaagtacctcttcgagggcaaggagcgctccgccgccgagatgacggagtactacgaggagctggtcgcggcctacccgctggtctccatcgaggacccgctgttcgaggacgactgggccggctggaagatcatcaccgacaagctcggcgagaaggtccagctcgtcggtgacgacctgttcgtcaccaaccccgagcgcctggcccgcggtatcgaggagggcaccgccaacgccctgctggtgaaggtgaaccagatcggttcgctgaccgagaccctggacgccgtcgagctggcccagcgcagcggcttcaagtgcatgatgtcgcaccgttccggcgagaccgaggacgtcaccatcgccgacctcgccgtcgccaccaactgcggccagatcaagaccggcgccccggcccgctccgagcgcgtcgccaagtacaaccagctgctgcgcatcgaggagatcctcgacgacgccgcggtgtacgccggccgcagcgccttcccgcgcttcaagggctgagcagccgcttcaagggctgagcagccccaccgctgagctgagctgagccgcgccgcgaagggtgaggctcagccagtcgcccgtacgtccccgtacccggtcccgtaccgtgtccggggacgtacgcgcgtgtgagcacgtacgaggtgaccgacgggaggcgcgacgatggccgtgaaggaccgggaccggttctccaccgcgaccaggctcaggctgctcggcgagcagaccgcggcccgcgtctaccgctcccagacccggcggcaggcccgccgctcccggctcaccgggcgcgccgcgctgctcgcgctcgtcgtgtgctcgatggtggtcgccctcgcctatccgatgcggcagtacgtcgcccagcgcgccgacatcgccgacctcaagcggcagaaggcgcaggcgcagcagcgggtcgagcagttgcgcgacctgaaggcgcgctggcaggacgacgcctacgcccagcagcagatccggcggcggctgcactacgtgctgcccggggagaccggttacaccgtggtcgacccggggccggtcaagcagtcccgcgcagagcaggggacggcccgccgtccctggtacaccaatgtctggtacggcgtcgacaagtccgacgccgcccgccagtgaaccgacagagagacatcccgacaggcatggaaacgcccccgccgcccaccccgcgcaccgcaccgaccgacgcggacgtcgaggccttcaagcagcagctcggccgtccgccgcgcggactgcgcgcgatcgcgcaccgctgcccgtgcgggcagccggacgtcgtggagacggctccgcggctgcccgacggcacgcccttcccgacgctgtactacctgacgtgcccgcgcgcatcctccgcgatcggcacgctggaggccgacggcgtgatgaaggagatgaccgagcggctggccaccgacccggagctggcggcggcctaccgggccgcgcacgaggactacatccggcgccgggacgagatcgaggaactgacgggctttccgagcgcgggcggcatgcccgaccgggtcaagtgcctgcacgtcctggtggcgcactccctggccgccgggccgggcgtgaacccgctgggcgacgaggcgatcgcgatgctgcccgagtggtggcgcaagggcccgtgcgtgacggtgcccgcggacgacgagcagcacgagaacgacgaggagaagagccagtgacccgggtcgccgccgtcgactgcggtacgaactccatccgcctgctcgtcgcggacgcgaatccggaaaccggtgaactgaccgatctggaccggcgcatgacgatcgtgcggctcggccagggcgtcgaccgcaccggccggctcgcccccgaggcgctggagcgcacgttcgcggcctgccgtgagtacgcgcaggtcatcaaggagtacggcgccgagcggttgcgtttcgtggccacctccgcctcccgggacgcggagaaccgggacgagttcgtgcgtggcgtggtggacgtcctcggtgtcgagccggaggtgatctccggtgaccaggaggccgagttctcgttcacgggtgcgacgaaggaactgacgggccgtgacgacctcgccaaaccgttcctggtggtcgacatcggcggcggttccacggagttcgtggtgggcgacgaccacgtgcgcgccgcccgctcggtggacgtgggatgtgtccgtatgaccgagcgtcacctggtccagggcggcgcggtcagcgacccgcccaccgaggagcagatcgccgccataagggctgacatcgaggccgccctcgacctcgccgaggagacggtcccgctgcgcgaggcgcacacgctggtgggtctggccgggtcggtgacgaccgtgtcggcgatcgcgcaggaactgccggcctacgactcggcccgcatccaccactcccgtatctcgcacgaccgcgtccgcgagatcacgaggtccctgctccactccacgcacgccgagcgcgcgacgatcccgtcgatgcacccgggccgcgtggacgtcatcggcgcgggcgcactggtgctgctggccgtcatggaacgcgtcggtgcgcaggaggtcgtggtcagcgaacacgacatcctggacggcatcgcgtggtcgctggcgtagccccttgacaccttgtcggaaaacttcgtgaagttcttcacaaggaattgggtcctgtgtcgtcaccggaggggtgccgttgctccctatgggggctcagcgggagagtgagggtgctcaggggagcgccgtacgggggg

SEQ ID NO: 1489 - DNA, 2246 bp, Unknown
  Kingdom: Bacteria, Phylum: Actinobacteria, Class: Actinobacteria, Order: Streptomycetales, Family: Streptomycetaceae, Genus: Streptomyces
cggtttgaagacggaccctagcgcttatatgcgaggagttggcagggcggggcgcttcacggaggcattcactcgtttacgtgaatggaccgaacgcatgaccgtgggggctttcttgctgggtagtctgcgtgcccggccggtccggcaggggccggtccggagcgggtcatgggggtgcggggatgacgaacggtccttcgaatcaaggtggcgggctgtctcggcgcaggctgctggcgtcgtcggccgccgcgggcggcggggtctggttgctgcgcgggctggtgcggccgggcagtgcctacgccgcttcggcaccgccgcccggcttcccggaggggatcgacgtctatcagcgcgcgtatgagaactgggccggtgagatccgtaccgaccagctgtggacgtgctcgccgcgcggccctcagcaagtgctcgacgtcgtcaactgggcctacggcgccggttggacggtacgcgcgcaaggacagcggcacggctgggctcccctcaccgtggccgacggcacccccgccgcgacccgggtcgtcctcctggacaccaccgcgcacctcaccgccatgtcgctggagcagcaggccgccgacggttcggccgcggtccgggtccaggccggcgcatcactggaaacactgctcgggttcgccggcgcggccggatacggggtcgcgtccgcgccggcgcccggtgatctctcggtcggcggagcgctggccatcggcgcgcacggtacggccgttcccgccatcggcgagcgcccgtcgcccggccatggccatggctcgctgagcaacctggtcaccgagttgaccgcggtcgtctgggacgagcaggccggccgctacgtcctgcgaaccgtcggccgggccgagcccgactgcgacgcgctcctcacccacctcggccgatcgctcatcaccgaggcggttctgcgggtgggcgccgaccacaatctgcgctgccagtcctttgtggacatccccgccaccgaactgttcgccgcccccggtgcgtcggccggcaagcggaccctggccggcttcgtggaccgcaccggacgggtggaggcgatctggttcgccttcacggaccgcccttggctgaaggtctggagcgtcgccccgaagcgtccgctcaccgcccgcgcggtcgacgaaccgtacaactacccgttctccgactccctgcccgagccggtggcccggctggccggagacctggtctccggggcgtgggcgagtgcgccgctcttcggacaggtccagtacctgctgaccaaggtggcgttgaccggcgacatcaccgacgtcctgctctcggggaccctcgtgcgggacgtactgaccggtgacgtgctcacccacctgctggccggcggactgcgctcggacctgtggggtgcgtctcgcaacctgctgcagtacgtacggccccgagaccgccaacggatacgccgtcctcacccgccgtgccgatctgcagtgggtcgtcagccagttcgccgacttctaccgcacgctgctgtcgcagtacgcggcgcgcggcgagtacccggtcaacggccaggtcgagatccgggtgaccggactcgaggacccggccgtgagcggtgtccccggcgcgcggcccccgctgctgtccgccctgcggccgcgccccgaccggcccgacgtcgacaccgccgtgtggatcgacgttctctccctgccgacgacgcccgccctgcaccgcttctaccgcgacatcgagcagttcctcctggccctcgacggcgggcgggccacggttcgtgtggagtggtccaagggatgggcctacgacgacaccgccgcctggtccgacccggacgtcctctcccgtgtcatccccgccagccagcgcgccggagggggccccggctgggacgaggcggtcgccactctcgaccggctcgacccccaccacgtgctgtccagcccgttcctcgacgtgctgctgcgctgaacgggcggaagggcatcggtctttccgcgcctcacgtggggacactccgtcgccggggccgcctgcttcggaggcgaggaggagggctccggacgagacccgcgtctcggccgccgtggcaccgctcccttgatgcccggccccaccgccaacgcgttcgtcaggtgcgcggctcagcccgctccggtgggccggcgttctccacccccggggtcggcgccaccgcggacaggccgtcg

SEQ ID NO: 1490 - DNA, 2830 bp, Unknown
  Kingdom: Bacteria, Phylum: Actinobacteria, Class: Actinobacteria, Order: Streptomycetales, Family: Streptomycetaceae, Genus: Streptomyces
ctcggggggtgggtgacaggtcggcgggtggcaggtcggttcgggcgcgtctggaacgccggcgggcggtcacccctccggccaccaggtgcgcgcgatgtccttgcggacctcgggccggccggcgggacgctcctcgggcgcctcgcggacccggcgggtgtccgtcttcctcaggggcttctgcactgtcacacggcgcatcggggcctccttcgacgtctaccgggttccgtgttcgtacggaggtagacctttcgggcgagagttgctcatcggtgcgggtctgtctgtggcggctgtcacgattcgggtgtcagtggcgcgtgtcactcttggggccatgggtacacgtacgacgaccgatggtgacgggaccggctggagtccggctgcagcggcggtggactgggacgctcaggcgcccgtcttcgacgacgaaccggatcacgggctgcgcgatccccgggtgcgcgccgcctgggcggagcggctgcgcgactggctgccggagagccccgccgagatcctcgacctgggctgcggcacgggcagcctgtcgctgatcgcggcggagcagggacaccgggtgaccggcgtcgacagctccccggccatggtggccctggcccgcgcgaagctcgccggccatgacgccgcgttcctcgtcggcgacgcggcggagccgccggtgggagagcggcgtttcgacaccgtcctggtccggcatgtgctgtgggcgctgccggatcccgccggtgccctgcggcactggcgggaactgctgcggcccgccggacggctggtcctggtcgagggcgtctggggcacggtcacgcccgtcggcatacccaccgagcggcttctcactctcctcacgcccctcgcacaccacacccgcgtcgaacacctgtcggatgacgcccggctgtggggcaaggaggtgacggacgagcggtacgcggtggtggccggcgtgtgagcgtggtggcgtgggccccggatcaggccagcagcgcgctgagggcgccctcgcgggccagcgactccagttcggcgagggccgccaccgccgcgccggccgccgcgggatcgcgctccgccaggccgctcgcggcgaactcgtcctcgtccaggcggcgtacgtccgtgccgtccgcggagcgccacaggtccaggtcgaggtcctccacgaccagctccgcacccgtgcgcacggccgggcgcgtgatgtcgcagtaccagcccttcagccgcccgtcgccgccgcggacctccttgaccgcgtaccaccggtcccgccagtagtactcggtgaagacgtcgcccggctcgaagcgcacgaagccgaagtcgcgtacgccggcgcccgcccacggcgcgcgcaccacgatccgtacgccgtcgtcggccacgagcgcgcccgtgtaacggatcttcgtccggccgcccttgacgaggacgacgtccaccgtgcccggctgctcaggcgagttcgcggacatagcgcacctccgtcgcgcacacctcgtacccgaaccacttgttgatcgcgatcatcggcccgttgccggtgtcgttgccggtgaacgcctccgtgatgccggccgcgcgggcgcggtgcagcgagtcgttcttggcgagcttggccaggccccggccgcggaaggcgcgcccggtgccggtcatgccggtgctgtagcgggtgccgccgtccgtgtaagccagggtgaaggccgccggacggccctcgacgaccgtgacggacgtcagctccgggttcagcagcggatgccgccaggtctcctccagccaggcctcgtagtcggtcaactccgcgccgacgtcgctgggttcgtccgccaccgtctccgcgtccagctcgaacagcgggcgcgggtcggcggcgtagtccgagccccggcgcagctccacgccgggcggggggtcctggagcggcgggagcgtgccctttgccaggtcgaggcggaggaagtgggcggagcggctgctgcgatagccgtgccgctcggcgaaggcgcggttgccgggcgagtccagcacccaggagtgcagccgcaccgcgccgtgcgcggccaggtactcctcggcggtgcgcacgagcaaggtgccggcgccgcgcccggtgtgctcggggtgcacgtacacgttgatgttgccctggccgggctccgggctctcgtgggccaggtgcacctgcgcggtgccgatcacctcgccgtccgccacggcgaccagcggacggtagtgggcgtcggggtgcatgcgggtgagggtgtaggcgatggactcgggggtgaacaggacgaacggcagcgcgaggcggcggacgcgggcgaagccctccaggtcggcgggcgcgccggggcgcagttcacggacgatcacggtcatgggcgcgcacgctacggggcggtaccggccgaccgcctcccattttccgcgggcccgctgctcggcccgccgccggtccgccgctcgatgcgcgggcgcgcaggagcgccggtgcgggacaatcaccccgtgaccttgaggatccatgtcgacgacggcgcaccgccctacgagcaggtgcgggcccagatctccgaacaggcgcggtcgggggcgctgccggtggggtaccggctgccgacggtgcgcgggctggccgagaccctcggactcgcggcgaacaccgtcgccaaggcgtaccgcgcgctggaggcggacggggtgatcgagacgcggggacgcaacggtacgttcgtggccgccgccgactccgccgcggcccgcgaggcggcggccgccgcccaggcctacgcgg

SEQ ID NO: 1491 - DNA, 3070 bp, Unknown
  Kingdom: Bacteria, Phylum: Actinobacteria, Class: Actinobacteria, Order: Streptomycetales, Family: Streptomycetaceae, Genus: Streptomyces
cggcgacggcgacgacgtagcgcatctgctggaggtccactcctccatcgtgccacgcattcatcgcgttggttcattgctgccatgacaaccatgctttggaatcatggcgggtccgccccgagacttgctcgcatgcattcctcgaccgaacgggcaccggggccggcccggacctcgctctcccgccccgggcaggtggcgaccgtcgcgctgaccgcgctcgctcccgcttcctggggcacgacctacgccgtgaccacgaagctgctgccgcccgggcatccgctgttcgccggtctgatgcgcgccctgcccgccgggctgatcgcgctcgccctcacccgtgtactcccgcgcggcgactggtggtggaaggccgccgtcctcggggtgctcaacatcggcgccttcttcccgctgctgttcctctccgccgaacggctgcccggcggtgtcgccgccaccctcggcgccgcccagccgctgctggtcgccgcgctggccgccgcggtgctgcacgaccggccctcggcctggcggctggcctggggtgtgatcggcgtggtcggcgtcggactggtcgtcctcggaccgcgggcccggctggacgccgtcggtgtgctcgccggcctcggcggtacggcgaccatggcgtgcggggtcgtcctcaccaagcgctgggggcgtcccgccggggtcggcccgctgcccctggccggctggcaactgacgttcggcgggctgctgttgcttccgctgaccctcgcgatcgagggagtgcccgggcggatcgacgcgggagcggccggcggctacctgtggctcggcagcatgggcgggctgatcgcgtacacgctgtggttccggggcatcggcagtctcccggtcggcgcgtccgcaccgctggtgctgctgtccccgctggtggcgaccgtcgtcggcctcgtcctgggcgagtcgctcagcctgccgcaggtcctcggtttcctgctggcgctggctgccctgctcgcggcccagctcagtccgccggacctgtccggcatccgcacgcgcacgcgtacccgcggcaggccggcgtccgaccacgcacgagcagaccggaaacccgcagacccgatacccgcagacccgatttcagaaggacggacacgatgaggtcccgtatgacgatcgccgtgctgggcgccaccggaatggtcggcacccgggtgaccgccgaggccgtggcgcgcggccaccaggtgctcgccctgtcccgcaagcccccgcgcgagcccgcgcatgcctctccccgggtgacgccgctcgcggtcgacgtacaggacgcctacgccgtgcgcgaggccctcaccggcaccgctgtacgcgccgccgcggacgccgtcgtactgagtgtgcgcaccgagcccgccgacgcggagttcctggtcggcgccacccgtacggtgctggacgccgccgcctcgctgggcatccgcgtcctcgtggtaggcggcgcgggcgcgctccgcagccccggccacgacggtctgctcgtcgcggacgatcccgtccacgtgcccgccgagtaccgtgccgtggccgccgcgggcgtcgctcagctgcgggcctgccaggcgcacgccggtgccgactgggtcctgctgagcccgccggccctgctcgggcccggtgcccggaccggccgctaccggcgcggcaccgacacgctgctcaccggcgccgacggccggtcctggatcagtgccgaggatctggccgtagcagtggtcgacgaactggagacccccggccgcgaaccccacatcaccgtggctcacgagacgcaggagccgggccggtagccgcagtcagcccccaccctcccccgccacggtcacgccgaactcagccgcgccctacagggtccgggtccccagcagctccgcgacctacagcctccccagcagctccaggacccggttgaccgcttcgacgaccggctggcccaccgcgccgacggtcgccgcgatggtggccacggcgatcagcgcgcggtgccgctcctgcggggcgctcgcctgggaggcgatcaccggcagggagtcgtcgatgacctgcaccgtcccgggcgtgacctggccgcgcagttcctggaggaggcgcgacaggtccccgatcgccacgaggaggtcctgtggcgccggttgcgccgtgccggagtactggttcttgacgatcccggtgttgtgcgtcccgccgtacatgttgaccgtgtcaccgctcacttcttcaacacccccgcgttgccgagaccgccgtacatgttgaccgtgtcaccgtggtactcccagcggttgagctgcactttctccaccagcacgtggagtttcttgtccgggttctcgacggcctccacgatggcgccgaccagccccatgagctgttcacggtccggcagcgtcaccagcgcactcgcgccgccggccgtgtcgatggccagtacgtgcttgttcggcgaggtcagcactctcaggaaccatccaagcagcacgatcgccaggacgaggctgaagacgaccagttccggcttcgccttcgccagtgagtacgcaaaggcgctcccgagcacgaagtacccgaaggccgcccaccgcttgggtttgagttcggcggtatagactctcacgacgttgtgcagtgggtaggcggcgtctccgagccagagcacccgcttgccgacccgtagatcgacgctcttgccttcaggcggcggcaccggcggcatcgccggcggcccccaggtccctttcgtctccacaagtcccccgtacgccgtgcggctccccgagaccgtatgggaaccattaagcatcgttaactcaccctttgaaaagggagagttgacagaaaccggaagccggatggctcagcatctccagtgagagtggtgacggacgtggtggccgggtgggagtgggacgacacgctgttcgcggggagtgcgccctactaccggcgcgggaggctgccctacgcgcccgggcctggaggactcgctggcccgggcgcgtagggcagcctc

SEQ ID NO: 1492 - DNA, 1512 bp, Unknown
  Kingdom: Bacteria, Phylum: Actinobacteria, Class: Actinobacteria, Order: Streptomycetales, Family: Streptomycetaceae, Genus: Streptomyces
ggcgggagccggtccggcaggcgcctgctcatcccggtcgccgacccggacgcccagcccgcggccgccccgtccgtagcgccggtgctgcccggccgcccagtgccccagcgcccccagtccgtacgggcccccggcgaggaactcggcgccgacggcggtctgccctgcccctggtgcggcacccggaaccgtccggagcggcacttctgcacgcgctgcgcgatgcccatggccggtgaccggcacgcaccggcacggctgccctggtggcggcggctgctgcggggcggcaaccgggagcagccgtgggccggcgaccgcccccggctgcgccgcgccttcgaccgcgtactgacctggctgggcgcggcgatcgtgctgacgctggtgatctggctggccgtgcagatccccgacggcgtgcaggcgacccgcgaccacttcgccaagcgcgcgacggtcgcccccgaccgggtcagcgcctcccgctcgttcccggggcacaagcccgacctggcgttcgacaagatcaacaacacctggtggggtccgggcgtctcggagtcgggccagggccagtggatcgaggcgcgtttcgacgagccgacgcgactgctgaacctgatcatcacgccgggagtgtccatccgccccgaccagctctcccagtcggcgctcccgcaccgcatcgaggcccggatcaccctggccgacggcaagaccacgacccgtgaactcgtcctcgaccagggagcggggccccagacccgcccgttccgcgtcggcaaggtcacggcggtccgcttcaccatcgagtcggcgtaccagccctcgtcgaccaagcaggtgtccatcgccgagatcgagttcttcggcccgtcgaacgcgagcagcagctgaccgagagacccggaagaccgccgacgaaccgacagccggcgaaccggccccgccgggacgacagtcggcgaaccggtccgaccgggacgacagccggggatcgaagccgacggcagagcgtcgagcggctcgtcccccggctgtccccccggccgtcgtcctggcttcagcctgccgtcaggcccggaagcgtggtgaggaagacggtcatggcggcgagggccgccgacaccgcctcacccgccgtaccggccggcccctggcgggcggccacctctgccatgcggggcgcggtgaccgccggatcggcgtccggcagggcgagggcgtgcaggcccgcgtggtgcagcagggtgatcagctccgccgtccgcccggacggccgtgccccgtccactaccaccgcggacagttcgccacgcagtgcctcgggcaccgacgggtccgtcaccgggtaccggtgggagccgaagacgccgagcgtcttgtggccctcccggcgcaccagtcccttggcgagcagcccctcgtaggcggcggtgaccgcctggtcccgcgccccgagcagccatgcctgcggctcggcctcggggtgctgccgcatctgcc

SEQ ID NO: 1493 - DNA, 1272 bp, Unknown
  Kingdom: Bacteria, Phylum: Actinobacteria, Class: Actinobacteria, Order: Streptomycetales, Family: Streptomycetaceae, Genus: Streptomyces
gccgccccgcgcggccccgccctcaacctgcgcaacccggtccacgccaccgagcgcgaactgctgaagctcgccctgcaacgcccggagctggtctccccggccttcgacgcgtacggcgtggacgagttcaccgccccgccctacgcggccgtacgccaggccatccaggacgcgggcggcgccgagtacggcacggccgacccgcaggagtacctggtccgcgtccgcgaggccgcccccgacgacacggtccgcgcgatggtcaccgagctggcggtggaggcgatcctgctccgccgcgaggtcgacgagggctacgcgggcgcgcaactggtgacggtccgccgccgcgccgtcgaacgccgcatccgcgacctctccagcaccgtcgcccgcctcggcaacggcggcgaccccgcccacctggccgccgcccagaacgaactgtggatcctccagcagtacgaccaggccctgcgggagcggggcgcgggggcgctgtgaggggacccgggctactcctgtgaggaccgcccggacggggtgatcccgaggtgctccgtgatcgcctggagatgctccatcatggccacctggccggacaccagcgccccgagcacgttgccgtgctcggccagcgtcctggtgtgcgccgccagggccacgctgtgctccaactgcgtcgtccgcagcgcctgcatcagctgcacgtcggcccgccgctgctgctgcaacgcggccaggtccggtccgagttcacggcgaggtgccgtgtcgcggcccgctgctccgccagcccgtgcacctcggcctccagcgcctcaagacgccgccgcagctcctcgatctcgcccatgcgttccatcctgcctcatcacggagcaccaccccgtcggtcgatccgactgccgaacgacccgaataaccgcccggtaacggaccggacgcaaaaagtcaccgcacgcccctcgtggcggcgttgtgtcgtaccccacactgggggccggtgcccgagttcccggagtgcggccgggccgtcccccacggggtccctcccggcggccgtgctcctcgcgtacgggacgggcggcggcgtgcccgccggccccgtcctcccgagcagcgctgcggcacaggtcagcagcgatcatcctggaggtcgcccgcgtgcagacccagaccctcactcctaccgacagcgccaccgacctcgtcctggccgcggccgtgcccccgcaggaccgggtcgcgcacgaccgggaggcggcc

SEQ ID NO: 1494 - DNA, 1862 bp, Unknown
  Kingdom: Bacteria, Phylum: Actinobacteria, Class: Actinobacteria, Order: Streptomycetales, Family: Streptomycetaceae, Genus: Streptomyces
gcctgcgagggggccggcccaggcgtcgtcgtcgtccggcttcgcggtgtcggggccggggccgaagtaccgctcgccgtacgccgccgtccgcagcccggccggcttcagacggccggcggccctgagggcggcgaccgggtcgatcatgccgaagccgcgggagtcgtcacgtccgccgaccggggcgtcgcgggcggtgtcctccaggagcttcttgatctgcgcgggcgtcaggcccgggtgggcggcctcgacgagggcgacgacgcccgagacgaaggcggaggccgcgctcgtcccccagcccttgtagtactcgtggtccggctcggcgatgacgatgtccacgccgggcgcgctgacggtggcgtaccagcggcgggtggagaaggcggcgcgggtgccgtagcggtcgacggcggtgaccgcgatgacgcccgggtaggcggccgggtaggagacgtggtcgcccttgtcgccgccgttgcccgccgaggcgacgacgacggtgcccttcttcagcgcgtactggacggcctcgtcctcggcgggctcggggtgtgcggagtccgagtcgtcgccgagggagaggttgatgacgtcggcgccgtggtcggcggcccagcggatgccttcggcgagcgcgttgccgcgggtggtgcgggcgcgggcgcgggccttgtcgccgtcttcgaggatgacgcgcacgggcaggatcctcgcctcgggggcgatgcccatgacgccttcggcgccgccggggccgtggccgtgtccggcgatgatgccggccatggcggtgccgtgccgcgcccaggtgtcgtcgccgcgccgcgcaccgaatccgatcaggtccttggggggcaggacgttgcctgcgaggtccgggtggtcggtctcgacaccggtgtccaggacggcgacggtgatgcccttgcccttggtgaggcgccaggcctgctgcatgtgcagggtgtccagggcccactgctgggcacggatgccgtcggcgtgcgcggcggtggccggtacgagggccagcgaggccgcgagcagcacgctcaggacgccgccgcggcgcgtgagggctggtttcgctgccccggggacgcctgcgcggacgttcgccggggcgttcacggggtcgttcacgagggcttctccgtggcggatcctgcggccttgcggaaaccgcgctcgatgcggtcggccaggccctgcgcctcgttgccgagccctgcctgggcgacggccgtggcggcgcccgccttcgtcgcgtcggcggcgggctgcggtgtgtcgacggtgcggccgtcggcccagccggagactgcgtagacgacgacgggggcctcggtcagcacggagacggtccaggaggcgcgctggcggacgccgaaggaggcggcgacggtgtccttggccgcgtacgggcggggcatgaggtccgtacgactgccgagcccctcggccttgaaccgggcggccagagaactcatggcgggcgcgtcggccgtggtgaacagcaggcccaccgtggtgacgaagctctgggtcgcgtccgtgtaggtggcgcgcagcaggcgggagcagccggccggcgcgagggcctcgcgcagcagcgggtcgaaggcgtccgcgcagccgctgtcggcgacggcgacccgggtccaggtgcggtcggctccgccgggtccggcaccccggccctcgaccgtgggcgggaagagctggtcgaccggggtgctgtgccacagggtgccggccgtggcgaaggacccggcggtgccgctgacgcccgtgtccccggtgagccagctgccggtcgcggcgccgccgatgaggccgagcccgaggac

SEQ ID NO: 1495 - DNA, 5222 bp, Unknown
  Kingdom: Bacteria, Phylum: Actinobacteria, Class: Actinobacteria, Order: Streptomycetales, Family: Streptomycetaceae, Genus: Streptomyces
ggctccggggttgcggctccggggttgcggctccgctcgggcagggggcacccgggcacccctcaccgccggtgacgtcctcaccggcggccgcgtaggaaggcagctccccatgagcgccgtacagggacagaccgtcgagatccccaccgaggacggcacggcggacgcctatctggcccaccccggggacggacgtccgcacccggccgtcctgttgtacgtggacgcgttcggtctgcgtccgcacatcaagggcatggccgaccggatcgccgccgccggtcacaccgtgctggtgcccaatgtgttctaccgtcacggccgggcgcccgtcgtggagttgccggagttcatcgacctgtccgggcgccctgagatcttcggccggatcatgccgctcatccagtccctgacgcccgaactggtgcggcgcgacgcgggtgcctacctgcggatgctcgccggtcaccccctggccgccgacgggccggtggccgtgaccggctactgcatgggtgcccggctgtccctgctgaccgccggcgcgtacccggaccgggtcgcggcggcggccggcttccacggcggcgcactggccaccgacactcccgacagcccgcacctggccgccgggaccgtcaccgcggagctgtacttcggacacgccgacaacgacccctcgctgccgcccgagcagatcgagcgcctggagaacgcgctcaccgaggcgggcgtccgccaccgctgcgaggtgtacccgggcgcctcgcacggcttcacccaggccgacaccgacgcctacgacgccaaggcggacgaacggcactggacggccctgctcgacctgctgcagcgcaccttcggctgaccgacgggcagtcaggcagcccgtaggactcagtagttggcgggcgggacccttaaccgggttccgcccacccgcctgccgtgcgcggtgcgcaggttgttacggtgcaccgcgtgtctgactcctcacgcgataccgtcgaaggcgccggctggaacgacgccgaacgcggcacctacggccggctgatgccgggccgggccgagaagctgtcgtggctgaacccccggacgctgtgggccgcgcgcaacggcgtggccgcgtcctggttcggggatcccacggggcagacccggtcgcggtgggtggcgcagcgggcggccgccggcgccccggcggacaaggtgatccggcgtacggaggcggaccgcttctccttcatggtcatcggggacaccggcgagggcggcgattcgcagtacgcggtcgtgccgggcttcctgaaggcctcccaggacacgtcgttcgccgtgctcgccagcgacgtgatctatcccgtcggcagtacggacgactacggcacgaagttcttccggccctaccgcgactatccggcgcccattttcgcgatacccggcaaccacgactggtacgaggacctcggcggcttcatgcgcgtcttctgcgacgacgcgcccccgctgccgcccgcgccacagccccgtgcgctgagccgtgcctggtggcgggagctgctgtggcaccggccgcgcccggccgacgagcaacggctcgccgaggcacggaagttgcgttccgctccggcgcagcaggccgcccagccgggcccgtactgggcgatcgacgccgggccggtgcggatcgtcggcatcgacacgggtctgctcggcaccctggacgcggagcagggcgcatggctccgggaggtgtcccgggggccacgcccgaagatcctcgtcaccggctcaccgctgtacgtggacggcgagcaccatccctgtcccatcgacggcggcggcaccgtcgacgacatcgtccgcgacccggcccaccgctacgtggcggcgatcggcggtgacatccacaactaccagcgctatccggtggacgtggacggccgtacggtgcagtacgtcgtctccggtggcggcggcgcgttcatgcacgccacgcacaccatcccgcgggtgtcggtcgcgaacgtcacggagtccgacttccgctgctatccgctgcgcggcgactccctggcgttctacagcgccctctacggacgccggctgcggctgcgccgcttcttcacgctcaccgaggcggaggggatggccgtgatcgccgagcggctcggcataccgcccacccgggcgccgggcggcccggtccgggtcacccggcgggtccgcctggtcgcgagcctgctgggcgccggccgccggcccgaccgccgggcgcgtctgcgcctcccggtgcgcaagatctacacccggctcttctcgccgggttcggtcacgtacagcccgccgttcttcaagtcgttcctgcgcctggacgtcagccccgaggcggtccggctgcgctgtttcgcggcgaccggcaaccgcgcgcaggaggtcgacccgccggtcgaggacgaggtgaccatccccctgcccccgccggtctgaccgggccgccggccgtgcctcaccagcggcccggtgcgctgccggtgagcggttcggagcgacggccgtccactcctgcgggtacgtcaccgtgcagcatcacgcggtgcatgatccgcgggaagccgaggtgggcgttgtcggtgggtgccaggtggatggtggcccggttgtcccagaaggccacgctgcccggctcccagcggaagcggaccgtgtactcgggccggacggcctgctcgaggaacatgccgaggagggccgcgctctccgcgcgggagacgtcctcgatctgctcgacgtagtagccgttgacgaacagcacccgctcgccggtctccgggtggacccggaccagcgggtgcaccgtggcggtctgccgctccagcaggtggcggacgtacgcgtcgtcgccgggacgcggctggtagccgacgccgaggcggtgctcggcgcgcagcgtgtcggcgaaggcccgtacgggggccgacagcccggcgtaggcggcggccaggttggaccaggtggtgtcgccgccacagggcgggacgctctcggcgcgcaggatcgtcgcggccggcgggtcgatccgggcgccgtggtcgcagtgccagccgcgcagcagggtgtgccggcgacgccggagccactcctcgtggtccatgccgtaccggccgcccagctccagccggtcggcggtcgtctccacctcggggacctccggcggtgacgcgccgccccgccggcgcaggacgaccggctcgccgaagcggcgggtgaacgcgacgtgcccggcgtggtccagccgctgcccgcggaagaacaccaccttccagcgcagcaccgccgcgcggatcgccgcgaccaccgcgtcgtcgaggtccccggccaggtcgacgccggtgatctcggcgccgatgtgcccggcgaccggtttcacctccatcccgtccgtcgccgtgccgcccgctgtgcccgtgtccgccgtcatccgcgctccgatggtcgtccgtcacgtcccagtgagatcgtgacaggcgtcgcggcggacggcgacagggcgtcaccccgcgaactcccttgtcacaccgagaactcccgtatgaccgtgtcgcggaacaccgccgtgccgccggcgctgaacagggcgagccggtcgtcgaccagataggggaacacctccgtggagtgcacgtagcggccgtcgtccacgaacatctcgaccgaggtgcggtcgacgaggatgcgcaggcgcaccgagcgtgcggaggcgtcgaggggcgtacggctctcctgccacttcccggacgcgtcggggttcaccgtggcacggcggttgaggaagacgtagtcgtcccagatcccggcgtcgatgtggcggttgccgtccggggagcggcgcagttgcaggcccgcgccggtcagccggtcccaggtgatctcgcagctcacctcgtaggagatgcccgtgtggtccagcaggcgcgtcccgtcgacggtcaggtcgcccaggcgcacggtgcgggagacgtgggagtccagtgctgcgacgggccgcgaggccaggtagtacgtaccggaggagtcgcggtccagggcgacctcgcggacgatcgagtcggtgccgttgaaaccgtcgcagtcgatggtgggtgtggtgtgggcgtagtcccagttgttcagccagcccaacgcgtaccgtgcggcggggtcgggcgtgccgtccgcgcggtgtttgtcgaaggtgacgcccgcgtaccagtcccagccgtggtcgagccactgcgggtcggtggcatcggcggtgaaggcgccgccgtcgaaggaacccgtccagtaggcgtaggtgttgggcagcccggccggtttgccgttggcgctcaggcccagcacccacttgacggtgccgtcggacgcggtgacgcggaacaggtctgggcattccaggacgccgatgccgcggtgggtgaactgtcccgccggggtccaggacttcagatcggcggagtggtagaagccgatggtgtcgttctgggcgagggccatcacccaccggccccgctcctcgtcgcggacgaccttggggtcgcggaagtcggccacgccggggttgggcaggacgggttcgctgccgtacggggtgaaggtgcttccgccgtcggtggagtagtacaggaactgctcctggtggtcggtgccgccgcccggtgacatggtgacgaggacgaccaccgcgcccacgccgaagcccgccgtgtcgtgcgtgtccaccacggccgagcccgaccagaggtcgccgttgggagtggtgtccttgggcacggcgaccccgcggtcccggaaggagaccaggtcggtgctggtggccaggcgccaggcggtcccgacgtcgccggccaggtagtccgcgttgtacaggtagtagtagtggtattcgccgtcgatccacagcgggcgctgcgggtcgttcttccactggtcggggaccgtgaagtggtatccggcacggtagcgggcacagcctccggccgccgtcggacggccgggcctcgcggcgcccgggtggccgggcctcccctcgcccgggcggaccggctccgcggcggccggggccgcgggcagcagcaccgccgccgtccccgcggccgttccggcgaacagcgctcttctggacatgtcaggtaccacgcgtcgattcctctcctcgggcggcttgctcgatgcgc

SEQ ID NO: 1496 - DNA, 4174 bp, Unknown
  Kingdom: Bacteria, Phylum: Actinobacteria, Class: Actinobacteria, Order: Streptomycetales, Family: Streptomycetaceae, Genus: Streptomyces
ggccgcgaacggctcgctgctcagccgggtcggcagcgccgagtggaacctgctgaccggcgcggccgactggtccgccgagctgtaccggatcctcggccgcgaccccggcgtccgcaccccgaccctggacgaactgccctcgctggtgcacgaggaggaccggccccggctgaccgcgatggtcaccgactgcctggtcgacgcgcggccgatcgacggcgagttccgcgtcgtacggccggacggcacggtccgcaccgtgcacatgatgggcgaaccggtgctcgacgccgacggcggcaccgcctccatgtgggcggtggtgcgggacgtcagcgaactgcgccgcagccagtcggcgctgcgcgagacccgtgactcgctgcagtgccaccggcagccggcgcagagcgggcaccggcccgcggtcgagttgcgggaagccgtgccgcccccgtggcacggctccccgcggctcccgcaccgaggccgtcaggggctcgacctggcggcccgtcacctgaccgcttcctccggctcggtgatcggcggtgactggtgcgacgcgctggagctgtccgacggcgacacactgctcggcgccggcgacctcaccggacagggtcccggcgtgacctccgccgtcgccatgctgctcggcgccctgcgcggaatggccatgacgggcgccgggccggcccaactgctcatctggctcggccagttgtacgacagcaccctccagcccgccccgggcagcgccgtctgctgccgctaccggccggccgcccgcaccctgacctgggcgcaggccggacaccccgccccgctgctcttccgcgacggggcgggccggcccctggacgcgccgagcggcgtcccgctcggcgccgcccccgccgccggttacgggcaggccgaggaggccctccggccgggcgacctgctccttctgcactcgggcgcactggtaccgggacacgacgaaacggcagccgtgaaccgcctgctgggtctcgcaccgcgcctcgccggggcgcgcagcgcgcgggacggtgtgcgcacgctcctggaggagttcggcacggcggtgcgcgaggacgacgcctgtgtgctggtcgccagggtgacgccgtagccgacgcctgtgtgctggtcgccagggtgacgccgtagccgacgccggctcgggcgtgcgccgggtgcactgcccgcgctctcctgcgccggtgtgcctaccgtgctcctgcgccggtgcgctgccggtacgtctacgccggtgcgctgcccgtgcccttgctcctgggccggggcagggcgagctggatctcctcacgcagctcgtggatcttcgggtaggtggcgtactgcgcggtgagccggtacatctcgcgcagccggtcccaggtgcgccgggaggagttcgaccccatcgacatcagggccagccgtgcgtagcggtcggcctgttcggggtcgtcggcgatgaagcaggccgacgccatggacaagtggtcgaagatcttcgaccgttcgcggccgtcgatcctcagggccagtgccttctgcgcgtagtgctgggcgtgcacggccgcgtccgggtcgaactccgccagcgtgcggtacgccagtgcctgcatgccgtacaggtcctcgtccttgaaggtctgcatccagggcagcggttcatggttgccccggtcggcgacgaacaggtcctccgcctggccgagcgtgcggcgcatcgcctggcccttgcccatggaggcctgcgcccaggcctcgatggtgtggaacatcgccctggtgcgcggctgcagcccgtcgccggagccggactgggcgagcttcatcaggtccagtgcctcgtcgggacggcccaggtgcaccatctggcgggccgcgcgggagagcgcctcgcccgcgcggggccggtcgccgccctcacgcgcggcgtgggtggcgatgacgaagtacttctgtgcggtgggctccaggccgacgtcgtgcgacatccagcccgcgaggacggcgaggttggcggcgacgccccacaggcgccgctgcaggtgggcggggtggcggtaggcgagcatgccgcccacctcgttgagctggccgaccaccgccttgcgctgcagcccgccgccgcgtgccgcgtcccaggcccggaacacctccaccgagcgttccagttcgtcgacctcctccgcgccgaccggggcggcgtcgtagcggtcgaagccggcggggtcggtgtgcagggggtggtcgaggtcgggggcgtcggccttcagggtcggatcggtgtgcagccagtcgtgcatggcgccgctgagtgctgatcccgtggtgagcgcggcacccgcgcccaccaagccgcgtcggttgagcatgaggtccattcccgtgaattcggtgaggaccgcagcggtctgctcgggcgcccacggcatgccgtcgggatgttccacgtcccgctcgccctgccgtttccccgtacgcccgtgccgtaccagaccgaggtcctcgatggtcacgacacggccgagacgctcggtgaacagggccgccagcacccgcggcacgggatcgcgcgggatctctcccatgtcgatccaacgccgcacccgggaggtgtcggtcgccagctgcgggtggcccatggccgccgcctgccggttgaccagcctcgccagttcgcccttggaccagccggccaggccgaacagatccgcgagacgggtgttggattgtcctgtcacgtcaagcccccaggtactcggctgagttgacagtagacccggtgagagttgccgggcgactattcgccagggttcgccagggtgcgccagatggtgtgccacggggccaggggtgtcaggtaggaacgcgccaccccgacccggtcgccgagggacattccccagggtgcacccgggcggccgggccgggcagcgcgcttcgagcaggcacacgaagggatctgtctctctcatgtacgcagcatcgtcctccgtgtccgccccgccccggccgctgcgcgcccgtccgggcaccgggggcccctacctcgaccccgcgcgtccggcgggacccgtgctcggtgtgggccggccgcggcgcgccgcggggctcggcacaccaccgctcagcgggagactcgacctgtccggcccgcagggcgcccaactccgctcggcgctcgcgtccgtgcagcggatctgcccggagttcgctcccgtgcaggtgctgcgccgcagcgcccggtcggtgctcctggtcggcacgaccgggcgcgccacggccgtggccaagtgtttactggacccgtcccgtgaatgggccgagcggtaccggcacgaaatagcggcctaccgttcgttcgtccggcaccggcccccggtccgtgtgccccggctgatcgcggcggacccggacaactgcacgctggtgatcgagcgggcggcgggtcgggtggcagcccttcagcgccacccggcgcagaccccgccgcgggcggacatcaaggccgctctcggcgcgatctgccggctgaacgcctggcgccccccggcgggcaccttcgacgccccgctggactacgccgcccggatctcccggtaccacgagctgggactgctgaccgaccgggacatgggcgacctgcagaagctgctgcacggcatcgcgcacgcggcgggccggcagggcatgggccagttctgtcacggcgacgcgctgctctcgaacatcctgctctcaccggccggtccagtgctggtggactgggagcacgcgggctggtacctgccggggtacgacctggcgaccctgtggtccgtgctcggcgacgcgccgatggcgcggcggcagatcagccaggtggcccagacgaacgggccggcggcgcgggacgcgttcctggtgaacctgatgctcgtcctcacccgtgagatccgcgcctacgagacggccgtgcagcgttcgatgcacgacgcggccccgacgccgccgggtacggcccacccggctgccgcgccgtccggcgaagaacagcgactgctgctgaggcggctgcacgacgactgccagctggcccggcgggccgtgcgtgcggcggtcggcacccgctgacgacgacgatgggccgcggtgcgccgctgtgaca

SEQ ID NO: 1497 - DNA, 2469 bp, Unknown
  Kingdom: Bacteria, Phylum: Actinobacteria, Class: Actinobacteria, Order: Streptomycetales, Family: Streptomycetaceae, Genus: Streptomyces
gtcatgtcctcgccgtgtccggcggcggggacgagggccccggcgagcgcgaggtagggcacggccaggacgccgagcaccgcgccggcgccggcgtcgccgaccgcgcgggaggcggcgaaggcgccggccacgagcagcagggcgaggacggccgcggcgaacgcgcgggccacggcctggccgggcaggcagacggtgagcaggcccgcgaggagggcggcggcggtgaagccgagcaggaggcggcgggtcagcgcggggcgccaggtgtcggggcggggccgcaggacgtcgccgatgccgtcgacgaggtcgtcgaagtccacctcggggagtttgtcgtggcgggcgcgcaggtagaggacgtcaccgtcgcgcagttcgagggagtcggcggtgccttcctcgtcgagcggggcgccgccgagccgctggagggtccagccgccgtgttcgaggccctgttcgtggaggtcgtcgccggcgtactcgacgagcaccggcatcagatccacgaggggtacgtcggcgggcacgctcaattcgaaggatcgggccgggcctctgacggatattcggcagaggccgacggtcttgtcgctcacggttgctcgattcactcccgcctggaattcaagcgcggtccgactcgggaacggaggcacactatcgcgcagccgtatcagtatgatcaaccgacaagtcgcgtcggcggtattcgacttgcccgcggacgcgccgcttgcacatgaccacgcatgacctcatgccggtcgccgtatgaccgtatgtcgctttccgtagggcccgcaccgcttcccgcagggccctcactcctagccgggagccggtttgagcaccgtcacgttccgtcggcccccgcgccgggtgggcccgcagatgccggagggagagctggcgctccaggagccgcccgccctccccgagccccagggcgccatgggcggcctcgtcacctacctgccgatggcgctgagttcactcggcatggtcctggtgttcatccgccccggcgagggcaacggtgtgctgatgtgggtggccgtcgccatgatgggcgtgtccgcggtcgccatgctcgtcgcgcagttcctgcgggccgcgggcgaccgcaagcgcaagctgcgcgccgagcgccgtgactacctgcgctacctggccaccagccgcaggcgcatccgcaaggtcgtcgaccagcagcgcaaggccctcgactggcgccatccgcgccccgaaaccctggcgtcgctcgcccgcaccggccggctgtgggaacggcggcccacgcacgaggacttcggcgaggtccgcatcggcaccggcgaccagcagctcgccctgacgctcaccccgctgtccacccggcccgtggaagacctggagccgctgtgcgcgcacgcgctgcgccggttcatccacacctactcgaccctccgcgaccagcccgtggcgctgcggctgcggtccttcgcgcgggtgctgctcagcgccaaggacgaggaccgcgaggtctcccgcgccctcgtccgcgccgccctggcccaactggtcaccctgcacgcgccggacgagctgaccgtggccgtggtcgccgacggcgacggcgcgccccactgggcgtggaccaagtggctgccgcacgtccagcacccctcggacaccgacggggcgggctcggctcggctcatcgcggagtccgtctccgagctggagccgctgctcggcgaggagttcacggccagagggccgttcgagccgggcgcggaacccggccgcgacgagccgttcacggtgatcgtcctggacacggcgaccgtgccggccggtgcccggctcgcggaggccggctaccgcaacaccgtcgtcctcgacgtgcgcgccacgctggaggcggcggcgcccgcccgcggcacactgcggctgcgcgtcgaggcggacgcgctggccctgctgtccaccacgccggacggaaagcccaccgagacgccgctgggccgtcccgacgcgctcggtccgcacgcggcacgcaccctcgccatgggcctggccccctaccggctgggtgccgccgtccgttccgaacgcccgctccaggaggacctggagctgaccgacctgctcggcatccgcgacctgcactccgccgcggtcgccgaactgcaccggccgcgcgcggcgggtgaacggctgcgggtgcccatcggcgtcggcgcggacggctcgtacgtcgtgctggacctcaaggagtccgctcagggcggcatgggcccgcacggcatgctcatcggcgccaccggctccgggaagtccgaactgctgcgcaccctcgtcctcgcgctcgcgctcacccacagctccgagacgctgaacttcgtcctgaccgacttcaagggcggcgcgaccttcctcggcctggaccggctcccgcacacctccgccgtcatc

SEQ ID NO: 1498 - DNA, 607 bp, Unknown
  Kingdom: Bacteria, Phylum: Actinobacteria, Class: Actinobacteria, Order: Streptomycetales, Family: Streptomycetaceae, Genus: Streptomyces
gtcgagggcaccctcggccgaggaagcggtcgacctgctccttgagtcgggtcgcgcccccggggaggtgctggtgatcaccacgggcgacccgcacccctgggccgtccacgagttgtccttcggtgaaacgtcctactgggcgcagcacgacgcgggcgacgacgtcttctacacggacgccgccggaacctcccgtgccgtctcccgccctgtggtcgtggtcgccgtcaacggcggcaccgacgccgctgtcgccgccgccctgccctcggcccacacccgggccggagcgctgctgatcgtctgcggtgacccgcagcagatcaactcggtgctgggcgtcagcgtctgaggcgtttccggcacgtcgggcgggggcttcggcatatcggccggcgtttccggcacgtcggccggcacccatgcctgtccggcgcccggcatgcctcgcccgtccggcccgtccggcgcagagggtgacagccgtcgtcgcggaacaccgcgcgcgacggctgtttcgatacgtgcgggtggtccaggggcgcccgaccgccccggggcgttcgtgcgcttgaggtgtggtgcgcgggcgcggcgggtccgt

SEQ ID NO: 1499 - DNA, 4031 bp, Unknown
  Kingdom: Bacteria, Phylum: Actinobacteria, Class: Actinobacteria, Order: Streptomycetales, Family: Streptomycetaceae, Genus: Streptomyces
gcctgaccctgcacgggcggcagctgccgcagccgcccgtgcagggtcaggctgtagagggcgatgaagagggcgacgtccgcgcggagtgcggcaccgagggaccactggaggacgaagacggccgtgacggcgccgaaggcgacggccggtgcccggcgccgccacagcagtggcagcaccagcccggcctgcagcgcgaggatgccgggtacgggcagccgggtgaacgccaggcgcaggcggcgcgggccgtcgtcgtccccggtgatcacgccgagcgcgtgcagcaggtccggcaggcagaacagcaggaagaccaggaccaccacggtggtgtccagcacccagggtcgggcccggtcggcgtgccggaaccgctggccggcccggccgagccgggcgaccagcggtcccatgccgccgaggtcttcggaggtcacggacgtcacggaggtcaccggaccatcatgcggcggctgccgctcagacgtcgctgcgcagcagccggtacgccgcaccggccagcgccagggccgtccagccgaggaagaccagcagcccggcgcccggcgacagggtggtcgagtcatgggtcagcgcgaagaacgactcaccggcgtggctcggcaggtacgggttgatgtcgccctgccaggagctgggcagcagggagaccagcccggggacgagcatgagggcggcgaccaggaccgagatgccgcctgccacggagcgcagcagcgcgcccagcgcggtgccgatgacgccgaccaggccgaggtagagcccggcgcccagcaggctgcggaggacaccggcgtggccgaggcccatggcggcgggcgtgccggagaccacccggctgccgatgaggaaggcggcgaacgcgccgacggtggcgatcaccagcgcgacgagcccgtacacggcggccttggaccacagcacgggcagccggcgcggtacggccgcgagcgtcgagcggatcatgccggtggagtactcgcccgccgtgaccaggacaccgagcacaccgagggcgagctgggcgaagttcgtaccgaagagggacaggctcacggcgctcgcggtggcgaagtcacggtccatgggccggccggagccgagactggacttgtagtggctcgcggcgatgacgccgaaggcgacgaggaacagcaggcccaggccgagggtgatccaggtggagcgcagggaccagagtttcgcccactcggaggccagcacgcgccgtccggtgacccggtaggcgggccgggcggcgggagcggcgggggtggtcccggcggtctcgtgggtggctgtgaggctgctcatgccgcgctcccggaggtctcgatgccggcggtcccggtgccggaggtcccggtgccggtcgtcgagccggcggtgccggtcgtgtcgcccgtcgtggagccgtggtactccacggcgtccctggtcagttccatgaacgcctcctccagcgacaccgccttggtggtcagttcgaacaacgggatcccgtgctcggcggccttcagcccgatctcgcgggcggacgccccggtcacctgcagttcctcggagccgatgcggccggtgatctccacgcccggcccggccagcacctcgcgcagccgcgcgggatcgtccgtcgcgacccgcacggtgtccccgcccgcctcgcgcaccaggtcccgcacggtcgtgtcggccagcagccgcccccgccccacgatgatcaggtggtccgcgaccagcgcgacctcgctcatcaggtgcgaggagacgaagaccgtgcgcccctcggccgcgagggcggtgagcaggttccggatccacaggacgccctcggggtccagcccgttgacgggctcgtccagcatcacggtctgcggatcgccgagcagcgcggccgcgatgccgagccgctggcccatgcccagcgagaaggcgccggcgcgcttccccgcgacgctgccgagaccggcgagttcgacgacttcgtcgacgcggcggcgcgggatgccgtgggtcagcgcgagcgccctgaggtggttgtgggcggagcggcccgggtggatcgacttcgcctcgagcagcgcccccacctcctgcagcggggcgcggtggcgggcgtagcgctgcccgttcacggtgacggagccggccgtcggcgcgtccagtccgacgatcatgcgcatcgtcgtggacttgcccgctccgttgggccccaggaagccggtgaccgtgcccggcttcacggtgaagtccagaccgtcgacggctgtcttctccccgtacctcttggtgagctgctgtgcctcgatcattcgcgtgctctctttcggactccggcgtccggaacgcccgacgcctcctccgtcacgttaagtccgggatccgccggatccggtggtaccggggacgcaagagcgcggggcgggtggtaccggggtactacgaccctgctgcgtccccgcgccgggccgcggagcggcagcggggctgcgcggcaggcccgggtgccggtccgacacgcggcctgacctgctgaccggcccgggttcaggaggtgtgcgcgctgggtgtgccacggtcgacgggcgcggccaccgtcggcggtcggctcgtcgcacagggtgctcgtcccggctgcggcgcgagcgccctgtcgcctgaccggacaggagtcaccgagttggagcaaccggaggttctcaccgacctcgacgcggcgggcacgccggggaccgccgggtcggtgatgaagaagctgcccgaggccaccctggcgttctgggtcatgaagatcgccgcgacgaccctgggcgagacggcgggcgacctcttcgcgcagaccctgaagctgggctacttcctcaccacgatcgcgctgttcctggtcttcgtggtgacgttggtggtgcagctgcgctccagccactacaacccgttcttctactggaccgtgatcctgtcgaccagcatggccggcaccacgatgtccgacttcatgaaccgcgacgccggtgccaggtacctctcgggcggcgcgaccaggctgggctggggcccgcagggtctcggcctgggctacccggccggggcggcgatcctcgtctcggtgctgctggcggtcttcctggcctggaagctgagcgggacgacgttccggatcggcgacatcgtcaccttcaagggcgaggccttcttctggtcggcgatcctcgtatcgaacaccctcggcacctccacgggcgacttcctgtccgacagctccggcctcggctacggcggcggtgcgctgctcgtgaccggggcgctcgccctgctcgccgcgctgacgaaggtcccggcggtgccgaacgtcctgctgttctgggtcgcgttcgtcctcacccgcccgctcggcgccaccgcgggcgacttcctcaccaagccggtcaccaagggcggcctggacctcggcaccgcgggctcctccgccgtgctgctcgccgtcctgttcgggctgatggcctgggcccaggccaaggagcgccgggccgccgccgtggcgtgaaccggaacggcggcttctgtgcggggcgcggaaaggggcgcccggtggccgatccgccaccggacgcccctcacccgtgcgtcacttgctcaggtaggcccagaactcgtcgaaggacaggaccttgtcgccgtcgaggtcccgctgcttgatgatcgcctccgccaccgtgtcggtgacgttccagtcgcctccctgcgcgagggcggacttgaactcggcagcggtgatgtagccgtcaccgtccgcatcgatccgcttgaactgctcgcgtgcctcgtcgatgtccgccaccgatccgcccctctgtgtcgcttcaggtctgtcttgctgtcgtactgacgcaggtcagattaacggcccacggcaggggtgcggtcaccggccgggtctgcgaggctgggcctccggccggcggggagccgacggcagccgccatgaagacgggtcgcgaagacgg

SEQ ID NO: 1500 - DNA, 3034 bp, Unknown
  Kingdom: Bacteria, Phylum: Actinobacteria, Class: Actinobacteria, Order: Streptomycetales, Family: Streptomycetaceae, Genus: Streptomyces
tccgcctcggccgcggcgcggtggcgctcgctgacgtcgacgaccgagttcgccacgccgatcacccgtccgcccgccccttcgatccggtagtacgacaccgaccaggcgtgatcctcgtccgggtcggccggggtgcggccgacgatgtactgatcgatcagcggggtgccggtgaccaggacctggcgcagcgcggactcgatggtgtcgatgggggcgaaccggaggatgtcgtgcgggcggcggccgatgtggtcggccagggggacgccgttgatccgctccagggcggggttcaccaggaggtagcgcaggtcggcgtcgagcagtgcgatgccgatgggcgactgggagaccaggcgttcggacagggccagctcggtctcgatccgctccagcgcgctgcggtccgcggcgatgcccagcgcgtagacgtcgccgaggtcgtccagcaggcgcatgttccggaactccaccaggcgggtgccgccgtccttgtgccggacggggaacgctccggcccagctcgtcccggtggcgagcacctcggcgaagagctgggtgaccagttcccggtactcctcgtggaccagcagccgggccgcgtaccggcccagcgcctcctcggccgtgtatccgaacacctcgctggcctgcgggctccagaacacgacccgcccgctgctgtccaggaccaccgccgacacgctgagcaggtcgagcagtccgccgggcggtgccggtcccacccggtgggcctgggcttcctgtgcttcctcgtcgtgcgacgcgtctgtggccatcgctctcagctccctcctcgtccgggcccgggggctgcggctaccgagggccgtcccctccatgctgctcccctcaccggtcctcgcatccggtgccgggcgcgcaccgccggcgggacgggatgcgcgaggtcaccgggcgcgccgcccgccgggctcgatgcgcgaggcccggggcacgagaggcccggggcatccgtgcctcgcggccgtaccggtgaacgcgtggggtgcgcaggtagcgcgggcggcgacgggggaggttccttcaaggagagccggcccagcggtcgacggtggagcccgcagaccccgtagagccccgtagagccccatagagcactgagggaggatccactgtgactgatcggtctgcggcggatgccgggtccaggaccacgtcggacctggtggtggagcggctgctcgcgtggggcgtcgacacctgtttcggtatctgcggggatcaggtgaacggcttcttcgaggcgttgcggacgcacccgcggatgcggttcgtccatgtgcgacacgaggagaacgccgcgctggcctgcgtgggctacgccaagttcaccggccgtccggcgatgtgcgtggccaccgcgggccccggtgcggtccatctgctcaacggcctgtacgacgcccggatcgacggcgcgcccgtgatcgccgtcaccggtctgtcgtaccacgacacggtcggcgcgcacttcctccaggacctcccgtccgaccggctgctcgaacacgcctgtctgttctccgaacgcgtcatgggacccgcgcacgccctgacggccaccgacctcgcggtgcgcagcgccctgatgaaccgcaccccctcgcatctggcgatccccatcgacgtccagtccttcgcgctggagcaggacacggcctcgccgaagaacgtgccggggcatctctcgctcgccccgcagccgttcgaggtcgtcccgcccgaggagcagttgcgccgggccgccgaggtcctcaactcctgtgagcgggtggccatctgcgcgggcgccggagcgcggggcgccggcgatctcctcgaacaggtcgccgacgtgctgggcgcgcccatcgccaaggcggggctgggcaaggactgcgtgcccgacgacagcccgtacaccaccggcggcatgggcctgatcggcacccgcgcctcccacgaggcgttcgaggactgcgacgggttcctcatcgtcggctcctccacgccgtactacgagttctggccgcagccgggccaggccaggggcgtgcagatcgacctcaacgccgaccgtatcgccatgcgctaccccgtcgaagtcggtctggtcggccacgcaggtgccgttctggagcgcctgctgcccctgctggagcgcaagacggaccgctccttcctggagcgggcgcaggacacctaccggcgctggtgggatctgatcggcgagcaggcggcggcctcgggcacacccatgcggccgcaggtggtcacctgggagctgtccaaggccctgcccgacggtgcgatcgtgaccggggacgccggcaccgtgaccgcctggggcggccggctcagactgcgcaagggaatgcagtactcgttctccggcacgctgtgcaccatgggttccgccctgccctacgccatcggcgcccagctcgcgcaccccgaccgccccgtgatcgctttcaccggcgacggctcgatgagcatgggcatgggcgagctggccacgctcgcccagtacgacctgcccgtcaaagtcgtcgtcctgcgcaacgacgccctcgccctggaggtgtgggagcagaacgccctgctgggcaatccgcagatgggctgcgacctgcatcccgtcgacttcgccgccgtcgcccgcgcctgcggcctgcgggcgttccgcatcgacgacccggccgacgcggccggtgtgttcgccgaggccatggcggccgacgggccgtgcctgatcgaggcggtcaccgacccggacgaagcaccgttcggcgaaaccctgctgcccacccacgcccagcacctcgcgcaggccttcgccaagggagagcccgccgccgcggcgatggcacgcaacctcctccaggacggccgcgtcaccctctccccggcgttgcgccggcattacgacgaactggcccgccaccgctgacccgtggtcgccaaggcgcgcgcgggttccgtggccgtgggcggcgtgcgc

SEQ ID NO: 1501 - DNA, 2126 bp, Unknown
  Kingdom: Bacteria, Phylum: Actinobacteria, Class: Actinobacteria, Order: Streptomycetales, Family: Streptomycetaceae, Genus: Streptomyces
ccgcggcatgggcaccaaggtgttccgccacccggtcgccggcgacctcaccctcgactgggacaccctcacctgcgccgccgaccccgaccagcagctcgtcacctggaccgccgaaccgggcagccccgcccacgacggcctgcgcatcctcgcctcctggtccgcgagcgacgcccgatcggagcccggcaccgcccggcagcacgccgacggccaggagcccggcacggcacgctgacgctcaggaacccggcacggcaagccgacgctcagcggtccggacccctcacgcgaggtcgcgcatcctgcggaccgggctcgccaggaggatcgccgggctgaccgcggcgagcaccgccatgagcgcgagggaggcacggttgccccacagggcggcggcgcctcccgcggtcagcgcgccgaaggggaccgcgccccaggagatgaagcggaccgtggccatcacacgcggcagcagctccgcgggtgtggcggtctgccggtaggtgcgggtcacgatgctcgtcaccaccacggccccggcgaaaccggcgttgcccagggcgaacaggccgagcgcggcggagtggccggccagcggtatcagcgccgcgaagcacggcgagagaaccgcggcccagcacagcgcccggccgctgcccaggcgcgcgacgatccgcggtgtcagggccgcgccgatcagggtgccgaggccctcggtcgcgatgagcaccccgaccagggcgggcggcgcgtcgagcgtgccgaccaggaagaccggggtgagcgccatcaggccgccgcagacgaagttgaccgcggtcgcgtccgccgcgcaggggccgatgacggggtggcgggtgacgtagcgccagccctcgcggatcatctcgcccacgccccggcgcgggccctcctgcgcgggatgcgcgacctgcggcaggctgcccatcagcgcggccgagaccaggtagctcaccgcgtcggccacgaccgacgtcgccgcgccgagcaactggaccagcacaccgccgagggacggcccgccgagctgcgtcgccgccctggtacccgaggtgaggctgttgcgggcggtgagttcctccttgctgacgatggagggcaggaaagtggagttgccgacgtcgaagacgacggaggccagcccgatcaccagggccacggcgatcagctgcggcaggctcaggacaccgagcgcggcagccaccgggacggaggccacggcgacggcccggaccaggtccatcgccacctgtgtcccgcgcaacggcagacggtgcacgagcacgccggccggcaggccgatcagcagccatgccgcgaaggacgcggccgtgatgaggctgacctcgaacgccgaggcgtgcagcaccaggaccgcgagcaacggcagtgccaccgatgtcacggcgtcgccgatcccgctcgccgtggacgcgccccagtaccgccagaacaccgccgcccgcgccgcgccgtccggccgcgactgcttctctgacccgtcccgcccctgcgccaccgtcgtcatgctgccccctgcgaccgagtgagtctctttagggaactgactatactcatggatcatgcgatacacagagctgggcgacccggactgcgcgatcgcgcaggcactgacagtggtcggtgacccgtggacgctgctgctcatccgcgatgtcgcgggcggcacgcaccagttcgacgcgctccgggacgggctcggcatcagccgcaaagtactggcggagcgcctcaaggccctggtcgcggacggggtcctggagaagcgcctgtacagcccgcaccctccgcgctacgcctaccacctgacacccgccggacgcggcctgctcccggtcctcgtcgccctccaggactggggcgcccgccatgtcatgggcgacggcgccctctcggccaccagcaccaccgactccgcggagacccgccgcgtgcacgccctggtgggacgccgcctcccccgcctcgaactcgccggcccgcggggcgtgccggccgacccggtcgccgcggaccgggcctggacggtcctgtactgcttccccggcgcctacgcacccggcgggcacgactatccg

SEQ ID NO: 1502 - DNA, 3020 bp, Unknown
  Kingdom: Bacteria, Phylum: Actinobacteria, Class: Actinobacteria, Order: Streptomycetales, Family: Streptomycetaceae, Genus: Streptomyces
tccctgcccggcgctccggcagggaggtgccccacgatgctttcgccgaggagtctgttccaggagatcctcgaccacgacgagtccttccggctgttctgctcgatcgcggccggcggcgaggcgcagggcggctgggagaacgggcggatcgccgccggccgcgatcgagcagaacagccggaaggactcgtcgtggtcgaggatctcctggaacagactcctcggcgaaagcatcgtggggcacctccctgccggagcgccgggcaggggagggggcaggggtaccgccgtcccgccggaccgtcgcagaggtcgagtcaaatgcgggcgcgggggtggcgcaacacgtgcgggggcgcactgcgccgaacggagcagcggtcaccggtgtgcggggcgtaaccccacgggccgcggcgcgttgttctccgtgacggccgtggcggggaagaccccccgagcccccaccacggccgcaggattttcgcccgcctccgcgccccgccgcctcaggccagtccggcgcgttccagggcctcggtgccggcgcggagcgaggccagtcgctcctccagggtgaagccggccggggccagggtcagggtggtgacaccggccgccgcgtaggccttcatccggtccgcgatgcggtcgacggagccgagcagcgtggtctggtcgatcagctcctgcggtacggcggcggcagcgccctgcttgtcgccggacaggtacttgtcctggatctcggccgcggcgctctcgtatcccatgcgccgggcgagctggttgtagaagttctgcttgcggctgcccatgccgccgacgtacagcgccgtgtaggggcggaaggtgtcggcgagcgcgggcacgtccttgtcctcgccgagcgcgaggggcaccgtcgggcagacgtcgaagccgtccatcgacagcccggccttctcgcgtccggcccgcaggtggcggatcgccgtctcctccaggtggtcggcggaggggaagatgagcagggcgccgtcggcgatctcgcccgtctgctccaggttcttcggaccgatggcggcgatgtagagcgggatgtgctcgcgctgcgggtgcacggtcagcttgatcggcttgccggggccgccgggcagcggcagcgtccagtgctcgccgtcgtaggtcagccgttcgcgggtcatcgccttgcggacgatctcgacgtactcgcgggtgcgggcgagcggcttgtcgaacttgacgccgtaccagccctcggaaacctgcgggcccgagacgccgaggcccaggcggaaccggccgccggacagcgagtcgagcgtggccgcggtcatcgccgtcatcgccggctgccgggcggggatctggaagatggccgagccgacgtcgatacgttcggtctgcgccgcgacccaggtgaggacggtggccgcgtccgagccgtaggcctcggcggcccagcacacggcgtagcccagccggtccgcctcctgcgcgacggccaggttgtccgcgtccatgccggcaccccagtagccgaggttgatcccgagccgcatacccaatccccttaccgatgagtaacgttctgtgcgcacgaccctagcgcggggccgcgcgatgcggcaggtggcggccggtgtgacggcggactcgtcggtgcccgcggcggccgggaggcgggttgtccacaggtcacccgcgcggcatccgtggccagtaatctcggcgttcatggagcagaggcatctcggccgtacgggcctgcgcgtgtcccgcatcggcctcggcaccctcacctgggaccgggacaccgacgagcacgacgccgcggacatgctgaaggcgttctgggaggcgggcggcaccctcgtcgacacggccgacgtgtacggcgacggagaggccgagtacctgctcgggcggctcatggaagggctcgtgccgcgccacgacctgatcgtctcgaccaaggccggcagcgtcccggaccccgaccgccgcttcgacggctcccgcggccatctcctcgcggccctggaggcctcgctcgcccggctcggcacggactacgtcgacgtgtggcacgtccacgcgtacgacccgttcacgccgctggaggagaccctccaggccctcgacctggccgtgagcagtggccgggtgcggtacgccggggtctccaacttctgcggctggcagctggccaaggcggcgacctggcagctggcggcgccgggcgcccggacccggctggcgagcacgcagatggagtactcgctgctgcagcggggcgtcgagcgcgaggtgctgcccgccgcgctggacctgggcatcggcatactgccctcctcgcccctgggcagaggcgtcctgaccggcaagtaccgcgacgggctgccgccggactcgcggggcgcatcggatcatctggcgccgttcgtagagccgtacctcgacgacacggcgagccgcatcgtcgacgcggtgagcacggcggcggccgggttctggcgggccgggccggacccggcgccctgcggatccgggacggcgtccggggtcccgggcccggtgttctccgtggtctccggctccgtgctcacagcgtgctccagtcgtgatcgggatagcggtgcacgggcgccgacacgtcgtcgagcgcccggcagatctcgtcaggaagactaagggtctccactgacaacgcggccgtgagctgctgcgcagtgcgcgcgccgacgatcggggcggtcacgcccggccggtcccggacccaggcgagcgcgacctgcagcggggtcaccgccagtccgtccgccgccgtgctcaccgcgtcgacgatgcggctcgccgtgtcgtcgaggtacggctctacgaacggcgccagatgatccgatgcgccccgcgagtccggcggcagcccgtcgcggtacttgccggtcaggacgcctctgcccaggggcgaggagggcagtatgccgatgcccaggtccagcgcggcgggcagc

SEQ ID NO: 1503 - DNA, 1823 bp, Unknown
  Kingdom: Bacteria, Phylum: Actinobacteria, Class: Actinobacteria, Order: Streptomycetales, Family: Streptomycetaceae, Genus: Streptomyces
gccggtaccggccgcggaccacgaactccgcccccataacaagcacgttgacagctcggcgagacaggtcggtgcccgggaggacaggtgtgcgggtgaggcgaggacaggcacctcatggcaggcccacaaggtcctgtaaggtgagcctacccttactaattgctcacccgtcctcatcggagtgcacatgtcccttcggcgccgcgcccccgtcgcagtcgctctcgctgtcgtcgccgcactgtcggtctccgcgtgcggcagcggcggttcctccggcggagggaactcctcctccagctccgccgcctccgggggcggttcgaagtcggtggccaagggcggcaaggacttcggcagcgcggcggagaagaccgcggcgatgggcaccgacgccaagcccggtcagtggccgcgcaccatcaagcacgcgatgggcaccaccgagatcaagaagcagcccgagcgtgtggtcgtcctcgacgtgggcgagctggacaacgtcgtctcgctcggcatcaagccggtcggtgtggccttcaccgaagggtcgccgcacctgccctcgtacctgaagggcgcgggctcgcccaagagcgtcggcaccatcagcagcctcaacctggaagccatcgcggccctcaagccggacctcatcctgggcagtcagctgcgcgccgccgactcctacgacgagctgtcgaagatagcgccgacggtcttctccatccggcccggcttcacctggaagcagaactacctcctgaacgccgctgccctggaccgcaccgcgcaggccaagtccgcgctggccgcctacgagaagcgggccaaggccctgggcgacgagctcggcgccgacaagccgaccgtgtccatggtccgttacatgcccaacggtgtgatccggctgtacgccaacgactcgttcatcggcaccatcctgaaggacgtcggagtcccccggccgaagaaccaggacatcgccgacctcgccgccgagatcagcgccgagaacatcgacaaggccgacgccgactacatcttcagcggtgtctacggcaacccggacgccaccgcccgcaccaaggcgcggggcaacccgctgtggaagaacctcaaggcggtcaaggcggaccacgcctacgacgtaccggacgagacctggtacctcggactcggcgtcaccgccgccgactcggtcctggacgacctccagaagtacctgaaggcctgagccggacgaaggcccggaccgctgccgagccaggccactgacgaaagagagtgagcgcggcccatgtcgcccccgaaccgccgccgagcggcctggctgctggccggcacggtcatgctgctgggcgccgtcctgctgagcctggcggtgggcagcaggcagatcgcgcccgccaccgtgttccaggccctgctgcacggcggcaccagcgacgacgcccaggtggtccgggcactgcgggtgccccgtacggtcctcggcgtcctggtcggcgtcgcgctcgcgctcgccggaacggtgatgcagggcgtcacccgcaacccgatcgccgaacccggcgtcctcggcgtcagccagggcgccgcggccggggtggtgtgcgcgatcgcgttcttcggcgtgcactcgacgggcggctacgtctggttcgcgttcgcgggcgcggtggtcgcggccgtggccgtctacgccgtcgccagcggcggccgggacggggcgagcccggtcaaactggcgctcgcgggcgccgccatgaacgccttcctcgcctccgtggtctccgcggtcgccaccacccgcgccc

SEQ ID NO: 1504 - DNA, 1725 bp, Unknown
  Kingdom: Bacteria, Phylum: Actinobacteria, Class: Actinobacteria, Order: Streptomycetales, Family: Streptomycetaceae, Genus: Streptomyces
tacgtcatgaggccccggccggggcctcatgacgtatgcgtcagctcacgcgcacgtgaccgtcacgcggcgaccacgtccaccgcctcggcggcgggcgccttgatcgtcacccgttccggtggcacaccggtcaccgacaccgaacccagcatcgggcgaaccggcgccggcacgtgatcggtggccgcagcagactgggccagctcggcgagggcgagctcgtcgctcacttcccgcatgagctcggacatccgtacgtccagcgcgtcgcagatggcggagagcagctcggaggaagcctccttctgcccccgctccacctcggagagatagccgagcgagactcgggcggacgaggagacttcgcgcagagtacggccctggcgttggcgctgccgacgcagcacgtcacccagcaggcgacggagcagaatcatcggtggctccctcctcggaccgcgtagccgcatccttcacgccccaccgtaccgcctcgcgacgcggccgtgcggggagcgatgtcgtgttcactcagggctgcaaacatcagaaccccccgttccgttccgtatcctgtgcccgctcatttccgctctgttcgccgacaatccgctccagaagcagtgcgagtacgctccgtacactctccatacgaatgtccgcccggccgccgttcaaccgcagtgccgccgttttcgcgccacgcgccgccgggttccgcgctccgggcggcccgtccacggccacgaagaccgttccgacgggctgtccgtcctgggggtcggggccggcgactcctgtggtcgcgatgccccagtccgcaccgagcgccttgcgcactccggccgccatctcggccgcgacctgcggatccaccgctccgcgctcggccagcagagtggcgtccacgccgaggagccggtgcttcagctccgtggcgtaggcggtgaccgagccccggaagaccatggaggctccgggcaccgaggtgatctccgcggcgacgaggccaccggtcagtgactccgcgacggcgagggtctcgcccctcaccgtcagtagttccacgacctcggcggcgctcgaactcacgcttccgattccttcaacgcggcccggcgctcggcgattccctgcctgcgcagcacaatggcctgtttcacatagtcaagaccggtcaccacggtcagcaccacggcggcggccatcacccagaacctcagggtggccagccatcccgtcagcgccaggacgtacatccccacggccacgccctgcgtgagcgtcttgagcttgccgccccggctcgcggggatcactccgtaacggatgaccaggaaacgcaggagggtgatcccaagttcccggccgaggatcactccggtcacccaccagggcaggtcaccgagagcggagagacagatcagcgccgctcccatgatcgccttgtcggcgatggggtcggcgatcttcccgaagtcggtgacgaggtcgtacgtacgggcgaggtgtccgtcgaacaggtcggtgatcatggccacggcgaaggccgcccacgcgaacgagcgccacgccgggtcgtaccccccgtccgccagcatcagggccacgaagccgggcaccagcagcagccggagcatggtcagcagattggcgacgttccacacgctggcctggttgactgcggcggcggcgatcttgccgccgcgcgcagtcaaccag

SEQ ID NO: 1505 - DNA, 595 bp, Unknown
  Kingdom: Bacteria, Phylum: Actinobacteria, Class: Actinobacteria, Order: Streptomycetales, Family: Streptomycetaceae, Genus: Streptomyces
  misc_feature (252)..(272): n is a, c, g, or t
ggtgccagacgtactgcccgtcgaataacccagcggccatcttccccctgtccgtcaccgcacgatgcctcacagtgcgctcccggcactttactcaccgccgagcacaaccggaacgcggtttccgacatgttcgccgcggctttcgggggccggtcagcgggagttgagggtgccggggcaggcgttcggccgggcgttccagcaggtgttcggatgggcgttcaccgggtgggggcgcgcacgtccggnnnnnnnnnnnnnnnnnnnnncaccgccgcctcgcccgcgcccgcgctcgtcgttcactccgggacccgtcattcacctcctcgccgcccgtctgcgccgcctcccgccgtcctgcggccccgtccgtctgatcggcgtcgacgggcacgcgggttccgggaagtccaccttcaccgcccggctggccgcggcgctggacgacgcacccgtcctgcatctggacgacgtcgcgagccacgaggagctgttcgcgtgggacgggcggctgctgaccgaggtgatcggaccgctcacccgtggcgtgacggcgcactacgccccctacgactggccggcccgaagc

SEQ ID NO: 1506 - DNA, 3065 bp, Unknown
  Kingdom: Bacteria, Phylum: Actinobacteria, Class: Actinobacteria, Order: Streptomycetales, Family: Streptomycetaceae, Genus: Streptomyces
ggccgccaggtgacgcggctggccccgcacttcaagccgcgccccggttcgctcgcctgggccgaccagcccgaccacaaccggctgcgcaggccggtcgccggtgccttcaccgtcggcgcgatgaagcggctgcgcccgcgtgcgcaggagatcctggacgccctcgtggagccggtgctgagggccgggccgcccgcggacctggtggagcaggtcctggagccgttcccgatagccgtggtcgcggaggtgatgggggtaccgcccgccgagcgggagcaggtgcacacctggacccggcagatcatctccatgtgcggcggggccgaggccgccgaccgcgccaaggagggcatgtacgggtggatcgcgcggacgatccgggcccgccgggacagcagcggccaggacgtgctgtcgctgctcggtgcggccgtgggccgcggcgagatcagcgaggaggaggcggtgggtctggccggtccgctgcaaataggcggcgaggccgtcacgcacaactgcgggcagatgctgtacctgctgctgacccggccggagctgatggcccggatgcggcagcggccgggcgaacgcggcccggtcctggacgagttgctgcgccacatcccgcaccgcagcaccgtgggcctggcccgtatcgccctggaggacgtcgagctgcacggcgtgcgcatcgccgccggcgagccggtctacgtctcctacctggccgccaaccgcgacccggccgtcttccccgacccggatgtcatcgaccccgaccgcgaccccaacccgcacctggccttcggcaacggcccgcactactgcaccggcgccgtcctcgcccggctgcagaccgaactcctcgtcgacaccctgctcgaccggctgccggggctgcggctggcggtgccgcccgcacaggtcgcctggcgccgcaggacgatgatccgcggcccggagagcctgccggtcacctggtgagggccggcgacggcaccccctcggcactcacgcccgcagccactgggtgaccaccacgtccgagcccgtgtgcagccgcagcgcgaacggtcccgcgggcggtgcctgggcggcgaagcggcccaggtcgtcggcggtgagcggggtaccgggacgggggccgtggagcacctcgatccgggccggctgcggcggcatcacctgccccagcagcccgtccccgctcacctccacgtccacggtcagctcaccggcctggaaggtcagcatccgcggcacgtccccggcgcccctgaccgggatggcgtcgagcagcgagtcgaaggtcagctcggcgatccgggcgtcgaggtcgtgcagcgcgtaggcgtccagggcgagttggcgcagctcgtcggggaccgggtcgaggacggcggcggcctgccgcagttcctcctccagcagggcctgctccgcctcaccgaagtcatcgcgcgcgctgtcgtggtcgtgggtgccggtgccgtcgttcacgaagtcccccgtgcgtcgtctagtcgtgcgcgcagccgccgcagacagcgctggcgcagaggtccgatgctgcccacggcgacgccgagtgcggccgagacctcctggtagctgggcggcggcgaggccatcaggacccgcagcaactggcggcagcggtcgccgagtttctcgaactcctgccacagccgccggatccgctcgctctgcgccgccgcctcctcggcgtcgagcagcgactgctccggcgcgccgacctcgctgacccggtcgagcaggtgcgggtcgtccgtcaccgtcagccggctcaggctccgcagcgtcctgaggcattcgttgcgcgcggtgctcgctagccacgagcccgccttgtcgggttccctgatccggccgaggtgctgggcgaagcggaaccagacggtctggtacacctcgtgcccgtcggcgtcggagagccggtgtgcgcgcaccaccgaccacaccagcgggctcatcccctccaccagcgctttccaggccgccgcgtcaccgtcgaccgcggactggacgagcacgccgacatctgcacggtccaccgattcacccctcgtgtacggcctgtcatcgtacgccgtggaggggagggttccggtcttcatggggtcctcataccggccgggccggccgctggacggggacggggcgccaggcgggcgggcgcagcgccggtacgtgcgcaccgcgcacctccgcgtactcccggtgcgtggcgaggagttggcggcgggctgctctcgggtcgcgttccttgtgggccgtcatgtgggcggcgaccatggcggcggccacgggggtggcgaaggaggttccgctccagtgcgcgtacccctcgaacatcacctggtccggtttggccggtgacttgtcgccgtcctcgctcaacaggcccgtgtgccggggcgactggcaggtgcaggcgtagtggaagccgaaccggcaggcgtcgtaggtggagtggcggtagacgtagggcacgggtgtctcgaagccggtgaggacgctggtcaggcgctcgccgggggcgtacgccttcacccagtggccgtggttgctgaagcaggcgccgtactcgccgtcggagcgcagcgcgccgaccgacagcaccgagtcggcgtagccgggccggtcggcgtaggcggcgggccagaacggcgtggcgctggagttgttgccggcggcggcgaccaggagggtgccgtgggagcgcagttcccgcatgaaggcgtccacgccgagcagaccgtcggtgcggccgttggaggtgccggcggagaggctgatgatgtcgggccagccgcccgcgtcgacggcctcgaacagccggtgcccgaagtcggactccaggacggcaccggcgtcgtcgagggtggagcggacggtgatgtcggtgttgggggcgacggcggcgacgagtccggcgatgaacgtgccgtggccgacgtactgttcgagtacgccgtcgtcgtcggtctcgcggacctggcggtcgccgcggacgtgggcgagcagcgggacggcgc

SEQ ID NO: 1507 - DNA, 557 bp, Unknown
  Kingdom: Bacteria, Phylum: Actinobacteria, Class: Actinobacteria, Order: Streptomycetales, Family: Streptomycetaceae, Genus: Streptomyces
ccccgcgcgcggggaccaggtagcgggcctcccgctggacgacgaggtcgcctccggtgttggtgatcagggcgagggcgcacaccgtcgagggcaccgtgcactcgtccagggagaagtcgacgggggctccgtgctggggctggagggtgacggtggcgtgcaggtcggcgaaggagcgggcgccctcgtagatggtcacgaagacgaggatgcgccggaagtcgtgcgtgtggtccaggttgatggtgaggttctcgccgctggacacggcaccggtgcggtcgtcgccgtcgaggtggatgtagggcggccggtgcagtgctccgaaggcgttgccgagggcctggacgacgcccttgcggccgtcggtgagttcgtagagggcgcacaggtcgaggtccaggtcggcgtgcatcgcgacggcccgtccgcgcttgccggcccagccggtgaactgtttgcgcacctgccagttgaggttcacgcgcatcgcgcccgaggtgcccccctgcttggccagcgagaccgaaggtgccgccttggtgagcgtgacc

SEQ ID NO: 1508 - DNA, 4262 bp, Unknown
  Kingdom: Bacteria, Phylum: Actinobacteria, Class: Actinobacteria, Order: Streptomycetales, Family: Streptomycetaceae, Genus: Streptomyces
ggcggcgacaccgccgagggcgtcgccgccttcctggaacgccgggcgccgcgcttcacgtggaacgccgggtagggacctacgtcaggtacgggcggctgtcggcacggagcctctccacgagctgggcgggcgccttctgcggggaccccgcgtcgtagggcggctgggggtcgtactcggtgagcagctggacggcctgggccgtctcgtcgcccgcgatccggccgagcagggtcaggcccatgtcgataccggaggagacgccggcggcggtgacgtacttcccgtcggtgaccacccgctcgccggtgggctccgcgccgagtgaggcgaggtggccgagggccagccagtgggaggtggcgcgccggccgcgcagcagcccggccgcgcccagcacgaacaccccggaacacacgctcagcacccgcgtgccccggtcgacggcccggcgcagggcggccagcagttcgggcgggtacacgcgggtggcgaagtcgtttccggcggggacggcgatcaggtcagcctcgtcgagccggtcgagcccgtacggggtcgtgacgctcagaccgccgacatgggtgccgagcgacggcccctcggcggagaccaccgcgaagtcgtagaccggcagtccgtcgtcgctgcggtcgatgccgaagacctcgcacaccacacccagctcgaagggatgtacgccgtccatcaggacggccgccacgttctgcaacatgccgccagtgtgcctcggaagtggcaggaatttgaaggcctacggcagtcctgccactcacggccacgagtgtccggcgcgacagtggtgtgcatgaacgcagaccagacagaagccctcatcggaatgctcttcaccttcggactcctggtcctgatggtccttccctcggtgctcggcatcgtgcgcgacaagcgcatcgaccgcagcatccgcgaggcacagcgggcacaccaggaacaggagtccgcgaccaaggagccctcggctcagaagtcctcgtccaggtcgaccgtgccctccaccgccacctggtacgccgacggacgccgctcgaagaagttggtcaactcctgaaccccctgcagctccatgaaggagaaggggttctcggagccgtacaccggagcgaaaccgaggcgcgtcagacgctgatcggccacgcactccaggtactgccgcatcgagtcggtgttcatccccgggaggccgtcaccgcacaggtcgcgcgcgaactgcagctcggcctcgacggcctcccgcagcatgtcggtgacctcctgctccaaccggtcgtcgaagaggtccggctcctccttgcggacggtgtccaccacgtcgaaggcgaacgacatgtgcatcgtctcgtcccggaagacccagttggtgcccgtcgccaggccgtgcagcaggccacggctgcggaaccagtagacgtaggcgaaggcgccgtagaagaacaggccctcgatgcacgcggcgaagcagatcaggttgagcaggaagcgccggcggtccgccttggtctccagccggtccagcttctccaccgagtccatccaccggaagcagaactcggccttctcccggatggacgggatgttctccaccgccgcgaaggccgccgcccggtcgtccgggtcgggcaggtaggtgtcgagcagcgtcaggtagaactggacgtgcacggcctcctcgaacagctgcctgctcaggtacaggcgcgcctcgggggagttgatgtgcttgtacagcgtgagcaccaggttgttggcgacgatcgagtcaccggtcgcgaagaacgcgaccagccgcccgatgaggtgctgctcgccgggggagagcttggcgaggtcggcgacgtccgagtggaggtcgacctcctccacgtgccaggtgttcttgatggcgtcccggtagcgctcgtagaagtccgggtagcgcatggggcgcagggtcagttcgaagcccgggtcgagcaggtgggtgttgcgtgtggtgctggtcatcactggcatgcctcgcaggactcggggttctcaagggagcaggcgaccgcgtcggggtcggcgacctgctgggcggggacggtggctcgggtctgcgcctgggcggcgcgggcgatccgggtcgccgggcgggagcgcaggtagtacgtggtcttcaggccctgcttccaggcgtacgcgtacatcgaggagagcttgccgatggtcggcgtctccaggaacaggttcagcgactgggcctggtccaggaacggggtgcgggcggcggccatgtcgatcagaccgcgctgcgggatctcccacgccgtgcggtacagccgccgcacctcctcggggatccacgcgaagtcctgcaccgagccgttcgcctcgcgcagcgcctcccgggtgcgggcgtcccacacgccgagcgtcttgaggtcgcggaccaggtaggagttgacctggaggaactcgcccgagagcgtctcgcgcttgaacaggttggagacctgcggctcgatgcactcgtagacgcccgcgatggaggcgatggtggcggtcggcgcgatcgccagcagcagcgagttgcgcatgccgacggcggcgatccgctcgcgcagcgccgcccagcgctcgggccaggtcagctccacgtcgtagtggtcggggtgcagcactccgcgcgcggcgcgggtcttgtcccaggcgggcagcgggccgttccgttcggcgaggccggcggaggcctcgtaggcggcgagcatgatgcgctcggcgatccgggtcgacagtgccctcgcctcgggcgagtcgaaggggagccgcaactggaagaagacgtcctgcagccccatcgcgcccagacccaccggccgccagcgggcgttggagcggcccgcctgctcggtcggatagaagttgatgtcgacgacccggtccaggaaggtcacggccgtgcggaccgtctcgtccagccgctcccagtcgaggtccccgcgctcggggtcgacgaaggcgctgaggttgacggagccgaggttgcagaccgccgtttcgccgtcgtcggtgacctccaggatctccgtgcacaggttcgaggagtggatgacgtggcccggctcggcggtctggttggcggtgcggttggcggcgtccttgaaggtcatccagccgttgccggtctgcgccagggtgcgcatcatccggccgtacagctcacgggcgggcagggacttcttcgccagcccggccgcctcggccccgcggtaggcggcgtcgaactccgcgccccacaggtccaccagttccggcacgtccgccggggagaacagcgaccactgcccgtcggcgtcgacgcggcgcatgaactcgtccgggatccagtgcgccaggttcaggttgtgcgtgcggcgcgcgtcctcgccggtgttgtcgcgcagctccaggaactcctcgatgtccgagtgccacgtctccaggtagacggccgccgcgcccttgcgccggccgccctggttcacggcggcgaccgaggcgtccagggtcttcaggaacggcacgatgccgttggagtgcccgttggtgccgcggatcagggaaccgcgcgagcggatgcgggagtaggcgatgccgatgccgccggcgtgcttggagagccgggcgacctggtggtagcggtcgtagatgctgtccagctcgtccttgggtgagtcgagcaggtagcaggaggacatctgggggtggcgggtgccggagttgaagagggtgggggaggaggggaggtagtcgagccggctcatcagcccgtacagcgcggcgacctcgtcggcggcacgggggctgtcgtcctcggcgagaccggcggccacccgcagcatgaagtgctggggcgtctcgatcaccttgcgggtgatcgggtgccgcagcaggtagcggctgtgcagggtgcgcagcccgaagtagccgaagcggtcgtcggcggccgggtcggccagcgcgtccaggcgcgcggcgtgcaggcggacgaacgcggcggtccggtcggcgatcagcccctcacggtggcccgtggcgaccgactcggtgaaggacctgacgccctgcgaggcggcctcggcgcggacggagagcgtcagcaggcgggcggccagccgcgagtaggcggggtcctcggagatgagcccggccgccgcctcggtggccagctcccgcagctccgcctcgtccgcgtgcgccgaccggccgcgcagcgc

SEQ ID NO: 1509 - DNA, 2034 bp, Unknown
  Kingdom: Bacteria, Phylum: Actinobacteria, Class: Actinobacteria, Order: Streptomycetales, Family: Streptomycetaceae, Genus: Streptomyces
  misc_feature (1532)..(1533): n is a, c, g, or t
cgggccgcgttggcgtgcacggccttggccaggtaggcggcgaggcccggacgctgctgcgagggcgggacgaccagggcgaaggcgcgcgggtcggcggcgatgtcgtccgcgatgcgccggtgcatggcgggcgggcaggaggtgaaccagcgggagatgtgcaggcggtgctcctcggcgagctccatggcccgttctccgtcggcgctctccccgtcgtcgaaggcggcgagcagttcggcgcgccaggcggcggcctcgcgcatgagctgccgccagtcctccttgctgtgcgcggcggcccgcgccatcgactcccgctgtcctgccgagtcggcccacttcagctgggcctcggtggcgtagctgaggtcgaaggcgatctcgccgaagacgtcgaagcgttcctccggagtgagggacacgccggtctgctggacctcgatggcacgctcggccacctcggccagccgccgcagccgggcgatctcctcgcccagccgccgctgccgggcccgcaggtgttccagcgcgttggcctgcgggtccttgaggatgtcggcgatctcgtcgagggagaagccgagttcccggtagaagaggatctgctggaggcgcgccaggtcggcgtcgtcgtacagccggtatccggcgtggctgcggccgctgggcgacagcagccccgcccggtcgtagtggtgcagcgtccgtaccgtcaccccggcgaacgccgagacctgccccacggagtaactcattcacctgccctttcgtcggcccacagcgtggagcctgacgcaggggcagggtcaattcccgcccggccgatccttgtccggtcgatccccgtccggtcgatcccgccccgtcactcccggtccggtcgatccctgtaccggtcgccggtgccggtgcggcgggtcacgttcagcaggtactccttgcggtcgagcgggttgaggtcggtgcgcgggcgctcggggaccgtgtccccgcgtaccggcgcgtagtggtcgaaggcggtctccagttcgccttcgccgcgggtcaggccgggcagccgccgttccagggcgtgcacgcgcgcggcgggcacctcgccctccaggacgcagagcgggccgcgggtgttggtggtgcgcgggaccgcgcgcagtgcggccagcaccggcaggagggcgccgagggtgtccgcgggtgcctcgattcggaagcggtgcatcggttcgtggacgagggtgccggcgcggcgcagggccgtcatgaggacgagcggggtcaggccgcggaagtcggcgccggtgctcgacatgctcttgtcgaaccgctggtggcgtggctctgccggggcgagtagccgcagtgggtcatggtgaccgtgcagtcggtgacctgccagccgtgcgggccctgtccgagcgcttcgcgcacggtgtcctcgaccgccttgaagaaggcgtacggcatcgagcccagctcgaccgcgaggcggaagccggtgccgggaccggccggggcggggtccacgnncccggccgggcgttcgacgcacaggggtgtggtctcccggaaggtgacgtccagagcgaactcgtcggcgagggtggcctggacgacctccttctggacctctccgtacagcgacacggagatctcctgccgcgcctcgtcgtggcgcagcccgatcagcgggtcctgctcggcgagccgggtgagcgcggcgtgcagggcgccgcggtcggtcccgggggccgggactacgacggtctccagggtcgggggcgcgaagaagtggccgtgggtcttgcggggtgcgccgacggtgtcgccgatgcggatgtcggcgagaccccacaggcgggcgatgcgtccggcggggacggcgtcggcgcggacgtcggtgccgtggtcgaacaccgcgagcgcggtgatccggccctcggtgcgggcctcgccgtaggggacgcggtcgcggacgcggagtgtgccggagaacacgcgcgcgtacgccgtcttctcgcccgccgggcc

SEQ ID NO: 1510 - DNA, 1567 bp, Unknown
  Kingdom: Bacteria, Phylum: Actinobacteria, Class: Actinobacteria, Order: Streptomycetales, Family: Streptomycetaceae, Genus: Streptomyces
gagtcactgcgggccgcggcgcgcacggcggtgccgtaggagccggtcggcggagatcagcacgcgccggtcacgtggggccggttcagccgtgcgtgaggcgggcggcctggcgggctgcggcgtcgaggaggctgtcgagcaggcccgggaagaggtggtcgaggtcgtcgcggcgcaggccgttcatcttggccgtgccccggtagacctgccggacgacaccggcctcgcgcaggacccggaagtggtgcgtggtcgtcgacttgctgacgggcaggacgaagtacgagcaggacagttcgtcgccctccgcggcgagttcgcgcacgatccgcagtcgcacgggctcggacagcgcgtgcagcacgttctccagacggatctcctcccgcccgggatgcgggagatcgcggctgccggtggcgggcacgggggtgggggcggtcacggtggctccacttcgtaggaggagcctcattctacgatgagcatcgtagtttgacagctgccgtactacgagagttaccgtacaagcctgtccctcggtcccgtgatgaatggagcccgccgtgagtgcgctcttcgagccctacaccctgcgcgaagtgacgatccccaaccgcgtctggatgcccccgatgtgccagtactcggcggcgcccgagggcccgacggccggtgcgccgggcgactggcacttcgcgcactacgcggccagggcggccgggggcacgggcctgatcgtcgtggaggccaccgcggtgtcgcccgagggccggatctcaccgtacgacctcggcatctggaacgacgcgcaggtcgaggcgttccgccggatcaccggcttcctgcgcggccagggcacggtgccggcgatccagctcgcgcacagcgggcgcaaggcctccaccgagcggccgtggaagggcggggcgccggtcggaccggacgcgcacggctggcagccggtcgcgccgagcgcggtgcccttcgacgagggccacccggtcccgcacgagctgagcgtcgaagagatccagcaggtcgtcgggcagttcgcggccgcggcacgccgggctctcaccgccggcttcgagatcgccgagatccacggcgcgcacggctacctgatccacgagttcctctccccgcactccaaccaccgtaccgacgcgtacggcggctcctacgagaaccgggtgcgcttcgcgctcgaggtcgtcgacgcggtccgggcggtctggccggacgacaagccgctgttcttccgcatctccgccaccgactggctggaggaggccggctggacggccgacgagacggtccgcttcgcggcggagctgcacgcccacggcatcgacctgctcgacgtctccaccggcggcaacgctcccgccgtacgcatcccgaccggtcccggctaccaggtgccgttcgcggcccgggtgaaggccgagacaccgatgccggtggccgcggtcggcctgatcaccgagaccgagcaggccgagaagatcgtcgccaacggcgaggcggacgcggtcctgctcggccgcgagctgct

SEQ ID NO: 1511 - DNA, 1610 bp, Unknown
  Kingdom: Bacteria, Phylum: Actinobacteria, Class: Actinobacteria, Order: Streptomycetales, Family: Streptomycetaceae, Genus: Streptomyces
gccgaccgcggtcggcgtggtcccggacagcaaggaaatgcaggacaaggcccggaaactggcggcgcagctggccggttcgctgggcggctgacgtgccgggcgcggcacgtggcgcggtgccgcgcgcgcggtgacggcgaaccacgcggctgaccgattgcgtacggtggccctccggacccgatcaggccgcacccgatcggaccgcaccgatgagaccgcaggggaccacgagcgtcatgagtgaaggaaccatgcagcgagcagctcagcgagaacagcgtgaccggcgtgatcagcgtgaggagcgcggcccgcgggcgaagcggctgcaccgtgccctcgtctgcgcgggtgcggtacccgtgttgctgctggccgcggcctgttcctcctcggactccggttccggctcgggcgacgcgtcgaagagccccgcggccggcgcgaagacgtcggcgagcccgagcgcttcgccgaccgtgcagcccgcggcgtacgggaagctgcccgacgcgtgcaaggtgctggcgcgcgggacgctggacgacctggtgccccgcggggcgaagtccgcgaaggcgggtacgtcgagcgatgtgaccacgcgcgccagttgctcgtggaacggcctggacaacaacggcgtgaagggctctcagtaccgctggctgaacgtgtcgttgctgcgcttcgagtcggacaccgcgcgcggcacgggcgagacccaggcacaggcgtactaccgcaagcaggtgcaggacgcgcagtccgtcgacggggcgcggagcagcaagtcgcagccggtgtccggcgcgggcgacgaggcgacggcggtgcgctacgacctgaagaagaaggaaggcaccttcaagcagcagacggtcgtggcccgggtggagaacgtggtcgtcaccctcgactacaacggcgcgggtctggccggtgacaaggccccggacgccgacgacctgacgaaggacgcggtgaaggcggccaaggaggtcgtggcgtcggtgacgaaggcgaacggcggcaccgactcgtcgtccggttcctcggacaagccggcgtctccgtcggactccacgtcaccgtccaagacgcagtccacgtcaccgtccgagtcgccctccgggtcggcgtcgaaggacgcttccccgtcggcgtcgcagtccgcggccacgtcgtaggacggcagccgagcacagcgggtcatcggatccggccaaccgttccccggacagatgtgccaccctgttgcgcgcaacaggacgtaaggggaggggagtacgagtgaccgcgccactgcagttgactcggatgcaccgggttctcatcggcgtggtcgtgaccggcgccgtggtcatcgccggtatcggcttcgcgggttcgtacgcggccgtgcgcgagctggccgtcaagaagggcttcgggaacttcagttatgtgttcccgataggtatcgacgcgggcatctgtgtgctgctggcactggacctgctgctgacctggatccggatccccttcccgctgctgcgtcagacggcgtgggtgctgacggcggcgacgatgagcgcgaacggcgccgccgtcagcacccacgc

SEQ ID NO: 1512 - DNA, 988 bp, Unknown
  Kingdom: Bacteria, Phylum: Actinobacteria, Class: Actinobacteria, Order: Streptomycetales, Family: Streptomycetaceae, Genus: Streptomyces
  misc_feature (799)..(800): n is a, c, g, or t
cgcgcggctgaccacggcccgcctgtcggcctgcatgcccgtcgacggcgaggcggccgtcgtcccgctcaacgccatggagcgcggtctggccgatctgtgggcgcggaccaccgcggccatgacccccgaccagcggcgcaccttcaagcacgcgatcgactcgatgaccgagagctgggtgtgggagctgtccaaccagctgcagaaccgcgtgcccgaccccgtggactacctggagatgcggcgcgccaccttcggctccgacctcaccctcagcctgtgccggatgggccacggcccggcgatcccgcccgaggtctaccgcagcggcccggtccgttcgctggagaacgcggccatggactacgcctgcctgctcaacgacgtcttctcctaccagaaggagatcgagtacgagggcgagatccacaacgcgatcctcgtcgtgcagcacttcttcggcatcggctatcccgcggcgctcgacgtggtgcacgacctgatgacgcagcgcatgcgccagttcgaacacgtcgtcgcccatgaactgcccgtcgtctacgacgacttcgagttgtcgcaggaggcccgcgcggtcatgcgcggctacgtcgccgacctgcagaactggctgtccgggattctgaactggcaccggaacgtgaaccgctacaaggccgagtggctggcccgccgcgcccacaccttcctcccggaccacccgccggcacccgcgctgcccgtcggctgagcgggcaccggttcagtctcactctttcgtggctcgtggcggccnngtagtcaccagccggaggccgaggggggccgatggaggccggggagccggagggggcagaaggagagcgatggaacagacggcgttgcgtcccaagccgatgcccggcggagtggccggcccgggcacgccgcgcgagcagcgcgtccgcgcgcaggccgtgaaccggcgtggccgccggttcacggg

SEQ ID NO: 1513 - DNA, 1816 bp, Unknown
  Kingdom: Bacteria, Phylum: Actinobacteria, Class: Actinobacteria, Order: Streptomycetales, Family: Streptomycetaceae, Genus: Streptomyces
gccgtcgtccgcacggtcagcgggtggtcgagttcgcagacccggccgaggccccggcggccctccggatcgcccgggtccgggacgaggggccggaggaccctgaggtccagcgctccggcgagcgcgtcgctgacgcccgggtccgcggtgtccgcgttggtgtgggcgacgtgcagcgcgatgtcgttcttgatgagggtgtgcacgacgcggcccttgaaggtggaggccgcgaccgtcgtcgtaccgcgcaggtagagcgggtggtgggtgacgagcaggtcggcgcccagcttcaccgcctcgtcgacgatctcctggaccgggtcgacggcgaacaggacccggccgacctcctggtcggggtcgcccgtgacggtgccgaccgcgtcccaggactcggcccgctcggcgggccacagggtctccagcgcggtgatgacttcagacagacggggcacgggtgcaaggctacctgggtgttcggcgcggctgaaccggtgccgccgccccggagggagccgccccggcccggggccccgtccgcactcggggtcgcacagcagtttcgttttcctccagcacaaacgttccgcttttctcaggcgaatcgttcctcggccacccgtatgtgtgaagcgcccgcccgccggtcctccgcctgtgcgtacgaaaactagcgtcctcacaggaggtgaccgagcaatgacagtctgtgcctctcaggggccctcggcagcacacgaacaggagggcgccccaccacgcccgccgacggcgggcgagaacggcgccagaccggcggcgggctgcgcgatcacggtggacggcgcctacgccgcccggctcgcccgcagcggcgactcctggtaccccgagcgctggaccctggacggccccgagccgtacgcggtgccgctgccggccggccagcccgaggaaccgggcaccgaggtgcagccgatgggcgacggccgggtcctcgtccggcgcctggtggcgggccgccacaccttctcgctgctgtacccgaccggccccggcaccggcgagctgccgctgggcgcggtcgagtgcccggagcgcacccggctgcggctgctgccctgcgcgcccggcggcgagcgggcgtacgcgctcgcggtggggccgcggtcctcggcggtgtggctggtggcgggcggcgccttcgggcccgagctgctggccgaggtgccgggccactgctcgggcggggtctggctggaccggaccgggcggatgctggccctggaccggcggaccggcgggcgcaccaagacggtcgtggtggacctcggaagcggcggcgaggtgaccccgctgctccagatcgcgccgcacagcgacgaccggctgctcctcgccgaccccgacagcggactgctgctgatccgctcggacgcgccctcacccggacgggaccggctgggctggggggtgctcggcagcacgctgccggtgcggttcccgcagtgcctgcggctgcccgactgcgtggtgaccccgttcgcgatccagccggggcaggtgctgaccccggagcagtgcgcggtggcactgcgctgcgacggcccgttcggcagctgggtcggtctgtggcggcccgcggagcggcgggtacggcatgttcccgcgcccgaggggtggctggccggttccggggtgtggacgggcgagggcactctgctgctgccgtacagcacgcgcgcggtgccgtgcggggtgacgcgccgcccggcgccggggcgtgaggcggcggacgcggcagcggatggcacggcagagggcgcgg

SEQ ID NO: 1514 - DNA, 2564 bp, Unknown
  Kingdom: Bacteria, Phylum: Actinobacteria, Class: Actinobacteria, Order: Streptomycetales, Family: Streptomycetaceae, Genus: Streptomyces
ccggccgcgcgcccggcgcccccgtaccgcagccctacgagaaggtcggcggcacctgggtggtctacggcaccggcgaccagatcaccgacccggcggccggcgccgccgccccgcgcgacccgcgcaccggccagagcaccctggcccgcttcaccttcgcgccgcccgcccggcccggcggccgctgggaggtgacccgggccgagtacgtccccgagtggttcgaccccgatgccggccgggtcgtgaacgtcgccgacgccatcgaccggggggccgccctccaggccgtacgcgaccggatccgcgacgcggtgctcgcccggggcgcggcgaaggacggactggtgatgggccggtgacctccggtgatggtccgctgacgtgacgcgcgtgtcagacctgctcctcgcggcggggcgcgagcgccgaccgcttgtacgagtagccgaaatagatcacgcacccgatcaggaaccacaccacgaaccgcacccaggtctgccactgcaggaacgtgatcagccagatcgagaagacgatcccgagcgccggcacgaacggcatccacggcgtgcggaaggcgcgcggcaggtccggctgcttgtagcgcagcacgatcaccgccgcgcacaccaccacgaacgccagcaggatgccgatgttggtcagttcggccgcctcggcgatcggcaggaacccggcgatgacggcggacgcgaccccgacgatccacgtcacccgggtcggcacgtgccgcgtgggatgcgtcttcgcgaaccagcgcggcagcagcccgtcccgggacatcgagaaccacacccgggtcacacccagcatgaacgtgaacatgaccgtgaggatgccgatgatcgcacccaccgcgatcacgtccgccagcctgctcagccccacagacttgaacgcggtggcgaacccgctctccttgtcgatgtccttgtacttctgcatgccggtcagcaccagacaggccgccacgtacagcaccatcgcgatcgccagcgagtagatgatcgccttcggcatgtgccgctgggcgtccttggactcctcggccgccgtcgacatggcgtcgtaaccgaagaccgcgaagaacacggtcgcggccccggtgaacgccccgctgaccccgtaggggaagaacgggtggtagttcgcgctgtggatgtggaacacacccaccacgatcaccaccagcaccacgacgaccttcagcaccaccacgatcatctcgaaccgggccgcgttgcggatgccgaggttcagcagccaggcgatgagcaggcacaggatcgccgcgaacagatcgaccttgtgcccggccccggtcccgggcgcgcccagcatccaggccggcaggtgcgcgcccatgtcctcgacgaggaagctgaagtagccggagatgccgatggcgaccaccgccacgatcgccgtgtactccaggagcaggtcccagccgatgaaccagcccgcgaactcgccgaggaccgcgtacccgtaggtgtaggcggagcccgccttcgggatcaggcccgcgaactccgcgtacgacagcgcggcgcacgcgctggccaggcccgcgatgaggaaggagacgagcaccgcgggaccggccgtgccgttggccaccgtgccggccagcgtgaagatgcccgcgccgatgatgccgcccacgccgatcgcggtgagctgccacaacccgagcgaccgttcgagtttcggtccctcgccggcttccgtctcctcgatgtgttcgatcggtttacggcggagaatgccctcgcccatacggagcccggccatgcgcctcacctcttcgcagacggcaaacggctgacggcggatcatgatggcccagcaccgccgggtacggaagacaccacgcacgccccgcaggtcacaggggcaccgatgcgagcagctccctccacaaggcctacggaaccaccgtcaccggccaccttcccgccttcaccaggcgcaccgccaccgacccgatgatccggtggcctgcctgctcggaggcgccgacgaccaccgcgtccgccttcagctcgtcggcggccgtcaccaggccgttgtacggatccccgcggaaggtgtggaactcccagcggacctcgaatatccccttcagccgttcggtggactcgcggatctgcttgaccagatcctcggcgatctcgtcggtcgtctcggccaccggcgcacccatcgccgccccggccggcatcaccggctgcacgtacacgacggccagccgcgcgccctgacgccgggccagaccggcggcgtaggcggcggcccgcatggaggagtcggagccgtccatcccggtcacgatcaccttcggcccgtcggtgccccgctcgaaccggtgcgcctgttgctcgtgcccctcgtgctgttccgtcacgctgagcagattatcggaagagccccttccggcccctgtccagggagcccggaatgcgcgaccgtgccgcagcggcccgcccgctcgcgcccgctgcgcacctccgcgccgagacccctcccgc

SEQ ID NO: 1515 - DNA, 1371 bp, Unknown
  Kingdom: Bacteria, Phylum: Actinobacteria, Class: Actinobacteria, Order: Streptomycetales, Family: Streptomycetaceae, Genus: Streptomyces
gacaccggaccaggcgcggcgcccgggagcctgacgggagattcgcccgcatgctcgaaccgaccgaacccacccagggttccgaagaactgaacacccccagcgacaccctgccgccgcgcctggtccggtgtccgatcgcatcgatcggacgccgttgacgtccgcggcctcgcggttgcgcgatggccgccgtccggggcgcgggcgccgcacgggagctctctgtgtcctgtctcgccggttccgtacgctcttgtcgcgtaggcctggcgaaagtcttctggtcggtgcgctgcccgacccaggtggctcccgagtacgagggcggcgcttcgacgtccgtccctacggaaccttccctaagcaggcgccttcgcggcggcagcgtcggcggcccctgatgaagcggccggggcggccgggtctgcctcgcggtcgggcgcgagcgggtcggtcaccgtgccggtctcttcatcgagcagcccctgcgccagcctggtcaccgctgcggggaccggcggcgccaggtcggccacggcgcggagaccggacaggacgtcgtcgggtcgtacggcaggcgtcacgtgccgaacaaccagccgcagtatcgcacagggctggtcgcccggcctatcggccgccgcaccaggcgtttccacgcagccgagactcacgaccgcgggacgggcgtcgaaggtgcgcataccgttctttgtccggcgctgcacctcgacggccccggctccgttgaacgccgcgaccgcacggtccgcctcggccgggtccacaccgtccagccgcagctcccacacggaagccgtcagccggtcggcgagccccgacgtgcgggcctcgaccgcgtcgacgatgtccagcccggcgggcatcgactcgtcgagcaggccgcgcagccgctccgggtcgcgggacgcggtgagcgcgatctccaggtactccgcctcactgcccgtgccggtgggtgcggcattggcgtaggacaccttcgggtgcggagtgaaccccgccgagtacgccatcggcacctcggcgcggcgcagcgcacgctcgaaggcgcgctggaagtcacggtggctggtgaaccggaggcggccgcgcttggtgtagcgcagtcggatgcgctgcaccgcgggtgcgggcggcgggccttcgggctgtcgcttgcccaggggaacttctccttgtgtgcggcgggtggtcacgggcgccctcccagcggggagcgctcagccggcgccttgccggcgccgaccgctgcggacggctcccgcgtctgcggggtcgcctcgcgcccggtccttcttcaagagtacgcgtcccggccgcccggagttcccgcccggtcccccg

SEQ ID NO: 1516 - DNA, 682 bp, Unknown
  Kingdom: Bacteria, Phylum: Actinobacteria, Class: Actinobacteria, Order: Streptomycetales, Family: Streptomycetaceae, Genus: Streptomyces
ccgagcacgacgacgtccgggccggcgaggtgcgccaggcgggcgccgagctgcctgcccgcttcgtcacggtccgtgaagagcaccgtgcggctccttcactccccggcggaccagagcggggcggacgtggtcgcctccggcgctccgaccgcctcgatgtcgcccgcggcggcgcgcagcagttcgcggccgagcgcgatcagggcccggcccgccgccagttcgtcgccgatgtcggacacggcggagtcgtaggggctgcggcgggcctccgcgcagctctccaggacgttgtcaccggtgtccagcacgatccgggccgtggtgtccgggtcgtgttcggacaggtacaggttcagccgccattccttgacggacgcaggccggctgatgtcgacgggtcgcgtcatcgtcggtccctcctcagcttcgctcgccgggacggtggactccctctcgcaccccttccactgtgcctcgcgcacgtgcgtgccgcgcggccgtaccgacgggtacggccgcgcggggccgccgggcgcggcagtgcacgccggggccggtgggtggcctgcgggcggtgtgcgccggatccggcgggtggcctgcggcgggtgcggcggggcggtgtgtgacagggccgacggccggtcggagcggtgtgcgccaggtgcgggggggc

SEQ ID NO: 1517 - DNA, 1396 bp, Unknown
  Kingdom: Bacteria, Phylum: Actinobacteria, Class: Actinobacteria, Order: Streptomycetales, Family: Streptomycetaceae, Genus: Streptomyces
agcagctcgcgcagggcccgctcctcctcggcgctcagcccggtcacgaactgctgcagcgcggcgatcgggtcggggccgcggtccagggcctcgtgcatggcctcggcggtcagctcggcggcgttcttcgcgggccggtaggcgccccgccgcccgtcgacctcgcgcagcaccaggcccttgtcgtagagccgcttgaggatggtgtgcacggtgttgtaggccaggtcgccgccgagctccaactggatctcggccggtgtcagcgggcgttccgtggaccacagcgcggcgaggacctcgctctccaactcgcccggactgcgccgttccgtcctgccgtgaggccctctgccagccatgccctcaaccttacagcgcgtagggatgtcgggtgtccggtggcgtcccgcccggcagatcgccccgacaaggggtaacttgtccgtgattccttgcttgtccccgatctgacgccccgactgcttctttcggcttctgccggtaccgtcctgtgtgttcgccgagttttccgcgacgttttcccggcgattccccgccgacccgcccgactcccgcaccgctcccgcacactgtgaagtcagaaaccctacagtgcgtagggacgaggggtggagatggccgaccacacacacgccgtactcgccgcgatccggcgagccgcaccggcaaccggccccggcagggttccgcgccgtcggggcgtcctgccggtcgcggccgtggccgccgccttcaccctggcgcaactcctcctggtaggcccccacatgggtctcggctgggacgagaccgtctacgtcagccaggtcagcgcgcacgccccggccgccttcttcagcgccccccgcgcccgcggcgtctccctcctcgtcgcccccgtcgcctcctggtccgcctcgaccgcgctgctgcgcgtcttcctcgccgtgctgtccggcctcgcgctgtacctggccctgcgggtgtggcgcgaccacttccccgcccgcgtcctcgcgctcgccggcgccctgttcgcctccctgtgggtgaccctcttctacgccccgcaggccatgcccaactactgggtcgccgtcggcgcgctcgcctgcgcgggctgcttcgtacgagcccgcgcgaacccgcacgaccgcgccgcccacgccggcctggccggcacggccgccctcatggccctgatgcgtcccgtggacgccgtctggatcgcgctcccactgccggccctcgcgctgtccggccggcactggaagccgctcgccgcactcctggccggactggccgccggcggcggcgagtggatcgccgaggcctacgccggctacggcggcccgctgcggcggctcgccgacggctccgccatccaggg

SEQ ID NO: 1518 - DNA, 827 bp, Unknown
  Kingdom: Bacteria, Phylum: Actinobacteria, Class: Actinobacteria, Order: Streptomycetales, Family: Streptomycetaceae, Genus: Streptomyces
ggggtggaggggcccggctgggacggcgtggtcttgcaggtgaacgccggcgaccccgtccacgggtagttgtggctctcgttgcccgtgccgtgcgtgtgcacgtccttgccgacgtagacgcgtccgttggtgctggcggtgaggtcggcagtggcgtgcggggcgaggagggaacccatgaagttgcctccgccgccgagcgtgacggccggggtcttctcgaagttgtagaggacgcgcgaggccacgtcgccgaacaccggggagccgtacgtgtcggcgcgctcgccgttgaagccgacgctcatgggcgagacgtccacggtgtgaccgccggtcacgttgaccaccaccggcgccttctcggggatcgcctcgaacacgaaggaggaggcgccgtcgaggtccttggcatcgatgtcgaagacctggagcgcgccctggccggccttcgtgcccgtgaaggtgaccgtgccgcccgcccgtacggccgtaccggtggacttgagggcgccgagcgccgccgactcccgggtgagggtcgcgtcgaaggtgtcgtacggagtgagggcgtccttggtgcccagtcccgaggagcgtgcgccgccgttcgtctccagggtgcccttcgcctcgatctcgccgccggcccggacggcgccgccgtaaccgggaccggccgtgagaccgtggccgacgtcgaccgtggtgcccttggccacgacgaggtcgccgccgacggcgagcatcacggagccgggcgtgggcaggatgccggaacccgcctcgacccggcccacgttgaacacgcccccgcccccctt

SEQ ID NO: 1519 - DNA, 1329 bp, Unknown
  Kingdom: Bacteria, Phylum: Actinobacteria, Class: Actinobacteria, Order: Streptomycetales, Family: Streptomycetaceae, Genus: Streptomyces
ggacgaccgggatgcccagctcggcggcccggaccagctccgggttgtccgggcggatcgccgaggagacgacgacgcaggaggcgtcggaggcgaggtggtccgccgcgtgcccgatgtgcacggtggcgccccctcggcgccgcgctgggcgaggatcttggcgatgcccgacattccggcgccgccgatgccgatgaagtgcggtcggtccatggcggtaggaaggccgggtgccatgcgctgttctccccaggtggtgcggcgtcggtacgggcgtgcggcgcaccgcgggcgcgggcgccgccccagcctatgccttgctgtgggagaacagcttcaggaccggcacgccgaccttgtggcgggcccgcgaggcccagtcgcggtggaagaactcctccacgtagtgcggatcggtcagcacgatcacctcgtcggcgccgacctccccgaccagggccttgagcgcgtccagcggatggtcctcgacgagtctgccgtcggcgtcggcgccggccgcgcgcagcgccctcagggagacgtcgagggcctgttcgccctcacccttggccgcctccccctcaggtgtcccgccctcgcgcgcggcctcgtcgatctcgccgagcgcgatgtcgtcgatggcccgcagcagccggtccgcctggtcgccgcgcggctggagcagcacctggaagcggacctgctcctcgccgtgcaacgtcgtgacgaactccacgtcggcggacgtcagggccttctcgatcatcagtacgcttgtgaacaccagacgccctttctcgtgtgagggccgcggccctcccgctacctccgtgtgggccggaaacagcccccgcagaaaccatcctgccctgtgatctcacgggtatcgccggaattcctcccgccgccaccacctgaacggaattaccaattccgcttacgggtgacgccacggagagtgacccccggacggggcctctgaggtgccacgcgggcgccccgggggcaccacgggggcgccacagggaactctccccgtcacggccgccggtagcggctgaacaggaacccctcctcctccagcaggccggccagggcgaaacggtgcgggacggtgaccgaagggccgccggcgatgcgctgggcgtcgcccgcggtgagcgtcggcgagatggtcaggcacagctcgtccaggacgcccgaggcgatcatctgcccgagcaggcgcgggccgccctcggtcagcagtcgggtgtggcccagttcggccagcgcccgcaccgcgcgcggcgggtcgatgccgacgccgtcgccggcggtcaccac

SEQ ID NO: 1520 - DNA, 3585 bp, Unknown
  Kingdom: Bacteria, Phylum: Actinobacteria, Class: Actinobacteria, Order: Streptomycetales, Family: Streptomycetaceae, Genus: Streptomyces
gtgctcgcggtgacggcgaccggccgcgaggcggaggacctggcagccgccctgcgctcactgctgccgccggagggcgtcgtggagtacccctcctgggagacgctcccgcacgagcggctcagcccgcgcagcgacacggtgggccgccgcctcgccgtgctgcgacgcctggcgcacccgaggccggacgaccccgagaccggcccggtctccgtggtcgtcgcccccatccgctccgtgctccagccgcaggtcaagggcctgggcgacctggaaccggtggcgctgcgcacgggtcagaccgcggacctgaacgacatcgtcgaagccctggcggccgccgcctacgcgcgcgtggagctggtggagaagcgcggcgagttcgccgtgcgcggcggcatcctcgacgtcttcccgcccaccgaggaacaccccctgcgcatcgagttctggggcgacgacgtcgaggagatccgctacttcaaggtcgccgaccagcgctccctcgaggtcgccgagcacggcctgtgggcgccgccctgccgtgagctgctgctcaccgaggacgtccgcacgcgtgcgcgtgcactggccgagcagcacccggagctgggtgaactgctgggcaagatcgccgagggcatcgcggtggagggcatggagtccctggcgccggtcctcgtcgacgccatggagctgctgctcgacgtgctgcccaagggctccatggccgtcgtgtgcgacccggagcgggtgcgcacgcgcgcggcggacctggtggccacctcccaggagttcctccaggcgtcctgggccgccacggccggcggcggcgaggcgccgatcgacgtcggcgcggcctccctgtggtcgatcgcggacgtccgcgaccgggcgcgcgagctggacatgatgtggtggtcggtgtcgccgttcgccgccgacgaggcggccggggacgccgacacgctgaagctgggcatgcacgccccggagacgtaccgcggcgacaccgccaaggcgctcgccgacaccaagggctggctcgccgacggctggcgcaccgtctacgtcaccgagggccacggcccggccgcccgcacggtcgaggtgctcggcggggagggcatcgcggcccgcctggacgcggacctcggggcggtgtccccgtcggtggtgcacgtggcgtgcggctgcatcgacaacggcttcgtcgatccggccctgaagctggcggtgctcaccgagaccgacctgtccgggcagcgcaccgcgagccgggacggcgcccgcatgccggcccgccgccgcaagaccatcgacccgctcaccctggaggcgggcgactacatcgtccacgagcagcacggcgtgggccgctacatcgagatggtgcagcgcaccgtgcagggcgcgacccgcgagtacctggtggtggagtacgcccccgccaagcgcggccagcccggcgaccgcctctacatccccaccgatcagctggagcagatcaccaagtacgtcggcggtgaggcgcccaccctgcaccgcctgggcggcgccgactggaccaagaccaaggcgcgcgcgaagaaggcggtcaaggagatcgccgccgacctgatcaagctgtactcggcccgcatggcggcccccgggcacaccttcggcgccgacacgccgtggcagcgcgagctggaggacgcgttcccgtacgcggagacgccggaccagctgacgacgatcgccgaggtcaaggaggacatggagaagtcggtcccgatggaccgcctgatctgcggcgacgtcggctacggcaagacggagatcgccgtgcgcgccgccttcaaggcggtccaggacggcaagcaggtcgcggtcctggtcccgacgaccctgctggtgcagcagcacttcggcacgttctccgagcgctacggccagttcccggtgaacgtgaaggcgctctcccgcttccagaccgacaccgaggcgaaggcggtcctggagggcctgcgggagggctcggtggacgtcgtcatcggcacccaccggctgttctcctccgagacgaagttcaaggacctgggcctggtcatcgtcgacgaggagcagcgcttcggcgtcgagcacaaggagcagctgaagaagctgcgcgccaacgtcgacgtcctgacgatgtccgcgaccccgatcccgcgcaccctggagatggcggtgacgggcatccgcgagatgtccacgatcaccaccccgcccgaggagcgccacccggtgctgaccttcgtcgggccgtacgaggagaagcagatcggcgcggcgatccggcgtgaactgctgcgcgagggccaggtcttctacatccacaaccgggtggagtcgatcgaccgtgcggcggcgaagctgcgcgagatcgtccccgaggcgcggatcgccacggcccacggccagatgtccgaacaggccctggaacaggtggtcgtggacttctgggagaagaagttcgacgtgctggtctccacgacgatcgtcgagtccggcatcgacatctccaacgccaacaccctgatcgtggagcgcggcgacaacttcggcctctcccagctgcaccagctgcgcggccgggtcggccgtggccgcgagcgcggctacgcctacttcctctacccgccggagaagccgctcacggagaccgcccacgagcgcctggccaccatcgcccagcacaccgagatgggcgcgggcatgtacgtggcgatgaaggacctggagatccgcggcgccggaaacctgctcggcggcgagcagtccggccacatcgcgggcgtcggcttcgacctgtacgtccgcatggtcggcgaggcggtcgcggactaccggcgccagctggagaccggcgaggcggaggaggaagcgccgctggaggtcaagatcgagcttccggtggacgcgcacgtcccgcacgactacgcccccggcgagcgcctgcgcctgcaggcctaccgctccatcgcctccgccaacagcgaggaggacatcaaggccgtccgcgaggaactcaccgaccgctacggcaagctccccgaaccggtggagaacctgctcctggtcgccggcctgcgcatgctggcccgcgcctgcggcgtcggcgagatcgtcctccagggcaacaacatccgcttcgccccggtggaactgcgcgagtcccaggaactgcgcctcaagcgcctctacccgggctcactgctcaaaccggccacccaccaggtcctcgtccctcgcccgaagacggcgaaggtcggcggcaagccgctgatcggccgcgaactgctgggctgggtgggggagttcctggcgtcggtgctggggtcgtagggagcgcgggggaggtgcccctcaggcctccgcccccgcacccgtgtcggccgccgcgcggctcagggccgtcgccagccggtcgcggacggcgagctgcgcggcgatgcgctcgtcgatgacggcgaggcgttcccgggcgaccgccagcgcgcgagcggaggcaggccccgcggtgacgtcgccgtccaggcacggcaggaacacccg

SEQ ID NO: 1521 - DNA, 4450 bp, Unknown
  Kingdom: Bacteria, Phylum: Actinobacteria, Class: Actinobacteria, Order: Streptomycetales, Family: Streptomycetaceae, Genus: Streptomyces
cgttgatctcgaacagaccgaggtcggagccgccggagatggagagcagcacgccgcgggcgccgtcgatggaggcttccagcagcggggaggagatcgccatctcggcggcggccaccgcgcggtcgtcgccgcgggccgagccgatgcccatgagggccgaaccggcttccgacatgaccgacttgacgtcggcgaagtcgaggttgatcaggccgggggtggtgatcaggtcggtgatgccctgcacaccggagagcagcacctggtccgcggacttgaacgcgtcgagcacgctgacctggcggtccgagatggacagcagccggtcgttggggatgacgatgagggtgtcgacctcttcgcggagttcggcgatgccgtcctcggcctggttggcgcggcgccgtccctcgaaggtgaacgggcgcgtgaccacgccgatggtgagggcgccaagggagcgcgcgatgttggccaccaccggagcgccgccggtgccggtgccgccgccttcaccggccgtcacgaagaccatgtcggcccccttgaggacctcttcgatctcttcgcggtggtcctcggcggccttgcggcccacggccgggttggcgccggcgccgagtccgcgggtcagttcgcggccgacgtcgagcttgacgtcggcgtcgctcatcaacagcgcctgcgcgtcggtgttgatggcgatgaactcgacgcccttgagaccgacttcgatcatccggttgatggcattgacaccaccgccgccgacaccgatgaccttgatgactgcgaggtagttctgcggtgctgccacgtcgaaggcctctcgcctcgaattacgtcgccgtcgttgcgcgctgtccgcgccgcgacggctgatgccgaatgggacggtccgtaacgccgacccgaaccctaaccctgaagtttagggttaccagtgtgcctgttccttgaagtcttctgaacaggacactaagtcgacaagtggcgcccgttcaacgaacacgccgaacctcccgtttttcttttcaccctatgtgatcaggcatagcggtgcccaaccagggtgctggcctgcacgtatacccgtcaactccccgatgacgcaggcgcggtggggacactgacgtcgaagtgccgggcgccgggcgcggctttcatcagcgcggtgagcgcgcgggccttctcggcgccgctctcaccgctgccccacaccacggtgcgtccgccgctcagctccagcgagatgtcgtcgtaggtacggaccttgacggcgcgggtccggcgggagaccgcggccgggatgcggccggcgaccgtgacggcctcgcgcaccaggcgcgcctcgtcgaagcggcgcaggctcgcggccgccgagccggagcgggaaagggacaattcgaggaccggaacgcctttcggcgcctgcgcgaccgtggcgaaccggacgccccgcgcgtccacttcgacgaactttccgcccttttcctccaccatgaccgcggtgcgctcgaccactttcagctggattccgtgcggccatgaacgaacgacgtcaaccgagtcaattcggggcaattggcggcgcagccgggccgcgacggcggcggtgtcgacggaaatgagcgggtcgcccaccgggacctccgcggccgcgcgcacctgcgcgtcggtcaacgcccgtgtgccggagacggatacccgctccacccgggtccaggacgagccgtacaggacccagagggttccgccgccgagcagcaccacggccagggccaggatgacgatcgtacgaagaggcggccgccggggcctgcggaagcggggccggccggacgactcctgctggcgttcaccgcgttcggcggtcgtccgtccggccacttctcaaaccccttcgttcatatggtcctaacggcgcgaggcgatggcctcgtacaccatgccgacgagcaggtcgtcggcgtcccggcggccgaactcaccggcggcgcgggacatctggtacagccggtgcggatcggcgagcacgggcagtacgttctgctgcacccactccggggtgaggtccgcgtcgtcgaccagcagtccgccgcccgccttgaccaccggctgggcgttcagccgctgttcgccgttgccgatgggcagcgggacgtaggcggccgggagtccgacggcggagagttcggcgacggtcatcgcgcccgcgcggcagagcatcatgtcggccgccgcgtaggcgaggtccatccggtccagataacttaccgggatgtaggggggcatacccggcatctggtgcacgcgcggcagttcgttcttcgggccgacggcgtgcaggatctggatgcccgcctgctggagccagggcgcgacctgctggaccacctcgttgagccggcgggcgccctgcgagccgccggtgaccagcagcgtgggcaggttggggtcgagcccgaacgccgcgcgggcctcgggacgcacggcggcccggtccagggtggcgatcgcccggcgcagcgggatgccgatgtagcgggcaccgcgcagcttgctgtcgggggtggagacggcgacctgggcggcgtagcgcgagccgatcttgttggccagacccgggcgggcgttggcctcgtggatcacgatgggcacgccgagccgcttggcggcgaggtagccgggcagggcgacgtagccgccgaagccgaccacggcgtcggccttggtgcgttccaggatctgctcggcagccttgatggtgccgcgcagccggcccgggacggtgatcagctcgggcgtgggcttgcgtggcagcggcaccgccgggatcagcgccagctcgtaaccgcgctccgggacgagccgggtctcaaggccgcgctccgtgcccagggccgtgatccccacggtcgggtcctgcctgcgcagggcgtccgcgagggcgagcgcgggctcgatgtggcccgcggttcctccgccggcgagtacgacatgcaccgaaattcaccgctctccggacgaacgcgccgccgaggcgcgccgtcgcatcgtgttccatctgcggggtccctggccggacccctgccccgatcctgccccggatccctgacccgaggcacggccgggcctcccggcggactcccggccgggtttgcggccggaggcccggtcgggcttgcggccggttctccggccggccgcggagcccgcccgctttctaccaaaccggggctgccgcatggcaagcgccgcccgcgcagcgggctcgtcacgcgcgaaggcgatcagcagcccgatggcgaacatggtcggcagcagggcggatcctccgtaggagaacagcgggagcgggacgccggcgatcggcagcaggccgagcaccgcaccgatgttgatcaccgcctgcgcgatgatccaggtggtcacgcctcccgcggcgtacctcacgaaggggtcctccgtgcgtccggccacgcggatgcccgcatagcctagagccgcgaacagggcgagcaccgacagcgtccccgccaggcccagttcctcaccggtcacggcgaagatgaagtcggtgtgggcctcgggcagttggccccatttttccacactcgcgccgagcccggaaccgaagaatccgccggaggccagggcgtagatgccgtgcaccgcctgccagcacttggtcacgtcgccggagccgacgcaggcgaaccggtccaggcggttggggctggtcttgacgaggaccaggccgatcagggcggcgaccgagagcacgcccacgaagaggcgggtgggcgcgcccgccagccacagcaggccgaacaggatggcggtgaggatgatcgcggtgcccatgtcgccgccgagcatgatgagcccgagcagcatgaaggcgaccgggacgagcggcaccagcatgtgcttccactgcgtgagcagccgcttctcctgcttgcgcgcgatcaggtcggcggcccagagcaccagcgccagcttgccgatctcgctgggctggatctggaaggagccgccgagcgagatccagttctggttgccgttgaccgacatccctatccccggcacctgcaccagtgccatcaggaacaccgcgcccgccaggatcgggtaggccagcgcccggtgcagcttcaccggcatgcgcgcggcggcgaacaggagccctgcgccgatcacggcggcgagcagctgcttgcggaagaagtacgagccgggcagcgccatctgcagcgcggtgacctgggaggccgagtagaccatcaccaggcccagcacggtgatcagcgagctgccgccgaggatcaggtagtacgcggtgagcggccggtcccaggccttgcgggcgcgggtgacgagcgtgcgtacggcgttgtcgcgcacggccgggccggtggcgggccgcccaccgcgtactacc

SEQ ID NO: 1522 - DNA, 1305 bp, Unknown
  Kingdom: Bacteria, Phylum: Actinobacteria, Class: Actinobacteria, Order: Streptomycetales, Family: Streptomycetaceae, Genus: Streptomyces
acgcggcctaccggccgggcccggacgccgcgacccttcgccgcgctcgcggctgggccgtgctgcgcgccctcagcgccctgcacatcggacacgccggcgtccacggccgccccggaggcaaacccacctggggcccaccggcccacgccgccctacgacgcctcacggcgacggcccacccgtgatcaagcacctcggcggcaggcggacggccgaaccggtcccttccggcctctcccttcggccccggtgacaccgtgccccggcgtaccgcaccgcaccgcgcggccgtcgcggtcgccgccgcgcaccggaggcaggcggtcgggcggattccgtattgtggggtgggaactgccgggcgaccgaggggggcacgtgccgctgcacaaggacgacccgcgatccgtcggcggctacaagctggtcgaccggctcggggccggcggcatgggcagggtctaccgggccagagcgcgttccgggcgtgaggtcgccgtcaaggttgtgcacgccgaatacgcacgggactccgtcttccgcgcccggttccggtacgagatcgaggccgcacgccgggtcagcggcgccttcaccgcggccgtggtggacgccgacccggaggccgagtcgccctggatggccacccagtacgtgcccggccagtcgctcgccgcccggatccgtgaccagggcccgctgcgcgtgagcgagttgcggccgctggccctgggcctggtggaggcgctgcgggacatccaccgggccggggtggtgcaccgcgacctgaagccggccaacgtgctgctggcgccggacggtccacgggtcatcgacttcggcatctcccgggcggccgcgagccaccacaccctcaccgagaccggccaggtcatcggcaccccgcccttcatgtccccggaacagttcaccgacgcgcggatggtcggcccggcctcggacgtcttctcgctcggcgcgctgctcgtctactgcgtcaccggacgcggccccttcgacgccgacagcccttacctgaccggttaccgggtcgtccacaaccagcccgccctggacggggtgaccggatccgtgcgcgcggtgctggagcgctgccttgccaaggagcccgccgaccggcccacgaccgacgaactggcacgcgagctcgccgccgtcctgcccaagccgtcgccgggcgaaccggagacgatgacgctgcggctgccctccgcagggcccgccgggccgcccccggcgcggtcgggcagctcgcccttctcgcgttccggcggctcgtcc

SEQ ID NO: 1523 - DNA, 1563 bp, Unknown
  Kingdom: Bacteria, Phylum: Actinobacteria, Class: Actinobacteria, Order: Streptomycetales, Family: Streptomycetaceae, Genus: Streptomyces
cggtgcaccagccgggccgcgtggacggcggcgagcgcctcggcgagccgcgccgccagcgcccgtacggtgtccgggggcagcggcccgtgccctgcgacggtctcggcgagcgagggcccggggacgaagacggtcgcgatccagggttcggccgcctccgggtcggcggccgtgacgggcgcggtccagcggtcgtcgacccgcgcggcggcctgtgcttcgcggcggaagcgggcccggaaccccggatcggcggcgtgctcggcgcggatcaccttcagggcggccagcgcaccgcccttcgaacgggcgagatagacgacgcccatgccgcccgtgccgatccgcgcgagcaggcggtacccgccgaccgactcagggtcttgagcggtgagtggacgcaccgtcacttccctttcggccgcggagccctgtccggggcgggccccaggtagtggaaggcaccgtcgtgtacctggtggacgaagctggcgggggtgctgagctgcaggagcttcgggtcgaaggcgaagttccgggtgatgccccggtacgtggcggccttcagtggcgcgaccagcgccttgcgcgccgggcgtttgcccttggtggcggtgagctgccgtatcagcaggttggccgcgtcgtagccctcggcggcccagaacccgggcgggcggccgtaccgcgtgcggaacgcctgggcgaaggagcggacctgagtcgcgtcgggcccgatcgctccggccacgaccgtccagccccccgcgctttcctcggcggcgaaccgggggtcgagcgcgggttcggccgcgtacttcggcccgtcgaagccggccagccccttggccgcccgtatcgccccctccaacggtccggcgtagacgaacgccttgatgcctgcaccgcgcatgtcctccaggacgggcccgaagtcggccgtgccggcggggacgacgcgggggtgggtggcgtcgccgtacttccggacgatgaagttgaccatctggatggtctgccaggacacgtcaccggcggtgcggtccagcaggacgccgacgggggtggccgcgctggtcgcttccagatggaaggccagcttcatggcgaccgtgccgtgcaggaggcggccgcgtacgaaagagcggatgttctggtacaggttctgcccggcggacatgctgatcacgggcagcagggccatgtcgtagacgggcagcgcggcctgggtcgtctcgtcggtgctcgagccgagcacggccagcacgtccgggtcgtcgacgagccgctgggccgcggcggcggcacggtcggccaggcccgcgtcgtcggaggtcttcagctccagcgcgaacggcttgtcgcggcgggcattgaactcctccaccgcgagtcgtgcaccctgctcctgggcctgcccggccctccggccggcaccgctgaggtcggcctgcacaccgagcgcccaaccgggcgcggcggcctgcttcttcccggtgccgccgtcggggcgcagaccggcccaggctgccacgcccccgcccgcggcgagcacggcgg

SEQ ID NO: 1524 - DNA, 822 bp, Unknown
  Kingdom: Bacteria, Phylum: Actinobacteria, Class: Actinobacteria, Order: Streptomycetales, Family: Streptomycetaceae, Genus: Streptomyces
gacctcgacgtcccagccgagggcctcgacggtggccggggagagttcctcggcgagcagcacgacggggcgcggggagcgggcggtggcgcggtgacgggtcacgtttctggcctctcgttgggtgtacggggaagacggggcccgccgtggcgggcgggcccccgggtggacccggcgggggtccggaacgctcagtagccgccccactggacgaggagccgggcgcgctccgtctcgtccagcaggtcgacgcggtgcacgggggtcgccgggtcgtcggcgaaggcccgcagcaccgtggcggtgcggctgaggaacctggtcgcctcgtcgctcccgtgggtgtcgggacggtgtccgaggcgcagggtgagtccgccgccggtgccgggcacggcgaccaggcgcagcgggtagtgcgtggcgtcgtcgactccgatgccggtgagccgggggcccggcagtccgccggagagggcgtcgaggtcgagcgggtagttgacgaacatggtcgtggtgtcgaacagctgcccggtgccggcgagttgctggacgcggccgagtccgaggtgatggtggtcgatgaggtcggcctgctcgttctggagccgggtgagcaggtcgaggagggtcgcatccccgggcacccggacgcgcacgggaagggtgttgacgaagaggccgaccatgcggtccatgccggcaagggcggggggccgcccggagacggtggtgccgaacacgacgtcgtcgcggccggtggcgcgggccaggaccagcgcccaggcgccctgcaccagggtgttgagggtgagtccg

SEQ ID NO: 1525 - DNA, 2440 bp, Unknown
  Kingdom: Bacteria, Phylum: Actinobacteria, Class: Actinobacteria, Order: Streptomycetales, Family: Streptomycetaceae, Genus: Streptomyces
ggccgccggggcgggcgcccgggtcaggcggggtcgatctcgcgcagccgaccggtcctgacgtcgaacacgaatccgcgtacgtcgtcggtgtgcggcaggaacggcgaggtgcgcacgcgctgcatcgactgccgcacgtcctggtcggcgtccttgaaggcctccacggcccacgacggacgctgcccgacctccatctccaggtcgtgccggaagtcctccgtgatggtctgcatgccgcagcccgtgtggtggatgagcaccacgctgcgggtgccgagcgcgcgctggctgatggccagcgagcggatcacgtcgtcggtgaccacaccgccggcgttgcgcagcgtgtgacagtcgccgagccgcagcccgagcgcggcgtgcaggtcgagacgggcgtccatgcaggccacgaccgcgacctggaggacgggccgcgcgtccatgccggggtcggtgaacgcgtcggcgtaggtcccgttggcggcgacgagccggtcgacgacggaacggtccgttatggcgtcctcggagttggcgggaactgatgcagaagtcgtcatactcatgacgttactggccgtgtgccccgcggtcgcgtcatgggagcggacaaagatcgccacagtggcttgttgtgagcgactccacacacagcgcgagccgcgtccgtgcgggtgaatccggtcggccggccgtgtcccggcactccggcgggcgacgcgcaggccggttgattgaccgggcgaccgggtcgactagagtgacgcgaagcgggaggcgtggtcctccctgctgtactgcattcaccggagaccacggcatacacccgaacggtctccccacgtgcgcggcgcgtacgtacggctcggcctccacccgctcccggtcggctgacgctcttggcgccggcagggcaccgtcgtccgcgagcggccggggacccggcggtgcgtgcggggcgcgccggacctgagagggccccttgagcgacagccgacacgtccccgtgatgctccagcggtgcctggacctcctggcacccgccctggagcggccgggagcggtggtcgtcgactgcaccctcggcctcggcggacacagcgaggcactgctcacccgcttccccgaggcccgcctcgtcgccctggaccgcgacaaggaggcgctgcgcctgtccggtgaacgactcgcccccttcggcgagcgggccaccctggtgcacgccgtctacgacgaactgcccgacgtgctcgaccggctgcgcatcccgcgcgtgcggggcgtcctgttcgacctcggtgtctcctcgatgcagctcgacgaggcggaccgaggcttcgcctacgcccaggacgcgcccctggacatgcgcatggaccagtccaccgggatcagtgccgcagaggtcctcaacacctatccggccggtgaactcgtgcgcatcctgcgggcctacggcgaggagaagcaggccaagcggatcgtggccgccgtcgtgcgcgagcgcgagaaggagccgttcagcaacagcgcccgcctggtggagctgatccgcgacgcgctgccgcaggccgccaagcgcaccggcggcaacccggccaagcgcaccttccaggcgctgcgcatcgaggtcaacggcgaactctccgtcctggagcgggcgatcccggccgcggtgaaggccctcgacgtcggcggacggatcgccgtactgtcgtaccagtcactcgaagaccgcctggtcaagcaggtgttcgcggccggcgccgccacgacggcgccccccggcctgccggtcgtccccgagcgctaccagccccggctcaagctgctcacgcgcggtgccgaacttcccagcgaggaagagatcgccgcgaaccggcgggcggcacccgcccggctgcgcggggccgagcgcatcagggaggacgccgagtgagccagggggaccagtgagcagcaaacccgagctgaggggccgtgccgcccggctggcgcggctcctgccggtgaagggccgacaggcggcccgcgcccccttcgtcctgctcgtcgtgctgctcctcggcggcggcctcatctgcctgctggtgctgaactccgcgctcagcgaaggcgcgttccagcgggacgacctgcagaaggacaccaagagcctcaccgacgaggaacaggccctccagcgggacatcgacgcctactccgcccccgacgccctccagcgccgcgccctcgaactgggcatggtgcccggcggcgacccggccttcctgaaccccgacggcaccgtcaagggcgtgccctcggccgccgagcagtccgccgtgcaggacctgccggtgtccgtacggccgcccgagagcctcacgaacgccggctacccggcgcccgccaccggcaccaccaccgcggcccccgggcagaccgaccc

SEQ ID NO: 1526 - DNA, 1930 bp, Unknown
  Kingdom: Bacteria, Phylum: Actinobacteria, Class: Actinobacteria, Order: Streptomycetales, Family: Streptomycetaceae, Genus: Streptomyces
gtccgggccggtgtcgaaggcggtgcgcggctcggcgcccagggcctcggccgccccgtcgggcagttcgacagcggtgagcggggcggtcgggaagtcgaggatgatcgcgccgccgtcggcaggcgtggcgatgagcacgccgctgcgggtggcgaagcgcaccggccccgtgtgcgcgccggtggcgtacaggacgtgggcggtggcgagcgtggcgtggccgcacatcgcgacctcggtggcgggggtgaaccagcgcagcgcccagtcggcctcgccgccctcgggcagtgggtgcgcgaacgccgtctcggcgtggttcacctcccgggccaccttctgcagccagtcgtcctcggggaaggcgtcgaggagcaggaccccggccgggttgccggcgaaggggcggtcggtgaaggcgtcgacgattcgaatccgcatgccccgaccgtaggggcgccaccgtgcgcccggccaaggccaattcggggtccgtggcccggtgttccgtgccctcggcgggacggggacggagaacccgcagttcggaagagggttgtcgagaactgttccgatatatcgttgagatatcgcgacagatcaacgatggaatggagtggttgcgatgcgtacccacggattcgagcgtggacaccggcacgacggcccccgtggcggcggccgtggcggcttcgacgggcgacgtgcggccttcggtcccttcgggccgggcggtcccgggttcggccccggcagccctggcttcggaccgggtttcggccccggcccctggggcgggcgagggcgtgggggaccgcgcggcagggcacggcgcggcgacgtacgggcatcgatcctggccctgctcaaggaccggcccatgcacggctacgagatgatccaggagatcgccgagcgcagcgcaggcgcgtggaagccgagccccggctcggtctacccgaccctccagctgctggaggacgagggcctgatcgtcagtgagtccgagggcggcaagaagctgttctcgctcaccgaggaaggccgcaccgttgcgggcgaagggccggacgcgccctgggaggaggcctcgcgcggtatcgactgggaggttctcggggagatccgccaggccggcttcgggctgatggaggccttcgggcaggtctggaagaccggcagcaaggagcagcgcgagaaggcgctcaccgtcatcaacgacgcccgcaagaagctgtacctgatcctcgccgacgaggactgaaccgccgcctcgcgacaggcgccccgtggagtcgtccgcggggcgcctgacgcgtgtgcggcggaggcgtcgcccggctgtgtgacgtccgggtacggcctgtgcggattgacctgatctcatccgtaaggaggagattccagtcgcccgggtccactctccgtgggacgcggaaatgcttcccgccggggatgaccggggcgcgcgggactgatgggctgggggatgtgcaaccccgtattcccaggcagtcggcccccgagcaggaccgcagccgtccggacgacgatgccgggctcagcgccgagctggaggcggtggtcgccgctgcccgcaggagagcggtgcgggacggggaccggcagatcgacaccgcccacctgctgcacaccctcctggaggcggaccccgaggtacgcgccgtcttcgccggcggtgaccggatcgcccggctgctcggctacctcgtccagcgcagcatcggttacggactgcgctggcagaccggcgtggaggactccggtgccctgcccgtggtgagcggcaccgcgaccgccgaggccgacggctgctcaccggtggcgtccgccgcactggaacacgcccgtgcgcgcgccgtccgccgcggggacgacctggcgtccggtgtcgacctcctcgcgg

SEQ ID NO: 1527 - DNA, 2926 bp, Unknown
  Kingdom: Bacteria, Phylum: Actinobacteria, Class: Actinobacteria, Order: Streptomycetales, Family: Streptomycetaceae, Genus: Streptomyces
ggaagaccaggttggcggcggccagcgtcgcctcggccttcagcgtgccggccatcagcaggccgaggccggagaaggcggccgtgccgagcaccagcaacaccagtacggcgagcgggttgccatgcggcgaccagccgagcgcgaaggcgatcacggtcagcaggatcacctggagcacctcggtgaccagcacggacaccgtcttggcggtcatcaggccccagcgcggcagcggggaggaggccagccgcttcagcacgccgtagcggcgctcgaagccggtggcgatggcctgcccggtgaacgccgtcgacatcacggcgagcgccagcacaccgggtgtgaggaagtccacggccttgcccgcgccggtgtccacgatgtccacggagctgaaaagcaccagcagcagggtggggatgacgacggtgagcagcagctgctcgccgttgcgcagcagcatcttcgtctccagcgccgcctgcgccgcgatcatgcggggcagcggggcggcgccggggtccggcgtgtacgtacccgtgggtgagccggtggcggtggtcatgagcgcagctccttgccggtcagctccaggaagacgtcctccagggtgtgccgctccaccgagatccggtcgggcatcacgccgtgctgcgcgcaccaggaggtcaccgtggcgagcagttgcgggtcgacctcgccgaccacgcggtacgcgccgggcgtcagctcggcggcggaggattcggcgggcagggccttgagcagggaggcgacgtccaggccgggccggccgctgaagcgcagggtgttctccgcgccgccgcggcacagctcctcgggggagccctgggcgatgacccggccgacgtcgatgatcgcgacgtcgtcggcgagttgttcggcctcgtccatgtggtgggtggtgaggatcacggacactccgtcggcgcgcaggtcgcggaccaggtcccaggtggcccggcgggcctgcggatccagtccggcggtcggctcgtcgaggaagaccagctcggggcggcccacgacggccatggcgagcgcgaggcgctgctgctggccgccggacaggcgccggtagccggtccggccgcagctgccgagcccgagccgttcgatcagggcgtccacgtccagggggtgggcgtgcagcttggcgacgtgccggagcatctcgtcggcccgcgcaccggagtagacgccgccggactggagcatgacgccgatacgggggcgcagcgctgcggactggccgaccgggtcgaggcccaggacgcgcaccgtgccggaatccggcctccggtacccctcgcaggtctcgaccgtggtcgtcttgccggcgccgttggggccgagcacggcggtcacgcccgcccgggccaccaggtcgaggccgtccaccgcggtcttcgtgccgtaccgcttcaccagggactgcacctggaccacgggctcacttcgcatggaaccagagtctagggacgcgccggacgtctcaggcgggcgggtgggcgatgtactcctcacgggggcggtgcacggcgagccagtgttcggcgtaggcgaccgcgtcggccagggggaacagccgtgcgcgggccgcgccgacctctcccgtggcgacgggccggtcgcgttcgaagtcgtgcccgaggtcgtcgaaccgctcggaggtgatggacacctcggtcacggtctcccagccgtgcggtccgggtctgccctcgcgcacacggggcgcggggatgcggtactcggcgaggtggaagcaggtgcaggcgtcgtatccggcgccgagcagcagcacgcgggcgccggcggcctcgagccgggccagtgggctgtgctcgccgagccggcagtcggtggcgtggccgtcggtgatctcccgcgcgcgtgggccgatcgcggcgaacgacgtctgcgggtgggcgctgcgcagggcgccgggccaggtgcggacggtctccgggatgacgccgaccccgcaggtgggggtggtcgcgggggcgtaggcgggcatggtggcccggatggtgtcccaccactcctcggggaccggcgggttgcgccacagcgcggggtcggagaggtcgccgctgtgggtggggacgacgagtgtgccgtccgggccgagggcgtcgaggagtccctggacgacggcgacggggccgccgcagacccatccgagggacttcagggaggagtgcgccagcaggatctcgccgggccggacgccgagtccgcgcagggcggcggcgaccgtgtcgcgggtcacaagagggccggtcgcagggggtgtgggcatggtccgggagtctggcccatggcagggcgaggcgccacccgtttgatcgatcacagatcgtttccgcaggtcggattaggtttgcctaagtgacgcagggcaccgtccgccccgacaggccgcgcttgtcaggggccgacgaattacgcaacaatggtgttgtgaaaaacgtcggcgaggctcgggagacccccacggggcccccgcaggaggagttcgcgaccggggagcgttccacgcgcaaccgggtcgtgcggtccgtcctggaccacggtccctcgaccgtcgccgagctggccgggcggctggggctcacccaggcggccgtacggcgccacctcgacgcgctggtcgccgacgacgtcgtggaggcccgcgagcggcgggtgtacggcacgcggacgcgcggcaggcccgccaaggtcttcgcgctcaccgactgcggccgggacgccttcgaccagtcgtacgacaagctcgccgcggacgccatgcgctggatcgccgagcaggagggcggccaggaggcggtcgccgccttcgcccgggcccgcatcgccgctcaggcgcgcgcgtaccgcgaggccatccagg

SEQ ID NO: 1528 - DNA, 3804 bp, Unknown
  Kingdom: Bacteria, Phylum: Actinobacteria, Class: Actinobacteria, Order: Streptomycetales, Family: Streptomycetaceae, Genus: Streptomyces
tcgccgcgttccacggcgggcctgcccgccgtggaacgcggcgacttcaccaccgaccactggctggccaccttcgccgtgctggcgctcgacctgcgggaccccgcgcggacctgacagctgacctgaccgcgggccgggctatcctggcggccgtacctggacacggggtgccccgcacggggctgagatcacacccgtcgaacctgaaccagttaggactggcggagggatgtcacatgtcattgccgcatgcccgcaccgagccggccgccggctcgcggcacgtcttcgacggacggatgccgacggcccccggtgatctgcggatggaggcgcgcggcatcacgccggtgcccgaggacacccgctacggcagccccggacggctgttcaccgtctggttcgcgcccaacctgaccatgaccggcgtgttcaccggcaccgtcggcatcgcgctcggcctcgatttcgccaccgccctcgccgccgtggtgctcggcacgctgctgggtgcggtgcccaccgcctacctggggacctggggaagccagaccggtgcggcacagatgcccctggcccggctggcgttcggcggggcggtcaccgtgccgggcgctctgcagtggctgtcgtccatcgcctgggacgcgctgatcggcctgttcggcggggaggcgctggcccagctgtgcggctggccgttctgggcgggcgtcctgatgatgatggcgggccagggcgcgctgggcgtactcggctacgaggccatccaccggctgcagacggtgatgaccttcgcgctcgccgcggccttcgccgtcctcgccgtcaagctcctgggccacgcccacccggcggcggccggcaccgcacacggtgccgacaaggccggcgcgttcgttctgacctgcaccgtcgcactgagcctggccctgtcctgggccccgtacgccagtgacttcagccgctacctgccccgcacggcgtcccggccgcgcatgttctggtacacgctgctcggcatcggcctgtccttcgtggcggtgcaggcgctcgggctgtggggcgccgccgagttcaccgaccagaccgcccacggcgtcgacacgctgctcggcgggggcgcgctcggcgcgttcgggctcctcgcgatcgcactcgcggccctgtgcagcaacgccatgaacgactacagcgggtcgctggccctgcagaccatgggcgtacgcgtgccccggccgctcgccgccgccctcgccgcggtgctcggcttcccgctggtgctgtggatgcacgcggccgacaccaccgcccgcttccagaacgtgctgctgttcgtcgggtactggatcccggccttcgtcgcgatcgtgatcgtcgactgggtggtgcgcgcccgggcccgcggtggcagcccggtcgacctggcggcggagagcgcccggccgcagccgtggtggccggccctcaccgcgttcgtcgtcgccttcgccgcggcggtgccgttcatgagcaccagcctgtacgtgggccccgtcgcccacgccctgcacggcgccgacctcgcctatccggtggcgttcgcggcggctctgctcgtctacgcgccgctgcgcggacgccgacggcactgaggcgacgacgctgaagcgcgcgtcgtcggcgaccggtgcggtggccgcccaccgcaaggaccgcgaggaccgcgaggaccgcgaggaccgcgagacgatcgagcatcgtcggtgggaccggtggtcacggtggcctgcgcagtcacgccagtaacgatgtgcgctttagcccattcggccccacactgaaagtgcctcgccgcgtgcggctcgcggggccgggtgaagagtccgctggtgctcccctcgggaggctccatggttctggtggcgctgtgcactccgatcgcgatgatgctgcttctgctggggatggacgccttcgaggaactcctgtcccgctggggcaccgaaccacccgacgaggagcagcccgagccctgacccggctcgggcgggtccacgcggcgctgcctgccggtcagctctgccgggcggcggtgtcgtcctcgggagccaggagtacggcgatacggctggcgcgggcgacggcatcgctgacgcgggggctgacgagggcctccagtgtgctgcggtggtggtggcccaggaccaggaggtcggcatcgaactcctcggccgcggcggagatggcggtggctatctgggtggtcaggccgcccgcgacagcgccgtcggcgtcgacgcccgcttcccgcaacgtggtgacggcctcgtcgacgacggccttggcctccacgtcgttctccaggggaaccacggcggcgagcgtggccgcggtgggagcgacgtgcagtacccggaccctggcaccggtcagccgggccatgtcaccggccagacggaccgtggcgtggcgggcggggctggggtctacggcgacgagaacacggtggaacatgagctgacttccttgtctctgcgggtttctgagggcgtttctgagtgtgtgtcttcgggtgtgcgtggtcctgggtgtgtccggcctggccacacctgggccggtgtgatcaagcaacgtcgtgaacaacgcgacggtgcggatctgttccgtgaggcggcaccggggcgtcccttgccttgaagtgggctccaactcgtagggtcgcggccaccaggaaacgacacccgaggagaaccgcatgcgccatcgcgttctgggcggcaccggcatcgaggtcagcccctactgcctgggcaccatgatgttcggcttcatcggcaacgccgaccacgacgagtgcgcccggatcatccatgccgcgctggacgagggcatcaacttcgtcgacaccgccgacatgtactcggccggggagtccgagacgatcgtcggcaaggcactcaagggccggcgcgacgacgtcgtgctcgccacgaaggtccacttccccatgggggacggccccaaccggggcggcaactcacggcgctggatcgtccgggaggtggaggagagcctccggcggctgggcacggactggatcgacctgtaccaggtgcaccggcccgaccacaggaccgacatcgaggagacgctctccgccctcaccgacctcgtacagcagggcaagatacgggcgttcggctgctccacgttcccggcggaccagatcgtcgaggcccatcacgtggccgaccgccggggactccagcggttcaggacagaacagccgccctactcgctgctggcccggggtgtcgaacggcatgtgctgccggtgaccgaacgcctgggcatgggggtgctgacctggagcccgctcgcctccgggttcctgaccggacgctaccgcaaggaccgggacctcgatctcagcagcgggcggcccactcttcacccggaccgcttcgaccccacggcgcctgcgacccaggcgaagctggaggtcgtcgagcagctcgtggcggtcgccgaggaggtgggctgctcgctgccggagctggccctcgccttcccgctcgctcatccggccgtcacgtcggtgatcatcggcccgcgcacgatggagcaactgcgcgccgcgctcaagggccggtcgatggtgctcgacgacgcggtgctcgaccggatcgacgagatcgtgccgcccgggaccgacgtgtacccgccggacggcgtgtgggcgccgccgtcgctcacggtcccggcgctccggcgccgcccggccggttcccgttccgccgcctgaagcacgtctggcgg

SEQ ID NO: 1529 - DNA, 2204 bp, Unknown
  Kingdom: Bacteria, Phylum: Actinobacteria, Class: Actinobacteria, Order: Streptomycetales, Family: Streptomycetaceae, Genus: Streptomyces
gcggggccgcgaccagcgccttcgcccagcgtttgtggcgccagcggtgcggccagcagaagacggcggcgaccgcgccgagcgcgaacatcgtgcccaggccgaacgtcacccggcccgatatggcgttgcacagcagcccgaagatcccggccgccgacgcccacagcgggttcctgaccacgcggctgcggatgaggatcagggtgagcagaccggcggagaccgtgcccgcgatcatcatcgtggtacggacgccgagcacggacatcaggtacggcgacaccatgctgtacgagaccgcgtgcataccgccgtaccaggcgaggttgtacgcggagtccgggtgccggccgacgaactcggcccaggcgtcctgcgcggcgaggtcgccgccgctgttggcgaacgtgaagaaccagacgatgtgcagcacaccggccaggccggtgatcgagaggacggggtgccggagcatccgctcccgcagcgccatgacggcggcccgggcgcgcggccatcgggaagcggggccgggggcggcggtggcggtcgagtcaccttcccggggccgcccgcggtcaccatcgccgtgcgtgggcgaggtgtcacgttccgtgtcagtcgtgcacgaacctattcgcgggccggcttccgggcccggatcggcgtcgtcggcgcgtgtcggctccgcagtggccacctgaaggcactccccgtgtcccgttctctgttcgcggcctcgtcccacgaccggtgacgtgcccgattcgtgacgctagcacgcaccccgccgaggagcgcccgggtggggctcgtcgacggggtgcgcaggcactcgcaagcagcggctcacggggctccggcacgcggggtgccgggcgcgcgtcagccgaggcgggtcagcttggccgcgaagccgggctcggtgaggtccttctgcagggcgaccgggaccttgatcgcaccgcccgcgccgccttcaccgacggtgagcgtgccgaccttggtgccggtcttcgccgagtgcggcacctggtccggggcgaaggacaccttcacctgggaaccggcccagccgaccgcggtgacgtcctcggtgaccacgaccggcgtgtgaccgccgagctggtcgtcgacgtacccgacgacgtcgcccttcttgaggatcttcgccgaggtcagcgcctccttggcggccacgagagcggtcttgctgacctggttgacggtggtcaggatcggattcttgcgctgccccaggaccgcgccgacgacggtgaccgtctggccgccgaccttcttgcgggcggcgaagagcaggttgccgccggcggcggtggtgctgccggtcttgatgccgatcgcgcccatccggtacggcagttcgttccagttggaccagttcttgccggacgggtccgtccagctggccgcgctggtgatggccaccagcgccgcgttcttcacgacctcgttgccgagcttcacctggtcctgggcggtggagacggtggtcttcgtcaggccggaggggtcggtgtacgtcgtgttggtcatgcccagctccttggcggtggcgttcatcttcttgacgaacgccgcctcggaacccgcgtcccagcgcgcgagcagccgcgcgatgttgttcgcggacgggatcatgacggcggacagcgcctgcttctcggtgaggaactggccggccttgaccgtgttgagggtggactcgtcgccggtcttgtcgtagccgccctccttctccgcctgcgggtcgatctggatcttcgggccctcctggcccaccttcagcgggtggtcgcgcaggacgatgtacgccgtcatggtcttggcgaccgacccgatggcgaccggcttctggtcaccgaagtggtccatcgtgccgacgccgtcgacgtccatccagccctggccctcgctcggccacggcaggctcagcttgctgccgtcgaaggtgaaggtgtccttcgcggtgagggcgagggtgggcgagggcagcgggcggaacgcctgcacgaccgcgaagacgaccgcgagcagcaggaccagcggggtccagatcttgacccggcgcacggtggtgcgcagcggggtctggggcggcggcggcgtgttcgtcagctccgccagcaggtccagcggcggcttggggggcagcggctgctgggtggtgggctcgaagc

SEQ ID NO: 1530 - DNA, 1714 bp, Unknown
  Kingdom: Bacteria, Phylum: Actinobacteria, Class: Actinobacteria, Order: Streptomycetales, Family: Streptomycetaceae, Genus: Streptomyces
cccgactacgagcggctcagcccctactccggacagctcggcgacgagctggccggcatggtgcgcgactacgcaaagcagaagcgctaccccttcatgggcccgatcaaggtccacctggagaaggcggacgacctcgacaccggcctgtaccgggtgcgcagccgtacgctcgcctcctccagcagccagcagggcccggcggggggccctgcggcggggcctggggcgcctggccctgctggctgctggaggaggcgagcgtacggctgcgcacccggtacaggccggtgtcgaggtcgtccgccttctccaggtggaccttgatcgggcccatgaaggtgtagcgctgctgcttggcgtagtcgcgcaccatgccggccagctcgtcgccgagctgtccggagtaggggctgagccgctcgtagtcgggcgcgctcagctccacgatgaagtcgttgggtacgaccgtgcggtcgcggttccagatcgtcgcgttgttgtcgcactcgcgctgcagtgcgcccgcgatctccacgggctggacctcggacttgaagaccttggcgaaggtgccgttgaccagaccttcgagacgctgctcgaacttcttcaggactcccatggggcacctcctccgtcgtggccgtcgcttcgggtcttgccggtgttgcggttgtcgcgggtcttgccgtcgtgctgatgcgttctgctcgcctggtactgcttactgatcgtatccacgcgccggtaaatcggctggttccccctgtcggcccgtcgacgggtcgtcggcgtctcctcctcggcggctggtaccgctgcgtactgcttcgtactcctccgtaccgctgccgtaccgctgccgtgctcctgccgtacttctgcccaggatcgtagaggcggccacggaccagtgtcccgcacccggcggcggacccgccccggctcctggggagacgggccggaccggtacgaggttgatacgtgaacaggcacgggttgatacggaagcggcgggcagccgggccggcgggcgtggcgggcgccgcgggaccgcgtggccggtgggcaggacggcggggcaggacgggagcggggagggccccgggcctgggcaactgccccgggaaagggatgtgaatccaccctgcgcggcgtgctaatgttctgcatgtcggaaggcgccgggcccgaaagggagcggagccggaggacacacccaatgcgcgggtggcggaataggcagacgcgctggattcaggttccagtgcccgcaagggcgtgggggttcaactcccccctcgcgcacagcggaaagccccgcaggtctcggacctgcggggctttcttgttccccgggcggcgccgggtcgtgtgacatacggccgtcggcctgtggggaaggtctgtcagcctgtgaggaaggtctcaggaggggcagctcactcggcgcgccacagggcggggacgtggggcggctcccagcccgccatggacgtgtgggcctggacacaggtgtagccggcgccgtcgtacgtcacccggtcgcccgccgcgtaggcgcggccgggggcccaggtgccgcccggcggatcggtcggcgggtcggtggggccgccggggccgggggtgccgtcgacgttcagcacgaagtcgaacgtcccctcctcgccgctgccggcgccgcgcccgttcatcagcagcgcggggt

SEQ ID NO: 1531 - DNA, 1253 bp, Unknown
  Kingdom: Bacteria, Phylum: Actinobacteria, Class: Actinobacteria, Order: Streptomycetales, Family: Streptomycetaceae, Genus: Streptomyces
gcgagagcagtgcggcggccgccgaacgcccccgaggcgccggccgccgcactgctctcgctcacctaccgctcctccgtatgactgcgtgcccctgtgcactgtgcagtgtgaccctgtgccgtcctggaggacgcggcggggccggtatgcgttgaccgtggccgcggcggtgaccggcgaccgggcgcggctcagacgtccgccgccccggcgctcccccgggtctcgtcggccgcgccggtccggccggtcgcttccgtggcgttcacgtgcacgcggggaacgcgtgttccgatgcgggtgacgatctcgtacgcgatggtgcccgcggcctgcgcccagtcctcggcggtgggctcaccgcggtcgcccggcccgaacagcacggcctcggacccggtgccgggctcgtcgccgccgaggtcgacgacgaactggtccatggcgatccggcccgcgaccgtacgccacttgccgccgaccagcaccgggccggtgccggaggcgtgccgggggatgccgtcggcgtatccgacggggacgaggccgagggtggtctcgcccggggtgacgtagtggtgcccgtagctgatgccgtgcccgccggggacgtgcttcaccagggccagcgaggcggacagggtcatcaccgggcgcaggccgaagtcggccggggtgcccagttccgggctgggcgagatgccgtagacggcgatgcccgtgcggaccaggtcgaagtgggtctcgggcagggtgagcgtggccggcgagttggcgatgtgccgcacctcggggcgcacgccctgcgcctcggcgtacgcggtcatctcgcggaaccgggcgagctgcgcggcgatcgacgggtggcccggctcgtcggcgcaggcgaagtgggaccacagtccggtgatccggacgagtccctcggcctcggcccgcagcgcctcggcgacgagggcggcccagtcgccgggctggcagccgttgcgtccgagcccggtgtccgccttgagctgcacgcgcgcgggccggccggcggcgcgcgccgcctcccgtacctccgccatggcccacagcccgctcacggacacgtccacgtcggcctcgacggcctcccgccaggggccgccaggcgtccacagccagcacatcacccggacctggtccggcgaaagaccggccgcgcgcagcgccagcgcctcctcgggtgtggcggtgccgagccaggtggcgccggcggcgacggccgc

SEQ ID NO: 1532 - DNA, 627 bp, Unknown
  Kingdom: Bacteria, Phylum: Actinobacteria, Class: Actinobacteria, Order: Streptomycetales, Family: Streptomycetaceae, Genus: Streptomyces
ggccagcaccgtgcccgcggtgtcggagcgctgggtcgccgggtgccagccgagcaggtgccgccacagcagcggggtgccggcgagtggccgggtggtgatgccgggggtggtcgggaaggtggcccggcacagacccaccgcccggccgacctggaccaggtgcacgcaggaggcgatgtccgtctcgtacatgcgtccgggcgcgaacccggcacgggcacaggccgcggtgaaacagtcggcgaaacacccgtcaccgggcacgcaggcccactcctcgtccgccagtttggccagctccacctcgagggcgggggcgagcgggtggtcgtcggcgagcatgacgaagaccgggtcgacggcgaactcctcccaggccaggtgctcggtcccgggcggcgcggcggtgccgcaggcgccggtgacggcgtagtcgaggctgccgtcggcgagcaggccggcgagttcccgttcggaccaggatgcctgcgtcgacacgtgtacgtcggggacggcggccgccagcaggtcgatcagggcgcccagcagcggcccgtgggtgccgcccagccgcagccgctcggccgcccggccgccccgcgcccgggcgaaccggacggcttc

SEQ ID NO: 1533 - DNA, 3418 bp, Unknown
  Kingdom: Bacteria, Phylum: Actinobacteria, Class: Actinobacteria, Order: Streptomycetales, Family: Streptomycetaceae, Genus: Streptomyces
tcccggtcgaccgctctgacctcggcccccgcggcggccagccggagtgcgcaggcgcggccgatcccgccggccgcacccgggacgagcgcggtgcggccggcgaggtcgagcgggcggccgtggggtgcgccgagcggggagctgtgtggtgcggggtgggggccgggagaggtcatgcctcgaccttaggcagcgcccgcaccccgccgcatatgggcacagcccatagttcagtcaagatcaatagggtcgaaccacgtgggagcgtcggacatggcctgcttgatccggaacagcgcgaagtcgttcagggcgggcagtgcgtccaccgcgaaccatcccacttccagcgactcgtcgtcgttgacccgcgcctcgccgcccacggcacggcagcggaaggtgatgtccatgtactggcagacgtcgccgttcgcgtaggtgacggggtccagcgcctggaccaggaccactcgctcggtgacgcagcgcacggcggtctcctcgtacacctcccgcaccgcgcacgcggcgggctgctccccgggctcggggatgccgccgatcaccgcccacttgccggtgtcggagcggcggcccagcaggaccctgccctcgtcgtcgaagacgagggcggtgaccccggggagccacagcaactggttgcccgcggcggcccggatcgtacggatgaagtcaggagtggccatggaccgaccctaacggcccgataccgccggtcagcgcgcggacggtgcggtgggcgggggcgtacgtccggcgtacggtcacgcctcctgggcgcgccggccgcgcacaccggccccgatcgcccagcccaggccgccggccgcgaccaggacgaggacgatctccggcaggacgcccagctcggtggcgggcgtccgcgaggagcgcagcggcaccttctggaccaggtgggccgggacgaacatgccggtcttctgcgtgatgtgcccgtcgggcatgatgatcgcgctgacgccgctggtcaccggaacggtgacggtccggctgtgctcgaccgcgcggatgcgggacatggccagctgctggtaggtcatctcgctgcggtcgaaggtcgcgttgttgctcggcacggagatcatctgcgcgccgtgggtgacggtgtcgcgcacggcccagtcgaaggcggcctcgtagcaggtggccaggccgatccgggtgccggcgacggagaacacgcccggttcggtgccccggctgaagtcctggcggaccatcgaggtccagttcccgttgatcgcgccgagcagcgagcgcagcggcaggtactcgccgaacggctggatctgccgcttgtcgtaggtctgcacgggtcccttgaccgggtcccacaggatctgctcgttcagcagtctgccgtcgcgctccacgacgctgccgaccgagatcggcgccccgatcgccttggccgcctggtcgaccaccatccgcgcgtcgagatattcgagcgggtcgatgtcggaggagttctccggccagagcacgacgtcgggccggggggccttgcccgccttcacgtccgccgcgagccgctcggtctcccgcgcgtggtagtcgagcaccgcgcggcgctgggcgttgaactccagaccggagcgcggcacgttgccctggatgacggcgacggtgacggtgccgttctccgccttgtcgctcaccagggtgcgggcggccagcgctcccccgaccggcacggccacactcaggagcgcgacggccgcggccgaccggcgcagcgtccgggcccgccgtccctgcaccgcgaggcgtacggcctcgtacagcccgaagccgcacaggaccaccgcgaagccgagcaccggcgtaccgccgaccgcggccagcggcaggaacacaccgtccgcctgaccgaaggcgatcttgccccaggggaagccgtggaagggcacgcgcgcgcgtgccgcctcaccggcgatccacagtgccgccgcccacaccggccaggcgggcagcttcgacaccgccgcgatgcccgcgcccaccagggccacgaagagcgcctcgacggcgaccagcgccagccaggggccggggccgacctccacgccggtccacaccagcaggggcagcaggaaaccgaggccgaagaggtagcccaggccgagcgcggccttccagccacggccgcgcagcgtccaggcgaaaccggcgaaggccggcagggccagccaccacagggtgcgtggcgggaagctgacgtagaggagtacgccggacagtgccgccacggcggcgggcacgagtcgtacgagtctcgcggaccaaggcgggcgggcggaccgcgggtgcagccggtccgactcgtcgacggaagttgcggtgacggtcaccccgggagtgtacggcggctgacctgccccttgacagcgcggttcgcgggccggaacaggggcgccggccaccggtccgaagccccgccgggccccggtgagacgtcattcccgcgcgggacgcacccctcaggaccgtccggccactgcgccggtgcaccgctcaggcgcgtcctggtgccggcgggcgcagccggtccctgatcacgcggaccgccgactccgcgttgtcgacggtgatcgtgaaggtgtggccgtcccagaggctcaggacgatgccctcgccgcgccggacgaccaccgcggtgcccttctcgggacgccagcggtagccccagccgccccagtggcgcggagtgacgtgcggcgcgaactcggcgtccgtcacgtgggcgagcggaatgcggcggcgcggcagccctatgtggccgcagcgcacctccagggactccttgtcgaccttcagcgcgacgtgcacgaaggcgagggtgccgaagaggaccaggagtccggcggcgatgcagcccacgaccgacatcaccagcgcggggacaccggaactccaggcggagtcgacggccagttcgattccgagcgccaggcaggcggcaccgacgagcgccagcagccactggaaccggttggtggcccgtcccgtccacacctcgggatgcgggccgttctcgacgcgggagtggtccctcatggcaatgaggttactcaggtttcgccgcgtgggtagcgcgtcgcacacggggagtgtcccgtaccgggggcctcggcttgcggcgtccgccgctgtgacgccggccgctgtcgccgtgcgtcagcgggcgggggtgaccgtctggaggagacggccttccgcgtaggccagggccggcgcgggcagggcgccctcctgaccgttgagcaggaccgtcacggtgccttcggccggggcctccggctccggccgggcaccgatgcggcgcagcgcctgggcggctacggcgcccgccgagccgtgcaggacc

SEQ ID NO: 1534 - DNA, 1993 bp, Unknown
  Kingdom: Bacteria, Phylum: Actinobacteria, Class: Actinobacteria, Order: Streptomycetales, Family: Streptomycetaceae, Genus: Streptomyces
aggcggcccgtccccaggagcgggcggccgaagccggcggcggtggcgcccgcggggcggacccgatggaggtcgcgcgccgcggccacctgcgtgtcctgcgttcaccggacaactgacaaaaccgttcaccacggcccgagtcgggcacggtgtccccgttctccccaccctccgcggcgcgttccgccacgcccgacgcgctcacccctgccgctccacccgacacccgccacccgcctcgtgcgtcggcggcactgcccgggacgggtagtttgtggggacccgatcggtacttcagaagggttggccgtggctgctgatctgtcgcagatcgtcaaggcgtacgacgtgcgcggggtggtcccggaccagtgggacgagtcgctcgcggagttgttcggcgcggcgttcgccgaggtgaccggtgcggacgccatcgtgaccggacacgacatgcggccctcctcgcccggcctggcccgtgccttcgcgcgcggtgcggcacggcgtggcgtcgacgtcaccgagatcggactctgctcgacggaccagctgtactacgcctcgggcgcgttgaacctgcccggcgcgatgttcacggcctcgcacaacccggcgcagtacaacggcatcaagatgtgccgcgcgggcgccgcacccgtcggccaggacaccggcctcgccgagatccgcgaactgacggagcgctggcgcgcgtcgggcgccccggaacccgccgcgcgcacgggaaccatcacgcagcgcgacacgttggaggattacgcggcgcacctgcgctcgctcgtggacgtgacctccatccgccccctgaaggtcgtcgtcgacgcgggcaacggcatgggcggccataccgtccccacggtcctgaccggcctgcccgtcgacctcgtcccgatgtacttcgaactggacggcaccttcccgaaccacgaggccaacccgctcgacccggccaacctcgtcgacctgcgcaggcgggtccgcgaggagcgtgccgacctcggcctcgccttcgacggcgacgccgaccgctgcttcgtggtcgacgaagacggcgagcccgtctccccgtccgcgatcaccgcgctggtcgccgcccgcgaactggcccggcacggcggccgcggtgtgatcatccacaacctcatcacctcctggtccgtccccgaggtggtgaaggagaacggcggcaccccggtgcgcacccgcgtcggccactccttcatcaaggccgagatggccaggagcggcgcgatcttcggcggcgagcactccgcgcactactacttcaaggacttctggaacgccgacacgggcatgctcgcagccctgcacgtcctcgcggcgctgggcgggcaggacggccccctgtcggcgctggtcgcccagtacgaccgctacaccggctccggcgagatcaactccacggtcgccgaccaggccgcccgcctcaccgcgctcagggccgcgtacgccggtcgcgacggcgtcaccctcgacgaactcgacggcctcaccgtcaccgccgccgactggtggttcaacgtgcgcccctccaacaccgaaccgctgctccggctcaacgcggaggcgcgcgacgaggcgacgatggccaaggtgcgcgacgaggtcctggagatcatccgaggctgaggatccggcagccaccggacgcccccggccgggccggcccgtgctcgccgagcgctccaccggaggacggcccgaacctgaccgatcccgccatcggcgccccgaccggcggtacgctgaccaggcacgtccgtacaaccacacacgcaccccgcgccccgaagggaacccccatgccgctcgaagccggcctcctggagatcctcgcctgcccggcctgccacgccccgctcaaggagcaggacaccgagctgatctgcaccggtcaggactgcggcctggcctacccggtccgcgacggcatccccgtcctgct

SEQ ID NO: 1535 - DNA, 1149 bp, Unknown
  Kingdom: Bacteria, Phylum: Actinobacteria, Class: Actinobacteria, Order: Streptomycetales, Family: Streptomycetaceae, Genus: Streptomyces
cggcggcggtccagctcgccgcgggtccaggccgcgccgagggtgtacggcacgagccagccggccggcaggttcagccagccgagccagccgggcgcgccgaggccgaaccggaggaggtccacgtgcaggacgaccgccagcggccacagcgggttgagccgggtcagcagcggtgtagcggccgtcagcgcggcgaagaccaggaggaaccacatgggcgacagggccagtttgacgagagtgcggaccgtgttcgggtccgcgccggtcagcaggagggcgaccgccgtggtggcccacagggccagtacggcggcggccggtttgaacaggcgggacagccgggcgtgcagccaccgcggataggtggtgccacgcgcctgggccgaggcgtagctccgggtggccacgtggccgccgaccaggaagaagacggcgagggtctggaagacccaggagatgggcgccagccagggcatggagtgcagggggctcgcggtgtggagcgtcgggtgggcgccggtgcgggtgtcctcgaccagtgccgtgaccagccagtggccgagcaccacgccgaggatcgcgaaggcgcggagcgcgtccaccgagcggtccctcccggacggggtggcggcgtcgatccggtgagccgccgcccgtatccgggcgagcgccgggacgtgggcgcgtacggcggtcgcctcgggcggcgcggtcgcctgccgcgcggcgagggttcggtcggtcaccgcagctccttcgtggtgcccaggacgatccgggccatgttggtcagggacggggaccccggggtgaagtaggcgctgtggccgccgcttccggccgggaacgtacgggcgccgaaggccgggtccatggggtcggtgccgaagccgacggtcgtgccgagcaggtcggcccgcacatgcggcacgttcgccacccagtcgtcggtgccgcgggccgcccacacgcgggccggtgtgtgcagcgcggccacggaggcggcccccgtgccggggctgccgatcagcgcgatgtcactgacgtccaggccggaagcggcccggccgcagaccaccgagccgtaggagtggcagaccagggtcaggtgcgccggcctgcccggcgcgccggcgacggtcc

SEQ ID NO: 1536 - DNA, 1122 bp, Unknown
  Kingdom: Bacteria, Phylum: Actinobacteria, Class: Actinobacteria, Order: Streptomycetales, Family: Streptomycetaceae, Genus: Streptomyces
gcggcaccgccatcggcacctggctgcggctcgccgaccgcctgctcgcctcgcaggacgtcgccatccggcacggcatcctgctcaccgacggccgcaacgagcacgagtcgcccgaggacctcaggcggacgctcgacgaatgcgccggacgcttcacctgtgacgcccgtggcgtgggcaccgactgggacgtgaaagaagtcacagggatcgcctccacgctgctcggcagcgccgacatcgtcgccgatccggcgggcctggccgccgacttcacctcgatgatggagacggcgatgggcaaggaggtcgccgacgtcgccctgcgggtgtggacgccggtcggcacgagcatccgcttcctcaagcaagtcgccccgaccgtggaggagttgaccggccgccgcagcgaggccggtccccgcgccggggactatccgaccggctcctggggcgacgagtcccgcgactaccacctctgcgtcgaggtcccgagcgccggcctcggccaggaaatgctggcggcacgggtctccctggtggtgccccaaccggacggaagcacacagaacctcggggcgcaggggctcgtacgggccgtgtggaccgacgacatggccgcctccacctcgatcaacccgcaagtcgcccactacaccggccaggccgaactggcacaggccatccaagagggcctcgatctgcgcaaagcgggcgatatcgatggtgcaacggccaaactgggacgggcggttcagctcgccggagcctcggggaacgccgatacggccaagctgctctccaaggtggtggacgtggtggacgtggcggcgggtactgtgcgactgaaggcgaaggtcgcggaggccgacgagatgactctcgagacccggtcgacaaaaactgttcgtgtaaagaagtgacctgacagacagcgagcccggcccctcggggtgggagaaatccggtcgatgcggccggacaaggagagggggaagcgccgacatgccgacctgcccgaacggacaccagtcgggttccgacgactggtgcgaggtctgcggtcaccgcatggctggtgccgtaccaccaccccctccgccgccacgtccaccacgt

SEQ ID NO: 1537 - DNA, 1936 bp, Unknown
  Kingdom: Bacteria, Phylum: Actinobacteria, Class: Actinobacteria, Order: Streptomycetales, Family: Streptomycetaceae, Genus: Streptomyces
gtccaccatcgcgcatccggcgcgctcacgcgtccggaacccagcttccgtggaagccgagcggcacccggccgggcaggtggacccgggccaccggctcgccggtgaagtcctgcgcggcgaggatcaccaggtcggcggcgccccggtccgggttgtggacgtaggcgagggtgtacccgtcgtcctccgcggcccggcggtcgccggcgtcgcgcggcacgaacaccgcctcgcccgccgccgcacccgtcggcagccggtgcacgtgggtgcgcccgcgcagcaggtcgtgcttgatgagcgcgttggagaaggcgcggtcgggcggattgccgtccgccgtctcgtaggcgagcgtcatctcggccgccgcagccgagtagccgtagcggtgccgccgtgacaccagcgcctcgttcacccgcgggaactcctgcggacgcccgtcgatcgtcaccttgctgacgtggccgtggtgcggatcgatcgtccagcgttccagcaccggatggccggcgccgtacgggccgcccgagccgcgtccggcgacgtagaacggcgccggatacgtcgtcaggtcgacgaccacgcgcgaaccctcgtcgtaggcgttgagggtgtgcgagtagtacgccgggtccgtctcgatccagcggacctcaccgcccgcccggggcagcagtcccacgcgcatcgggtgcttgtcattccagacgtagggcaccgggtcgccgcgctcggcgcccgccgcgtcgaaggtgaccggcgcgtcgatgacgacgacgtacgtctcggtgagcgcgaagtcgtgcagcatcggcgcgtccgccaccgggatccgcgtcgtgcgggagacgcggccggccgggtccacgaccaggtggcgcacatggtcccaggtcgggtagtacgcgatcgcgtgcagctcacccgcgtgcacgtcgaacttggtgtgtgccgcgaacgcgccctccagggtgccacggaagtcgtacgtccccacggtgttcagctcgccgtccagctcgtacggcagcggcccgctctcctggagcgcgaggatcctcccccggtacgggatcacgtgcgtgttggacgggaagtcgtccggcggcaccgggcgcggacagggctcgccgagcttctgcgcgacctgcgaggagcggacccaccggttgcggtaccactccgcgcgcccgtcgcgcagccgtacgccgtggaccatgccctcgccgagcatccagtggtgcgcgcgcgggtcctccaggccgagcacgttggggccgttgcgcaggaagcggccgttcagctcggcggggatacggccggtgaccggcaggtcgaaggccgtcagctcctcggtgaccggcgtgaaggcgccttccaggaagggatagtggcgcttcgccgactgccccggggcggcggtggccgcctgtgccgcccgctgccctgccgggccgccgaggaacccggccgtcgccgcgatcgccgcgccgccgcgcagcacgttccgccgtgtgtgctccctcatcgtccgtactcctgaacgccgttgccgtgaagggacgtccatgagtctgctgcgccgaggccgccggatcaggagggctggagcccctgtgggggtgtggccagcccccctgttcccgatgtgccgagcagggtgatcagcgcgcgggcggccgggctggcggcctgctcggcgggcagcaggacgacggtctcgtacgccgtcccgccggcgccgtcgaaggggagtgcggtgagcgagggccgcttgtgccggaagtgccgtgggaccaccgcgatgcccaggttctcgtcgaccaggtcgagcaggctgtgcacgtcgttgacctccagggccaccgtgcgccgcacgcccgccagcgcgaacgccgcgtccggggtgcggcgcacggtggccctg

SEQ ID NO: 1538 - DNA, 2854 bp, Unknown
  Kingdom: Bacteria, Phylum: Actinobacteria, Class: Actinobacteria, Order: Streptomycetales, Family: Streptomycetaceae, Genus: Streptomyces
cctcggcccgctcgtccgggccctgcgcgccgccggggccgacgccgaggccgtgcactgggacgacgcggacgccgactgggccgccttcgacctcgtcgtcatccgctcgacgtgggactacagctggcgcgccgcggagttcgtggcctgggccgagcggtgcgcgcaggtgacacggctcgccaacccggccggggtcgtgcgctggaacaccgacaagcgctacctcgcggacctcgccgcggccggggtgcccaccgtgccgacccgctacctcgcacccggcgacccgtacgcagcgcaggacctgcccggcgaccacgacttcgtcgtcaaaccgtccttcggcgcgggcgcccggttcgccgcccggtacacgcccgccgagcgggagacggccgccgcgcaggtcaagcgcatgcacgcggagggcctgaccgcgatggtgcagccgtatctgccccgcatcgacgtcagcggcgaacgggcgctgcagttcttcggcggccggctgctgcacgccagccgcaagcgggccgtcctgtcgcccgggacggcctacgacgccgagaaggtggcccacccggacctcgaaccctggacgccgacacccgccgaactcgccgtcgccgaaaaggcgttggcggccgtgcccggcgcacccgagctgctctgcgcccgcgtcgacctcgtggacgtggggaacggagaggagggggacggcggcgcgccgtgcgtgatggaactggagctggtcgagccgaacctgttcctgtggctgcatccgggctcggagcagcgggtcgtgcgggagatcctggccgccgtcccggcccgctcgtcccgcccggggccttctgtgccgcctacgcgtccctgacccgtgtccgctggagcagcccccaggtgaactccgcgacgacctcgcgccgtacgccccgcgcgccgagcgccgtgaaggccagcccccagcgcgtcggcgcggtgccctccagcggacgggcgggcgcgaaggcgcgggcggcctcgtcgaccgtgcaggaccagggagcgaggtcgtcgagcgtacggaggtcagggccctcggcgccgggcgcgcggaccagccacgcgttccagacctgcccgtccgggccggccagcacctcgaaacgcagcccgggccagagcggcagcgcccactgccgggcctcgcagtccaggtcgccgatccgccgggcggcggtggactcgggcgcgccgaggacggagcggatggggataccgcccatgctgtccaggctatgggggagggcggcggccgaacgcgccctgggcgagcgcaccatggcctgccaacgcttgttggcctcacgcatctcggtgagcgaggcccccagctcacgccgggcgtccgccaccaggtccggctggtgatcggccatgcgccgcagcagcaccagctggaagtcacggggagtgaagggcgcggagagggaggaggcagccatacgcaccatcgtcgcgtacgtgcgccgtaccgcggggcgcgcggtggtgcgggcggcggcgcacagcggccgagccccactcgcccgcaccgctgcccccgcccattgcccccgtccctccccatggctagcctgtgttcgtcatgccgatcgcctgttgaaatctcgaacaggcctggattgaggggagggggccggtcgtgggacgcctcgtacctgccgtgacccgggctctcgacatactcgagctgttcctcgacggggacggcacgctctccgcccccgacatcgtgcgcaggctccagctgccgcgcaccacggtgcacgagctggtcaccacgctcgccgcccgccagtacatcgtcccggtcaccggccggcccggacgctaccggctcggcgtacgcccgtaccagctcggcagccgctacgccgagcagctcgacctcgccgccgagggccagcaggtcgcccgcgccgtcgccgagacctgcgacgagacggtgcacgtggcgatcctggagggcgccgacgtcatctacatcgccaaggtcgactccacgcacgcggtccgcatggtctccgcggccggccgccgcctgccggcccactgcacctcggtcggcaagatgctgctcgcctccctccccgagtccgcactcgccgaacgcgtcccggacggcgccgaactggtcgcgatgacccccaacagcatcaccgatcccgccgccctgcgcgaggccctggccgagatccggcggcgcggcctggccgtggagaaccgcgagtcgaaccccgacgtcagctgtgtggccgcgccggtgcgcgaccgtaccggccaggtggtcgcggccctgtccatctccgtgccgatgatccgctggagcgaggagcgcaggagcgagctggagcagctcgccgtgaagggcgcggcccagctctcggagcgcctcggccaccggagcgcggcatgacgacgacggcgtacgacgtggcggtggcggcccgggccgagctgggcgagggaccgacgtgggacccggcggcccagcggctgatctgggtggacatcctcgcctcccgggtgcacaccttcgatccggcgagcggccggcgcacggtgcgcaccaccgggcagcacgtcggcgccgccaagccgcgcaccggcggcggactggtgctgaacctgcgcgacggggtcggcctggtcgaccccggcccggacggtgccttccgctggctgcaccgcgtcccggtgcccggccgccgcggcaacgacgccgccgtcgcgcccgacggctccctgtgggccggcaccatgcgctacgacgaggcccggggcggcggcaccctgacccggc

SEQ ID NO: 1539 - DNA, 573 bp, Unknown
  Kingdom: Bacteria, Phylum: Actinobacteria, Class: Actinobacteria, Order: Streptomycetales, Family: Streptomycetaceae, Genus: Streptomyces
gggtcacgggcttcgccgccggggacgaggtcttcgggaacacggcggcgaagcccgtgaccccttcgccggcctcctccacgacaccggacgcctcgctgccgaagacggtcgggaagaccggctcaccgctctcgccgggccgccggaaacccgtgcgcagcttccagtcgaccgggttcacccccgccgcgcgcaccgcgatcaggagctgccccggcccgggccggggccgctcgacctccaccagcgcctcggtctccgggccgccgtagcgggtgaagacatacgccttcggcatcgctcccactctccttcttctcggtcttcccggtcttcccggtcgctcgctgccgccgtctccccggctgcgagacgccccggccggcacgccacctgcaagggagatcgcccggcggctattcccggcggcagaggtccggccggagagttcatacggccgtcacgatggcgggcccggccgggtcgggagcaggtccggcgagcacgtacggttgaatgcgtaagcaaccgtcccgtccgaccggcaggatccgtcccgccggccggcgg

SEQ ID NO: 1540 - DNA, 1696 bp, Unknown
  Kingdom: Bacteria, Phylum: Actinobacteria, Class: Actinobacteria, Order: Streptomycetales, Family: Streptomycetaceae, Genus: Streptomyces
ccggtacgcctggccggcctgcctgctgttcacggtcccgtggttcctgcaccgccgcgtcccgcgcctgccggtgacgcacgtctggtacgaccgcgccgccggccgcatgacggtgcgccccgcctccttcgcctgcctgccgggcgacccggcggccacgctgcccggcgcccgcgtcgtacccgacgaggaggcgctgcgcgccgaggtgcgctccgccgtcgccgaacacctggacccggtcctcaccggcttcggcccgcgcatgcggcggcgcggccgggccctgtggggcatggcgaccgacgaggtcgtcgagggcctgtggtacgtcgcccacctgctcggcgagcaggaacgggcccggtacgaactggagtcgctgctgcccggcgccacccgcccctacgtcggctcggccgccttccgcgaactgaccggcccggacggcgaggcgctgccgacccgcgaccgggcgagctgctgcatgttctacacggtgcgccccgaggacacctgcgccacctgcccgcgcacctgcgacgccgaccggatcaccaaactgaccgcgactaccgccgcctgaggacccgtcaccccgccgcgcggtccggcggacccccgcgagtcccgtaagatcaaccgcgaatgggacggccctcacgggtgcgacggtcacgggacatgcacaactccctcacctgacgcgggaactttccgcggaaccatccgtacgggtagtcttattcgaactcaactcccgcccctcacgcggtagttcgagcagaacgccgtccgcgggcatccccttgcacctccttggcggcctcttgccccgaaaaccccctgagggccggtgggattgggccactatggcgggcgttacgccctatccccatgcaagggaccccagatgagactgaccgacatatcgctgaactggctgcttccgggcgccgtactgctcctgggcgtgctggcggcggtggcggtgctcgcgcgcggcaagcggtccgccaaagggagcacgcgcagcgacgactcgtgggagcgcagcgaggagcgccgcaggcgcaaggaggccgtctacggcaccgcctcctacatcctcctgttctgctgcgccgcggtcgccgcggcgctctccttccacggactggtcggcttcggcgagcagaacctcggcctgaccgacggctggcagtacctggtgccgttcggcctggacggcgcggccatgttctgctccgtgctcgcggtgcgcgaggccagccacggtgacgcggccctcggctcccggatactggtgtggatgttcgccgccgccgcggcctggttcaactgggtgcacgcgcccaggggcatcgaccacgcgggcgcgccgcagttcttcgccggcatgtcgctgtcggcggcggtcctcttcgaccgcgcgctcaagcagacccgccgggccgcgctgcgcgagcagggcctggtcccgcgtccgctgccgcagatccgtatcgtgcgctggctgcgggccccgcgggagacgtaccgcgcctggtcgctgatgctcctggagaacgtgcgcagcctggacgaggcggttgaggaggtccgcgaggacgcccggcagaaggaggcgaaccgccggctgcggcgcgagcacgaccgtgtggagcgcgcgcagctcaaggcgatcagccgg

SEQ ID NO: 1541 - DNA, 1257 bp, Unknown
  Kingdom: Bacteria, Phylum: Actinobacteria, Class: Actinobacteria, Order: Streptomycetales, Family: Streptomycetaceae, Genus: Streptomyces
acgaacgccatccagcggccgccgggccgaccagaccggcccgacggccgctggatggcgttcgtcgccgagtccgtcctgtggctgctccccgtcacggcggacggcgcccccgcgggcgctgcccgccggctcaccgacgagcccgccgaccaccccagttgggcggccgactcccgcaccctgctgtacctgtcgtgcggacacctgcgcctgctgtcgctcgacgacgcccggacgccggtgcgggcgcgtaccctgcccgcggcgccgcccgtccgccgccgtgcgcccggcggccgggaaccgctgcgtatccacgcggggcagttgtgggacggcaccggcggcgcgccacgccaggacgtggacatcatcgtccacggcgaccggatcaccgccgtcgaaccgcaccgcgtccgctggccgggccaccgcacgctcgacgcctccgcccacacggtcctgcccggcctgttcgacagccacacccacccctaccaggccacctacggcgcccggcagaacctcaccgcgctcgcctacggcatcaccaccaccgcctgcatgggcggaccgctgtacgagacggtccggctgcgcgaggcgaccggcgccggggcctgcctgggcccgcggtccctggcctgcgccgagctgatcgacggctcccgcaccgcctacagcatgggccgcgcccaccgcaccgagagcggcgtacggcgcacgctggagcgggccaccgccctggacgtcgacttcgtcaagacctacgtccgggccccgggccggtacatggcgctggccgccgaggccgcgcaccgcctcggcgtgccgtccggcagccatctgtgcgcgccgggccgggcagcgggccaggacctgaccacccatctccaggccacccaacgcctgccctacggtcatgccacgaccccgctgggccacatccaccaggacctggtcgagcagtacgccgacggcgacttcgccatgatcatgacgccgttcagcgcgcagttcctgctcggcgcggatccggcgctcgccgacgatccccgggtggacgtcctcatgccgccctgggacgccgccgccgtccacgagcgggcccgtacccggcccacggcacgtgaactggccgtactggacctcgagttcgaggactaccggcgtcttgcggcgcacggcgcgcggctcgcgctcggcaccgactcgcccctggtgccggtcggcctctccctgcacctggccctg

SEQ ID NO: 1542 - DNA, 628 bp, Unknown
  Kingdom: Bacteria, Phylum: Actinobacteria, Class: Actinobacteria, Order: Streptomycetales, Family: Streptomycetaceae, Genus: Streptomyces
cggcaccgccaccaggctcacccgggccgacagcacgacgaccaccggcgcgcacagcacctgggccgcggctgccgcggcgagcgcctcggccggccgggcgggcatcccgcgccggtgcagcgccgcgctccagcggggtgccagtgtgagcagggcgccggtcgccagtaccgacagcaggaagccgtaactgcgggcaagccacgggtcgtagagcaccagcagcaggacggccgtcgccagggccgggaccagcgacctgcgccgcccggtggccagggccagcagcaccaccgccccgcaggccgcggcgcgcagcacgctcgggtcgggcctgcacacgacgacgaatccgagggtgagcgccgcgcccagcagtgcggtggcccgcagcggcaggccgagtcctggtgcgagtccccggcgctcgacgtgctgggccaggccgggcgggccgatgagcagggcgaggaggatcgtgaggttgctccccgagacggccaggacgtgtgcgaggtcggtctgcttgaacgcctcgtccagttcgggggtgatccgtgaggtgtccccgacgaccagtcccggcagcagggcgcgcgcgtccgccgggactggtcgtcgggga

SEQ ID NO: 1543 - DNA, 1083 bp, Unknown
  Kingdom: Bacteria, Phylum: Actinobacteria, Class: Actinobacteria, Order: Streptomycetales, Family: Streptomycetaceae, Genus: Streptomyces
  misc_feature (229)..(254): n is a, c, g, or t
gcagcagcgcgcggtccgcgtcgcccccttcgagctgatcggggacgcggaccgcgcgctgctgccggccggtgccgtcgacgcctacccgctgggccagaaccagctgggcatggtcatcgagatgctcatggacgacggccgcaaccactaccacaacgtgtcgacgttccggatccgcgacgagcaccccttctcggccgacgccctcgtcgaggccggccgcatnnnnnnnnnnnnnnnnnnnnnnnnnncgcccgccacgaggtgctgcgcacctccctcgacctgacgacgtactcgcggcccctgcagatcgtccacgaccacgccgaactgccggtctcctcccaggacctgagcgggctgcccgccgacgaggtgacggccgcgctgcacgccttcaccgtcgccgagcgggcccggctcttcgacctggccgtgccgtccctgatgcgcttctgcgcgcacaccacggacgacggcggctggtggatctccgtcaccgagtgccacccgatcctggagggctggagccaccactccctgctgatggagcttctgacgacctaccaggccgtccgggacggccgcactcccgaaccggtcgagctgccctcgctgcgcttcgccgacttcatcgcgggcgaactggccgcactcgacgacccgtccgaccgcgcctactgggcgcgactcgtggaccgccacgccaagttcacgctgcccgagacctggggcgacgccgaggcggcgcacgtcaccttccagaccggcatctcctggcaggacctggagcccggcctgcgcgcgctcgccgcggccgccgacgcctccctcaagagcgtcatgatcgccgcgcacctgaaggtgctggggcagctcacccacgagcaggccttccacaccggcctggtctgcgacgcccgcccggaggaggccggggccgaccgcgtctacggcatgtacctcaacaccctgccgttcccgcacaccaagggcgcccgcacctggcgcgaactggtccgccgcaccttcgccgccgaggtggagctgtggggccaccgccgctacccgctgccc

SEQ ID NO: 1544 - DNA, 934 bp, Unknown
  Kingdom: Bacteria, Phylum: Actinobacteria, Class: Actinobacteria, Order: Streptomycetales, Family: Streptomycetaceae, Genus: Streptomyces
gcgccatgtcggccaccgacgccggaccgaagcccgccaggtggcgcaggaccagcgtgcgcagcgcctgctggtcgggcgccttgcccatgggcccgggttcggcctgggcggccacgtaggacgggcggttgccgaaggaccagggcgcgccggtgacggcgtgcagcagcggcgcgtagcccttcagcccccaccacgcgtccttcttccgctccccgccgagccgttgttccagccaggtctgcaactcggtcgcggtacgcggttgttcggcgtaccgcagcaggtggggcaggagttcaccggcgtccgccggagtgagtccggccgcggcgaagcgggcaccgagctgggaggcgtacagcgtcggttccatggccctgcggaacaccgggcggtcctcggcgtggacggcgtgcagggtgacgcgcatcagggtcgccttgaccaccgtacggccggcgaacgcggcgtccagcgcgtcgggccggaagccggtgagccggttccacagtgccaggtacggcgaggcggcgtgctgcgcctgcagcgcgaccaccctgcgcacggcgtcgggcacctccaacggctcgcggcgcagcagcagttggcgggcgagtgtggcacggttgaggtccccggtggtgagcgtcacgagcggtgattctgcccggccccctaccctgagcaccaccgtacggcccggcgccggcggaacggtcgccggggcacggtccctggaaccgggcgggccgccaccggccgccggtcaccccccgtcggcgccggcgaggaggtcggtggtctgccggcggaccacctcccacgcggcggcgggcaggtcgccgaaggcggcggtggcccgcagcgcgtcgagcgcggcttcggcgccaccgtggcagagcgtgctgtcgtcgcgtacgtcgtagcc

SEQ ID NO: 1545 - DNA, 1075 bp, Unknown
  Kingdom: Bacteria, Phylum: Actinobacteria, Class: Actinobacteria, Order: Streptomycetales, Family: Streptomycetaceae, Genus: Streptomyces
atgcgggggcggtctccggggcgcggctctcggggatgtccgcgagggcggtcgcgtcggtcgggccggtcgtgccgggggtgcgggtcttctggtgcgcgagctgctggatcatgacgtgctccttgtcgtgcggtggtgcgcgttcttgtcctgcttctcctgcgtctcctctttcgttcgtcgtcaggggacggggtccgggtctcagttctgtgcgccggagcgcagcttggccaggtcggccttgacggtgttgatcgggatggcgaagccgaggccgacgctgccggcgctggacgagtccgagccggccgccgccgagtacatcgccgagttgatgccgatgatgttgccgttggcgtcgatcagcgcgccgccggagttgcccgggttcagtgacgcgtcggtctggatcgccttgtaggtggtggtggaggagccggtgtcgccgttgaagtgccggccgccgaactcgaacggccactggccgtcgccctgtccctgtccctgcccctggctctcgtccgtggacacggtcacgtcccggttgagcgaggagacgatgccgctggtgacggtgccggtcaggccctcgggcgagccgatggcgacgacctggtcgccgaccgccacaccgtcggagttgcccagggcggcggacttcagaccggaggcgccctccagcttgatcagggcgaggtccttggaactgtcggtgccgaccaccttcgcggtgtacgtgtcgccgttgctggtccgcgccttgatcgtcgacgcgcccgctatcacgtggttgttggtgacgacctcgccgccgccgctgatgatcacgccggagccggtggaggtcccgttgtcgagcgtggcggtgatctcgacgacgctcgggctgaccgccttggcgatcgcggcgatgctgccgcgctggctggagggcaccacgttggtgctggtgctgctggaggcgacggtgtccttgccggtcagctgctggaaggcgtaggcggtgccgccgccgacggccgctgccgcgatcgccacggcggcgagcagcgcgagcggtcccttggcc

SEQ ID NO: 1546 - DNA, 784 bp, Unknown
  Kingdom: Bacteria, Phylum: Actinobacteria, Class: Actinobacteria, Order: Streptomycetales, Family: Streptomycetaceae, Genus: Streptomyces
ggcggccgccgacccggagcacttcttcgacctggagtcgatcgacgatccccgggcgctgctggagcgtgcgaccgagctgacgctggcgttccgcgctgctgccgaccgcgcggtggagttccaggcggtggccgcggcccagctcgccgacccgcgccgcttcgaccggctgagccctgccgacatcgccgagcaggcggagtggaccgaggactacgccaagaagatggtcgagttcggtcgggatctgctgcgcggcgccgagggcagcgtgcacgccaatccggccgaccccgtctgagccgtccccgctccccggagccatcaccagaacccgtcctggcatatgccagcggggcaagatactcccttcggctccttcgtgtcccgatttcccgcaaccgtgtggaagcgtgccctcacggtcggtagacgtaacagtcatgagccgcacagggacacgcaccttcctcgaccaccccgacgccgcgaccggtgtcaccacggacggcgccgcatggctcgcctcggccggggcgtacccgcgcagcacgctcgcgtactggcgcgagcgcccggacgcaccggtcgtgctgccctgcggctcggtcttcgacgtggtcaacgtgcccgcgatcttcggccgccgcatgctggaccggctctggggcgaggggcccggctcgggaccggtggccgtccaccgcgggcggatgctggtgttcgccgcgccgggcaccgcgcaccggctgccctcgctgctggagtgggaggcgtgggg

SEQ ID NO: 1547 - DNA, 834 bp, Unknown
  Kingdom: Bacteria, Phylum: Actinobacteria, Class: Actinobacteria, Order: Streptomycetales, Family: Streptomycetaceae, Genus: Streptomyces
cggacgccggtgaggcggcggtcggcgccttcgccctggccggagccgcggtccgcgccgccgcctcaccggcgtccgccgaggactcacgcacgacgtggccaagctcagcaactgcggcacgcgccggtggacgagcatcacgtcgacgaactcggtgccggtgtacgcctgaccgcacgcgcacgatgacctgattggtgcttctgacgtccgggttccccacctagtgtgcggcgcaatcgtggtcgagcgtcgcacctcggggcgacgcgtcaagagggagggacatgagcagcactgtgcgaatgctcgcgcgtaccgcctgcgccaccatggcgctcggtgccgccgtctcgctgggcaccgcttccgcttccgccgcgcccgccaccaccaccgcaacctgcgcctacccgtacgtgtgcatccagcggttgtccgacggggtcgtcatcggccgcttccaggacgtcacctcgacgtggcagtcactgccgtccaaaccgagcaacgtcaacatcatcaacacccgtcacgacgacgtcgcctacatccgctacgccaacggatcgcaggcgtgcatcgctcccgacagcaccttcttcatcaagggctacgtcctgacgggcattcgcatctcctcgtcggcgacctgcagttgacccgcgtgatcatcgaccggacaccggccaaggaggagacatgaagacatcgcgctcgtccgccaaacggattgcctgggccgtggcagcggccaccggactcctcgccgcctccatggggacggcggtcgccgcccccgcctcgcccgcgaccgcggtcgccccggcg

SEQ ID NO: 1548 - DNA, 1693 bp, Unknown
  Kingdom: Bacteria, Phylum: Actinobacteria, Class: Actinobacteria, Order: Streptomycetales, Family: Streptomycetaceae, Genus: Streptomyces
tcgcaggtgcgtccggcggcaccggacccggcggcgtcaccgggcccggatcggccgggcggggccctgccagcagtacgtccgtgtccggcgccgcggcgagctgcggctcccacgggtccccgagggcggtcgtgaggcccgcgcccagcatccgcccccgcacctgcccgaaggcctccagcagcgacagttccccgtccggctccaggatccgtacgagcgcgtccgtgaacggagtcggccccgcaccctcgccggagtcgatcagccggttggcctggacgctcatcagcagcaggatcttctgccggccggggaagtcgtgccacaccttggccgcgttgcccgcgtagcagcagtcgaggatcaccacgatccgctcggcgccgctcccggcgaggacggtgagcacctcggtgaacgaggtcgcgttcgggaagaccgcctgggcgccggcgaccacgcgcgcgttgcgcatctggaggaacagctcgttgcccgcgctcggcacggcgccgtgccccgcgaagtagcacagcagcaggccctcggcctcgtgggccgccttgcgcaggtcctcgccgaagtcgtcgtgggagggcgagcggcagtccgtgatctcccggtcctcgaacaccccgccccgcagggcctgccggagccggctgacgttgtgccggacggcgggcagctggccggccactccgtcccacgcggccggctgcgtgtgctcgtactccgaaacaccgaccagcagcgcccggttcacccgcccccgcgggtcgaagcggctcacgggactattccccgccggggttcaccggatcgacgtgctgctcgggaggcggcccgggctccacccggcggcggttctcccgccaggccgccaccgcccgcctggtctgctccagcagctcgctgaacaccacttcggcgcccgcaccggccaggaccagcaggatctccatgcccgcgcccatgtggccgggcggcgcgtcgggccgcggccgctccaggatctgcagccgcccgtcggcgaccagctcctccagcgggttctcccgctccagccacgccttcagcgcgtcgatgtcccggttgctcgcgtttccgtccagccggacccggatacttcggccggccacgccctccccctcagccataactcaccattctggcaccgcgcgcatgccctggggagggggcggacgcgtcgggcaccgatccctcacaccggcagccgacgcgccgtcggttcgccatcggtccgggctgcgcctcagccctgcgccgtcgtctgcaactgccgcagctgacgccgtacgtgatccagcgcgccctgctgccgccccggcacccggccgcgcaactcggccagcagcgggcccagttcacgggcacgctccgggtcgctgatctgtccccactggtggtgcgcccggtccacggcggcctcgacctgcgccgcaccggcgctctggcccagggcgagccgggtcgcggcgacggacagccagccgcggcagctgcgggccgcgtccccggcgaacatcgcgaggtcggcgcggacctcgctccagtgcagcgcctcctcggacgccgccccgtgctcccgcacggccgcctgctcccagcgcgcggcgagcgcgtcggcgtcgccgtgccggccggactccacccaggccgcgat

SEQ ID NO: 1549 - DNA, 3164 bp, Unknown
  Kingdom: Bacteria, Phylum: Actinobacteria, Class: Actinobacteria, Order: Streptomycetales, Family: Streptomycetaceae, Genus: Streptomyces
gttccgggccgaggccgagcagatgcccggcctcggcccggaaccggtagcgccgcgcgggccgcccctggcgccgggcggcgccctcctcggcggccttctcggcgacgagtcccgctcccatgaggtcctcgacgacaccctcgaccgtcggccgggacaggccggtcagccgggtgatctccgtgagcgtcgcgcagtccgtggcacgcagcgcgtgcagcaccaccgcggaattgatccttcgcagcagcgagggatccccgccggtcagccgccccaacgtccgtcctcccagctcgtgcgcgtgttgggcggatcgtactcggcgcgggccggggcagcgagtgccgggagggccgccgcggccggcgaggggaggagcccggccggccgacggctcctgacgccccgccaattgtcagtggtggccgctttactggaacgcatggacatcgcgaaggctctcgctgtgatcgaccggctgtgctccgcggcgtttcccgccgagcccacccggacggacgtcggcacggcgggacctggctacctgatggccgagttggagacgagcgacgacttctgggaggacgacggcagccggtgggaggagacggcggatcagttcgcgtgcgaccgggacgggctgggggagcggttgaccgagcggtggggggctccacaggcgttcagtctgtacagcgtgctcgaccgggccacgcgcggggaggagacgacggagccgtggacctcgctcagcggccatgtgcccgacctccagctctggcgggagcccgggaccggccggtggatagccctcggcgtctcccagtgggacaaggagctgccgttccagctcctcgcggtcgtcacggacacggacccgccatgaccgccacgaccgccatgaccaccgagcccgccacgactaccgcgccgaacgcggctcctcacggggtctgcgccgccgcccgcagccgggcgaactccacggccatggtctccgccgtccagtgcgcgttcagaccgctcggattgggcagcacccacacccgggcggaaccgatcgtccgctcctgcggcccgacctgcgcccggcgttcggcgaaggccgcccggtacgcggtgacgccgaccacggccagccaccggggccgcagccgtgccaccttcagcgccagcagccgcccgccctcgcggtactcctccgccgtcagctcgtcggcccgagccgtgggccgtgccaccacgttggtgatgccgagcccgtacgccggcagctcgctctgctcggcgggcttcagcagcctcggggtgaacccggagcggtgcagcaccggccagaaccggttgccggggcgggcgaagtggtggcccgtcacggcggtcgtcagacccgggttgatgccgcagaacagcacgctgaggccgtccgcgaccacgtccggtacaagacggtcgcgggcggcctcgagctgcgccggggtgaagcgggtcagaggatcgcccccggggcgtaggcggcggcctccgggtgctgcttgacgatctcctcgatgcggccgacgaccgtgccgacctggtcggcggcggcgcccgtgaaggacagcttgtcggccatcagctcgtccaggtgcgcgcggtcgagcgggaggcgttcgtcggcggccagcttgtcgagcaggtcgttgcgctcggcgccctgctcgcgcatggcgagcacggtggccacggcgttctccttgatggcctcgtgggcgacctcacggccgaccccggcccgcaccgcgcccatcagcaccttagtggtggcgaggaacggcaggtagcggtccagctcgcgggcgatcaccgccgggaaggcgccgaactcgtcgagcaccgtcaggaacgtctccagcagcccgtccagcgcgaagaacgcgtccggcagcgcgacccggcgcaccaccgagcaggacacgtcaccctcgttccactggtcgcccgccagctcaccggtcatcgaggcgtagccgcgcaggatgaccatgaggccgttgacgcgctcgcaggagcgggtgttcatcttgtgcggcatcgccgaggagccgacctggcccggcttgaagccctcggtgaccagctcgtgcccggccatcagccggatcgtcttcgccagcgaggacggcgccgccgcgagctgcaccagcgcggtgacgacctcgtagtccagggagcgcgggtagacctggccgacggaggtgaacgcctggccgaagcccaggtgggcggcgatccgccgctccagctcggacagcttcgaggcgtcgccgccgagcaggtccagcatgtcctgagcggtgccgaccgggcccttgatgccgcgcagcggataccggccgagcagttcctcgacgcgcccgtacgccaccagcagctcgtcggccgcggtggcgaaccgcttgcccagggtggtggcctgcgcggcgacgttgtgggagcggccggccatgaccagctcgccgtactccgcggccagcttgcccaggcgcgccagcacggccaccgtgcggtcgcgcaccagctccagcgagagccggatctgcagctgctccacgttctccgtcaggtcgcgggaggtcatgcccttgtgcacgtgctcgtgcccggcgaggtcgttgaactcctcgatccgggccttcacgtcgtgccgcgtgaccttctcgcgctcggcgatcgagggcaggtcgacctggtccagaacacgctcgtagtcggcgatcgccgcgtccggcacctcgatcccgaggtccttctgggcgcgcagcacggcgagccagagctgccgctccagcctcaccttctgctcgggcgaccacagcgtggcgagctgggcggaggcgtagcgtccggcgaggacgttcgggatgcggggcttggcgggagcggaagtcacgtgtacggattctactggcgaatcgtgcaggccagcgccacaggggtgttcgtccgaacctacgaggacccggtgcgggaggagtcagccctcggcgggctccgggtcggggtagggcagcagttcggggcgcttggccgggcggccgtcgccggaggagcggccggtcagccgcctgcctatccaggggagcaggtgctcccgggcgaaacgcgcgtccgcgacc

SEQ ID NO: 1550 - DNA, 1800 bp, Unknown
  Kingdom: Bacteria, Phylum: Actinobacteria, Class: Actinobacteria, Order: Streptomycetales, Family: Streptomycetaceae, Genus: Streptomyces
cggtgaccgcgtcggggccgaggcggccgagttcgacggtcaccttctcggcggggtgacgcagggcgtacgccgtggcgtgccggcgcacggcgggcaggaagcgggcgccgagctggaggcccgcccagccgccgatgaggatgcgttcgggctggaagaggttgatcaggtcggacaggccggcgccgaggtactcggcggtctcctccaggacggcgagcgcgaccggatcggggacggcggccccggtcgggtaggcggcggccagcatcgcggtgagcgcggtctcctcgtcggcgtcgtggggcggccgtccgccctcctcgcgccagcgggccagcagcgactccgcgcccgcgtaggcctccaggcagccgagcgccccgcaccggcagcggcggccccgtacgcgtaccgtcaggtgcccccattcgacggcgcggccccgctccacctcgggggtgaccaggcaggcgccgacgccggaaccgaagagcaccacgaccgcgttgcccgcgccgcgccccgcgccgaaccacatctcggcctggcccagcgtcttggcaccgttgtcgatcaggcagggcacgctgtcgggcagccggcaggcggtgcgcagcagcgcctccagcggcaccgcgtcccagccgatggtctgaccgtgcacgacggcgccgcggtccggggtgtgctcgacgataccggggacgccgatgccgacaccgaggaggcgttccgggacgaggccggccgccgccaggacctcggcgacgccatcgcggatgtggccggtgatcacgtcgacgtcgtagcgctgcgcggtgagcggacgctcggtgcgcgccagttcggtgagggtcaggtcgaacagttcgacgcggacccgggtctcgccgacgtccacgccgatcatgtggccgctgccgggaaccacgcgcagcagggtgcgcgggcgtccgccgtcggagtcgacgctgccggcctcctccaccaggccgtcggcgaccaggtcggcgacgacgttgctgaccgagcccgagctgaggccggtcgccggaccgagttcgaagcggctgaggggcccgtcgaagtacagccgctgcagcacggccgtgcggttggcccgcctgagatcgcgcaccgtgcgcccgctccgccccgccatgtggctccctcgtccgccccgggcgctgcgccctggtcctgccccgtcccgacctgcaacataccgctgcgggccccttcggcgcgacttccgcccactcttaggtcaaacactaaattaaggcgtggcgacgtcgggcatcgcagacacagaggcggcgggcgccgcgggaccgcacgcgccacgcccgccctccccaccgcccacgcggggcgcgcacgccgttcccgcgccctcgggcgccccgtgccgcgcgaggaggtgccacaccttcttcaggtcctgcgcctcgtggcggccggtgcgggccgcgtcgccgatgacccgcgggtccaggagcccgtcccgggcgatccgcgcacccagcgcggtgtactcctcgccccggtagtcgccgtggcgccgcagttcggcgacggtgagacggtagccggggtgccactcgagcgggcacggcaggtcccgggcgtcggcctcgacggacgtgccgcggtagcacgcgtccaggaccagcgcctcgacgtcccgggcgaggtcgacgccgccgtggacctgcgcctcgatgtagtcgtcgagcgcgtcctgctcgtcggcctcggccagggcgatcaggcccatggcggccgcggtgc

SEQ ID NO: 1551 - DNA, 861 bp, Unknown
  Kingdom: Bacteria, Phylum: Actinobacteria, Class: Actinobacteria, Order: Streptomycetales, Family: Streptomycetaceae, Genus: Streptomyces
gcgcaggtcgggggcgatcacgcggtggcggccggccagcggcgcgaggacgtcggtccacagccgccaggtgtgcgggaagccgtgcagcaacaggacggcagggccccggccggccagcgccacgttcagcccgacgccgcccaccgtgacccggcgcagttcgacgtcggccgtggcgccagtggcgtcggcggttcccgcggtgttcgtcgtggtgttcgtcgtacccatgtctgctcccttgagtaaccaatagtgacaagggaaccgtaggaaactatcctggaccggccaagaccgcacttctgcatcaggtggtgagttccaggtgactgcccaggtcacgggcgtccccgcccccgccgcggggcgcggcgacctgttcgacccgcagtgcccgacccgcaggctgctcgaccgcatcggtacgaagtggacctcgatggccgtcaaagtactggcgcaggagcatcccggcgaggtgcgtttcggtgagctgcagcgccggatgccgggtgtctcgcacaagatgctgtcggtcaccctgcggaacctgacgcgtgacggtctggtcgcacgccgggtcgagccgtccgtcccgcccggcgtgcactaccggctcacaccgctcggactctccctggagagtgtgctcgccgcggtccggacctgggccgaggaacacatggccgaggtggaccgggcgaaccgggcggccctccaggaagaggacgggtgaggcgggcggtgacacgggccggtcagccggccggcatcaccgtccggaactcccagtgccccggccccacgtggtacacggcttcgccgccggccgagcgcagcaggcgcgcgcccgcc

SEQ ID NO: 1552 - DNA, 2515 bp, Unknown
  Kingdom: Bacteria, Phylum: Actinobacteria, Class: Actinobacteria, Order: Streptomycetales, Family: Streptomycetaceae, Genus: Streptomyces
gggtacgcggtcggcggcgccctggtcgcgctggtctccccgcgcccgtcactgctgctggcggccgcgctgtacgcgctggcggcggcgacgatccggctcggcctgacccggcgcccgccccgcgcccagggccgcccctcggtcgcggcgacctggcacaccaacgcccgcctgtggtcggaccgcccgcgccgcctgacctacctcggcctgtggctgcccaacggcctggtggtcggctgcgaggcgctgtacgtctcctacgcccccggcgccgccggcaccctcttcgcctgcgcggccctcggcatgctcgccggcgacctcacggtgggccgcctgctgccgccggccgtaagccgccgggcggccaccccgctgctgctcctgctggccgccccgtacctgctcttcgccctgcacccgcccgtaccggtcgccgcctgtctggtgacgctcgcctccgccgggttcggcgcgagcctggtccagcaggagcggctgatggccctgacccccgccgaactgagcggccacgccctcggcctgcactcggcgggcatgctgaccctgcagggtgtgagcgcgtccctggcgggcgccgtcgcccaggtcacctccccggcggtggccatgacggcgctggggacggcgtcggccgccgtgaccctcgccctggcggctgcggcccggcgcaccccgacgacggccggggaggcgccggagcagccccgcccggccccggcgccctgactgcggcaacccggccccctgactgcggcagcccggccctcctgactgcggcagcccggccccctgactgcggcgaactgccgcaagaggactccccgtaccacgggatggctcaccccaccgcgggatagagtcgcccgatgaaccggtcatgggggcgaccggtgatgcttggctgtaccggtgtcctggggagggggccttcggagcatgagtcgtcgctctactggtttggtcggcgtctgggccgaggcgcagcggcagcagcagcgccagcgggaggccgacgacaggcggcgccgggaacaggtgcggcaggcacaggcctaccagcggcgggccgcccaggaccaccggcagtaccggcaggcggaggcccggcggcgaaccgaggaactggacgcccaggtcacggcgttgcagggactgctggccgccggctgccgcgggcccgccttcacggccgcctcgctgctgcgcgccgaagaggtggcgcccttctccccgggcccgctcgcgcagcccgtacccatgccgcaaccgcagcactaccaggcgcagggcggctggaccgcgggccgccgcgcccaggcggaggccgaggcgcgcgcccggttcgagcgggactggcacgcggcgcaggccgcggaggcccggcggcagcagcaactggaggcgtaccggcgggagtacgagcagtgggccgggtcccagctcacccaggtccgccggcacaacgcgggcgtcaccgagaccaccgagggcgtacggcgccgtgacccggactccgtggtcgagtacttctccgccgcgctctacgcgtcgacggcctggccggaaggcttcccgcggcagctctcggcggcctacgacgcaccggcgggccaactggtcctggactgggagctgcccggctacgacgtcgtccccgcggtgaagtccgtccgctacgtcgtctccttggacgaggacaaggagagcccgcggccggtgacccagtgccgggcgctgtaccgggaggtcgtcgcccagtgcgtgctgctggtgctgcacgaactcttcgcggcggacggcgggttcggcgcgctggagtccgtggtgctgaacggcttcgtggacgcccacgacccggcgacgggccggcagggacacatccacctggcgaccgtcatggcgccgcgctcgacgttcggcgggctgcacctggagcaggtggacccggtcagctgcctgaccgacgcgctcaggggccagctgacggcccgccccgaccagctcacggccgtacgccccggcagacggccgcaggacgtcggcgacggcggccgggtcgtcacccacggcggcgacggcgaggacgagccggacctgtacacgatggacccgatcgccttcgagtgcctcgtcgccgacctgttccgcgcgatggggatgcaggcggtgacgacccagcgctcgggcgacggcggcgtggacgtcgacgcgctggaccccgccccgatcaggggcggcaagatcgtggtccaggtgaagcggtaccgcaacacggtgccgccgacggccgtacgcgacctgtacggcaccgtccaggaccagggcgccaacaagggcgtcctggtgacgacgtcgaagttcggccccggctcgcacacgttcgcggacggcaagccgctggaactggtctccggcacggaactggtcgacctgctccaccggcacggcctcagcggcagactgggcgaccgcaccccgccggccc

SEQ ID NO: 1553 - DNA, 809 bp, Unknown
  Kingdom: Bacteria, Phylum: Actinobacteria, Class: Actinobacteria, Order: Streptomycetales, Family: Streptomycetaceae, Genus: Streptomyces
cgcctgggcaccctcgacgacttcgaccacttcgtccagcacgcccgcgaactcggcctggagatcgccctcgacttcgccctccagtgctcccccgaccacccctgggtcgacaaacacccccagtggttccaccaccgccccgacggcaccatcgcccacgccgagaacccgcccaagaaataccaggacatctaccccatcgccttcgacaccgacatggacggcctcatcaccgaaaccgtccgcatcctgcgccactggatggaccacggggtccgcatcttccgcgtcgacaacccccacaccaaacccgtcgtcttctgggaacgcgtcatcgccaccgtcaacaccaccgaccccgacgtcatcttcctcgccgaggccttcacccgccccgcgatgatgcacaccctcgcccagatcggcttccagcagtcctacacctacttcacctggcgcaacaccaaacaggaactcaccgactacctcaccgaactgaccggggaagccgccgcctacatgcggcccaacctgttcaccaacacccccgacatcctccacgcctacctccagcacggaggccgccccgccttcgaggtccgcgccgtcctcgccgccaccctctcccccacctggggcatctacagcggctacgaactctgcgagaacacccccctcagagaaggcagcgaggaatacctcgactccgagaaataccagctcaccccccgcgactgggccgccgccgaacgcgagggccgcaccatcgcccccctcatcacccgcctcaacgacatccgccgccg

SEQ ID NO: 1554 - DNA, 1021 bp, Unknown
  Kingdom: Bacteria, Phylum: Actinobacteria, Class: Actinobacteria, Order: Streptomycetales, Family: Streptomycetaceae, Genus: Streptomyces
ttcaccctggaccccggcggacgggacccggtgctcggcatccgcttcctcggcgaggcctacgaccggcgggagacgggataccccggcggggtgagtgtgccggcggtcgtcgacgtgcccagcggcgcgctggtcaccaacgactaccagcagctcaccctcgacctcgccaccgagtggacggccctgcaccggcccggcgcgcccgacctgtatccgcgggccctgcgcgacgagatcgacaccgtgatgagggaggtgtacgaggacgtcaacaacggcgtctaccgggcggggttcgccaccggccagcaggagtacgaggccgcgtgcgagggcgtgttccgccggctgaacgtgctgacggagcggctggccgggcagcgttacctcgtcggggacacgatcaccgaggcggacatccggctgttcacgacgctggtccgcttcgacgccgtgtaccacgggcacttcaagtgcaaccgctggaagctggcggagaacccggtgctgtgggcgtacgcccgcgacctctaccagacgccgggcttcggggacaccgtcgacttcgaccacatcaagcggcactactaccaggtgcacaccggcatcaatccgaccggcatcgtgccgctcgggccggacctgtcgggctggctgacaccgcaccgacgcgaggaactcggcggccggcccttcggcgagggcaccccgccgggcccggtacgcgatgccgaacggatcccgtcccagggcaggccctgacacaaggaggaaacaggtggccggaaagaagaagaacaagctcccgctcgtctaccagcccgtcggtttcgtgctgggctgggcgggcggcgccctggccgggatggcgttccgcaccacgtggaaggcgttccggcacgaggacgacgccccggacgcgctcgacgaggaccgccgctggggcgagatcctgctcgccgcggccgtgcagggcgccctgttcgccgtggtgcgcagcgcgtacccggccgca

SEQ ID NO: 1555 - DNA, 3779 bp, Unknown
  Kingdom: Bacteria, Phylum: Actinobacteria, Class: Actinobacteria, Order: Streptomycetales, Family: Streptomycetaceae, Genus: Streptomyces
ccgggccggcgccgcggagcggggcgtcccgcccgaggagtacgcggccacactgcgctgcctgctgctgcccgccgacccggcctgccgtacgcggatcttcttcggcgtcggcgcgggcggactcctcagactgcgtgacggcacctggcaggacatcgagccccggcacgccgagccccaggatgccgagtccaagctccctgggaccccgatcgccgggccccagccccccggtcccacgatcgccgggtcccggctgtccggtccggccgagacgcccgagggcgaccggctcaccatggacctcggccttcccgtaccgccgccgaccccgcacacccggaccgcggggccggacgccggctccggaccgcctcacgagcccttccgcttccgcgcctgtgtagcccggccgggtgacaccctgctgatgtgcaccggcggcctctccgagcccctgcgcggcgaggcggagctgggcgcgcacctcgcccgccggtggtccggtaccgtcccgcccggtctcgccgcgttcctggcggacgtccaggtgcgggtcaagggctacgcggacgaccgtacggccgccgccgtttgggaggcgtgagcggcggggctgtgaattcatggatccaggagtccgcaccgggcgacggcagcaggcaccgggcaccagcgggaggcccaccagccgcagggcatccgcagggcagccgcagcggtccgcagccgtcggcccggagaccgaagggtgccgggagcatggccaagcagaacgtcgcagagcagttcgtcgacatcctcgtccgcgccggggtcagacgcctgtacggcgtcgtcggggacagcctgaacccggtcgtcgacgcggtccgccgtaacgccgccatcgactggatccacgtccgccacgaggagacggccgcgttcgcggcaggcgccgaggcgcagatcaccggcaagctcgcggcctgcgccggctcctgcggccccggcaacctgcacctcatcaacggcctgtacgacgcccaccgttccatggccccggtcctcgcgctcgcctcgcacatcccgtccagcgagatcggcctcggctacttccaggagacgcaccccgaccggctcttccaggagtgcagccactactgcgagctgatctccagcccgaagcagatgccccggctgctggactcggccatccagcacgcggtcggccgcagcggggtcggtgtcgtcacgctgcccggcgacatcgcggccgagccggcgcccgagaaggccgccgagaccgccatcgtcacctccaggcccaccgtccggcccggcgacgcggagatcgaccggctggtccggatgatcgacgaggccggcaaggtcaccctgttctgcggcagcggcacggcgggtgcgcacgccgaggtgatggagttcgccgggaagatcaagtcaccggtcgggcacgccctgcgcggcaaggagttcatccagtacgacaacccgtacgacgtcgggatgagcgggctgctcggctacggcgccgcctacgaggccacccacgagtgcgacctgctgatcctgctcggcacggacttcccgtacaacgcgttcctgcccgacgacgtgaagatcacccaggtcgacgtgcgccccgaggtgctgggccggcggtccaagctggacctggccgtgtggggcgacgtgaaggagacgctgcgctgtctgatcccgcgggtcaaggagaagaagaaccgccggttcctcgaccggatgctcaagaagcacgcggacgcgctggagggcgtcgtcaaggcgtacacgcgcaaggtcgacaagcacatcccgatccatcccgagtacgtggcggccgtgctcgacgaagcagccgatgacgatgccgtgttcaccatcgacaccggcatgtgcaacgtctggggcgcccgctacatctcgccgaacggacgccgccggatcatcggctccttctcgcacggctcgatggcgaacgcgctgccgatggcgatcggcgcccagttcaccgaccggaaccggcaggtcgtcgccatgtccggggacggcggtttctccatgctgatgggggacttcctgaccctggtccagtacgacctgccggtgaaggtcgttctgttcaacaactcctcgctcggcatggtggagctggagatgctggtcgcgggcctgccgtcgtacggcaccacgaacaagaacccggacttcgccgccgtcgcccgcgcctgcggcgcccacggcgtgcgggtggagaaacccaaggacctgccaggggcgctgaaggaggccttcaagcacaagggcccggcgctcgtggacgtcgtcaccgatcccaacgccctgtctatcccgccgaagatcagcgccgagatggtgtccggcttcgccctgtccgcgtccaagatcgtgctggacggcggcgtgggacggatggtgcagatggcccggtccaacctgcgcaacgtgccgcggctgtgaggccgcgtacgggccgggcgccccggcaagggtgcggtgacgcgggaagggtgtggtgcgcgggaacggcgcggtgcgtggtggtgcgcggaagagacgtcgtactccggccaagttcccagggagcgggccgggcggccgtaggcacgccgtacgtcccgtgcgcgtgcgccgtacgtcctccgtacgccccgtgtacgtccgccgtacgtccggcggcgtacggcggacgccggcaggagcgggtccggggccccggagggccgaaacgcctcacgccgcacgggcgcccgcacctcgacccgctctcgcgccccggtgggaccgtggccgaaccgacgttcgccgacgatccgacaggactgccgcggatcccacggggcatggattcccgtgaacgtgttcgagctggaggggaacggacatcggcacgcgggcgggggagatgaagagtcagacgcgaggtggcggtcccgggacggcagggggctcctcggtgaggacggtggaggaagaggccgacgacgcggcgcagcgggcgtcggagccccggctgagacgccggctgggccgggctgacctgcgggcggtgcccgaggcgcgccgggcgctgcgcgagctgctgcaccgctggggacccgaggaccggtcggacgtcgccgagctgctcaccagtgagctggtgaccaacgccctcgtccacacggacgacgacgcgatcctgacggccacggtctccccgagcggactgcgcgtggaagtacgggacttcgtggccggcggcccacggccgcgggtgccggtcgccgccgaggacacgggcggcaggggactggtcctggtcgagtccctcgcggacgactggggcgtgtgcgcgcacgacgtcggcaagtccgtgtggttcgaactgggcgcgcgacaggcggcgtgagggtggagggaaggacagccggagcagggcagcaaaagggtgaggggagaagggcccccttcgcccttctcccctcaccctcgtgaagacctagccgaactgctgctcgaggtccttcagcttgcgctccagcgagtccaggcgcggcagcgcctgcgtgtcgtcctccgcggtgaggtcgacggtgagggcgtcagcgcccttgcggacgggctgcagcgagggacgggcgcgtaccggcagcggttccgccgatatggcaggctccgcggtgacctgcgaggagccgcgctccagggcctgtgcctcgccctgccggccgccccggccgccgaagccg

SEQ ID NO: 1556 - DNA, 1658 bp, Unknown
  Kingdom: Bacteria, Phylum: Actinobacteria, Class: Actinobacteria, Order: Streptomycetales, Family: Streptomycetaceae, Genus: Streptomyces
cccaggccgtgctcccgcgcgctggcgcgcaccgcgcgggagcacggcctgggtctgatcgtggacatcgtgccgaaccacatggcgatggtcccgcggcacaaccccgccctgtgggacgtgctgcgccagggacccgcgtccccgtacgcgcgctggttcgacatcgactggcaggcgcaggacggcaaggtgctgctgccggtgctcggcggcccgctcggcgaggagatcgagcacctgaaggcggacggcgacgtcctgcgctactacgaccacgccttcccgctgcgcgcgggcaccgaggggctggcgctggtcgaactgctggacgcgcagtggtaccgcccggtgtggtggcggctggcccgtacggaactgaactaccggcgcttcttcagcatctcgacgctgatcggcgtgcgcgtggaggacccggaggtgttcgaggcgacccacgccaagatcctgcagctgctgcgcgagggcgtggtcgacgggctgcggatcgaccaccccgacggcctcgccgaccccgacggctatctcgaacggctgcacgaggcgaccggcggccgctggacggtcgtggagaagatcctctccgacggcgaacacctgccgccctcctggccggtggccggcaccaccggttacgacgccctgcggcacgtggacggtctgttcaccgacccggccggcgcggagggactgctggagcactaccggcgcttcgccgccccgcagaccgaccgcggcggggactgggcggccacggtacggcgggcggcgtacaaggtgatcacgcacgagctggcggccgagaccgagcggctgacccgggtcgcggaccgggtgtgctcggccgcgccggacccggcgctgcgcgaccgcgcgccgtggacgctgcgcaccgcgctccaggagctgctggtccgcctggaggtgtaccggccctacgcctccacggacgccgcctcggtgctcaccgaggaggccgccacggaggcccggcgcgccttcacggtgcccgaggagggcggggccgtggacgtcgtacgggacctggtgctcgggcgggccggtgccggaccggaggcggtggagctgcagacccggttcgcgcaggccgcctccgcgctgcgcgcgaagtccgtggaggactccgcctactaccggtacgtgccgctgctgtcggccaacgaggtcggcggcgaccccggccgcccggcggtgtccccggaggacttccacgcgtactgcgcgcgcgtgcagcgcgactggcccgcgaccgggacggtcgtcaccacgcacgacaccaagcgcagcgcggacgtgcgggcggccctggccgtgctgaccgagtgcccggggcgctgggccgggctgctggccgagctgagcggtgacgggcagggcgcgcccgacgcgcagctggcgtgggcggcctggcagacggtgttcgggctcggggaggcggacgcggagcgggtgggtcccgcgctgctgaagcacgtgcgcgaggcgggcctgtacacgagctggacggagcaggaggcgccgtacgaggaggcggtggagcggttcgtcaccgaggggccgtgcgggccgtccggcgggcgtgtgaccgccttccgcgccggactggagccgcacat

SEQ ID NO: 1557 - DNA, 613 bp, Unknown
  Kingdom: Bacteria, Phylum: Actinobacteria, Class: Actinobacteria, Order: Streptomycetales, Family: Streptomycetaceae, Genus: Streptomyces
gcagcgctccccagctcggggcgggcgcgggggcctcgaagccgtgcccggtgagcagcacggtgtcggtgaggaagcgcgcgaggtgctccaggttggcggggccgccgtgggcgaggtaggcgtgggcttcggcggcgatgccgacgggcacgttggaggcggccatcaactgggcgtcgggggcctgttcgccggtgaggacgacgaccgggcggccgtcggcgagcagcaggtcgaggccctcctgccaggcgcggacgccgccgaggaggcgtacgacgaagaggtcggtgtccgccatgagggcgggcaggtcgtccagcgccagccgggcggggttcgcgaagcggtacgggacggggccgccgacggcgcgggcgctgagcaggtcggtgtcggaggtcgacaggagcaggatgcggggggacggcggctgttctccggctgcgtgcgacatgcggcgtcctgccttcctcggggtgtccacgccccgggtggtgtcggaatggggttctccgctgctcggacgggccgaggccgggagagagggagttcctggctcacccggttctttctcgaaccgggctcacagtggcgggaccgcgccgga

SEQ ID NO: 1558 - DNA, 1828 bp, Unknown
  Kingdom: Bacteria, Phylum: Actinobacteria, Class: Actinobacteria, Order: Streptomycetales, Family: Streptomycetaceae, Genus: Streptomyces
cgcgggtgccacgcccgcgccggtgatcatcagggtcgtgagcgcggccaggagaggcttgttcatgtgggggtcccctctgcagacgtgagcgaccggagatcttccggccgcctgtcttgtcatgcgcattgtgatggcgccgtgcgggcccccacaagaagccgtcccgctgtcatggggtcatccctcggtccggattccgcggccgcggccgcgccacgtgtctcaagtggcggaaaacacgagccaccgggcgttacccggccgtaagctcccatacatgcaggtgatccagtcgaccaagctcgccaacgtctgttacgagatccgggggcccgtgctcgaggaggcgatgcggctggaggcggccggtcaccgcatcctgaaactgaacaccgggaacccggcggcgttcggcttcgagtgcccgccggagatcctggaggacatcctccgcaacgtctccacggcccacggctacggcgacgcgaagggcctgctcgccgcccgccgcgcggtcgtcatgcacaaccagacgctcggcatcgagaccgacgtcgagcacgtcttcatcggcaacggcgtctccgagctgatcgtgatggccatgcaggccctgctcgacgacggcgacgaggtcctcgtaccggcgccggactacccgctgtggaccgccgccgtctccctgtccggcggcaccgccgtccactaccgctgcgacgagcagtccgactggatgcccgacctcgccgacgtggagcgcaaggtcaccgaccgcaccaaggcgatcgtcatcatcaaccccaacaaccccacgggcgccgtctacgaaccggccgtgctcaaggggctgaccgacatcgcccgccggcacaacctgctggtctgctccgacgagatctacgacaagatcctctacgacggcgccacccacaccccgaccgcctcggtcgcccccgacctgctgaccctcaccttcaacgggatgtccaaggcgtaccgggtggcgggctaccgggtcggctggatggcggtctccggtccgcgcgcccacgccgactcctacatcgagggcctgaccatcctggcgaacatgcgcctgtgcgcgaacatgccgggacagcacggcgtggtcgccgcgctcagcgggcggcagaccatcaccgacctggtcctgcccggcgggcggctcaaggagcagatggacaccgcccacgagctgctgacgcagatcccgggcgtgacctgcgtacggccgaagggcgcgctgtacctcttcccgcgcctggaccccaaggtcttcaagatcaaggacgaccgccggatggtcctggacctgctgcgccgcgagaagatcatggtcgtgcacggcacgggcttcaactggcccgagcccgaccacttccgcgtggtcaccctgcccacggccggcgatctgcgcgacgcggtgaccaggatcggcaccttcctggacggttacagccagccctgacgctcacgctgggtgcggctacggaccggttccgcgaaccgactcaactttagacgggttctaatgtaggatgctttctgtcagagcacaggaggccatcccatgtacgaaccgatccgcagcaagtcggtccaccgcacgatggccggcaccacctccgacttcccccaccgctcccgcgaggaggagctggacatccagctcgccggccacctcgcggcgctgctcgccgtcaccgacgaactgcgcactctgaccccggagcccggcctggacgcggcggccgatcggctcgccgcccaggtggcccggctgcgcggcggtcacgccccg

SEQ ID NO: 1559 - DNA, 1873 bp, Unknown
  Kingdom: Bacteria, Phylum: Actinobacteria, Class: Actinobacteria, Order: Streptomycetales, Family: Streptomycetaceae, Genus: Streptomyces
cgccggcccggtccgcgcaccccccgtcgcggccggtcgccgagggcgccggtggccgaaacggccgcggggtgtgagcggcggacctcggcctgcccccgtacggcgtgtttcggagcccgccggacgggcaactccttgtgtcgagcgcgctgcacccggggagtcgccatgtggaagcgcagtaagcacggacgggccgccgtgcccgtgccgctggagctgtgcgacctgtgtgccctggtcttcccggcggacgaggcggtgcgcgggtacgttcccgactcctccgccgtccatcccacccaggactggttcgacgggctgcgcctggtcaccgcgtgcagcgaggcgcacttcgccgcggtccaggagcgctaccgccaccgccccttcgtccaggaggaactctgggcggcgaagatcgagcgcgccctgagcggcggtacaccggtcctcagcatgggacagctcggctgccgcaccggcctgcacgcaccggagatccggcgcgccatcgcctggcacaacgcgcacctgccgcccgacacgcagccctgacctgggccgggcgacgccggttccacgacacgcagccggtaccgggcctcgcgtgggtcgccgcgcgtgcccgcgtccgcacaccgtcgcaccggcgccccccgaccggtttcggacatgcggcccgcgggcactcgtgccggacccgttggccgcaccgtcccgggcgggcggtcgcgcccggacgggagccgagcgaggaggccggaacatgagcgagggcgacaccgcagcggtaggccgggcggacggcggccccgcacacgcgtttggcaacctgctgtccggaccgcagccgaacgtggccgaggccgccggttaccccgacgccccgccacggatgggcttcttcaccgacacctccgtctgcatcggctgcaaggcgtgcgaggtggcgtgcaaggagtggaactcggtgcccgaggacggcctggagctgaccggcatgtcctacgacaacacgcggggcctgggcgcggacacctggcggcacgtggccttcatcgaacagtcgaggcccgccgccgtcggcccggatcccggcgccggcgggttcgacgtgttcgaggccgcccgcaccctggacgcccctcaggctcctccggcctccccggctccccaggcttctccgcccactcccgacgggcggaccgagctgcgctggctcatgtcctccgacgtgtgcaagcactgcacgcacgccgcctgcctggacgtctgccccaccggagcgctgttccgcacggagttcgggaccgtcgtcgtccaggaggacgtctgcaacggctgcggatactgcgtaccggcctgcccctacggcgtcatcgaccagcgcaaggaggacggccgggtctggaagtgcacgctgtgctacgaccggctcggcgtcggcatggaaccggcgtgcgcgaaagcgtgccccaccgactccatccagttcggcccgctggaggagctgcgggagcgggccgccgaccgggtggagcggctgcgctcggccggtgtcgccggggcccggctctacggcgagagccccgaggacggcgtcggtggtgacggcgcgttcttcctgctgctcgacgagcccgaggtctacgggctgccacccgatccggtggtcaccaccagggacctgcccgcgatgtggaagcacgcggcgacggccgccgcgacgctcctcgccgtgggcgtagccagcttcgtcaggaggctccgatgagcggcccggaggacgcgaagaagcgcgaggacgcgaagaaggacacgggaccgggcggcggcacgggccgtgcggcgaacggcggcccgtgcc

SEQ ID NO: 1560 - DNA, 3936 bp, Unknown
  Kingdom: Bacteria, Phylum: Actinobacteria, Class: Actinobacteria, Order: Streptomycetales, Family: Streptomycetaceae, Genus: Streptomyces
gtgccggactcggctgcgcgctcctgccggggctgatggccgtgctgctgatcggcgcggtggcggcctcgtcctgacgcgggacccgcacccaggcccgacgacccacgcgcgcctcgctcccgacggcggaccgcaccgtcacccctgcggttcgaggtcctcctcctcgaacaccagcagcgtgcgcgtgctgagtacctcggggatcgcctggagccgggtcagcaccacctcgcgcagcgcccggttgtccggcgtgtgcaccaggagcaggacgtcgtagtcgccgccgaccagggcgatgtgcgaggcgcccggcagccggcgcaactggtcgcggacggtgcgccaggagttctgcacgatcttcagcgtgatgtacgcggacgtgctctgccccgcgcgctcgtggtcgacccgggcgccgaaaccgcggatgacgccgtcctcgacgaggcggttgatgcgggcgtaggcgttggcgcgcgagacgtgcacctgttcggcgaccgaccgtatcgaggcgcggccgtccgtctggagcatccgcaggatgtcctggtcgatggcgtccagcgggcgcggcggcggggcggagccgaaggcgtcgtcggagcgttcggcggggcgttcgctctgctccgggcgctcggcggtctcggcccggcgctcgccgttctcggccctgcgctcgtgagtcttccgttcggcgttctcggccattcgttcagtcggcatgtccccccgcctctccgccatggacgtactgcatccatagcaagctgtggagaaccgtttgtccacagcctggggccgcctgtagccaaaatgtgccgacgaccgaacaatcggtaggtggggcgagtcacagccgacgcgcctcccgtagccactcccacgaggaggtgcccgccatgacggtcatggagcagcggggtgcgtaccggccatcgccgccgcccgcctggcagccccgtaccgaccccgcaccgctgctgcccgacgcggagccctaccgcgtcctgggcacgccggccgccgcaaaggccgatccggagctgctgcgccgtctgtacgcgcacctggtgcgcgggcgccggtacaacacgcaggccaccgccctcaccaagcagggccgcctcgccgtctacccgtccagcaccggccaggaggcctgcgaggtcgccgccgcgctcgcgctccaggagcgtgactggctcttcccgagctaccgcgacacgctcgccgtggtggcacgcggcgtcgaccccgtcgaagccctcacactgctgcgcggcgactggcacaccggctacgacccgcgcgagcaccgcgtcgccccgctgtccacaccgctggccacccagctcccgcacgccgtcggcctcgcccacgccgcccggctcaagggcgacgacgtggtcgcgctggcgatggtcggtgacggcggcaccagcgagggcgacttccacgaggcgctgaacttcgccgccgtctggcaggcgccggtcgtcttcctggtgcagaacaacggcttcgccatctccgtcccgctcgccaagcagacggcggcgccctccctggcccacaaggccgtcggatacggcatgccgggccgcctggtcgacggcaacgacgccgtcgccgtccacgaggtgctcgccgacgccgtacggcacgcgcgcgcgggaggcggtccgacactggtggaggcggtgacgtaccgcatcgacgcccacaccaacgcggacgacgccacccgctaccgcggcgacgccgaggtcgaggcctggcgcgaccacgaccccgtccagctgctggagcgcgaactgaccgggcgcggcctgctcgacgacgacgccgtcgcggccgtacgcgaggacgccgaggcgatggccgcccggctgcgcgagcgcatgaaccaggacccgccgctcgaccccatggacctgttcgcccacgtctacgccgagccgaccgggcaactgcgcgagcagcaggccctgctgcgggccgagctggtggccgagtcggaggaaggcaccgcccgatgacgaccgtcgcgctcaagccggccaccatggcccaggccctcacgcgcgcgttgcgcgacgccatggccgccgatcccgccgtgcacgtcatgggcgaggacgtcggcacgctcggcggtgtcttccgcgtcaccgacggcctcgccaaggagttcggcgaggaccgctgcaccgacacaccgctcgccgaggccggcatcctcggcaccgccgtcggcatggcgatgtacgggctgcgtccggtcgtcgagatgcagttcgacgcgttcgcctacccggcgttcgaacagctcgccagccatgtcgcgaagatgcgcaaccgcacgcgcgggaagctgcccctgccgctgaccgtccgcatcccctacgggggcggcatcggcggcgtcgagcaccacagcgactcctccgaggcgtactacatggcgactccggggctccatgtcgtcacgcccgcgaccgtcgccgacgcctacgggctgctgcgtgcggccatcgcctccgacgaccccgtcgtcttcctcgagcccaagcggctgtactggtcgaaggactcctggaaccccgaggacccgcagcgcgtcgagccgatcggccgcgcggtggtgcggcgcaccggccgcagtgccacgctcatcacctacggtccctccgtgcccgtctgcctcgacgccgccgaggccgcccgtgccgagggctgggacctggaggtcgtcgacctgcgctcgctggtgccgttcgacgacgagacggtgtgcgcgtcggtacggcgcaccgggcgcgcggtcgtcgtccacgagtcgggctccttcggcggtccgggcggggagatcgccgcccgcgtcaccgagcgctgcttccaccacctggaggcgccggtgctgcgcgtggccgggttcgacatcccctacccgccgccgatgctggagcggcaccacctgcccggcgtcgaccggatcctcgacgccgtcgcgcgtctgcagtgggaggcggagggctgatggcacaggtcctggagttcaggcttcccgacctcggcgaggggctcaccgaggcggaggtcgtccgctggctggtcgaggtgggcgacgtcgtcgccgtggaccagccggtcgtcgaggtggagacggccaaggcgatggtcgaggtgccctgcccctaccaaggcgtggtcacggcccgcttcggcgaggaggggaccgagcttccggtgggcgcgccgctgctgaccgtcgcggtcggcgagtccgccgcgccgagtgcgccgagtgccccgaccgccgagggaggcaccggcggcggcccgggtggcacggacggctcggacggccccggtggatcggggggctcgggtggcggctccggaaacgtcctggtcgggtacggcacggcggaggcgccggcgcgccgccggagggtccgggcggtgccgggcggggccacggctgccgcggcggtgggctccgccgcggcaccggcgccgtctccggacgcccgtggtgcctcgcgcgcggccttcgcctccgtatccgccaccgctccgggcacggccggtcggccggccgagggcccggtcccggtgatctcgccgctcgtgcgcaggctcgcccgcgaacacggcctggacctgcggaccctgtcgggctcggggcccgaagggctcatcctgcgcgcggatgtcgaagcggctctcaagtcggcccgcgcggcggctgcgggacagcttgtcggcgaccgccccgcgcacgcccttgagcgggacccgggtcccggccgcagtccgcgccgccggggcgggcgcgagcgcgccggtctcggacagggccacggagatcgtctccggggccggtgacgccgccgcgcgggccgacttgagagc

SEQ ID NO: 1561 - DNA, 2023 bp, Unknown
  Kingdom: Bacteria, Phylum: Actinobacteria, Class: Actinobacteria, Order: Streptomycetales, Family: Streptomycetaceae, Genus: Streptomyces
gagctggccgtgcgcgaggcggccggcgagtaccgcgccgacgcgctggccgtcgtacgcaccgacgccctggccgcacccggcacaccgccgcgggagggcgccgcaccgcgttgggaggtgaccgtcacccacgtcgacggacgccgctggcacgtcaccgtggcgcagggcaccgccgagccgccccgccccgagagctgcggcgcgtcggtgctcggcacaccggcccgcatggacgtgctggccgtccgggaactggcggtgccccggccacaccgctgagccggcccggaggactggccgggagatccacgccacaccacctacggcggtcgccgtgccgcaccgtacggtcatccgtatgagcaccactgcccccgcacgccgccgacgcctgggcctgccccggcgggtgttctcacaggtgctgctgatgcagctggcgatcgccgcgggagtcgccgtcctggcgaccggactgttcctcgcaccgctcagccaccagctggacgaccaggcgatgaggcgcgccctctcgatcgccgagaccaccgcccagaacccgcagatcgtccgggacctccagcacaccccgcccagtgcggacggaccggtgcagcgggaggcggagcggatccgcagggcgaccggggccgagtacgtcgtggtgatggacatggccggcacccgctggtcccacgccgatccggagcagataggaaggcccgtctcgacaagtccgaaagcaccgctggccggccaggaggtcatgcagatcgacaccggcaccctgggccgctccgcccgcggcaaggtgccgctctacgacggcggccaccacatcgtcggggccgtctcggtcggcatcgcctacaccaacgtccgcgcccggctgatcgacgccatccccgggctgctcgcgtacgcgggcggcgcactggccgccggggcgctggccgcctggctgatctcccggcgggtgcagcggcagaccagggacctggccttctccgacatcgcggccctgctcgccgagcgggaggccatgctgcacagcatccgtgagggcgtcgtggccctggaccgcggcggccgggtcaggctgctcaacgacgaggcgcgacggctgctcggcatcggtgacgaggcggtgggccgctccctcgacgaggcgctcggcgaaggacgtacgaccgacgtcctggccgggcgggtgacgggcaccgatctgctcaccgtgcgcgggcagcgcgtcctggtcgccaaccgcatgcccaccgacgacggcggcgccgtcgccaccctgcgcgaccgcaccgaactggagcagctcggccgggaactggactccacgcacggcctgatcgacgcgctgcgcgcccaggaccacgagcacgccaaccgcatgcacaccctgctcgggctgctggagctggagatgtacgacgacgcggtcgagttcgtcggggaggtggtcggagaccaccgggccacggcggaacaggtcaccgagaagatccaggacccgctgctcgccgccctgctcgtcggcaaggcgacggtcgcggccgagcgcggtgtggcgctgtggatctcggaccggacgtggctgccggaccggctggtcgatccccgggggctggtgaccgtcgtcggcaacctggtggacaacgcgctcgacgcggtggcggcgaccccgcacgcgcgcgtggaggtcgagttgcgcaccgagggtcgcaccgtcgtgctcagggtccgtgacaccgggccggggatcccgtcggagctgcgcgagctgatcttcacggagggctggtccaccaagcagccgccggcacacggcaagcgtggcatagggctctccctggtgcgcagactggccgaacggcagggcgggagcgcgacggtgggcgcggcgcacggcggcggcgcggagttcgcggtcgtcctgcccgaggcgctggaggagcaccccgaggcgcgggacgagcaccccgaggcgctggaggagcacgaggag

SEQ ID NO: 1562 - DNA, 1714 bp, Unknown
  Kingdom: Bacteria, Phylum: Actinobacteria, Class: Actinobacteria, Order: Streptomycetales, Family: Streptomycetaceae, Genus: Streptomyces
ggccgtggacgcgctcgccgacggcctggtcaccgcgctcaccctgctcgacccgcgcacgctgatcatcggcggcggactcgccgaggccggcgagacgctcttcgccccgctgcgggacgccgtccggcagcgggtcaccttccagaagctgcccacgatcgtgcccgcggccctcggggacaccgccggatgcctgggcgcgggcctgctcgcctgggacctcctcggcacggccgccccggccctctctccttccccttccacgactgaccggaggtagccagcagatggcccccagcaaggttctcgacggagcccgggtggtgctgcccaccgggatcacggacggcggccgtgtgatcgtcgacggcaccaggatcaccgcggacgcccccgagaacgccgagaccgtcgacgtcaccgggcactggctggtccccggcttcgtcgacctccacaaccacggcggcggcggcgcggccttctccggctcggccgacgacgtcatgaccgccgtccgcgcccaccgggcacacggcaccaccaccgtcgtcgcctccaccgtcaccgacgagatggacctcctcacccaccaggccggactgctgtccgaactggccgagcagggcgagatcgcgggcatccacttcgagggaccgttcatctccccgtgccgcaagggcgcccactccgaggcgctgctgcgccaccccgacccggccgacgtgcgcaagctggtcgacgcggcccgcggccacgccaagatggtcacgctcgccaccgaactgcccggcggcctcgactccgtacggctgctcgccgagcacggcgtgatcgcggcgatcgggcacaccgacgccacctacgagcagacggtggaggcgatcgacgccggcgccaccgtcgccacccacctgttcaacgcgatgccgacgctcggccaccgcgcacccggcccgatcaccgccctcctggaggacgagcgggtcaccgtcgagctgatcaacgacggcgtccacctgcaccccgccgccctggaactcgccttccaccacgcgggcgcggcccgggtcgccttcatcaccgacgccatggacgcggccggctccggcgacggccgctacctgctcggcccgctggaggtccaggtcaccgacggcgtggcccggctggtcgagggcggttcgatcgcgggctccacgctcaccctggaccgggccttccagcgcgcggtcaccgtcgaccggctgcccgtcgaggacgtcgtacgggccctgtccgcgaaccccgcccggctgctcggcatggacgaccgcgtcggctccctggagcccggcaaggacgccgacctggtgctgctcgacgaggacttcgccctcaagggcgtgatgcggcgcggcgaatgggtggtcgatccccaactgggctgatccgtccggccctccggccgccctcccggcccaggtgagcggtacgaggggtgggcgccgggccgctcgctcacctgcgacacccggtgcgaggtgtggggccgcagggacggcacccggtaggtgatgtcgagagcggtgttcagcgtgaccgtgaggatcacgtgggccggcctcccccgggtaagtgcgtctgtcacgcgagtacgcctgtcacgaagctccggcggtccgccggagcttcgatcatgccaaacggacggcccggcgcccacccctcg

SEQ ID NO: 1563 - DNA, 2672 bp, Unknown
  Kingdom: Bacteria, Phylum: Actinobacteria, Class: Actinobacteria, Order: Streptomycetales, Family: Streptomycetaceae, Genus: Streptomyces
  misc_feature (287)..(288): n is a, c, g, or t
cctgacggacagacgtgaacaaacggttggagcagggtgcgcgatcacagaacgtatgcaacccactgccgctgcttgcgtcaagtgacgggggcagcggtgatcactccgctgcccccgtgtgccgcaagccgcatgaccgtccgtcaggcggcgacgcctgtcgactccgcgcccgacaccgccgccggcgggagcaccgctccggtggacttcttcgcgcgccgcagccggcgttccagccagctcgcgaagctggtgaggctgaagttcagcaggacgaagannatcgcgccgccgagcgcggtgtccttcacgatgaccaccagctggctgacgatcgccggcagcatcgcggtgaccgcctgcggcagcaggatcgacgtcatgacctgcgtcttgcgcagaccgatggcctgaccggcctccgcctgacccctgggcagggacaggatgcccgcccggacgatctccgcgaggaccgaggagttgtagagcaccaggccggtgacgacggcgtagagcgggcggtcgtccgagccgacgctcgtgtactgggcgaacagcgcgttgccgaagatcatcaggatcagcaccgggatggagcggaagaactccacgatcacggcggccggcacccggacccaggcgtggtcggagagccgcgcgatgccgaagacggcgcccagcggcaacgcgatgaccatcgacagggccgcggcgatcagcgtgttcttcaggcccggcaggatgtacgtcgtccacgcctcggaaccggcgaagaagggcttccacttcgcccagtccagctgccccttgtcgctcaggccctggtagacccaccacaggagtgccagcagggcgagaacgaacacgatcgagtagacgacgttgcgccgtttggccctgggcccctgcgcgtcgtacagcaccgagccgctcatcgcttcaccgccaccttcttgctcacccagccgaggatcagacccgtcggcagcgtcaggcacacgaagccgaacgcgaacaccgcggagatcagcagcagctgcgcctcgttctcgatcatttccttcatcagcagggccgcctcggccacaccgatcgccgcggccaccgtggtgttcttggtgagcgcgatcaggacgttggtgagcgggccgacgaccgaacggaacgcctgcggcaggatcaccagcgtcagcacctgggtgaagttcagcccgagggcacgggccgcctccgcctggccgaccggcaccgtgttgatgccggagcggatcgcctcgcagacgaacgccgaggtgtaggcgatcagtcccagcacggccagccggaagttgatggtgtcgaagttctccgagccgaggcgcacgccgagggtctggttcaggcccagcgaggtgaacaggatgatcaccgtcagcggaatgttccgcacgacgttgacgtacgcggtgccgaagccgcgcatgagcggcaccgggccgacgcgcatggcggccagcagggtgccccagaccagggaaccgacggccgagagcagggtgagctgcaccgtcacccagaaggctcccagcaggtcgtagccttcaagaaagtcgaacacgatctcccgcgcttccgcgtgtggtggaccccggcatgccgcccccctgagggagcggcacacccggcgggcgctgactcagctcttgacgtcgccgatcttcggcgcctgctcgtacttgtagttcgccggaccgaagttggccttcacggcctcctcccaggaaccgtccgagaccatgtcctcgagggccttgttgatcttggccttgaggtcgctgcccttcttgacgccgatgccgtagttctcgttggtcatcttgaggccgcccagcttgaacttgcccttgaactgggcctgggaggcgtaaccggcgaggatcgagtcgtccgtggtcagcgcgtcgatggccttgttctgcagaccgttcagacaggccgagtacgtcgggtacttcagcaggttcgccttgggcgccagccggtccttgacgttctgggccgaggtcgaaccggtgaccgaacacagcttcttgctgttcaggtcgcccgccgacttgatcgagtcgtcgtcggcacggaccaggacgtcctggtgggcgagcaggtacgggccggcgaagtcgaccttcttctcgcgctccggggtgatcgagtacgtggcggcgatgaactgcacgtcaccgcgggacagcatggtctcgcggtcggcgctcttcgactccttccactcgatctggtcctcgttgtaaccgagcttcttggcgacgtacttggccacgtccacgtcgaagccggagtaaccctgcggcgtcttctggccgaggccgggctggtcgtacttgatgccgatggcgatcttcttgtcgccacccgacccgccgtccttcttgtccgaaccgcacgccgtcgccgagacggcgagggcgagcacgacggccgaggcggcggtgaccttgcggagcttcatgctgaacttcctttgctgaaggactcgaagacccggtgcggggccgggcccccggctcggggggcggcggcgccgcgcgggcaggtacgagaggccggcacgggtgccggagcgagcgggtgtccggcggcaccggcggggttgtcggaccggacgg

SEQ ID NO: 1564 - DNA, 2037 bp, Unknown
  Kingdom: Bacteria, Phylum: Actinobacteria, Class: Actinobacteria, Order: Streptomycetales, Family: Streptomycetaceae, Genus: Streptomyces
gggcaggccggctggtccacaggccgaccggccgggcgggggtacggcccgaggggggcggttcagcgcggtgttcggcggcggtcgagcaggagggccgcggcgcccagcgccatcaggccgcgcgagggcgaccaggagcgctggccgcccatggaagccggggtgtacggctcgttgacctggagggcgaagcggcggttcgcggcgtccgcgagcaccccgcgccactgctcggggcccgatgtcaccgcggtgagcaggtccatggtgttgcgggcgacctggtcgagggagaagtactcgcgcagcagggagacgatgatgccgcgcacctcggacttgaagacctcggcgagcgcgatgtccggcgccaggcagcgcaccgatccttcgaggttggcgaaggacttgccgagcagggagatggacggcgcggagccgatgccgcgtctggtggccttctccagcacggtggtcagggacaccccgaagttgatgtcctccagggaggccgtggccaccttgggcaccagggcggccatgtccgaggcgaaggccggcagattggaccaggcggtgacccggcccatgtcggcccaggcccaggccaggccgtgcccgtcgttctgcgcgatggacatcagcagcggcagcaggcgcagactggtgcgccggtcgagcctgccgaccatgccccagtcgatgagggtggcagggccgccgggccgcgcgaagacgttgcccgcgtgcgggtcggcgtggaacatccggtcgacgaagtagccccggtacatgaaccgcaacaggtccttgcccatgtccatccgttcccggtcgctgaacgcgcgccggtcgacatggcggacggacgtccccggcgcgagcgactgcaccagcaccttcggggtggcgtggacgacgcggggcacgtcgagggtcggatagcggcggatgttctcgcgggcctcgtccatgtggcgggcctcgccggtgaagtccagttcgggctccatggcgtcgaagatggagtcgagcatcgcctccacgtcgatgacctcgttgaagcggggtgcggtgcgcgccaggatgcgggacgccttgcgcatcagggccatgtcggcgcgtacggtgtcgcggatgccggggcgctggaccttgacgacggccgggcgtccgccgggcagttgcacccggtacacctgggccagcgaggcggcgccgagcgggcgagtggtgtcgacgtcgtcgaagcagagtttccagtccgggcccagctccgcttcgaggacgggctcgaagacggagaagggctggacatcgacctggtcgtggaggttctgcagttcggcgatcatggtcgggggcaccatgtcgggccgggtggagaggatctgaccgagcttgacgtagaacgggccgaggctctccagcgcctggcggaccgctcgcgcacggcgggcaccctcgccggcggcctgtgcgccggagggcggggattcccggccgaactggcgcctgttccgggcgagttggctgacctcgtcggtgacgaggcttcccagcaccttcaccaccagccggagccggctgccgagcggggcactcatgcgccacatcctcctgatgtctgacggacgtcgggggtgcccgacgggatgccgaagtctccgcgcggatgccgggagttccgacggatgccgggagttcccgacggttgccggagcacccctgggcgtttcgcaccggtcctacggggtggtcgcctcggtcctacgaggtggtcgccccgggctcgcgaggtggccgcatcggtcccgcgaggtggtcaccgggcggaaaggtgcttccgcccggtgagcgcgggagccggatgaggctcaggcgggagccgggcgaggctcaggtggctttgcgggcggccggtgtggacgcgccggcgagcggtcccgcgaccttctggacgctctccagcacgctcgccaggttgccgacgagttcggtcagctgggcgagctggccgggcagcgcggccag

SEQ ID NO: 1565 - DNA, 1441 bp, Unknown
  Kingdom: Bacteria, Phylum: Actinobacteria, Class: Actinobacteria, Order: Streptomycetales, Family: Streptomycetaceae, Genus: Streptomyces
gtccggcgcgccgccgccgcaccacctcgccggccagccgctccagcagcagggcgccgggcctggccaaggggtgcacggagggcggcgtggcccgccggtacagcagcaactgccgtgccgtggggccgaacccggtgaggtccgccgcgcagcgagggcacttgctgaggtggtcctcgaagcggaaggcgtccgcgtcctccagcacgccgagcgtgtacgcaccgacgtcgcgatgccgttccagggacctcatgctctcatcctcgcgaggggtgcgggtgggacttgctcggtgctcccacccgtacgcaccacgctgccgaatcgctcaagccccgcgccggatcggtgaagagggcgcggccggaaggcggctgagcgtggcgtcagaagaggtggatggcgaggtgtcccaggggcaggccgagctgccaggcgggcgtccacaccttcggcccctcgtcctcgcccaccgcgccggcgccgtccggcaccgcgtccaggtcgggcgcgagcagctcggtctcctccagccagcgccaggccgcctcggccagcaccagatcgggcgagggcagaccgcaggcgtgggcgtcggccgcgagacagtccatccgctcgcgcacccagtcctgccacggctggtcgtacgccgtcagcgacagccaggtctccagctgcgagaccacccggatgccggacagctcgccgtcggtgtcggacaggaagacggtgagcgccagcgcgtcccgtccggcgcggaactccaccgacgccggcggcatcagatcgccggtgcgcaacagctcctcggcgatgtactcggcgtacaaccaggccatgggaacgacgagttcaccgccgccgtcctcaccgcccctactgtccctgccgtccccgtcgttcccgtccgtgctctcttgacctctgtggagcatcccttcctgccttcctccggtgcgtgcgcgtggccggccccggctcctgggacagggccccagcggaacacggatgagaacagccgattactcaaccgtggtccacggcaaggcgctttgcggagacttgacccggggatccgtttcaccgcaggtcggccgcgtaccccgggagcaccctgcgcagggcgcgcagcgcgtagtacgcgcgggacttcacggtaccgggtggaatgcccaggatgtcggcggcctccgccacactggccccctggaagtacacgagcaccagtacttcacggtggtgcggagtgagtgtcttcacagcccgccgcacatcgagtgccgcggtggaccgctcggcgtggtcggcgcagacccgcgcgttctccaggaccgcgtcgcccacctcgggcggccgggccagccgggcccggcgcgcgtcgatggcgaggcgccgggcgacggtcagcagccagggccgtacggagtcgaag

SEQ ID NO: 1566 - DNA, 2658 bp, Unknown
  Kingdom: Bacteria, Phylum: Actinobacteria, Class: Actinobacteria, Order: Streptomycetales, Family: Streptomycetaceae, Genus: Streptomyces
gaccacgcgcgcggcagccgcgccggacaccgctacgtcgaggagctgtgggaagccgcggtgcgccgcgacccgcaccaccacggctgccacgtggccgccctgcggtacctggccgcctcctgccgcgtcccagggggcctcaccccggaaacccggcacggctcgctgcgcgcctgcttcgacttcgccgaccgggcggcccaggacgcccccgcggacgccctcgcgcagggactgcccgtgcgggtcgccttcgcgtgcctggccgaaggcgggttcgcggtggagcggtcccggctcgacgcggcggcggaccgggcgatcgcgctgtccgcccgctcccccgccgccacgccccggtacgcggagctgcgcaacctgctgacgtacgtcctggtgcggctgggccgccaccaggacgcgtcggcgcagctgccgctgatcggcccgtacgccacctcctacccgtgggaccgggtgtccgacgacccgctgggcctgttcctggaactgcgcgccgacgtccgcgccgtccggctgaccccggtccagggcgccccgggcacccgggaaaccgggcgcggcggaggcgccgggacgcgcggccattaggcttttgcgccgtgaccaccgtccggctcccgctcttccccctgaactcggtgctcttcccgggactggtgctgcctctgaacgtgttcgaggagcgctaccgcgcgatgctgcgcgccctgctgaagacccccgaggacgaaccacgccggttcgccgtcgtggcgatccgcgacggccacgaggtggccccgaccgcgccgggcctgcccgatccgaccgcactgcccgaactcggccccgcggccggcttcgggcccgaccccgccagggcgttccacggcgtgggctgcgtggcggacgcggcgacgatacgggagcgggccgacgggaccttcgaggtgctggcgaccggcaccacacgggtgcggctgctgtcggtggacgcctccgggccgttcctcaccgcggagctggaggagctgcccgaggagcccggcgacgaggcgggcccgctggccgagggggtgctgcggtccttccggcagtaccagaagcggctggccggcgcgcgggagcggtcgctggcggccggcgcggagctgccggacgagccgagcgtggtgtcgtacctggtggccgccgcgatggtgctggacacgccgacgaagcagcggctgctccaggcgccggacacctcctcgcggctccgtgacgagctgcggctcctgcgctcggagaccgcgatcatccgcagtctgccgtcgctgccgtctccggacctgacgcgcggcccgacgagcttcaactgagaccggacctcgggacttcaggccggagaaacaggaagaccaggaagaccagggagaccggggccgcgtggcgaagaagacgaagaagcagcagcagtccgggggcactcccgcgacggtggccctgaccgctgcgggcgtgacccacaccatccactcctacgaccacgacccggcccacccgtcctacggcgaggaggcggccgaggcgatgggcgtctcgccggaacgggtgttcaagacgctggtcgcggacgtggacggtgccctgacggtggccgtcgtcccggtcgcgggctccctcgacctgaaggccctggcgtcggcggtcggcggcaagcgcgcggcgatggcggaccccgcgctcgcggaacgcaccacgggctacgtccgcggcggcatcagcccgctgggccagcgcaagaagctccgcacggtcctggacgcctcggcgacggcccacgccacgatctgtgtctcggcgggccgcagaggcctggaggtcgaactgtccccgaccgacctggcccacctgaccaacgcggtactggcccccatcgcccgaaactgaaccaccgcccccggccgcgcgatggcccggcccgctccagcccacccggtccgggccagaccggtccagccggcggccgggcccgctcggtcacgaaggggactggatctcgtggggttcctgggcgtacgggtccgggtcccgggggccgaagagggccgtcaccgccaggtggacgaccagggcggccagcggccacgccagcagcgcgcccttcgcgcccagccggagaggggccgggaaggtcttgccctcgcccacggccctggcgtgcgcgacgacgtcctgctgggggccgagccacacgccgagccgccaggcgagcagcgagccgaggagcgcgccgacgcacagggccaccaccaggggcactcccccgcgccgccgcagcaggaaggcggccaccgcgctcagcaccccgaatccgagcgccagcagcgtgaacgtgccgtccacgccgatcgcctgctccccctcggaatccttgaggtagacgacccagctgtccccggtgacgtttccgaccaggggcacccggggggacagccacagccacaggagccccagcaggacaccgcagagtgccacggccaccgtgaccacggcggcctcgcggagctcggtcttcatcccgggaccgtcctgtccgtacaccgaaccctccgtcccaccgccgccgacgggtgcctgccaggtctgcccggccgcgctctccacggg

SEQ ID NO: 1567 - DNA, 1190 bp, Unknown
  Kingdom: Bacteria, Phylum: Actinobacteria, Class: Actinobacteria, Order: Streptomycetales, Family: Streptomycetaceae, Genus: Streptomyces
gtctcgacgcggtacggctgggggccgtgcgcgtagccgtgcccggcgacgcggccaccggccgcgtaggcggcccgcgaccagggcgcgaaggactcctgggcgttccaggggccgcgccgggggcgggtctggccgttgggcgtgaagtggtcgaagggccgcaccgggcggccgaggacggcgccggggcgcagcagcaggaagtgttcggcgaggtcgggcaggcggtgcagctgccattcggagccgggacgggcgcgcagcacactgaggcgttcgccggcccgcagccaggccggggggtcggcctcggcgacgacgtggacgacgtccacccagggcgcgtactggtgcagcgagcgcagcgcggcccgcagcagttcctcgccccagggtgtggggtgctgccacagcaggacggcgtcgacggggaagccgatctcctccagccggacgacgtcgaacgtctccagggtgacggtgggttcgaggtcgccgtcgatgtcgcagtagccggacagccggtcgagtccgatctcgatgccgggggtgtcgctgggcacggcgcgctggacgcggttggggcgcgggccgatgaggcgttccgtggcgaggttggtgttgacggtccagaactcgatctccaggccctggtcctcgcccacccagaggttctcggtggggtcggtgcgcagccaggtcaggcggatcacccgggccttgccgtagtgcttccacgccttgatatggctgccggggacgtcctgggtgtcgttcttggcgggtgagacggagacgacgtatccggtgtgctcctccagcagggcgcgcaggacgcggcgcacggcgcccttgtcgcgctggtcgaccgcgaggcagatccggcggtcgtcgagcgcggggaccgcgaaccaggggatctcggcgatgtcgagggcctgggtgaccagatcgtggtcgaagcggcgggccaggtcggcagtgaggccggtgtgcacgtggccgacgcgcccgtcgggggcggtggcacggcgttcggatccgccgagcccggcccggcgcacctggcgcagggcgcggcggtgcaggcgggcctcgcggcggcgcagggtgcgggcgagctgtcccttgaccttgcggcgtacgccggccgggacggtggtcgcggccggcgtacgccgcaaggt

SEQ ID NO: 1568 - DNA, 2399 bp, Unknown
  Kingdom: Bacteria, Phylum: Actinobacteria, Class: Actinobacteria, Order: Streptomycetales, Family: Streptomycetaceae, Genus: Streptomyces
accgctccgtgcaggtacgggtgggtgctgttctgcgagcggcccaggtagttgcgcgtggtggcgccgagcagcagcggcccggacaccatggcggtgttgcgcccggcctcggcgccgtccacgtagaggaccccggtgccgtggcccagggtcagggccacatgggtccagcggccgacgggcagcggaccggcggcgtcgacgacgtcctcgccgtccatgccggcgatcttcagcgcggcacgggcgcgcccggcgccggtggtcgcggcgaggaacaggtacgtctccttgtggaagccgaggtcgaagacgcgggcggaggccgcgaggctgtcgatccgcacccgcacaccgaccgtcagttcgtccaggccgctcaacagccctgagggcaacgcgagatggccgtccacgccgtcgagcgccaccgaggtgacgtcgtcctcgcgcagccaggcggcaccgccgctcagcgtggcgtcggggaaggaacgggtggtgtccgcggccgaggcgccgatgccctccgccagcgggaagcgggcgacgtcccgtgcgcgggacggccgggggctgacggcccagtagacgttgtaacgctggtgctgcacctcgtggaacggccgcagggcgaccgtgcggcccccggcggtggcggtgaaccgcgtggatctgccggggacggcgcgcagtgtcgagggcaggacggtgggaagggtggcgagcggtgtgtccccgtactcgccggccagcacgagcgggccgagggacaacgatgccacctgcggattgtcgggggcgggccgccagacgggtgtgcgtggcaggaccagctccacggtgtcaccggcacgccacaggcgttccaccgaggcataggtgcccggccgcagacgcgtgcgcacctcgcggcggttgaccttgagcacggcgggccggccggtgtcggccacccaggacggaacgcggatcttcagcgcgaggcgcgcgctgccttccgtgacggtcagccgggtccggtcgcccgccggttccacggcctcttgacgaagtgtcagtccttgccgctcccagcggatttcggaaggaatgaacaggttgacgtagagtgcgggcggggtgcggggatcgcgggtgcggaagtagatgctgtcggcgaacttggtgtgcgtctcaaggcccgtgccgtggtcgcaggagaagttgtcgtagtcgctgctgtaacttcccggcgcggcgccgaggccgcccttgggctgccgctcggagcccgcccacagtcccgtgtagtacgtgacgaagccgtgcgcggaatcggggtcctgctcgccgagcatctggttgaccagggtcagctcgtagtggtccatgtactcggcgcgctccgggcggtgcaggaagagctgccggcccagcttcagcatgttgtagctgttgcagttctcgcaggtcacctcggacagccggctgacgatctcgccgggcgggccgaagagttcctggtcggagttgccgccgacggcgtacgagtggtggcgtgcgacggcggtccagaaggtgtcggcgacggtcaggtaccgcgcgtccccggtcgcctcgtacgccgggacggcaccgaccaccttggcgatctcggtgttggcgtgccggccggcgagttcgtcgcggccggcggccagcggcgcgtagaggtcctcgtggtcgaaacgccgggccgtccgcaggtgggccgggtcgccggtctcctggtagagccgggtcagtacgtcgttcatgccgccgaactcgaccttcagcaccgtctgcatgtgctcccgggacagcggcgcggtccgcgcgtccgcccaggccgccatctccagcaggaccgtgagcgcctcccggttcccgctgaggcggtactggtcgaggagccccgccatgatcttgtgcagggtgtagtacggcgcccagggcctgccgccggcctccaactgggcgaagaccgattccgggaaggcggacaggtatccgcggtggtagccggcgccgggcgcggcccgctggcactcggccagggccgagaccacggcgcggcccttgccggcgtacgcgtcgtccccggtgttggcgtgcgcctgggccagcgcgctgagcaggtgaccggtggtgtgtccgcgcagttgtacgtcgggggcctcccagccgccgcagggctcggcgtcggagggcagcccgacggtgcgccggaaggtgtgcaggagccggtcggcgtcgacgaagagcaggtaggcgcaggtgcggcgcatgtcggcaaggaacgggctgtccagcaggcgtacttccgacaggtcgaagggggcgaggaccggtcggtgcccggggcgggcggtggcggccgcagtggccgtggg

SEQ ID NO: 1569 - DNA, 893 bp, Unknown
  Kingdom: Bacteria, Phylum: Actinobacteria, Class: Actinobacteria, Order: Streptomycetales, Family: Streptomycetaceae, Genus: Streptomyces
ggtgacgcgggcgcaggaaccggcgctcatggccgaggcgatggggcacgcggtgacggcgggccgcctggcccgcctggcgggccgcatcccccgtcgccacttcgccgaggcgtcgtccccgacggagggcctggccgccctggacccggaacgcccggccttctgacgccggcaggaccgcaaggcccggcctcatgaagccgggccgggcccgcctccgcctgcgggccgggcccgtgcgccccgcgtacgctcccggctcgcgccccgcgcgcgtgggaagcgtcacaggacggcttcagtcctgctgcgggggcccgctcggcggctcgggtgtccgtggcggctcgtagactcccctgcgtggatacgacccttcaggaccctctcgtcgggcaggtgctcgacggccggtatcgcgtcgacgcgcggatcgccgtcggcgggatggccacggtctaccggggcctggacacccgcctggaccgtgtgctcgccctcaaggtgatgcacccggcgctcgcggccgacgggtcgttcgtggagcggttcatccgggaggccaagtcggtggcccgcctggaccacccgaacgtggtgcaggtcttcgaccagggcaccgacgggtcgtacgtctacctggccatggagtacatcgccgggtgcacgctgcgggacgtgctgcgcgagcgcggggcgctgcagccgcgggccgcgctggacatcctggagccggtgctcgcggcgctcggcgcggcgcaccgcgccgggttcgtgcaccgcgacatgaagccggagaacgtcctgataggggacgacggccgggtcaaggtcgccgacttcgggctggtccgggccgtggactcggtcaccagcaccaccggtgccgt

SEQ ID NO: 1570 - DNA, 921 bp, Unknown
  Kingdom: Bacteria, Phylum: Actinobacteria, Class: Actinobacteria, Order: Streptomycetales, Family: Streptomycetaceae, Genus: Streptomyces
ggctctcggtgggggtggtgcgagggtcagggggacggtggcaccggcagaccgcaggcccgccgcgccctggacaactgctccacggggtcgccgaagacgcaccacggcatccgtgaggcgtagggccccatggcggtgaggaccgcgcgggcctcgaactcgcatccggcaaggaccagcgcatgggccaggtaggccaggtcgatgacgggggtgaaccggtaaccggccacggtgggaagccagttgcggtagatcgcgagtgcggtggagcgccactggggttgctcccagacccgctccgcgagcgactgcgaggggtcgtagccctccacgagggcgaccagtggaagcagccgcagcgcggagtcggcgggcgcgcgctggctcaggaaggcggcgacgtcccaggccgcgttgaccgagccgccgtgccgggtgaagaagaaggccagaaatcggtggtgggcctcccggtgccaggggtcgagggacaggatgtgcgcgaacagccgccagggtccgggcggggcggtcagcagcccgtgcggcgccgggtcgcgcagccggtgcagccgggtcatggccagcttggccgtccagggcgtggggtcggtggggtccaccgccgaggcccgtgcgcaggccgacagggctatgcgctccagcgcggcggcccgctcgtcgcgggcgtcggccgcgcgcagcgcccggtgcaccgccacccgcgcccacaccagcgccgattccgggccgggctcctcggccagccagcgttcggcgaggtcggagtcggcggcctcggaggccagcaccagggagcggtgggcccgcagcgccaagtcgccgcgggtctcggcgagggcggcgcgggcgctcgcccagcggccggcccggatgtcgacgcacacgccggcg

SEQ ID NO: 1571 - DNA, 4192 bp, Unknown
  Kingdom: Bacteria, Phylum: Actinobacteria, Class: Actinobacteria, Order: Streptomycetales, Family: Streptomycetaceae, Genus: Streptomyces
ggttctggcccgaccgcgtgctgccgggaaccggtgccgccataccggcgggcgcgatgctcccgttcgccgccggcaaccgcaagtgcatcggcgacgcgctcgccgtggcggaggccaccgtggctctcgcgaccgtcgccgggcgtctgcggctgcgccacctgcccggaccggtgccgcagccgcgccccgcggtgaccctcggaccgcggtcgctggtgatgacctgcgaaccgcggccgacccacccccgtacgtcccgtccgcaggacttctccgacccgaagggcaggtgacaccggtgtcgacgacgcgggaggaacgcgcggtaccgcgccaggaggttccggccgctccggccaccgaccggacggccgataccgcggccacgctgaacgaccgggcggccacgctgaacgatctgatcgacgcccacctctacatgcccttcccgttccgcagcagccgccacgaggcacaggcggcggcggggacggactcctggctggacagctgcggactgaccgccgaaccgggcgtcgcggacatgatcatccgtacccgtccggcccagctcgcctcgtacatcaccccggacgtcgacgcggacatcctgctgctcgtcgcccggcagatcgcctaccagttcgtcttcgacgaccgggcggaggaggtgggtctggccgggcccgaccggctgctgcccatgctgtgcgagagcgtcgcgatcctccgggacggccggccgcccacgacggccctcgggtcggccctggccgacctccatcgccaggtacggcagcgctgcacccccgcccaggcggcacgctgggcggcgaacagccgggagtacgtgcacggcctgatgtacgaggcggtcgcccagaacgggacggcaccgccacagctcggggtgtgcacgtcgatacggtcgctgaccgcgggcgtggagccgttctatccgctctgcgaggccgcggaggccgaggagttggggccgcacgaactccatcacccgctcatgcgacggctgacccggctctccgtggacgcggcggtgtggataccggacctgtactcggcggtgaaggagcagcgtgccggcggcctgatcaatctggccctcggctaccagcgggcgtacgactgctccctggcggaggctttgttgccggccatctcgcggatcaacggcacgatccgcgagttcgagcggctgcgcgcggaactcgaaccggaactgagcgccgccggcgccggttacgtggacggtatggccggctggatccgcgggtgctaccactggtcgcgcaccgtgccgcgctacgccgactccgcgcgggcgcccgcccggtagccacctattcgagccgcaatacccacccggagggcgcgtcaaccctccgagggcgccggttcacccttccttaccccttgcatgccccattcggccctctgcgaccctgcccaggcgtacgctctggcttcccccggccgacagcgttcaaggacaggaagcggtagggcacatggcacatgagccgtggcagtcacacaccggacaccgacccttgctcgaacgccaacgggaactgcgcgcgctcgacaccgcgttggccggcctcgccgcgtcgtccgacggtgcgccgcgccgtggcgggctgctggccttcacgggtgcggccgggctgggcaagacggcgctcatggcgcagttgcgcgcacgggccgccgcgcgcgacctcactgtgctctcgggccggggcggggagacggagcaggaactggccttccacgtggtccggcagctcgcgcagccaccgctggcggcgatgcccggcccggagcgccgcgcgttcctgggcagctggtacgacatcgtcgccgccgcgctcggtctggaggcgtccggaagcgtccgcgtgcccgacccggccggggtgcgggacggtctggactgggtgatgacgcgcctggccgtggagcaggcgccggtcgtgctgctcctggacgacgcccactgggccgacgccgagtccctgagctggctcgcctcgttcgcggcgcgcatcgacaaccttccgctgctgatcgtggtggcctaccgccccggagaactgccggccgaggcgaccgcgttccgctcgctcctcgaacaccacgagaaccgcccccacgccctcgagccgctctcggccgcgggcgtggcccacatcatcagggaccatgtgggcgaggcggccgaggaggagttctgcacggagtgctggacggtcaccgaagggcgtccgttcgaggcggtggaactggcgatccggctcgccgaacggcaggtgcggggcaccggggacgaactgccggtcatgcgcgacctcgcgtcggcgatcaagggccccggactgctggaccggctgcatcggctcggcacgacggccgttcgtttcgcctcggccgccgccgtgctgggcacgtccatctcgccggagctggccgccacgatcgccgcggtcggtgtggagcaggccgcgcaggagaccgcgaagctgcgggccgccgggatcctgaccgacagccagtcgccgggcggtcgcctggagttcgtgcatccgctgatcgccaccgcgatctaccaggccatcccggcggccctgcgggtcggtctgcacaatgccgccgcggtggcggtccgggccgcggggctcggacccacggccgccgcgcggcacctgctggaggttccgtgcgaggccagggccgaggctgtcgagtgcctgcgggaggccggccgtgagtatctgcgggcgggggctcccgaagccgcccggcgggtgctgaccagggcgctgcaggagccgcccctgcccgaggaccgtgccgcgctgctccatgaactggcgtgcgcgaccttcctgatcgagcccgcggccaccgtcagtcatctccgggaggcgctggcggagccggacctcgctcccgggctgcgcgcctccgtcgtctaccggctgacccaggcgctcgcgcacacggaccgtatggcggaggccgcccgagtggccgccgaggaggcacaacaggccaccgatccgcggacgcggctgcgcatgcaggccgatcacttcgtgtggagcgccttccgcagcgacgaacccgactcacctgcccggtcgcggagactggcgcggctggccggacggctgaccggacgcaccctggaagagcgctgcatcctggggctgcgggcctgggacgccatggtgcgcggagagccgcggcgaacggtcctcgaccatgccgagaaggcgctgcgcggcgggctgagctggaccgacgagcaccgtggtttcgaggtcccggcctcggtcgcgctgctgttcatgtactgtgaccagccccggcgggccgaggaactgttcggccggggcatcgccgagtgcacggccaagggctggcgcggctcccacctggccctggggcagaccctcctcggctacatccgctaccaccgcggctgcctggccgaggcggaggacctggtgcgggagggcctgcggatcgccgaccgggtggagggcgcggttccggcgcagtggttcgcggtcggtgtcctgatccagaccctgctggcccgtggccgggtcagtgcggcgcggcaggtcgccgacgatcaccacttcggcgagagcgcaccgaacgcggtcatctaccccgatccgcggacggtctacgccgagcttctgctggcggaggaccgcaaccccgaggcggtgcggctgctggccgacgtcggtgaccggctggacgccagggcctggcgcaaccccgcctggtgtccctggcagctggatctggcatcggcgctggctcccacggcaccgaaccgtgccgtcagtctggccacggaagccgtcgagcgggcgcgggccttcggtgccgcgtcggccaccgggcaggcgctgcgtacgctggccgaggtcaccggcggaccggcggcgctggatctgcacgcggagtcggtctgcctgctggagggggcgcggccggccagggcctccgcaccgcagtggacggcggtctccagaccccggtagaggcggtcggcggcctcggggagcttgccgttgcgggccagcgccgcgccgtgcccgaccagcgcgcgggccagctcgtagccggccggcgccccctccag

SEQ ID NO: 1572 - DNA, 872 bp, Unknown
  Kingdom: Bacteria, Phylum: Actinobacteria, Class: Actinobacteria, Order: Streptomycetales, Family: Streptomycetaceae, Genus: Streptomyces
cgccgccgcctcccgcgccgcccgcggccactttcccggtgcccggaccgccgacgggaagcccggtctccgtacccgggctgcagtcggcaagcgggttcgaaccgcacgctcagcagccgcagcccgcgcagcggcaggaacagcaggcagcggacgcggacttcggagccgctgatctcgagagcggtgccactatgcggttctccgccgtgtccgtgaagcgggaggtcacggaacgagccgccgcggccggcgatccgagcccgctcccggacgccgcggaccggccggacgagcagggggccgtaccggaggacaaggatccggaagcgacccgcgagaccaccggcgtcactgacgcgtccgaaaccgcagcggaggccgaggttccgggtgaaggcgcccccacggctgacgacgcggcccaggacggtgggtcgaaggacggcgagtccgcatcggctgcggctgcggcggaactttcggacgtggcaggcacgtcggccgcggtggacaccgtgaactcagtggactcagtcgactcagcggacgcggtggacgctctgcggacggccgcgggtgcggtgtcggacagcgacgccgacacgaactcggacgaagcggaagagccggacgccgtgccggacgccgccttggccgatgcttcggccgccgcttcagccgacgtcgacgacgcaccggacgcgggcagcgatccggcggacgagacgccgttggattccaccgccccggacgctcgtcccgacgcagacccacgccccgccgccgcggcggacgaagcgcaggacgccgccccaccacaagactccacaccacaagaccccgcgccccaagacgccgtaccaccg

SEQ ID NO: 1573 - DNA, 1452 bp, Unknown
  Kingdom: Bacteria, Phylum: Actinobacteria, Class: Actinobacteria, Order: Streptomycetales, Family: Streptomycetaceae, Genus: Streptomyces
gggcatggactggttccgcctagacgcggtgcagtacttttaccagaaggagggcaccaactgcgagaaccagccctccacccaccagttcatgagtcgggtgcgcaaggagttcgacacccagaacgcggacacggggcttctcgccggggcgaacaagtggccgtaggacgtcgtcgactacttcggcgacttaaccggccactggttcgcctcggcgagcagcaccgtgtccgggtactgggtgtcgatctccttgcgcacccgcttcaggaactggtgggtggcgggcaggttctcgcagttggtgccctcctgctggtacaggtacggcaccgcgtcgaggcggaacccgtcgatgcccaggtccagccagaacttcagcgcggagatcatctcctcctgcacggccgggttctcgtagttcaggtccggctggtgcgagaagaagcggtgccagtagtactgcttgcgtaccgggtcgtacgtccagttcgacgcctcggtgtcgacgaagatgatgcgggcgtcctggtactgcttgtcgtcgtcggcccagacgtagtagtcgccatagggcccgtcggggtcttttcgtgactcctggaaccacgggtgctggtcgctggtgtggttcatgacgaagtcgatgatgacgcgcatgccgcgctggtgggcggcgtcgacgaactcgacgaagtcggccaggtcgccgaagtcggggagtacggcggtgtagtcggagacgtcgtaaccgccgtctctgagcggtgacttgaagaacggcggcagccacaggcagtccacgccgagccactggaggtagtcgagtttggcggtcaggcccttgaggtcgccgatgccgtcaccgttgctgtcctggaaggagcggaccaggacctcgtagaagacggcacgcttgaaccactccgggtcgcggtcctttgcgggagtgtcctcgaaggtgtccggaacgggctcgttgacgatcattgtgtgggtgaccctccgatctgcggggtggacggtcgcaggacggtgaggacgtgcgcgggcctttggcccggttcgagtcgcacatagttggccctgccccagtggtaggtctcgccggtcagctcgtcgcgcaccggcaccgactcgtgccattccaggccgagttgcggcatgtccaacgagaccgtggcctcctgggtgtggtgcgggtcgaggttggcgaccaccacaaccgtgttcgatccgctgcgcttcgagtaggcgatcacctcgtccttgtcggcgtggtggaagtgcaggtcgcgcagctggcgcagggccgggctgcggcggcggatgtcgttgaggcgggtgatgaggggggcgatggtgcggccctcgcgttcggcggcggcccagtcgcggggggtgagctggtatttctcggagtcgaggtattcctcgctgccttctctg

SEQ ID NO: 1574 - DNA, 624 bp, Unknown
  Kingdom: Bacteria, Phylum: Actinobacteria, Class: Actinobacteria, Order: Streptomycetales, Family: Streptomycetaceae, Genus: Streptomyces
ccccggccccgccccggctcatggcgatgtgggacagcgtcctgctcgcccacgccgaccgcagccgcatcatccccccggcctaccgtccgctcatgatccgcaccaatggcgacgtcctgccgaccctgctggtggacggccgggtcgccggcgtgtggcgtgcggtggacggcggcgccatcgagatgacggccttccacgaactgccggcggcggcctgggaggcactggaggccgaggcccgcgcactcgtggacctgctggccgcccgcgagccgcgcgtctacggccgcttcgaccactggtggtcgaagctgcccgcgggcgcccaggtgcgacgcctgccgggccggcccgcgtgagcggcgggcgcgccgcgcgtcaccgcttcgagtgtcaccgaccgtccggacggcacacctgggacgcctccgactccaccgacgcgcgcagccgggcgctggccatgcgcatgtgctcggccatggcgcggtccgcggcctccggatcgcgctcgcggatggcctggagcaccgcgtggtgctcgcccagggtgccgctgacggtgccctcgatgtcgctgacgcgctccatccgcacccgcagcagcgcgcggatgct

SEQ ID NO: 1575 - DNA, 3294 bp, Unknown
  Kingdom: Bacteria, Phylum: Actinobacteria, Class: Actinobacteria, Order: Streptomycetales, Family: Streptomycetaceae, Genus: Streptomyces
ctgcgcagggccctggacgcgacccggcgcaacgtccgcgcggtggactggctcagcgccgtacccgacatgatcgccgaggcgctggaccacgtggccgaccgctaccggcacgagaacgcgatcctgaccaacatccgcaaggcgcgcgacgagaccgaggagcccgagcacaagcggcgcgccgccgagctggtcgacatcgtcaaggactgcatccgcagacacacccagctgcagtcccggctgctcgaggccggccccctcttccgtgccgaacaggaccggcaggccttcgccacgccgctcaccacctcgggcaccgacctctacggccacctgctcgcccccaccctgccgctcccgctggaaggcgcgatccgggtcacggacgccttcttcgcccacgggaccgggctgcgcaccccggtgtccgtccgcgtctgcgacctcgtcgacatcctgctcacaccgcccgtggagcgggagcacctgggcgccgagatgcccgagcccgacctgatcgccacgccggacgacagccggttcagcgaggagcaactggcagccgccatggagctgctcgacctgcccgccgacgccccgcgccggctctcgggcctgctcgcggaggcccgccgcacggacgccgacctgccgtacctggtcgcactccttgccgtgcacgcggccagtccgccggtcggcaccgcctaccggcagggcgaggagaagctgctcttcgccgtcgacgacggcacggagctggacgacccggagttcggcggcgccgacctgatcgtcgggaccgcgctgctggacgcggccgggatggcggcggaccggacggaagcggcatgagccgacgaccgggcgtaagcggcatgagcgctgagccgagcggaagccgcacgaggcgcgagccgggcgtgagccgcacgagccgcgagccgggcctgagccgcacgagccgcgagccgggcgtgagccgcaggagccccgagccgggcgtaagccgtatgactgagcaagagcgcgacaaggagccccagcagtgagtgagcacgtcgagtggagtgaggcggagacccccgccccgtccgcgaccggcgccgtcacccccgccgacgccgccgacgcggcccggctcgtcgccttcggcctgcagcccaaactgcagcccgcccgggaccaggagtacgccgacctgctgcgccggcaccgcgaggacccggcgttcgcccgcctcgcggaagccgtggccgccggactcggcctggtcgtcctggaggtgtccccacgcgccggcatggcggtgacggccgccgaggactccgtgttcgccgtccgcatgggcgactacgcccggcgcaccgccgccgactccggcgaccgtttcctgcacggcctcgctcacctcgccgtggccgccctcgccttcccgcgccccgaggacctggccgacgacggctacatcggccgcgtcacggtcaacggcgtggacgccttcgtccgccaggcctgccgccgcctggaggagcgtgccgaggagcagggcgagaacaccgacccggccaccgacgcgcccggcctggaggccgcctggcggatctgggccagacgcagcgccaccggcgccaccaaggacgcccgccgccccgccgcctccaccaccggcatcgtcgccaaggccctggcgttcctcaccgactccgggttcctgcagcgcaccggagacgagagcggcggcacctaccgcaccaccgcccgctaccagctccaggtccgcgacatggcgggcggcgccgccctggccgaactgctcgacctgggcgtcgtcccggtcaccgacggcacggcgagcctgctgcccgccgaggacaccgacgacctggacctggtggccgacgccggactgccgttccacagccccgcccagcattgatccagtactgatccagcactgactgcgctgacccagcactgccccctgatccgccagaagactgacgagagtccgccatgtacgagctgtcccgggtccgcctctactccatcggtcctgccggtgcgcgctacgccgacaccgtgctcgacctgcggggcgtgggcgagccggtgcccgaccccgcgcccacccaggcggagttcttcgaggaggagccggtcggcccgccgcgccgccccgcacccgccggcgtgctcttcctggagaacggcggcggcaagtcggtcctgctcaagctgatcttctccgtgatgctgcccggccaccgcaacaccctcggcggcgccagctccggcgtgctgcgcaagttcctgctcgccgacgactgcgggcacgtggcgctggagtggcagcacgtgcagaccggcgagtgcgtcgtcgtcggcaaggtcagcgagtggcgcggacggcaggtctccaacgacccgcgcaagttcgccgaggcctggtactccttccggcccggccccggtctcaccctggacaacctccccgtcgccgaggccacttccgtacgcccgcccgtcgagggtgcctccggcgcgcagggccggcgccgcaccatgaagggcttccgggacgccctcacagacgccggcaagacctacccgcacctggaggtgcactgggaggagatccacgaccgctggatcgaacacctcggcgacctcggcctcgaccccgaactcttccgctaccagcgggagatgaacgccgacgagggcgaggcggccggcctgttcgcggtgaagaaggactccgacttcaccgacctgctgctgcgcgccgtcaccgacacccgtgacaccgacggactcgccgacctggtcagcggcttcggcagcaaactgggccgacgtgccgaactcatcgccgaacgggacttcaccgccggctcggtggacctgctcggccggatcgtcgaggccgccgaggcccgcacccgcgcgcgtgacatccacgccggagccgaacgccgcacccgcaccctcgtacgccggctgtccgcacggtcggggcaggagcgggtacgcgccgccgacctcgcccagcgcgtcaccgccgccgcctacaccgtcacgcactccgagggagcccgcgagcgcagcgcgctgatcgccgccgaactcgcctaccgccacgcctcgctggccctggccgccgccgagaagtccgccgccgcgcagaagcgcgaactggccgacgccccgtcaaactgtcccgccgcaagcggtacggccagaagatgtacgacaccaaacgcgaacccagggcggtgatgaagc

SEQ ID NO: 1576 - DNA, 1623 bp, Unknown
  Kingdom: Bacteria, Phylum: Actinobacteria, Class: Actinobacteria, Order: Streptomycetales, Family: Streptomycetaceae, Genus: Streptomyces
gttcgccgcgccgtcggcccgcccgcccgcctcggcgctccgcttgccggggccttcgttccgcttgcccgcttcgccgttccggcccgcgctcgtcccgcccatgggctgcccctcgcctgtggattccgttccgtcccgtccggtcagtgtattgggatcgcggcgaaccctattgacacgcccttcgggcggacctagcgtcgccccatcgattttgggtccacaccgaacccaatcgatgttcccgaaggagccacgcatgagccagtccacgggcacccaggcccccgccaccggggcgccacacagctccaggccctggaagatcgccaccgccgcgatgatcggcacgagcgtcgagtggtacgacttcggcatctacgccaccgccgccgcactcgtgttccccgagctgttcttccccgagatgaaccgggccctcggcaccgtgatgtccttcgcgaccctgttcgtcggggccctgggccgcccgctgggcgcagtcctcttcggccacatcggtgaccggcacggacgcaagaaggcgctcatctggtcgatgaccctgatgggcgtcgcgaccgtgtgcatcggcctgctgcccacgtacagccaggtcggcgttctcgcgccgctgttcctcgtgctgatccgcatgatccagtcactggccgtgggaggcgagtggggcggggccgtcctgttcgcggtcgagcacgcgccgccgcgccgcaaggcgttcttcggctccttcccgcaggtcggcgacggtgtcggttacttcctgtcgactggcgtcttcgccctgatcgcgctgctcgggcacgacgcgctggcgagctgggcgtggcgcgtgcccttcctgctgtccgcggtgctcgtcgccgtcggcctggtcatccgccgctccatggacgagtcgcccgaattcgaggccgcccgacgggccgaggaggccgcgggtccggccgccgcccggggcagggagagcgcgcccgtcatcggcgtcctgcggcacgcatggaagacgtggctgctggcgacgggcgcgtttctgatcaccgtcggcggctactacatcgtcgtcaccttcatgtcgacgtacgccgtcacgcacctgggcttcaccgacgcccaggccgcgggcgccggaaccgccgcctcggtcgtcgtcatcgtgtgcaccccgctgagcgcgctgtgcgccgaccgctacggcctgcgccgggtcacactcatcggcgtcctgcttcacctggtcgcggccttcccgatgttctggctcgccgacacccgctcggtcaccggcctgtggctcgccatgtgcctgcccatgctcgccagcacgatcgcgtacgcctccctcggcaccctcgcctccggctggttcgcgccgcgcgtccgctacacgggcctgtcgatgagcttccagaccgcgggcctgctcggcaccctggcccccgcggcgaccacctggctgtactcctcgttcggcaactcctgggtccccgtcgcggtcgccttcgccgccatggcggccgtgagcgccgtatgcctgatggcgtgccgcccggcggcggaagccggagcgtcccccgaggctccggaggccgcccccgg

SEQ ID NO: 1577 - DNA, 2379 bp, Unknown
  Kingdom: Bacteria, Phylum: Actinobacteria, Class: Actinobacteria, Order: Streptomycetales, Family: Streptomycetaceae, Genus: Streptomyces
ccagcagcgtgtcacccacggcggtcagccggatgtcggcccgcttgacgacgcgccgttgcagcagggtgggcccgtaggcgaccggcccgaagtccgcatcgggcgccacgcggctggtcggcaccgccctcggcggctcctgcggatgcgcaccggagaccggcttgaccaccaggtcgggaaagcgcgccgcgaagtcccgggcggcctgcggaaacgtggtgatcagcgtcgccggcaccggcagcccgcagtgctgggccagccgcagctgccagggcttcacccgggcccggcgcgccgcgtcgggatggttcatccagcgcgccccgcagccgcgcagcatgccgtagagcgcctgtgccgcctcctcggtgagccaggccgacggctgggccgcccgggccgcgggagcgccgggcctgcgcacccagacggagcgcagctcgctcagggtcaccaggcgtcccgcgcacgacagatggccgcggaaggaaccgtgcacgtactcgcccgagagcgcggcgcccgcggtgagatcggccggatcgagccggaccaccggaaccgaggaggcgttcaggtggaccaccaccatgtccgccgtcacgtcctcctcgcccgtgaggatcagtacggtcatcgtcgccgaccgtgttcagtcgtcgaagtgcgtcttggagcccgccgtcgaggtggtggtgcccagttccctcagcagcgcctggtcgcacgcggcgatccggccgtcggggagcacgttcagctggagtccggagtcgtaggcgtacggcgtgccggactcgcactccacggccggacgtgcgtagttgagcgcgaacggttgcatcgtctctcccctgtcggtgcagccgcgatcaagcggaggtcatccttgcggtgtcgcttggcccgctgactttgtttcgggttccggagacttatacgaatcgaacgggtgaatggtttccttacggaccgtaatcatgggcgtccggcagttcccgggacccgaaacgccccggtcggcgccctgcccagggcccgcccgcacgggccgcaccggcggctccgtgcagcgtgcgcagtgcgaggagcagcacaccgatgtcgtcgagatacacgggatcgggcagcaggtcgaccggcagcacgaagtagaggaccgccccccagaagacccagcgcggcccggtcggcagccccgcgcgacgcagcacacgccgggcccgtaccagccgtacgagcacggcgagcgccccggcgagcacggcggccgcgaggaccgcggcgaccaggaacaccttcgtggtggagtccaccgcccgcttccctcctcctgccccctcgtcccgggtgccctcactccggtgccgcaccccgatggcgccccggccgagccgccctgtcaatggtcagggtaagtcgcgtgtcgcgcttcgggggcgcaggagcggccgcacccctgccatggagcccagatgaccacccgctcttcaccaccccagccgaacccgtccgtcatcgccttcaccgaggagatccaccgggccggtccgcccggcggactcgccggcggcggtgaggcgggcggtgcggacggcgagcccgcccatcgtccggtccggtacgccgtgggcggccggcccctggacgaggtcgtccggctcgtcatcctcctcgaacagtccccgcagtacgccgacacggccggccgcgtgctgcgcgccgcggcactggaccgcccggtggaggacgtcgcccggctggtcgccgaactgacccggccgccgcgcccggcagagagcgctgacgacgtgatccgcgccgccgtcgagcaccgcggcctcgacgaggtcacccgcctggtgaccctgctgcaccaggcaccgcagcagccgcactgcgcgcgggaggcggcccgcgcggcgatcggcgcccgtaccgctgaggaactggtggacctcatcggcggcctgacccgggaaaacaccctcgttcccgccgccgagccgcagtacgccgaggaagccgcgtcggcggacagccggacagaacccgagaccgacgactctggcggtccgggtgacatcggcaatccaggcgattcggccctcctggacgccgttcccggcgctctcgtggacccggacgcggccgaggacccggctccgctggacgacgagggcgaaccggtccgcgcacggctcgtgttctggcccggctgggtcgccgcggcggccctggtggtgtgcgccgcggcccacttcccgctgcaccggcacggcacctccggcctcgtctacggcgccgccctcgcggtgtccgcgctgtgcggcgccctggcgctggcgctggtcctgcgcgccggggtgg

SEQ ID NO: 1578 - DNA, 1312 bp, Unknown
  Kingdom: Bacteria, Phylum: Actinobacteria, Class: Actinobacteria, Order: Streptomycetales, Family: Streptomycetaceae, Genus: Streptomyces
acctggcggactgggcaggtccgcgggaagacctgcccagtccgccaggtgcggcaggtacgcgtccggtatctcgggtacggacacgccgatgtcctcgcgctgctcgtccagcgggccgtggatcagcacccggtccggccggccgccctcctcaccctccgcgaacgtcgcgtcgtcggcgtaggaccacaccagtgtgtccacagtgttggccacctgctgcgccgccgacaggtcgacgagcgggtcgtggtgctcggggtgcagagcgtgcccggagcacgcgtccagccacaccgagggccggcctcggaagctgggacggcgcctgatgaaccggcccgtctcgacgccggtgatgtcctcgttctccacggacgtgccgccgtcgggctgccggaccacgtgcggcgcctccacgccgccctggagcagccgtccgtgcgaggagaagacgtaggcgtcacgcatccccgcaggcagttcccgcagcggaccctcggtgtcggtctcggggtcccagcgggcgaagtggcgcacccgcggcagcagccggtaggaccactcgttctccgcgaagtcgcccggctcgtgcgccgcgcggccggtggaacggccggtcgccggatccaccagggtgaaggtgatcagcgcgtcctcgctgaacgcgaagccggtaccggccccgaagaccagggagccctcgggcggttgctgcgccggatccggcagcatcccgggcgggctggcgatccactggcccagcggacggccgccgtcggggtcgtcgcggaacaccacccgcgtccggccgtccccggcgggaagcagctggtagcgggcatccatcgcccaggtctccaccccggcccggtcggcgaccgtccggggcagggtgagcaggccgtcaccggcgtgcgaggtgagcagcaccaccgggacaccgggcggacgctccgggtcccgggcgatgacctcggccgcctgctcgggcccgtacagccgcagcgggccgccgggcgcctcgggaaggtacagccccgacgggccgccgtcggccaccaccacgtacacgggggaatgaccccagggcgtggcggtcgcgccgcgcagcgtgccgtcggcctccagcacgtcccaggcggaggtgtccagccggcccggcgggcgcccggtgtagttgcggccggagcccggcgtgtcacccatgcgggtgccggcgtcgtagaccgaccgaggtgagggcggctcggccgggaggggggcggcgggccgcgcggttcccgtccggtgctgggcggtcagcgcc

SEQ ID NO: 1579 - DNA, 1865 bp, Unknown
  Kingdom: Bacteria, Phylum: Actinobacteria, Class: Actinobacteria, Order: Streptomycetales, Family: Streptomycetaceae, Genus: Streptomyces
agcggcggccggtcgtagggcaggtggggttcgtcaccgacgagggtgatctccccgtcccagcccaggcgccgcagcccctccgccgcggccagtccggccgcggcggcgccgacgacggcgatgcgggggcgggcggagttcattcccgcacctggatggccgcggccgggcagatggtggcggcctcacggaccgcggcgtgctgcgcggcgtccggagaggggttcagcaggacgacgatgccgtcctcgtcgcgctggtcgaagacctcgggcgcgaccagcacgcactggccggcgccgcagcacttcgcctcgtcgatggtgatcttcatcagtgtttccttcgggtgtgggaggtgtgatacctgggggtccgtgagggtgtggtcaccaggtgaccggcagcgcgtggcagccgtagatgaccatgtcggtgcggaaggggatctcctcgaccggcacggcgggacgcatcccggggaagcggcgcagcagggtggtgatgaccacctgcagctcggcgcgggccagtgcctggcccaggcactggtggatgccgtagccgaaggccacgtggtgctgggcgttggggcggcagatgtcgagccggccggcgtcggggaaggtgtcctcgtcgcggttggcggacggcacggcgacgatgacgccctcgcccttgcggacgagctgtccgccgacctcgacgtcctccagggccgcgcggcgcggaccgttgcggatgatgctgtggaagcgcagcagctcctcgacggcgccgcggatgagggaggggtcctcgcgcagccggtcggcggtctcccggtcgagcatcagggtcagggcgctcaggccgatcatgttcgccgtcgtctcatgcccggcgaccagcagcagcacggcgaacgcgacgaggtcgtcgtgcgtcagcccgcccttgtcgtactgctcggtgaccaggcggctgaggatgtcgtcgcccggctctgccttcttcgtctcgaccaggttgttgatgtaggcgaggagctcggtgcgggccgcgccgagctcctcctcggggatctcccgggagagaagggcgccggtcagccgctggaaggtgtcgtggtcctcgtagggcacacccagcagcaggctgatggcgagcgagggcagcggcagcgccagggccttgaccaggtcgacggggtgctcggagcggtcgacgcgctccatggcgtcgcacagctcgtcggtgagcttctgcagggtcgggcgcagtgcctcgacccgcttgaccatgaagtcgcgggtgaccatgcggcgcagccgggtgtgctccggcggatccatgcggatgaagccgcgggtggcgccgggacgcggtccgccgccggtcatgccgctgatcggatagccgggggtggaggtgtcggagctgaagcgcgcgtcgccgaggatcgcccggacgtccgcgtaacgcgtggccagccaggcccagccaccgtcgtccagggcgaccttcgacaggggttcctcgatccgcagccgggccagcccctccggggggtcgaaggggcaaccggagggcggctgggtgggaagtggggggagtgctgcggtggtcatgccgctccttggggggagaacacgttggataacagctgttagcttacatctgtatctctaggacgtgccgcggtccgggcgacgggaagagtgaagaaaaaccggcggaccggtggacgacgcgaccaggattgcgcctgccacggatacgccaggcaggggatgcgctggtcagggcccgtgccggtcaggggcgtgccgttcggggggcgcgctggtcagggaccgggccggtcaggagacccgttggtc

SEQ ID NO: 1580 - DNA, 3131 bp, Unknown
  Kingdom: Bacteria, Phylum: Actinobacteria, Class: Actinobacteria, Order: Streptomycetales, Family: Streptomycetaceae, Genus: Streptomyces
atatggggcggggcaggcgcagtgtgctcgcggcggccgtgaccgtggtctgcgcggtcaccgtgatgggcgcgtccggtacggcgttcgcgagcgcgggacccgaccgcgcgccgacaccgccgaccccctcctcgtcgccgactccctcgtcctcttcgccctcctcctccccctcggcctccgtcacggtcccgccggacaaggatctggaggcggtccgcaccaagctggaccagctctaccacgacgccgccgtcgccacggacgcctacaacgccgccgaggagcgggcccagcagcagtccgcgcaggtcgtcgacctgtcccggaagatcgtcgagcagcagcgcaagctggacgagctgaaggaccgggccggcgccgcggcccgcgcccagtaccgcacgggcggactcccgccccaggcccagctgctgctcagcaacgacccgcagcagttcctcgacggcgccggccggctcctggagggcgagcgggcgaccagcgggctgctccaggacatgacccacacccagcaggacctccagcagtacgccgccgacgccgccgaccgcctgcagaagctggaggccaaccgcaaggccaaggccacggcgaagaagcggatccagcagcgggtcaaggaggcggaacagctggaggccaggctggagaagcggcagcgggagcggctggcccagctggagcggcaggccgcccagcaggcgcaggcggcctggctgggcaccggtgtcctcaaggagatcggcggcagcgcgaccgaggcggacaagaaggcggtggcctacgccacggcccagatcggcaaaccgtacgaatggggcgccgagggcccgaagacgtacgactgctccggcctgacctcgcaggcctgggcggcggccggccaccccgtgccccgcacctcccaggaacagtggcggcagctcaagcacgtgcccgtgaaggacatgcgccccggcgacctgatcatctacttcagcgacgccagtcacgtcgcgatgtacgtcggcgacggcagaatcgtccacgccccgcgccccggccgcacggtgaccctcgcgggcgcgggcacgatgcccatcctgggcgtcgtacgcccggacgcggactgagccgtacgccggacgcggactgagcggcgggagaccttccggtgcgacagcgcccagatgcgcgagccgctgcgcaagccgccctcgaggccggctgggcctggaggggagtggtcttcggcaagcgtgagctgacggatgcggctcggagctgacggatgcggctcgcctcccgccacctcgtcgcagcgagcccgccccgcccgtccccacccggtgacctggaccatgtgatccagggcacgccctgtcggcgccaaacctgtccggacgtgaccttcgtcattcgcgggcgcggggcgcgctgcccaactccggtacggatcgcggcatatgacagcggctgaagcgtgagcgacgcgtctcacaccattcccccgcgccgcccactaccgctatggtccccgtcggtggaacgaggtccctcgtcccgccatgccctcggggggagggaaggaacccgaaacgatgcccgtgcccgtaccgcggcagcgagagatcccggccgcggagagcggccaggcgcggaccgtgctccacggcggcggcccctccgcagcacaggccccgcaccgtgacaccaccggagcaacagaagccacggaagccgtagaagccacagccgccccgaaggaagacgcgaaggacaccacggtcgagaaggacaaccgccccgccggccaccacgcccacggcacgaacctgacgctgctgctgatcgaggacgatcccggcggctccccgatcgtgcccgagctgctcgacgcgtccggcaagccgatccgcgtccgcacggcccgcaacctcaccgaggcctcgcggctgctcaccgacgacgtccactgcatcctgctggacctcgcgctcccggcccccggccggcccggctccggcagtggttccggctccggggacgacgacgagctggccgtgctcaagcacgtgctcgaactcgcaccccggcacgccgtactcgcgctcaccgcctccggagacgccgagcgcggcgcccaggcggtgcgggtcggcgcccaggactacctgctccgcgacgagctggacggcccgctgctgagccgggcgatccggtacgcggtcgagcgcaagcgctccgacacggccgagcgccggctcgccgagggccggctgcgcgcgcaggagaaccggcgtctggagcgcggcctgctgccgacgcccctgctggacggttcgacgctgcgtttcgccgcccgctaccgtcccggccgctcgcgcgccctgctcggcggcgacttctacgacgccgtccgcactcccgacggcaccgtgcacgccatgatcggcgacgtctgcgggcacggccccgacgaggcggcgctcggcgtggagctgcgcatcgcctggcgggcgctgacgctcgcgggactgtgcggcgacgagctgctgaacacgctgcagcaggtgctggagcacgagcgggccgacgacgagatcttcgcgacgctgtgcacggtggacatcgcaccggacggccgccgcgcgggcctgtgcctggccggccacccctcaccgctggtcatcacgcccggcctgcccgccaggctgctgccgtacgacaacaacggtccggcgctcggactgctgcccggtgcccgctggccccgcacgcaggtggaactgggcgccgagtggagcctgatgctctacaccgacggcctgatcgagggccgcaccggccaggacggcgaacggctcggccaggacggcatgctggaactggtccgccgccagctgggccagggcctgcgcggcgaggacctgctgcgggaggcggtcaacgaggtccgcgcactcaacggcggtgaactcacggacgacgtggcggtggtcctgctcgaccggcagccgtgagcgcggccaccggcggcgtggagacggcccggggggggcgtaggcgaggccaccgggacgtagaggcggccctccgggagggcaggcggtctaccggccgcc

SEQ ID NO: 1581 - DNA, 1146 bp, Unknown
  Kingdom: Bacteria, Phylum: Actinobacteria, Class: Actinobacteria, Order: Streptomycetales, Family: Streptomycetaceae, Genus: Streptomyces
cctcaacgacatccgccgccgtcacctggcgctccaccacctgcgcaacctgcgcttccacgcgaccgacaacgacgccgtgctcgcctacagcaagagcaccggcgaggacacggtcgtcgtggtggccaatctcgacccgcaccacacccaggaggccacggtctcgttggacatgccgcacctcggcctggacccgcacgcgtccacgtccgtgctcgacgaactgacgggtgagacctaccactggggcaggaacaactacgtgcgactcgaccccgggcaccgtcccgcgcacgtgctccatgtccagcgaccgtccacctcgccgcagatcggaaggcctcccgcgccatgacagtcaacgagcccgtccccgacatcttcgaggacgccccggccagggaccgcgacccggagtggttcaagcgtgccgtcttctacgaggtcctggtccgctccttccaggacagcaacggtgacggcatcggcgacctcaagggcctgaccgccaaactcgactacctccagtggctcggcgtggactgcctgtggctgccgccgttcttcaagtcaccgctcaaggacggcggttacgacgtctccgactacaccgccgtactccccgacttcggcgacctcgccgacttcgtcgagttcgtcgacgccgcccaccagcgcggcatgcgcgtcatcatcgacttcgtcatgaaccacaccagcgaccagcacccgtggttccaggagtcgcgaaaagaccccgacggaccctacggcgacttctacatgtgggccgacgacgaccggggctatccggacgcgcggatcatcttcgtcgacaccgagacctccaactggaccttcgacccggtgcgcggccagtactacttccaccgtttcttctcccaccagccggacctgaactacgagagccccgccgtccaggaggagatgctggccgccctccggttctggctcgacctcggtatcgacgggttccgcctcgacgccgtgccctacctctacgccgaagagggcaccaactgcgagaacctgcccgccacccaccagttcctgaagcgggtccggagcgagatcgaccggatgtacccggacacggtgatcctcgccgaggcgaaccagtgg

SEQ ID NO: 1582 - DNA, 2255 bp, Unknown
  Kingdom: Bacteria, Phylum: Actinobacteria, Class: Actinobacteria, Order: Streptomycetales, Family: Streptomycetaceae, Genus: Streptomyces
gcccagccgccagatccccggtttcgcggccgggcggggcgcgtcgagccactcggcgacggtggcagaggtgtgctgcgccggccggggcggcacgggcgggcgcagcggcgaaccggggtactgctgcggtaccgggccgctctgccccggaagcgggcccgcatgcttcggatgcgtgccccgcgcgtcctgcgtcccgccgtcgtccatcgccgtcgctccccggccagccgttccgtccaccgtcaccatcagcgagtcaatctaaccctgaggaagggcagttcaccgatcgcgtggcgcggcgcgcacacgcgatggcgcggcgcccgcgccgaccggtgcgtgcccctcccccgccacctctatatccaccgcggacaacggcgaccgccgacaacgcccacatggagcatgcccaccccccttccgccgtcctaacctgcgagaaaagaaggaaaagcgtccgaaaaacgccgtcctcgaacaagccccccaacgcatgatctcttcagggagcccccatgaccgcacttgagcaggagcgccgcgtcgtcaccgccatccccggcccgaagtcgcaggagctgcaggcccgccgtaccgccgcggtcgcgcagggcgtgggctccacgctgccggtcttcgtgacgcgcgccggcggcggcatcatcgaggacgtcgacggcaaccgcatcatcgacttcggttccggcatcgccgtgaccagcgtgggcgcctccgccgaggccgtcgtacgccgtgcctccgcgcagctggcggacttcacccacacctgtttcatggtcaccccgtacgagggctacgtcgccgtcgccgaggcgctggccgagctgaccccgggtgaccacgcgaagaagtcggccctgttcaacagcggcgccgaggccgtcgagaacgcggtgaagatcgcccgcgtgtacaccaagcggcaggccgtcgtcgtcttcgaccacggctaccacggccgtacgaacctcaccatggcgctgacggcgaagaacatgccgtacaagcacggtttcgggccgttcgcccccgaggtgtaccgcgtgccggtcgcctacggctaccgctggccgaccggcgccgagaacgcgggcccggaggccgccaagcaggccatcgaccagatcaccaagcaggtcggcgcggacaacgtggccgcgatcatcatcgagccggtgctcggtgagggcggcttcatcgagccggccaagggcttcctgccggcgatccgccagttcgccgcggacaacggcatcgtcttcgtcgccgacgagatccagtccggtttctgccgcaccggccagtggttcgcgtgcgaggacgagggcatcgtcccggacctgatcaccacggccaagggcatcgccggcggtctgccgctggccgccgtgaccggccgcgccgagatcatggacgccgcgcactcgggcggcctgggcggcacctacggcggcaacccggtggcctgcgccggtgcgatcggcgcgatcgagacgatgaaggagctggacctcaacgggaaggccaagcggatcgaggaggtcatgaaggcccgcctgggcgccatggccgagaagttcgacatcatcggcgacgtccgcggccgtggtgccatgatcgccatcgagctggtcaaggaccgcgccaccaaggagccgaacccggaggccaccgccgcgctcgccaaggcctgccacgccgagggcctgctggtcctgacctgtggcacctacggcaacgtgctgcgcttcctgccgccgctggtgatcggcgagaacctcctgaacgagggtctcgacatcatcgagcaggcgttcgcacgcatctgacacgcatctgagcggtgcatccgcacaggtggcgcggtgggcggcagaccgtgtgaagaaggtgtgcgaggtggatgacgggacgccgatcggactgtcctgggcccctgccctgccgtaggttctctcccagatgagagatacaccccgcccgcaggcgactgcgggcggcatcaggccgtagcctccccagcttcgacctggtccgtgcctcgcgcacaccaccggagcccccgggctccgggtctcctcaccgatcggacggtcgctcgccccaaaccccccggggcgcgcgacgttccggtcagggcggccgcaatcgcatggacggccgcccctcgaagggccgacgcagaggggggggttctgcgtcggcccttcgaggggcggccg

SEQ ID NO: 1583 - DNA, 1833 bp, Unknown
  Kingdom: Bacteria, Phylum: Actinobacteria, Class: Actinobacteria, Order: Streptomycetales, Family: Streptomycetaceae, Genus: Streptomyces
ctgcaccgccgaacggatgcgctcggcgacgagttcgtaatgggtgcagcccaggacgacggtgctcacggtctccggggtcagcgcggcggcggccgtgacggcctcgtcgatcgccgcctggtcggcgtgctcgacggcctccgcgaggccccagcacggcacctcggtgaccgggacgccgtcggcgaagtcccggatcaggccctgctggtaggggctgcccgtggtggcgggcgtcgcccagatggcgaccggtccgccgccggcggcggccggcttgatcgcggggaccgtgccgatgaccggaatctccggctccaggcggtcgcgcagggcccgcgcggtgaggtcctgcggggtgcggggtccccagggcatcccggcggggtcgagggacagcacgagatctgcgtcgggccgcaggcgccgtaccgcggcggtggccgccagcagcccgatcccggagtccatgagcgcgatcttcacccggccacgatagacgatcccctcgaaccggccgtccgggtggggcagactgcgggggtgagcgtgatcatgtggaccgccgtcggatcactcgccgcctggttgtggctgctgctcggccaggggttcttctggcgtacggacgtgagactgccaccacgcgaggatccggcaccggacgactggccggccgtgtgcgtcgtggtccccgcgcgggacgaggccgccgtgctgagcgagagccttccctccttgctcgcgcaggactatccggggcgtgccgaggtcttcctgatcgacgacggcagctcggacggcaccggtgaactggcccgtgaactggcgcggcgcggtggcgggctgccgctgacggtggactcgccgggcgagccgccgccggggtggaccggcaagctgtgggccgtacggcacggcgtcgcactggcacgcgcgcgtgcgcccgagtacctgctcctgacggacgcggacatcgcgcacgcgccggacagcctgcgcgggctggtggccgccgcgcgcaccggcggtttcgacgtcgtctcgcagatggcgcggctgcgggtggagagcctgtgggagcggctcgtggtcccggcgttcgtctatttcttcgcgcagttgtaccccttccggtggatcggccggcggggcgggcggacggcggcggctgcgggcggctgcgtgctgctccgcaccgaggcggccgagcgggcgcggatcccggacgcgatccggcacgccgtgatcgacgacgtggctctggcccgggcggtgaagggcggcggcgggcacatctggctggggctcgccgagcgggtggacagtgtgcgtccgtacccgcgcctgtacgacctgtggcggatggtctcgcgcagcgcgtacgcgcagttgcggcacaacccgctgctgctggccggcacggtcgccggactggcgctggtctacctggtgccgccggtggcgctggtggcggggctcgccgcgggcagcgcggcgacggcgctggcaggcggcggggcgtggctggtgatgacggcgacgtacgtgccgatggtgcggtactaccgccagccgttgtggctggccccgctgctgcccttcaccgcgttcctgtacctgctgatgacggtggactcggcggtgcagcactaccggggccggggtgcggcctggaagggccgcacctacgcgcgtccggacgccgtgcccgaggagggctgaggacgcgtccggacgctcacttgcggccgggcgtccagttcatgccccagccgtaggcgtggtcgatggtgcgctgggggctcaccccgcgcgcggggaccaggt

SEQ ID NO: 1584 - DNA, 553 bp, Unknown
  Kingdom: Bacteria, Phylum: Actinobacteria, Class: Actinobacteria, Order: Streptomycetales, Family: Streptomycetaceae, Genus: Streptomyces
cggacccgcaggcacgcgcctacgcggacccggcgccggtgggcctcgcggggttcgcgctcacgacgctgctgctgtccatcatcaacaccaacctcctcaaggaggccggcgcgatcatccccgtgctggccctcgcggcgttctacggcggcatcgcgcagttcgtcgcggggctcttcgagttccgccgcggcaacaccttcggcgcgacggcgttcatgtcctacggcgccttctggctgacgtactggtggctcgtgcagcacctcgccgccgccggcgacgtgcacaacgccctcgggttctacctgctcggctggggcatcttcaccgcctacatggcggtggccgcgctgcgtgtcagcctcgccgtgctggccgtgctcgtgctgctggccatcacgtacgtgctgctggccgccggcgagttccagggcggggcgccgccgcagctggtgacgcagatcggcggctggttcggcatcgcgaccgggctcgtcgcctggtacgcctcggcggcggccgtcatcaacgccacgcaccggcggac

SEQ ID NO: 1585 - DNA, 1231 bp, Unknown
  Kingdom: Bacteria, Phylum: Actinobacteria, Class: Actinobacteria, Order: Streptomycetales, Family: Streptomycetaceae, Genus: Streptomyces
gccctgctcggtcccaccgcccgtgaccgcctcccggacgccatcgggcacgtcgccgaagcccaccgcgcccacttccccgacgccgacctcgaaccgctgcgccgcgcctacctcctggccgagtcctcgcaccgcggccagatgcgcaagagcggcgagccgtacatcacgcacccgctcgccgtcaccctcatcctcgccgaactcggcgccgagaccaccaccttgacggcctccctgctgcacgacacggtcgaggacaccgacgtgacgctcgaccaggtcggcgaccagttcggcgccgaggtccgctacctcgtcgacggcgtcaccaaactggagaaggtcgactacggcgcagccgccgagcccgagaccttccgcaagatgctcgtcgccaccggcaacgacgtccgtgtgatgtcgatcaaactcgccgaccggctgcacaacatgcgcaccctgggcgtcatgcgccccgagaaacaggcccgcatcgccaaggtgaccagggacgtgctcatcccgctcgccgaacggctcggtgtgcaggcgctcaagaccgaactggaggacctggtcttcgccatcctccaccccgaggagcacgcgcacaccagccaactgatcgcggagaacgcgagccgcccgcacgacccgctcaccgaggtggccgaacaggtccggggcgtgctgcgcgaggccggcatcaccgccgaagtcctcgtcaggccacggcacttcgtctccctgcaccgcgtggcccgcaagcgcggcaggctgcgcggctgcgacttcggccggctgctcgtcctcgtgaacgaggacgccgactgctacgcggtcctcggcgaactgcacacctgtatgacgccggtcgtcgccgagttcaaggacttcatcgccgtacccaagttcaacctgtaccagtcgctgcacaccgccgtcgccctcccgccgtcacgcgcggacgcgcccgaagggacggccgcggacggccaggtcgtcgaagtcctcatccgcacccaccagatgcacaagaccgccgaggccggggtcgtcgcgctcggcaatccctacgcgccgcccgcggaggaccagtcggcgggcgacggtgaacgcgtcgacccgacccgtcccggctggctctcccggctcctcgactggcagcaggcggcacccgatccggacaccttctggtccacgctgcgcgaggacctcgcccagg

SEQ ID NO: 1586 - DNA, 1585 bp, Unknown
  Kingdom: Bacteria, Phylum: Actinobacteria, Class: Actinobacteria, Order: Streptomycetales, Family: Streptomycetaceae, Genus: Streptomyces
gtcctggactgctgcgcgctgccgcactccggcgcccgcgggctgcgcctgggcacggccgcggtgaccacgcagggcatggggcaggaggagatggcgcggatcgcggtcctgctgggcaaggtgctgcgcggcgagctggacggtgcgcgggcgcgggaggacgtgcgggaactcaccgccgcgttcccgccgtatccgggctgaggcgggccgaagggcgcccggagggcggatgagcggggcccgcgggggtaggcgcgggaccgtgcgcagttcgcgcacagcctggtgtgcaaccatcgtcgctacccggaagtccccatacatatgctcgcgtcgctagggtgtgaggctgagatggccagcgagacctgtggggaagcctgtgcgtgaatacctgctgacgctctgcatcacggccgcggtgacgtacctgctgaccgggccggtgcgcaagttcgcgatcgtggcgggggcgatgccggagatccgggcgcgtgacgtgcaccgggaacccactccgcggctcggtgggatcgcgatgttcttcggcatgtgcgcgggcctcctggtcgccgaccacctcaccaacctcaacgaggtcttcgagaagtcgaacgagccgcgcgcgctgctctccggcgccgcgctgatctggctgatcggcgtcctggacgacaagttcgagatcgatgccctgatcaagctgggcggccagatgatcgccgccggtgtgatggtcatgcagggtctgacgatcctgtggctgccggtgcccggcgtcggcacggtcgcgctcacccagtggcagggcacgctgctgaccgtggccctggtcgtcatcacgatcaacgcggtcaacttcgtcgacggcctggacggtctcgccgccggcatggtgtgcatcgccgccgccgcgttcttcatgtacgcctaccggatctggtactcgtacggcatcgaggccgccgccccggccaccctcttcgcggccgtgctgatgggcatgtgcctgggcttcctgccgcacaacatgcacccggcgcggatcttcatgggcgactcgggctcgatgctgatcgggctggtcctcgcggccggcgcgatctcggtgaccgggcaggtcgacccggacgtgatgaagctgttctccggctccgagcgcaacgccgtgcaccagatggtgcccgtctacatcccgctgctgatgccgctgacgatcatcgcgatccccgcctccgacttcgtcttcgcggtggtgcgccgcacctggcggggccagtcgccgttcgccgcggaccgcggccacctgcaccaccggctgctgcagatcggccactcgcacagccgtgccgtgctgatcatgtacttctgggcggcgctgatcggcttcggcgcgctcggctactcggtgaactccgcctcgatgtggatcgtgctgggcatcgtgctgctcagcttcctcggtctggtcctcctgctgctgccgcggttcacgccgcgcaccccgcactgggcggagcagttcgtgccgccgcgctaccggcgccgtcgccgcagggcggccgtggccccggccgcg

SEQ ID NO: 1587 - DNA, 959 bp, Unknown
  Kingdom: Bacteria, Phylum: Actinobacteria, Class: Actinobacteria, Order: Streptomycetales, Family: Streptomycetaceae, Genus: Streptomyces
gggcgcggcagcgcgtggggcgcgcccacgatgccgagggggccgccgcgcggggtgtcctccagggagtcggccgcggcgtcggtgacgcggaaccggtcgccggccagcagccgcgcggaggtctcgttgaggacggggtgcagcgtcccgtccgtgtacaggtagcgcgctcccgtctccctgacgacgaccagcgtgccgggaacccgccaggaggttccgccgccgggcgagacgagcccgaacaccgcggtccccacgcaggccagcgccaccagcacggcgccccacagcatgcccttggaggtgcgtgaggagggtgtctcgggggcgtccgggtcgctgcggagcatgctgcccgacagccgtcccatcacgaagaggtgcgcctgcacctggtccttgcgcgactgcaccgccatcagcccctatcccctgatcccgcgcagcgcgccgaacaccccggcgagcagcaccgcgagcgggagcaggacgagggccgcgaaggtgtgcagcaggtccgcgatccggccccagtacggcaccaggcggcggcccgggacggtccaggcggcgatggcggtgacggccgcgaggaccgcgagggcggcggtgatgccgaggcggccggacagctgcaggtcggcggcgcgcagacagctcgcgagggcgagtccgtacgcgccggggacggccatggcgaggcggtgccggaccgagccgacgaccctgacgtgcaggagcagcagcacgctgagggcgacggcgaggacgggtgcggtccagccgtcggagtcgggggcggtgagcagtgccgtctggcaggccatggcgaccaggccgagggcggtgtagcagccggtcaggtaggcgtcggcgagttcggcgcgggcggtgacctgggcggcggggaagggctcgatgccttcctggagttcgcgggcgttggacggcag

SEQ ID NO: 1588 - DNA, 1462 bp, Unknown
  Kingdom: Bacteria, Phylum: Actinobacteria, Class: Actinobacteria, Order: Streptomycetales, Family: Streptomycetaceae, Genus: Streptomyces
gccgccgcccgggcggcggccccggtgcggtcagcccatgctcttcgcgccgtccagcgcctcgcggatgatgtcggcgtgaccggcgtgctgcgcggtctcggcgacgatgtgcagcagcaccctgcgggccgaccagcgcgccccgggctcgaaccagggggccgcgggcagcgggtggtcggcgtccaggtcgggcagggtcgcgaccagctcgtcggtccggcgggccacctcggcgtacgcggcccggacgtcctccagtgtgtcgccgggcagcatgcggaactcgtcggcccgctgcgcgaagtcctccttggtcatcgccgagaagtcgggcatcgcggagggtccctcgacgatgaaggccgcccagtgccgctcgaccgacgtgacgtgcttgatcaggccgcccaggcacagctcgctcgcggtggtgcgccggccggcctgttcgtcggtgaggtcacgggtggtgaaggtcaggaagtggcgctgcttggccagcgcctgcagcaggtccgcgcgctcgccggtgacggccggcgcgtcggtgctcacggtgccggcgttctgcgtggtctcgctcatggtctcggccctccgccagagttctgttccctcggtcgacgaccacgctacgggcgatgtaggtcagatcccggcctacatggggctgggtgcactgccgggttccggccgccgctccgcctcgccggccgtcagcgcgccgcgcaggtggccgcgcgactgtgcgagcagccgggcggcggcggggccgtcgaccccggcgagcaggaccaggatggcgttcttcacctcgccgtccgtggcggtcagcgcccgctcgatctcctcgtccggcgcgcccgtggccagcgcgacgatccggcgggagcgggcgcgcagtttctcgttggaggcgcgcacgtcgaccatcaggttcccgtacgtcttgcccaggcggatcatcgtgatcgtcgagagcatgttcaggacgagtttctgggccgtgcccgccttcagccgggtggagccggtgaggagttcgggtccggcgacgatctcgatgccgtgctcggcggcggcggccagcgcgctgtgcgcgttgcaggccagaccgatggtcagcgcgcccagcgcgcgggcgtgctcgaccgcgccgatcgcgtagggggtgcggccggaggccgagatgccgaccaccgtgtcgtcgggggtgaggccgagcgcgtcgagcgcttcgacggccagctcccgggagtcctccgcgccctcgaccgacgtgaccatcgcctccggaccgcccgcgatcaggccgacgacctggcccggctcggtgttgaaggtcggcgggcactcggaggcgtccagtaccccgagccgcccggcggtgcccgcgcccgcgtagatcagccggccgccgcgatcgacgcggtggccgagcggatggcgcgcggcg

SEQ ID NO: 1589 - DNA, 3118 bp, Unknown
  Kingdom: Bacteria, Phylum: Actinobacteria, Class: Actinobacteria, Order: Streptomycetales, Family: Streptomycetaceae, Genus: Streptomyces
cgcgctctcccgcggggggcggcagggaatctcggccgcgtcgtggtgaccgggcaggccgcggcggcgcgcagtggcgacgtcctggtcggctccggtggagtcgccgggcaggcgcagcacggcgtcgcagtgggcgaggaggcggtcggcggtcgggtggagcacctggtcggcgagggggtcggtggggccggcgccggctgaacgcaggacgggcagggcgatccattccccgatgacggggaggtggccggccgcgaagacgggccaggcggctgcttcgaggcgggcgagatcggcggccatggcctggggatcgccatcggtgccggagcggtagggcccggcgatcaggatgagcatgggcttgtcggtcatggggcgctacgatacatgcagaaacgtgcaagaacaggagagaatgcggatgctggctgctgaacgccgtgaccacctgctgggcctgctcgcccgtgagggcaagatcgtcgccaaggacgtcgccgccgaactggggatctccgaggacagcgtgcgacgtgacctgcgcgatctcgcggccgagggactgtgccagcgggtctacggcggggcgctgccggtctccccggccgtggcggactatgccgcccggcaagctgtggcccccgacggcaagcggaaggtcgcctcgacggccgccgctctggtgcggccgggcggcgcgctgatcctcgacggcggcaccactgccctggctgtcgcccatgcgctcccgcaggatctggtctgcaccgtgatcacccacagtccaacgatcgccgctgccctgctcgaccacccgcgggtcgagctcttcctgctcggcggccgcatcttcaagcactccgcggtcgcttgcggcgcggccgcggtcgaggccgcgcagaacgtctccgccgacctgtgcctcatcggcgtcaccggcgtgcaccccgacgcgggcctgaccaccggcgacgcagaggaggcggcgatgaagcgcgccctggccgcacgggcggcggagacctacgtcctcgcctcgtccgagaagatcggcaccgcttcgcggttccgcgtcctgccctgggaggagatcagcggactgatcaccgacgccgacccccatgacgccgtcgtcgagcagctcacagcgctcggtgtggaggtcctggcagccggctgacaggaacatcccgaatacggaatcgccgaccggccgacgggacatccaggacaccgaccccgcaccgtgctccagccatccacaggaaccgacaagtgctccgctggcggcgaggtgcgccgcgcgtgtcaggcggctttcacgcccggcacagcgggagcccgccgtggtgctgtgccatctggcggaaccactcggcgacgtccagcggtgcccccggcggcgctccgcgctcctccgcgtaggcacggtgcaggttgggcaccaggcgttcggcgtccaggaggccggcgtacgggccgaggtcggcctcacgggcgaggtcgagcggggtgagaccggcggcgatgccctggcgggccaggtgctgcagacggcggaagtagccctcgtcggcgtcgaggagttcggggccgccgaccgggccgtgaccggggacgaccgtgcgcggaccgagggcgcgcagcgtggcgagggcccgcagggagccggtgaccgagcccatggggcagaacggggtgacgccgttcatcaccacgtcgcccgcgaacaggacccgttggtcgggcagccacaccacggtgtccccgccggtgtgcgcggggcccacgtggagcagttcggcgcgctgggctcccacatgcagcgtgagccggtccgtgaaggtgacctgggggacgacgacttggaggtcgccccagcgcacgtcgggccacagtcccgtcaggtgcagtcccgccgcggcggcctcggtgcgggcctgtgcgtggccgacgacgaccgcctcggggaagacgaagttgccgaaggtgtgatcgccgtggaagtgggtgttgaccaggaggcgtggcggcgcggaggtgcgggccaggacctgctcgcgcagggaccgggcccgtgcctcggtggcgacggtgtccacgagggcgctctcggcaccgccgacgatcagccccgcgttgttgaggcaccatccgccgtcgccctgtacgtaggcgaggacccggtcggcgatctcggtgagggtgccgccgggcatgtcaggccgcggcccgggcggacagggccgcgttgacgaggtcgaggtactggcgcggcgtctgggcctcgtcgagtgcctcctcgtcgagcgtcacgtcgtggtcgcgctcgatgacgccggtgacctggagcagggccagtgagtcgtagcccaggtcgaggaagagggtgtccagggcggcctcgtccagcggcgcgccctcgtcggcgcccgcggcgtcgcgcagcagggcggcaaggtcggtcaggtgaaggcggtccacggtgtcccctcctggtacgggtgcgtgttctcggttcctggtacgggtgcgtgttctcggtctgggactgagtctcggtcccggtctcttcgtgggtgccggcggcccgcgggcacgctcacggtcgtggcgcgcgcaccacggccgccgcgttgaagccgccgcgtccgcgcgcgaggacgagggcgtgccgcagctccgcgggacgggccgtgccggtcacgaggtccaggggacagtcgtcggcgagcgggcccacggcggcggccggcgggatcacctggtcgcgcagggccaggagcgccgccgccaggtcgagcgcggaacctcccgaaccgaggcgcccggtcagcgacttgggggcggtgaccggtacgccgtgcggaccgaagagagcggtgagggcggcggcctcggcccggtcggcgtcccgttcgccggccgcgtcggcgaacaccacgtccacgtcggcggcatcgaggcgcgcgtcggcgagggcgaggcgggccgcgtcgagcagccggggagcgccgcgtccgggagccgggtcgaaggtcgccgcgcagccctcgacggtgccgaggacacgggcgccccgggcgtgcgcgacgtcgccgtcctccag

SEQ ID NO: 1590 - DNA, 1707 bp, Unknown
  Kingdom: Bacteria, Phylum: Actinobacteria, Class: Actinobacteria, Order: Streptomycetales, Family: Streptomycetaceae, Genus: Streptomyces
gccggaccctgggccgcccgggcagaccgggccagacgccgaacagcggctcgttcgtggtgccggggccggcgatccacggttcgcgcgcgatctcctcgacgctgacgctgccccgttcggccaacgggccgtccgccggcaccgccacggccaggtgcacttccagcagcggctcgacgctcaggggcggatcgtccgtgtccggcgagcggtgcggtggcctggaggagaggagtgcgagatccagggtgccggcgcgcagcgcgcgcaccagcgagggagtgctcccctcgcgcgtcgtcacctgcaggtgcgggtgctcctggcgcagcatcgcgagggcgtggggcacgatcaccgccccggcggtggggaagaagccgagccggacgcggcccctgtcgacctcctccgctccgcgcaactcccggtcggcggcctccagggcgtccagggcgacgacggcgttccgcagcaggacgcggccggagccggtcagccggacaccgccggggtagcggtcgaagagccgggcgcccgccgcctgttccagcgcggccatctgccgggagacggccgactgcgtgtacccgagcgcgtccgccgcggccgtgaaggtgccacgctccgccacctcgcgcagcacccgcagcccgaccagcgtcatctccatgaggtctccgtgaggtcgtcgtggccgccatgagcaaacggcatccatgagcaaacggcatacccatcatgccggacattcgttggcggaatgccctccccgttcctagcgtggagggcgaagaacccggaacgagaaggaaggcaacagctcatgcctctgatcaacgtctacctgcgccagggaacccccgccgagtaccgccggaacgtctcccttggcatccacaaggcgatggtcgacgtgctgaaggtccctcaggacgaccagttccacgtcttccacgaggtctcgcccgacaacttccagatgcagccggtcgtgttcggcctgcgccgcggggagcgcgccatgctcatccagctgtccttcaaccaccgcacccccgaggagaaggcggagctgttccaggcgatcgtcggcaacctccggctgttcgccgacgtccccgaagaggacatcctgatgatgatcaacgaaaccgcccgcgagaactggtgggccgccggccgcgtcatcaaccccgccaccggctacgacgagcgcatgaacggcgttctcaccggtgcagatgcggtgcccgtgtcgtgaactgacgtgaactgaggagtgttcgggggtttcgcgggcacgcgtgggctgacgcggccggtccggcagggggccggccctttgaggtgaggagagatgtatgaagtcttggcgtaagaaggcgacctacggacttgccgcagtcgccgccatggtcgcgattccgctgaccgccggttccgcctccgccgccagttggcacgacatcgccggtggcccggagatgtaccccgacatggccgcgtgccaggcggacatcccgcgggcgaagcagtactaccaggacgccacctgcgtcgacaaccaggggcgtatctccctgtgggcgctgtactgatgccgtagccctccgagcccggagaccgcagctgacggtccggcagctgaactcgaacggcggccctgccgtccccggtggaggggacggcagggccgccgtt

SEQ ID NO: 1591 - DNA, 625 bp, Unknown
  Kingdom: Bacteria, Phylum: Actinobacteria, Class: Actinobacteria, Order: Streptomycetales, Family: Streptomycetaceae, Genus: Streptomyces
atggcgagctgatcgggctgatcggcggcatctcccgcaagatgcttacccagacactccgacggctcgaggcgcacggactcatccgccgccacgcctacgccgaggtaccgccccgcgtcgagtacgagctcaccccgctcggggcgacgctgatcgatccgatccacatgctgaccgagtgggcgagggcgaacggcgacgcagtgctcgatgcgctcgacgccgcccccgagccggtcgcccacagcgactgaggcccccgctagggacggcccctccaagcccacccagccggtacagccatccagcacccccagcgcactcagccgcgcgactcggttcgttgagaaagcgactcgattgagtgagacgggacagctgtctccccctggcgttcatataccgaagagcccacgcggatcaggccgcgaggggtctgatccgcgtgggcgggtgggcgcctggccgccgacgaggcccggcagagcgaagagacggtgtgtcagagcccgacttctcgggggcctgtcggtgggtgggtgctggctgtcagcgcgttcccgctggcgtcagccgtcctctgcgcgtggggcggccttcttcagcttgtcgtttaacgttc

SEQ ID NO: 1592 - DNA, 1725 bp, Unknown
  Kingdom: Bacteria, Phylum: Actinobacteria, Class: Actinobacteria, Order: Streptomycetales, Family: Streptomycetaceae, Genus: Streptomyces
ccgggcggtccggaggcggacgcgctccgccgtgagctgcgcgggcaccggcccggtgacggcctgcgccgcaaccccctgacggtggacctgagcaggctgccggacgggttcctgctggaagagctgcgctccggtcaactcccgtacgagtcactggacctggtgctgaccgaactcggcagacccgaccgcatcaggacgcgcgacatggacctgcatcacgaactgtgcgccgaagtgctgcgcaggggcctgtacttcaccccggaggcacccggtgcggaacaggtgtccagggccgtcctggccgaacgggcgaccgtgctcttccagtgggcggtggccccgctggcccgtgacgaacgctatgcgctcgacctgcgggagctgatgcaccgcatgagccgggaccctcaccccgccgcgggcacctggctgcgccacagcctcgtcgagccgccggacggccaggtccccgacctgcccccgaccgtgtggagccagatcctgcgggacgtgatcagccggaacagcagaccgcccgccgcgccgtcggcgccccggcaacccctgccgcccgaaccggacccccggccccgcaggaacaggccggcccgggtggtcgggacggccatggtgggcgtgatcgtcgtcctcgtcgtgctcgtggtgatcctggccaaccaggtctgacacatcgcaggtccgggggcccggacgaaatccggtggcgccccggaccgtacgtccctaggctgacgcacgcatcaggcgatggccctcggccgccgccgtcggcccgacgagatgcaggacgagaaacaggaggtgtgacccatggctgtctccgtgatgggcgctgcccgcaaccaccagagcatccacaccacctccgcggtctccggctgacacatcgatctgctgagcccgtgccctctcggtacgggccggccggggccgccctttgaagggttccccttgtctctctcctcttcttcacccgctaccttctcctcctcttcttcctctccctccggggagcacccgtcctcctccggggagcacccgtcctcctccggggagcacccgtcctccggggagcacccgctcgcccgctacggctgggacgagggctgggcggccgagttcgcgccgtacgccgagcagggtctgctggccgggcgggtgctgcgggtcgaccgaggccagtgcgacgtcgccaccgagggcggggtgctgcgcgccgacaccgccttcgtcaccccgcacgacccgatgcgggtcgtctgcaccggcgactgggtcgccgtcgaacccggcggcaccccgcgctacgtgcgcacgtacttcccgcgccgcaccgcctttctgcgctccacctcctccaagcggtccgaggggcagatcctcgccgccaacgtcgaccacgcgatcgtcgcggtctcgctggccgtcgaggtcgacctcggccgcatcgagcggttcctcgccctggcctgggagtcgggtgcgcagccactggtcgtgctgaccaaggccgacctcgtgccggacccggtgacgctgtcgtacctcgtccaggacgtggagacggcggcgcccggcgtgcgggtgctggcggtcagcgcgctgacgggcgacgggctcgacgccctcgtcgccgccgccggcgaggggacctccgtgctgctcggccagtccggcgccggccagtcgaccctc

SEQ ID NO: 1593 - DNA, 1126 bp, Unknown
  Kingdom: Bacteria, Phylum: Actinobacteria, Class: Actinobacteria, Order: Streptomycetales, Family: Streptomycetaceae, Genus: Streptomyces
accgacctggacggcacgctgctgcgcgacgacctcaccgtgtccgcgcgcacgctgcgcgcgctggcgcgcgtgcgggaggcgggagcacggcacctggtggtcaccggcaggcccgccacggcctgcaagcagtacctggccgcgctcggctaccgcgggctcgccgtgtgcgggcagggcgcgcagctctacgacgccggtgccgaccggctgctgacctcggccccgctcggcctggacctggcgcgcggtgtggtcgagcgggtggaggcggcgctcgggcggctggagctgggcgtggtgacggccccgccggagagccggttcaaggtgacgccggggttcggcgagcgggtccggcacggctgggacgtgaccgccgaccgggacctgctgtgggccggcccgatcgacaagctggtcctgcaccatccggacgtccccgaggacgaactggagtccgaggcaaggcggttgtgcggggacgaggtcaccgtggtgcactcggtgcggggcatggtggaggtgctgccgccgggcaccacgaagggcgccggggtggcacgtgcggcggagctgctggggatcggcgcggccgagacgatcgccttcggcgacatgcccaacgacatcccgctgctggcctgggccggccacggagtggccgtgggcaacgctcacccggccctgcgggcgatggccgacgagatcgccccgggcaacgacgaggacggcgtcgccgtggtcctggaacgcctcttcggcgtgccaggcaccgacggtactggcgtgaccgacgagactggcctgaccggcgtagctgacgtgtccggcgcggctgacgggcatggcgcggctggcaggactggcgcggctggtgggcctgacgcggctggtgggcctggcacggctggtaggcctggcgcggctggcatgacaggcatgaccggcgtggccgccgcggagcgtggcgtatgagtgacgcgttgcgggaactcgcccgcgcccacggcatctccaccgcctacaccaccgaccgcggccaccgggtcgccgtgtccccggacacgctggtggccgtgctcgccgcctgcggcgtggacgccaccacggacacggcggc

SEQ ID NO: 1594 - DNA, 770 bp, Unknown
  Kingdom: Bacteria, Phylum: Actinobacteria, Class: Actinobacteria, Order: Streptomycetales, Family: Streptomycetaceae, Genus: Streptomyces
ggcggggccggtgccccggggtgagcctggcgggcggccgtcgctcgtggtgcgtgtcgggctgccgcccggcgtacgcggtggggcgccgccggggcggcgtgtgtcgcggcggccgggcgggcgggcgccggggcggcgttgcgccctggtcatgaccttgttcatgcgtccccgttctcggtgtggtctggcttgcgccgtggacgtgcgggccgccggtcgtgcgagcccgcagtaccgagcagtaacttcctgctggggaccttgtacgggacccggctcgggggaggcaaggaaggttccgcccgggtcgacggccggacggattcacctatccgggtggtgctgagaacccgcgcccccggaactccgggccggaacaggggtgcaccgggtgaagcgcgaggcgcggggtggacgcgtacgggggtgcggccggggacacgaaaggggacccccgcacgtatcctgaaggccgtccgggtggcctctccaccgtctcccggagacctgtcggagccctccgaccacgcaccccgtgaacacccaccacgaaagcggccggccatgcgcgtctacgtccccctgaccctccccgggctcgccgaggcctacgaggcggggcagttgggggcgcagccgctcgtcgcctacgccgtcacacccgcgctgcgcgagtggtgcctctccgacgacctggaggaactggagtacgccgcgctgaaccgggccgcgctggcctcgctgcggctgctcgccgcggaccc

SEQ ID NO: 1595 - DNA, 897 bp, Unknown
  Kingdom: Bacteria, Phylum: Actinobacteria, Class: Actinobacteria, Order: Streptomycetales, Family: Streptomycetaceae, Genus: Streptomyces
tggcgaagttcagcaccacctcgccgcggtgcagcaccgccgccgcgttctgcggggcgccggccggcatgccgtacttcggctgggaggtctcgcagcggtcgaggtagccgacgacgaccggcagctcgccgaagccctcctcggcgagcctggcggcgagggcgcgcagcgcggcgcgggacgcctccacgaaggacgaccgcagggccaggtcctcgacgggatacccggtcagcaccatctccgggaacgccacgagatgcgctccctgctcggcggagtgccgggtccagcggacgaccgcctccgagttcgcggcgaggtcgccgacgcgcgagtcgatctggttcagggcgagacgtagttgaggcacgcgcaccagtgtaatcgtcagagcgacgcgatggggtgcaccgggggtgtgggccgtcccacgcccgccccacgcccgccccgcggcgcgcgaggcgggatgatgcccgtacggactccggcacggaccccaggggaggcggacggccatgaccttcgtcggcatcgacggcgtcgtccaccacgccgtggtcgagggcggcgggccggtgtgtgtgctcagtcccgggctcggtatgtgctggttcgactgggattccgtcgtcccgctgctggccccgcaccgcacggtggtccgcttcgaccgccccggcctgggcctgagcgcgtacacgcccgcgtggccgacgctggagggggaggcggggcggatcgcggccgtcctcgacgcgctcgatctggccggccccgccacggtcgtcgggcactccatggccgccttccacgtggaggcgttcgcccggctgtgtcccgagcggacggccgggctcgtcctggtggacgccagcgtggaggaggacc

SEQ ID NO: 1596 - DNA, 912 bp, Unknown
  Kingdom: Bacteria, Phylum: Actinobacteria, Class: Actinobacteria, Order: Streptomycetales, Family: Streptomycetaceae, Genus: Streptomyces
cgtaccggccgaccgggcggcggcccgcccgagtcggccggtacgggcagggcgtggggcagggttcatcggttgctccccaagaaggtaagcggtcgggagtgtgcgtgcgagcgcggcgacactgaatgacggcacgtcaggaatggccgcccagcggggtgttgtcggggtgtcccaggcgtggcccgtcggcggtgcggtgccggcgtcgttcatgcgcccgcacgcggaggcgggcgggcgctccgatcgggtcgccgccgttctgccacagcatccagttgctgccgtcggtcggtgaacgccgtctaggggcttggaggttgccgctcacgttcagccagagctcctcgcagacacgtcggtcgtgtcgacatggtgatcactgtgacatgtctccttacaacgttgcaagggttgagcggacttgggtcgtcgcccggtcatccagcggaaaacgttccacccacagctgccggccgacgcccgggtagtggcccggacgtgagcgtcctgccggtccggacccgtcaggtcgtcctcgcggcgcggtagcgcgagcatccgctcggtgtggtggagcgcggtgtgcggcgagaacgagaacaccatgggtgcgccgccaggagacggggccgtgctgtcctgctcgggacacgttcgaaatcgcccccggctttcgcagggggcgtcgcacaacggcggattccgtggagaccggcgctttccggtgtcggagccatggctgcatggaccacttcgcacgatcgtgttctcgcgcagcgtcgggcgaggggtggacagccctcgcgcccgcaccgcccctgccacgggcgatgcggcgccccgctccgagccgtccggcgcgtcacgcgcggaccttccctggccggcacggggcagtgccgg

SEQ ID NO: 1597 - DNA, 1216 bp, Unknown
  Kingdom: Bacteria, Phylum: Actinobacteria, Class: Actinobacteria, Order: Streptomycetales, Family: Streptomycetaceae, Genus: Streptomyces
ccgcccgcgcggcggcggccctcgcgaccaacgaactccgcgtggcctacgccctgcacccggtgcgcctcctcgtggaactgcgcgcccccgagtccgtgcccgcgctgatcaccacgctgcgccgccgcctgcgcccgcacgacccctaccgccgggtggccctggcctgcgtggagggcctcggcgcactcggcgacgcccgcgcccgcccggtcctcgacgaggccctcgcccacccggcgctcgccgaggcggccgtccacgcactggcgaggatccccggacaacggtgagttccttcagcccggcaactccctgacgtagcgcacctcgggcacggtgactccgtccacgacggaggagtcctcgacaccgtcggggcgaaagccggcgcgttcgtagaagcgccgggcccgctcgttctccttcagcacccagaggaacatccgcggacacccggcggcaccgcaccgccgcacggactccgtcagcagcgcgtgcccggtgccacggccgtaccagcgggggtcgacgtacagggcgtacaactcggcgtccccggtgggtacttcaccgtcccggcaggggccgtggcaggcccagccgaggacttccccggccccgctcccgggggtcggcggtcccggagacggctccaccgcgaccaggtcggtcactcttgcgtcaccccgcgcgagcagggcacgccggtgttccgcgtcccgctcgacgctgagcgcgtccaggtgggaacggggcatgaggtcccggtaggcgctctgccagccgcggacgcggatctcggccacccggtcgcagtcggccggcgtcatctcgcgtacgcgtaagcccttcacccgtccaccaccgcgaacgcctcgatctccatcaggaactcggggcgtaccagggcggcgacctggacggcggagcaggcggggaggcggtcgtcgggtatgtgggcggtgcgggccgcgcggatggccggcatgtgggtcatgtcggtgacgaagtacgtgagtttgacgacgtcgtcgaaggtggcgccggccgccgacaggcagcgccggaggttctcgaagacctgccgggcctgggccgccggatcgtccttcccgacgagggcgccgtcctcgtccacggccacctggcccgagacggcgacgaaacggccggtgcccaggacgacatgggagtactgcggggcgggggc

SEQ ID NO: 1598 - DNA, 1694 bp, Unknown
  Kingdom: Bacteria, Phylum: Actinobacteria, Class: Actinobacteria, Order: Streptomycetales, Family: Streptomycetaceae, Genus: Streptomyces
ggctccccgtcaccggcccccgcgccggcgtccccgggcccggacccggtgtccccggcgccggactccgcgtccggtacctccaccgcgcccgcccgctgctgcggtatgaacaactgcgtgtcgtacgaggcggccaccgaccgcagctcccgcatcaactcgtccggagtcggccggtcctcgggctccttggccagacagcgccgcaccagcggagccagatcctccggtacgccgctcagatccggctcgtcgtgcacgacctggtaggccacgacatacgggctgtcggagtcgaacggcccacaccccgtcgccgcatgcaccagcaccgacccgagcgtgaagatgtcggcggccggaccgacctcccgtggccgccggaactgctccggcgccatgaacggcggggtgccgatcaacttgccggtctcggtgcgcagttcactgtccttcggccgcgagatgccgaagtcgatgaccttcggcccgtcctcggcgagcaggacgttgctcggcttcaagtcacggtggacgacccccacccgatggatgtcgcgcagtgcctcggcaaggcccgccatcagccgccgcagcctcgccggcgccatcggcccgttccgcttcacctcctcggcgagcgtgggacccggaatgaacaacgtggccatccacggccgttcggcctccgggtcggcgtcgacgaccggcgcggtgaaggcaccgctgacccggcgggccgccgccacctcctgccggaaacgccccctgaactccggatccctggcgaactccgcgtgcacgaccttcaccgcgagcctcagccccgacgtactgcgggccaggtgcacgacccccatgccaccggaaccgagacacgactcgagccgatagtggccggcatactccggaagttccgcttccgcgcccgctccgatgttgcgctgtggcgtcatggaccacccccgtgctgttcgtccgcgcgcgcgacgcaccgaccctagtcgatgactcggagggaaccagggaggcttgctagcgttcgcgtgcgagttgcgcacatgtgttccatcgcgcgattcaggggaatcaacacgaccccatggcacccatggggaagaaacaacgggggaggtccttccatgtcggtcgaccacgtcgaagagacgacgagcggagacgacgagcagggcgtcacggcccaggccgcggccctgcgctactactcggtcgccccgggcgtcagcctcaacgtccgcagcggccccggcaccggctacccgatcgtgcggaccctgcccgtcggggccaaggtcccggtctactgccagacacccggcaccaaggtctccggcccctacggcacgtcgagcatctgggacaacatcgacaacggcgagtacgtctccgacacctacatctacaccggcgccgacggctacatcgcaccgcgctgcgcctgagcccgccccgagcccgcggaccccggggcgccataatcggttgcgtgagcgacgagaacggcaccccggccacccccgcgggctccacggccaccggccccggcggcccgcgccccgagcccctgcgcttcttcggcacgacctgggtgcaccacgacaacggctacgcgctgcgccgcgccggcgtcgccgccggctcgctcctgacggcggccgcggcctgcttcg

SEQ ID NO: 1599 - DNA, 3604 bp, Unknown
  Kingdom: Bacteria, Phylum: Actinobacteria, Class: Actinobacteria, Order: Streptomycetales, Family: Streptomycetaceae, Genus: Streptomyces
gggtggggtttgaagacgacgcgggtgtggccgcgcgcgacggcgccgcgcagcatccgcacgtgcagcgcctcctcctcctcggtggtgaggatgtccagcgcggacaggtactggccgagcagcagggcgggttcggcgggcagctcgggcaacgtctcgcccgcctccgcgagttcggccagcaccttgacgaaggcgtccgtcgggacgatctccggcgccacgtcgaactcggtgagcagcaccggccgcaggcccggcaccaggtccaggtggagcagacggtcgatgcgggtgcccaccagcgggtcgatcttgttgcgggtggggccgtaactcatcaggccgtcggcgtagacggtgaccggtgcgccggtgaagatctggcagacggcgagcgcgggattgacctggatcgactcgacggccagttcgacggcgtcctcgcccaggtcccacagcagtctcaggtgccgttcccacagcggcacgtcgtcctggcgcggtgcccagccgcccgggtggaacggggagatggtctcgttccacgacaccacgtcgtcgaagcgtgcccgcagccgttcgaagccgggcagctcgtccacgggcggggtggtctccggcgtcgccgtgttgttgcagaccaccaggatgcggcggtcggcggggccgaagcagtcggcgtcgagggcggcggcgagcgtggcggtgccgtacagcgtcgacgcgaggaagatccgggtggtcacgcggcggcccccgtggtggccgggcggcggcgcagccggcgcagccgggtggcgcgcgggacgtccatggagtccagcgcctcgtccaggacgccctgcggcatgcggcgcagggcgcgcgcgctgagcgacttcagtttccgtgccaccgccggttcgaacctttcgatggagcccagatggtgggcgatgatcgcgcagtaggtacggaccgccttgggcagcagcagggccgcctcccggtcccgggccgtctcctggacgacctggtcgaacgcgcggatgaagtccagctggcgcacatcgccgatctgggtgagcgaggaggccactccgcgccggtagtggacgcccagcaggccggtcacggcgaaggactccgcctcccggtgcagcttccagatccacggccggtcctcggcggtgcgcagcccgtccgtgaagtgcagcagcccccgctccagcagccggcggtggtagacgccggcccacgcgtaggggtagtcgaccgacgtggaacggtcggccggcaggatcgccgcccgcgggtcgagcaccactccgcgccggccgtgcggcacccggtggacgctgcgcgcccgcccggtgcactgcacatggtcggcgcggacgaaatcgcagcccagctcctcgatcacggcgagcagccgcgggtagtagccgggggccagccagtcgtcgccgtccaggaacgtcacgtactcgccgcgcgcccggtcgatcccggtgttgcgtgcggtcgccagccctccgttctcctcgcgcctcagaaggaccgcaccgggcagttcacgttccgcgcgcgcgagaatgtccggcgtctcatcgcgtgaacaatcgtcgacgaggacgaattcgaagtcgtcccgcgcgttcgcacgcagactcttcaaggtgtcgggtgcgtattgctgcacgttgtagaacggcacgatgacggagagcttgaccacgtgtgcgacgttagggcgcgggccccggtcccgtctttacctggagttcgaccgggggtgaacgacacatggcgatgccgtgaaccgggctttttggggcccgccccgcgcgccggttcggcattcggcgttgtgctgttaaccgtttgttgcggtccggttgggcgggacctagcaatgccttcctagcgtctgcggcgtgccagcaagtgcaacgaaaatcctgcgggtcgccgttctcgcggattccgacacccggtggaaatggggcgcgctcaccgcgcagcgcgtcgcccccgccggtgccggcatccggctcgacggccacctcctgcggggccgcgccacccccaccgcccgtcagctgacggaggtcggtgtccgcgcggactcgctgagtgaggtgaccgccgtcgagttcctgcgcgccatggaggagaacgcggcgggggaggacccctacgacgtcctcgtgctcgccctcgtcggcggcggcgtccaggcgctgctgcacggactgaagcggatctggggcggcgagcggacacgcgacggcgccggccggcggcccgtggtcgtcaccggatacgtcggcgtcgtctacgagaagctcaccgacggtctgctgctgcggcacggcgcggacctcgtcctcgccaactcccgccaggacgcggaacgtttccgcgccgtctacgagggagtgggcgccgacgccaccgcggtcaccgaggtggccctgccgttcctcggcggcgcctcctacaccggcgcgcacgagccgcacaccgtggtgttcgcggcgcagccctccgtccccgagagccgccgggaccgtacctacctgctggaccggctgatccggcacgcccggctgcaccccggccgcgaagtcctgctcaagctgcgctccaggcccggcgaacacaccacccacatcgaggaagtgccgtaccagaagctggcgcagcgggccgcgctgccgcccaacctgcgcctggtctacgggcacatgggcgaggtgctcgaccgcaccgacctgctggtgacggtcagttccaccgccgccctggaggcactgcaccgccggatccccaccgccgtcctcaccgacctgggtgtgcgcgaggcgctcggcaaccaccacttcaccggatccggctgcctcgcctcctgggaccaactggacgccggacaccgcccggtgcccgacgaggagtggctggcccggcagggcgtcgccgccgacggctcgtacgacaccgccttcgaccgggcccgcgagcgcatcgccgaactgctccgggaccccgcgggaccgcccccgctcgcgccctactacacacccgagaccgcgcccggctacctgccgggcatcctcgcccgccaccacctcggacccgacggcacgccgtggcgcccgtgatccggcggatgggagagctgtgagccgcccgaccccacgccaaggagcagatgacatgtcccacccggaaacgggccagggcgccccggtccgccgagtgctcgcggtgatccccgcgcgcggcggctccaagggcgtgcccgcgaagaacctcgcccgcgtgggcggcgtaccgctggtggcgcgtgcggtgcgcgcgtgccgtgcggcgcggtgcgtgacggacgtcgtggtctccaccgacgaccaggcgatcggcctgctgcgggccgcgcgggagctgcgcatcgacgtgcccggcgagctggcggtggccgggttcgacgacatcaaggaggcgccgctggcggacccgccgctcacgacggtcgcctccgaccggtccgcgatggcccgcgcggccgtggacctggtgctggacgacgggctgcgggtcgccggttcgcggcggg

SEQ ID NO: 1600 - DNA, 4208 bp, Unknown
  Kingdom: Bacteria, Phylum: Actinobacteria, Class: Actinobacteria, Order: Streptomycetales, Family: Streptomycetaceae, Genus: Streptomyces
cgccctcgccctgggcgacggaagcggtgcgcatcccgcgcagcgggcacggcccggccgtacgccggcctgcccccgacttaccgcccttaccgcccttgccgcccgtgcgctgaccgtgtcgggactgagcctccgtcagaactgatatgagcagcccgtcgtagttggtgacgacccgggcgaactgcccgtgatcgccgcgcagggccaggcagagcccgcacaagtgggccatccactgggccttgaggtgttcaccgagccggtggctgcagggtctgacgattccgaacacgacgatcccccgtggtgtctgcgacgttgagctgccgcatcgtaccgacggccccgttcacccgtccgcaccaccactcacccatgtgccgtggacaatcatatttcactcccggtcagcatcggtgtagggcatgacccttggggcacaaggccctcgacggatccgctgtgcaccagtaccgtcacaaaccccccgtgcggcgtctatccacttggcgcgctgtcagcatcatggatgaccatagggatgcgagaagcaagaaagaccgctgtgagaggaggcgtccatgggatcggtacgcaaggcgagtgcgtggctcggcctcgtcgacgacaacgaagacgagcgctactacgacgacgactactccgagggaaccgagtccggcgacgcctgggtcaccgacccccgggtgaaggtggccgcggacacggccgaggacaagggccgccggatcggcacggtgacaccggacagcttccgggacgcccgcgccatcggcgagctgttccgtgagggcgtgcccgtcatcgtcaacctcacggcgatggaggcgtccgacgccaagcgtgtggtggacttcgcggccgggctcgtcttcggcctgcgcggctcgatcgaccgggtgtccacgcgggtgttcctgctgtcgcccgccgacacggagatcgtcagcggcgacccgggcggacaccgctcggacgggttcttcaaccagagctgaggcagggccgcccgccggccctgcccccaccggggcctcgcgtcaaggaacgaaggccctccgctccacgcggttcaccggaaggcgtcgatgccggtgagcgccttgcccagcacgagctggtgcatctcgacggtgccctcgtaggtgagcaccgattccaggttggtcgcgtgccgcatcacgggatattcgagggagatcccgttggcgccgaggatcgtgcgcgccgtgcggcagatctcgatcgcctcccgtacgttgttgagcttgccgaagctgacctgctcggggcgcaggcggccggcgtccatgcgccgccccagatggtgggcgagcaggatccccttgtgcagttcgaccgccatgtccgcgagcttggcctgggtgagctggaagccgcccagcggcctgccgaactgttcccgcgacttcgcgtactccacggcggcctggaagcaggagcgggccgcgcccatggcgccccagacgatgccgtagcgggcgtgggacaggcagctgagcggtccgcgcagcccggtgacctccggaaggacggcgtccgcgggcagccgtacgtcgtcgaggacgagttcgctggtgaccgaggcgcgcagcgaccacttgtgcttgatctcgggggcggagaacccgggggcgtcggtggggacgacgaagccgcggatgccgtcctccgtctgcgcccagacgacggcgacggcggcgacggaaccgttggtgatccacatcttgcgcccgttcagcacccagtccccgccgtcgcgcttggcgtgggtgcgcatggacgccgggtcggaaccgtggtcgggttcggtgagcccaaagcagccgatcgcctcgccggccgccatgcgcggcagccactcccgcttctgctcctcgctgccgaagcggtggatcgcgtacatggcgagcgagccctgcacgctgaccagggagcggatgcccgagtcggcggcctccagttccaggcaggcgagcccgtactggacggcggtggcgccggcgcacccgtagccggtcagggacatgccgagcgcaccgagggagcccagctcgcgggcgagttcccgtacgacgggcagttcgccgctctcgtaccactcggcgatgtgcggcagcacgcggtcggcggcccagtcgcgcacggtggcgcggacggcgaggtcctccggttccagcaggtcgtcgatccccagcgggtcgacggggtcgaacgggggcagcgacggtttcggtgacgacgccggcatgggcacctccgactcagtaaactagcagtgctagtcacacggctccggcccgacgttacgacgcaccgtggtccgcgtccagcatcacccggaccggcatcgaacggacctgtgtcgagcggacctgtatcgagcggaccggcgtcacgtggaccggcgtgacacgggccggcaagcacgcggaccgcgtcacgcggagacgcgggaccgctcgacctcgcgttgcgcgggcagctccaccgccgcctcgtcgcactgcatcacccgcggcagccgcagcgccgccgccgcgccgagcagcagcagcccggcgctcaccagcagcgtcacgtgcagcccgtgcacgaaggagtcccgggccgcccgccgcagggccgccccggccgggccgccgagccggccggcgacctcgtaggcctcgcccagcgagtgcgacgcctgccgcgagggcccggccgggacccccggcacccgggcgacgccgggcgtgtacgccgcgttcatcaccgtgccgagcagcgcgatgcccatgcccgcaccgagctggtacgaggtctcgccgatcgccgcggccccgcccgcccggtccaccggcgcctcgctgagcatcgactcgtacgcgccgaagagcgtcgtctccagaccgaagcccagcagcacgaatccggccagcagcagcccggcgtcgtcctcgccgcccatcgcggtcagcagcaccacggccgccgccgtcacgcagaagcccgcgcacaccatgcgccgcggcccgaagcgccgcaggacgcgggcgcccgccagcccggccgccatcgcggcgaaggtcagcggcagcagccgcagcccggtactcagcggcgacagcccgagcaccagttgcaggtactgggccgcgatcagttccagtccgaccagcgccagcatcgccagcacgatgcagcccacggccgtgctgaaggcgggccgcgcgaacatcccgaggtccaccagcggatgcgtccggcgccgctgccgccgtacgaacgtcacgagcagcaccacgcccagcaccagcggtcccagcgtgagcacgctgagcaccggctcaccgccgccgagccgcttcacaccgaagacggtgccgaacagaccggccgccgcgagcagcgccccggccacgtcccacgggccctcgcgctcgcccctcgactcgggcagcagcagtcgtcccaccggcaggctgaccagcatcagcggaatgttgacgaggaagaccgagccccaccagaagtgttcgaggaggaagccgccgagcagcggcccgaccgcggcgcccaccgccgcgaccgcgctccagatgccgatggcgagcgcgcgctcgcgccggtcggggaagacctggcgcaggatcgacagcgtggccggcatgatcatcgcgccgccgacgccgagcagcgcgcgggcgaggatcagggtctgcgggtggtgggcgagggccgcgacggcggaggcgatgccgaagagcgcgtagcccagcagcaggatccgtctgcggcccacgcggtcgcccagcgtgccgaagaggatcagcagcgaggcgcagacgaggggatagacgtcgacgatccagagcagttcgatggcgccgggcctgaggtcctcggtgacggcgggcaccgccacgtgcagcacggtggcgtccaccgccaccagcagcaggctgacgcagagcaccaccaggacgacccagcggcccgcgccctctccggacgcccgatgacgcggcccgacggccgcgacggtcgtaccggacatgccggacatgtacgtacctcccaggtgaaccctcgcctcggcggatccgcggagtggggactttccgcgcgaccgggccgggaaccaccgctcctctccggcccggtcgcgcggaaag

SEQ ID NO: 1601 - DNA, 764 bp, Unknown
  Kingdom: Bacteria, Phylum: Actinobacteria, Class: Actinobacteria, Order: Streptomycetales, Family: Streptomycetaceae, Genus: Streptomyces
  misc_feature (291)..(292): n is a, c, g, or t
cactcagggcccgcctggtgcgcggcctcgacctggcactgctgccggccgggaccacgccgccgggcgagcccctgtacgtgcgcgggtagcgagccctcgtacggctgtgcggctgtacgacgtgcgcgggtgcgggatcagccgtagaccgggcccgtgtacttctcgcccgggccctgacccggctcgtccgggacgagcgaggcctcgcggaacgccagctgcagcgacttcaggccgtcgcgcagcggggccgcgtggaaggagctgatctcggtggcgctcgcnncacgatcacctcgaccgcggggacctccgcgatgtcgcgggtcatggcgtcgaagtcgggggtctcaggaggggtctcactcatgccccacacgataggcggtcggtccggccacgccccggttagcccttgtcaagcgatcctgctaaccttgtacacgaccggctggacccgtatgcctcacggctagcgcgtccggcccacaagtggaggcttcgaactcccacctgaccgccctcagggcggcgggtcaccggtcaggcggtcccgtccctgtggcggcgacccgcccgaaaagcgcgccccgcggccatcgcggcggtcgctccggtagttcgaggagccccgcctgtgatcgtccggggcattttttctgcttcggcgcggttaggtctatcgaacacagacgtacgcggctgtccgccagacggtcgtgtggtgctaccgaggaggatccatcagcgccgagccc

SEQ ID NO: 1602 - DNA, 1143 bp, Unknown
  Kingdom: Bacteria, Phylum: Actinobacteria, Class: Actinobacteria, Order: Streptomycetales, Family: Streptomycetaceae, Genus: Streptomyces
gcgcggccggtgcgcgcgcagccgcggcactcggatgaggcggacacgtatgcacgggacaccgacacaggacggcgcggcgcacgggacacccgcacgcgctgacgcgatgcacatcatccacttcgccttcgagtgcggcgggttcgacaaccggctcatgcggggcgggctgtcgccactggtgtggaacctctcgcgcgagtacgcggcgcgcggccaccgggtctccgtcgtcacacccgcccacgggctgctcggcgcgctgcgccgcgaccacgcgatcgaggagaccggctacgtccacgagcaccgggtgccgctcgtcctggaccccaaggtgtggccggagcaccccggcgagatcaccctggagctgaccacgcgggcgtaccggctgcggctggagggggtggacgtctacttcctgtccgacgccttcctggacctgctgcccgaccgcctgtatccgccgccgggcaccgagggccgggacctggcccacttcaaaccgctggtcttccaggtggccggggcccacttcatccggcgccacctcggcggctccccggcggtcgtgcacggtttcgagccgtactaccactacctgctgcccccggtgttcgccgccgacccgcagctgcgcaccgtgagcactgtcgcggccaacgcgccggtcacgcagaaggtgtaccggccgcaggtggagcggctgctcgccctgttcggcgcggacgcggacctggacgcgctcgacgcggagccgcccgccgaggacagtgcggcggcgaccatggcgcgggccctggccgggacccggatgcacgtcgagtacggtcccgaccacgtctccttcctgccgctgatcgtggcccacgccgacctcgtcgacttcgtctcgccgggccagcgcgaccactgcgccaccttccgcgacacgcctttcgagagcttcttcgcgacgctgccgctcgcgcggatgctgcgcgagcgtgccgacaaactgctcatgggcggctgcgggacagccgacagctggctggcccgcgatccgcgggccgtcgaccgggcggcgtggtagaagaccggccgggccgggtcgaggcccagcgagcgcagcaccgccgcccggtcgacggcccg

SEQ ID NO: 1603 - DNA, 1202 bp, Unknown
  Kingdom: Bacteria, Phylum: Actinobacteria, Class: Actinobacteria, Order: Streptomycetales, Family: Streptomycetaceae, Genus: Streptomyces
cggcagggcacggccccgccgcggccgtgccctgccgtgcccgcccccgaaccggccttgctcccgcgccccagtcctagggctgggactgggactgggaccggagctgtgcctgggcctgctgggccagcaggatgggcaaccgggtcgtgcgcggcttggcctgaacctcggccacggccctcgggagcgcctgttccacaccgtgcaccaccgacaggtgacggctcgcccggccgaacgcggtgtagacccacggtctgctgagcgcctgcgccgcgtctccggggaggaccacgaccaccgcgggccaccggccgcccacggcctggtgcgcggtcagcgcccacccgtgccgtacgcagccctccacccgttccctcgccacgaccacgggctcgcccgcgcacgacaggtgcagcccgtcggcgtcggccttgacgacatgaccgggcagcgtccggccgggcacgggggagtaggcgatacggtcacccgggtcgaagccgccgaagcggccggggcccggattcagccgttccttgagggccgcgttgagcgtgcgggtgcccgccgcgccgccgtgtcccggcgtgatcaccaccgtctgctcgggcgggacgccgatcgcccgcggcaccgagtccgcgacgagctgcaccgtgcggtgaacggcttcgccggcgtcccgcaccggaacgatcacgacctccttgccgggcgcctccacctggttcagctcgccgacgccgattccggagagcagctcgcccagcgggcccgggtccggcacccgcgaggcgacgtgcgggcagatccgggccgccagcaggtccgcgaagacccggccggggcccgcggaccacagcaccgcgggatctccggcgagcaccagccgggcgccgtccggcagtgactccacgaccagggcagccgtctcgacgtccagctgcggggcgtcgaggacgacgaggaggtccaggtcgaacgcgccgtccgtgtcccggccgggcccctcggcgccggacagcagcccggccaccgtggcgacagcgggaccaccccgcccggcctgtccggaggcgccggactgctcgcgggccccggacggcccggaggcgccgagcagctcggcgaaggcgtcccggccgagcggactgtgcgcggcggcccaggcgcgcagcccgaggccgtgggccgcg

SEQ ID NO: 1604 - DNA, 1875 bp, Unknown
  Kingdom: Bacteria, Phylum: Actinobacteria, Class: Actinobacteria, Order: Streptomycetales, Family: Streptomycetaceae, Genus: Streptomyces
  misc_feature (1692)..(1693): n is a, c, g, or t
gaacgcggccaccgccgccgcatcccgctccgtgctgaaccgcagcacagcccgggctcccgtactcacccgcgccgcgccctcgtcgtcctggtcctggtgctcgtcctggtcctggtcctccgcgtccaactccacctcaccatcagggagttcgccggacttcgggccgctgcgcggcctcgggtcggccagagcttccacggtgtccgtgtcgtgcgcccgcagcgccccgagcaccttcgccagggtcccgtacgcatccgacgtgagcatttcgttttcatcctcgtccggaccgaggaataccggcaccaccaaagtggccagcttcccgtgcccaggatgcatacgcagggcacgccctaccatctgcacgatgtccaccatggagccccgggcgtccgcgaaaagcaccgagtcacactcggccgtgtccacgccttcaccgagaacacgaaccgaggaaagcacccgcaatttcgcaggcacatcccgccccgagaattcgtcacccccgaggaaatcagacgcgaaatcatcgagcaccttccgacgatgagccggggcatgctcgccgtaaagccaatccgcccacacctgctcagcaggcgggaacgcctcggggtcgtcctcggccaatcgcagcgccacgctgggaaccgtgcgggccatagcttcagcctcccccacccgagagtgaaaggaaagaaccctcctaaaccgctccacacccgccgcccgcatcagccccgccgtgatcgcggacagccgcgccccgcgcaccgcgtccgaggccgcgtccccggcctggagcgccgcccacagctcagggtcccggatgtccatgacgagcacctgatacggcgctaccaagcccatacggatggcatccgacagccgtagcttgtacgccacggggccgaacacgggggagtcctcgtccatgctcgccaccagccgcggcgcctccccctcggccgcctcccagatccgggccgtggccgtcatgtacacccgccgcaccgccggaagctgagtctgatcatgcacggccgcccacggcttccccgcatccccacttgtccggtgcgcctcatcaatgatcatgaggtcgaacaccggaaggccggccccgtgggcgcgctggaggatcccgagccccaccgacgcgtacgtcgcgaacacggtcacggtctccaagccccccacccatgccgcgagttcggccggatcggtcgtgcagggaattccgtccgactcgtccgcccgcagggaacacaccccgaccatggcgcccttacgacctcccgcacgccatgcacgagtcatctgcgtcagcaggtccaaagtcggcaccaggaccagcacgcggcgcgcggaaagccggttggcgatctcggttccgatgagcgtcttaccggacccggtagcggcgatcacctgagtccgaagtccctcgggcggaatggtctcgcccggcggtaccgacagcgttttgagtgccgagtcaacggcctcaatctgatgggggcggagttccatgcgggtcatatctgctccgtttctcacgccatgctcggcgtgtttgtcggcgtattgacggctggaaagagggagtgatttcgaacggtcccggctgacgccgtggcagtgggatgtacccctggagggggacccgagtacgatccnntggaaggtggtgcgatgtggtcgggtgtgtgcacttccccggagggcgggggaggggagtgcggagtgacgggccgtcacaggcccccgcgtgggaagttgacgcggcgtcaatctgccacgcccacgctccgcaccccttcccctcctcgctgctgcctggttcggggcgcggagcgtccc

SEQ ID NO: 1605 - DNA, 2921 bp, Unknown
  Kingdom: Bacteria, Phylum: Actinobacteria, Class: Actinobacteria, Order: Streptomycetales, Family: Streptomycetaceae, Genus: Streptomyces
atggcacggcatgcggcccgtgcgggccgcatgccgtgccatcgggtccggtccggtgactcgacgccgagctggtcgaggacgcggaccaccaggtggtcgacgaggtcgtcgacggtgcgcggatggttgtagaaggcgggcatgggcggaacgatgcgtacgcccatccgcgcgagcgcgagcatgttctccaggtggatctcgttgagcggggtctcgcgcgggaccaggacgaggggtctggcctccttcagtacgacgtccgccgcccggcccacgagtccgtcggcgaggcccgagcggatccccgccagcgtcttcatgctgcacggcacgatcaccatgccgtcggtgcggaaggacccggaggacagcgccgatccctggtcctccgggcggtggacgacgtcggccaggtcactcacctcacggaccgtgcggcccgtctccagctcgatcgtggcgcgtgcccagcggctgatcaccagatgggtctcgatctgcggatcagcggcgagccgctccagcagccgcactccgagcacggccccggtcgccccggtcatccccacgatcagccgcatccaccactcctcctccactcggcgcacggcatggcggccggtgcgcagaatcagtcatcggggagggaggcagacagtcgccgtcgcgcccgttccccggtccatgcactgttcacgctagggacgcccgggcgggctccggcgatagactcgggcacgagatgagcagaatcggacaggatcgcggccccctcgccttccccttccccaccacgcccggcggcccgcccggcgtggaggtcaccggcctgcccgggctgctcacccggatcgggcggctcggtgcggcgcccgacacggccgtacggctggagttccatctgctggtgaccgtgcggacgggactgctgcgctgcgtggtggacaccaccgagtgcacggtggcgggcggcagttggctgtggatccggcccggtcagttcgtacggttcccggaccggagcaaggacggggcggccgaggcggacgcggcggtggtgctgttccaggcgagcttcctcgacgcggccaccgtcaccggggcgcatctggaccgcagggcctggcgcctgccgatgacgcccggccccgaggccgcgcggcccctggagcggacgctggagcaggtggagagcgagtaccaccagttgcgcgacctgcccctggaggtccatgtcgcggtcgtccggcacctgctctcggtcctcgtgctgcgcctcgcgaacctgccgggcgggcagcgcaagcacgcgggcgacgcggccttccgccgcttccgtgacgcggtcgaagcggacttcacccgccaccaccaggcggaggcgtacgcggcccggctcggttacagcgtgcgctcgctgacccgcgccacgaacgcggcggtcgggcgcggggccaaggcgttcatcgacgaccggctcgtcctggaggccaagcggctgctgctgcacacacagctcccggcatccgcgatcgcggaccggctcggcttctccagtacgacggtcttcacccgcttcttccgccaccgcacggcggagacacctctcggcttccgccgacgggcgcgcacggacccgtccgccggtccgggggcgggctgagcgggagaaggcggccgctcaggcgcgcaggtgggtgccgaagaagccggtgagcttgagcacggcgggggtgacgtgctcgtccttgtcgtacaggctgacgtgggcggcgccgtcgaccaggaagagttccgcgttgtcgccggccttctccgtggcctcacggctgaagtaggcggtgtcggcctccgtgccggcgatcatcaggagcgggcggggcgcgatcagttcgatcatcgcgtacgagtcgtactgggcgatctggtcgatggaacgcaggaccgtcttgttgtccgagtcgcagtgtccgccgcggggagtgcggtagtacgcgtacccctcacggaacagggcgggcgccccctccaggccctcggggtccgcggggacgtggcccgtccggcggctctgccggttgtccttccggcggccacgacctccagcgtcacatctgccggccgtgaccggaaggggcggaacgcgtcctgggacaggactggccccctcacccgcacccggtgtgctgcgagactgtgaagcatggatcgcaacgcgcaccgcggcgagctgggtgacttcctcaaagcccgccgtacggagctgagcccggccgccgtcggactgcccgagaccggcggcccgcgccgggtcaaggggctgcggcgcgaggaggtcgccctgctcgcctgcatcagcaccgactactacacccgtctggagcagggccgccggcaggcgtcgcacgcggtgctggacggcctggcccgcatcctgcacctcgacgacgacgagcgcgcgtacatgttcgaactggccgggcgtgacgccacgcggccgcggcggcgcgcgacgcagaaggtgcacccgcaactgcgccggctggtggacgagctggtgacggtccccgccacggtcctcaaccgccgcatggacgtcctcgcgtggaatccgatggccgccgccctggtgacggacttcgcgcggctcccggagaaacagcgcaactacgtgcgcctggtgttcaccgatcccggcgtgcgggcgctgtacccggactgggagagcgtcgcccacacctgtgtggcccaactgcgcatggaggccgcccgcgaccccgaggatccgcggctgaccgccctggtgggtgagctgtcggtgcgggacgaggacttccgccgctggtggggcgcgcatcacgtcgcggtccgcggcatgggcaccaaggtgttccgccacccggtcgccggcgacc

SEQ ID NO: 1606 - DNA, 792 bp, Unknown
  Kingdom: Bacteria, Phylum: Actinobacteria, Class: Actinobacteria, Order: Streptomycetales, Family: Streptomycetaceae, Genus: Streptomyces
caccgccacccagccgcgcgggcctcgccgcgcggctgggtggcggtggtcatgcgagcctcccggtgagcccacgcggccggacgagcagcagggcggcgagcaggacgacgacggcgaggtcgccgaggcctgcggtggtgtagtagttggcgaactgctggacgaggcccacggcgacggaggcgagcgcggccccggtgagcgagcccatgccgcccatcacgacgaccacgaaggcgaagatcagcagtgaggtgccctggccggggtcgacggagccgaagtagaggccgccgatcgcgccaccgagggccgccgccgcgccgccgatggcgaagaccagcgtgaaggccttgcggacgtcgatgccgagcgcggtgaccatcgcccggtcctcgacgcccgcgcggacgaccagtccgtgccgggtgcggccgaggaacagtttgagcgcgaccaggaccaccacggcggtggcgatcagcaccagtcggtcgagcgggacttcggcgccgagcagtgcgaaggtgccggacagcgccttcggccccgggaagggccgggcgtcggcgccccagatcgcggacagcagcgcggggacggcgaggccgacgccgacggtggcgaggatctgctcgcgcgggcgtcgaggaccgggcgatggtcaccgcgctcggcatcgacgtccgcaaggccttcacgctggtcttcgccatcggcggcgcggcggcggccctcggtggcgcgatcggcggcctctacttcggctccgtcgaccccggccagggc

SEQ ID NO: 1607 - DNA, 2700 bp, Unknown
  Kingdom: Bacteria, Phylum: Actinobacteria, Class: Actinobacteria, Order: Streptomycetales, Family: Streptomycetaceae, Genus: Streptomyces
gggccaggagcgccgcggcgacgaccgggaggagcagcgcgtcgccggcgcagatctgcagcagcaggtcaccgccgcgtgctcgcggggcgatccgctcgcgggagaatcgcgggaggtcggccgcgccgggcagcgaggcaccaaccgcgcgtaccagccgagggcccacgccgacggtcacggtgaggtcgcccggcggcaggcccagcagccgccggtcggtgccggcgacgagggtgcggatggtctggccgagttcggccagcaacgggccgggagccacggcggcatcgagatccgccaccacggccagcaggttgcgctgggcaggctggggaagggtgacgcctgcctggtgccggcccgtcgcaggaaccgtcgtgggcgtggccggtgcggaaggggcgtgccgtcctggccgggcggcgtccggtgtgcacccggcggtcagaccggcggccaccatggcgccggtgacatcgaggaacctgcggcgcgacggctggggatcggctcggtgcatggtgtgcagagtgccacacccgcatcgcgtgtgccggtcaactcccgtttcgtggtcgtgcgatggggcgccgtgccagactgggatcatgcctcgattagctcttcgcgtgttggcggcggtcctgggcacgctggcactggtggtcggctgcggcggtggcggcgacggttcgggcaagggccggcggccggccggtgcgcaggtgacgatccgggtgcccgccgacgccccgacgatctcggccgcggtgtccttggcccggcccggcgacctggtgctggtctccgcgggggtgtaccacgagtcggtgcggatcgacacggcgcgcgtcacccttcgcggtgtgtcccgggacaaggtcgtcatcgacggccggttgcagcagccgaacggtgtcgtcgtcgcggcgcccggggtggccgtggagaacctgaccgtgcagaacaacacgcagaacggcgtcctggtcaccggttcggcgaaggcggccgccgggttgccggggcgaagcggtggttacgacaccggcgaggagcccgtcaccttcctgaagtcgttcctggtctcgtacgtgaccgcaacccgcaacggcctgtacggcatctacgcgttctccgcgcagaacggtgtcatcgagcattcgtacgcgtcgggcggggccgactcggggatctacgtcggacagtgcaagccctgccgtatcgtcgtgcgggacaacatcgccgaactcaacgcggtgggttacgaaggcaccaacgccggcggggacatgtacgtggtcggcaaccgcctggtcggcaaccgggtcgggctcaccaccaactcggaccaccaggagaaactgctcccgcagcagggcgcggtcatcgcgggcaatgtgatcgccgccaaccagcagagggccacgccgcagcaggccgacggcgggtggggcaccggcatcggcatcgacggcggcagcgacaaccagttcgtccgcaaccgcatcgccggcaacagccaggcggggctggtgatcaccgcaaccgccgacatccctccggtcggcaaccagatcgtcgacaacgtgttcaccggcaacggtgtcgacgtcggctggacgttccccaccgccacccggggacggggcaactgtctgcggggcaacgagctgcgggccaccgtgcccgcccggctcgcgacgaccgcgaactgcccgcttccggccgggtctctctcgccggccggcaggtggacgccgccgactgcacccggtggcatcccgttcaccgaggtcgcggcgcctggcccgcagccgcagttcccgcacgccgccactacgggcgccaccgccgtgccggccgtgccggccctgcccaagacggcggacatcccgttgccgccggcctccctgctcgccgcgaacgcccgggtgcacacctcctgaacgacgcccgggtgcacgtcctgaacggcgcccgggtgcacatgtcctgaaccgcggctaccgggccggggcggctccgggtaccggcttgaccggaacgtacttgtgggtgtcgaaatcgatgaccaccggctgcggttcggaacccacgctgacgcggacccggtacatggtgccgtccgagccgacccagtagcgcacgttgcccgcggtaccggagcggttccgggcggacggcccggtcatgacgtccacccggtgcccgcccacctgctcccgtccccaccaggtggcgccgttctgcggcaggagttcggcgttgtccggccggtcgctgccgagcttgagcgcgatggccagcgaactgtccagcgcgctgcccgacgacagcagcggacggccgtaccagcccgagcggggcggcgccgcgggtgcgtacgccggggcgttcttcatcgggtggaccgacaccgagccggccgtccactcgatcagcccgtcgctggaggtggcacgcccggtgccgcgcaccacgccgtaaccgaccttgccccggtagtcgacggatcccgtgacggtcagccggccggcggtgcccggcacgctgatcgtcaccgcgcggccgtgcgcctcgtagttgcggaaccgcgtgatcgccagccggttcgcctcgtccgaggtcagtgcgcgcggaccgctggggccggagccgtccccgacgaccaggaacacggccaccgcggcc

SEQ ID NO: 1608 - DNA, 2313 bp, Unknown
  Kingdom: Bacteria, Phylum: Actinobacteria, Class: Actinobacteria, Order: Streptomycetales, Family: Streptomycetaceae, Genus: Streptomyces
ccaggcggcggcgtccacccggtccgccgttgtccgtccggtccggtcccggcagcagcccgatcaggaattcaacaaactgttgacgtcccgatcgcccaaacctaggctccacgaagcggaaacaagtttccgctgcccccgcatggaaggtccacgatgtcgcagcgcgtgctcacgacagagtccggcgccccggtcgccgacaaccagaactccgcctccgccggcgtcggcggcccgctcctcctccaggaccagcacctgctggagaagctggcgcgcttcaaccgcgagcgcatcccggagcgcgtggtgcacgcccgcggttcgggcgcctacggccacttcgaggtgaccgacgacgtcaccggcttcacccacgccgacttcctgaacacgatcggcaagcgcaccgaggtgttcgtgcgcttctccaccgtggccggcaacctcggtgccgcggacgcggtgcgcgacccgcgcggcttcgcggtgaagttctacaccgaggagggcaactacgacctcgtcggcaacaacaccccggtgttcttcatcaaggacccgatcaagttccccgacttcatccactcgcagaagcgcgacccgttcaccggcaagaccgagcaggacaacgtctgggacttctgggccaactcccccgaggccacgcaccaggtgacctgggtgatgggtgaccgcggcatcccggcgtcctaccgccacatggacggcttcggctcgcacacctaccagtggacgaacgccaagggcgagggcttcttcgtcaagtaccacttcaagacggaccagggcatccgctgcctgaccaacgaagaggccgccgagctggcgggcagcgacgccgactcgcaccagaccgacctgctccaggcgatcgagcgcggggtgcacccctcctggacgctgtacgtgcagatcatgccggcggccgaggcggacaactaccgcttcaacccgttcgacgtgaccaaggtgtggccgcacaaggactacccgctgcagcgcgtgggccgcatggtcctcgaccgcaacccggacaacgtgttcgccgaggtcgagcaggccgcgttctccccgaacaacttcgtgccgggcatcggtccgtcgccggacaagatgctccagggccgcatgttcgcctacgcggacgcccaccgctaccgcctgggtgtcaaccacacccagctcgcggtgaacgcccccaaggcggtgccgggcggcgcgaacaactacggccgcgacggcttcatggcgtccaacgcccagggccgtgacgccaagaactacgagccgaactcctacgacggcccggtcgagaccggtcgcccgctgtcggccccgctcgcggtctccggccacaccggcacccacgaggcgccgctgcacaccaaggacgacgacttcttccaggcgggcgagctgtaccgcgtcctgtcggaggacgcgaaggagcgtctggtcgcgaccatcgccggcggcctctcgcaggtctcccgcaacgacgtcgtcgagaagaacctggcccacttccacgctgccgacccggactacggcaagcgcgtggaggcggcggtccgcgccctgcgcgaggactgaccaccagccgcgtccggcgtcccggcggggaggtcgggacccggacgcgtacgccccgcgcgggcgccggacgacccggatgaggggtggtcggccggcgaccgtgcggtcaaggcgaggaccgcggtgggggtccccttgttcgagacaggtcttgaacaaggggagcgcgagccagtgcggtggtgaaggtcccgggaccgtcttctcgaccagagggaaggccttccggaccgtcgcacccaccgcggtcccagccaacaacccgcctcgctcacggcgaggcccacgaactccgtccggcggcgcgaatgtcctgtcgcgcccagtctcgcgtcgtcggacgggatccacaaccgaacaccttcaccggccggacggcgccggatgcggacggtcccgcatccggcgccgtttggtttttgtgcggcgtcggacccggtggtgggcgactgtgcgttgtgcggcgtcggggccagcgacgggcgggtgcgcgtcgtcggggccggtggtgggcggctgcgcctcgtgcggcgtcgggcccggtgacgagcggctgcgcgtgcgtcgtcgggccggtggtgggcggctgcccgttgtgcgtcgtcgggcccggtaatgggcgactgcgcgtgcgtcgccggggccagctccgggcggctgtgcgtcgcgcgtcgccggggccagtgc

SEQ ID NO: 1609 - DNA, 1274 bp, Unknown
  Kingdom: Bacteria, Phylum: Actinobacteria, Class: Actinobacteria, Order: Streptomycetales, Family: Streptomycetaceae, Genus: Streptomyces
cgtacgccttggtcagcccgcaggctcggcggctcgcgcccgcgggctgaccaaggcgtacggcacgggcgagaccgccgtgctcgccctggactcggtggacgtggacatcgcccgcggccggttcaccgcggtcatgggcccttccggctccgggaagtcgacgctgatgcactgcctggcggggctggacaccgtgtcggccgggcaggtctggatcggcgacaccgagatcaccgggctgaaggaccgcgagctgacgcggctgcggcgggaccggatcgggttcatgttccagtcgttcaacctcatccccaccctcgacgcgctggagaacatcaccctgccgatggacatcgcgggccgcgggcccgaccggcagtggctggatcaggtcatcgacaccctgggcctgcgggaccggctcgggcaccggcccgcgcagctctccggaggtcagcagcaacgggtggcctgcgcgcgggccctcgcctccaggcccgagctgatcttcgccgacgaaccgaccgggaatctggactcgcgggcgggtctggaggtgctcggcttcctgcgggacgccgtcgacagcctcgggcagaccgtcgtcatggtcacccatgatccgggcgccgccgcccactccgacctggtgctctacctcgcggacggccggctcgtggacgagatgacccacccgacggcggaggcggtgctggagcgcatgcgcctgttcgccggagcggaccggcgggcgccggctcccggcctgatcggcgatccgctgcaagcgggcggggccctgttccaggacggggacggcaccgccgtcgaggaggcctgaccggggtgctcaaggcgacgctgcgcagcttcctcgcccacaaggggcggctgctgctgtccgccctggcggtcgtgctgtccgtggcgttcgtcgcgggcagcatgatcttctccgacacggtctcccgcaccttcgaccggctgttcgcctcgaccgcggccgatgtcaccgtggggccccggcaggagctgaagtcgccgctgcggacgggtgccctgcagaccgtgcccgcctcgctggccgggcggctgtcgcgcgtaccgggcgtcgcggcggcccacgtggacgcctcggtcgacaccgtggtcgtcgtcgacagcaggaacgaaccggtcggcccgaccaccggcgctcccaccatcgcacgcaactgggaggtcgccgaccacagcccggtgacgctgacctccggccacgccccgcacgg

SEQ ID NO: 1610 - DNA, 3191 bp, Unknown
  Kingdom: Bacteria, Phylum: Actinobacteria, Class: Actinobacteria, Order: Streptomycetales, Family: Streptomycetaceae, Genus: Streptomyces
cccgggcgagggcgacggcgtcgcggggggcgaggtagcccgcggccgcggcggcggccagctcgccgaccgagtgcccggcgaacagcacctggtccggggccacgtcgagggtgtcggccagcagccggtgcgcgagcagggacgctgccacgatcagcggctgggcgtaggccgtgtcggcgagcagcgccgcgtcacggccggccccgaccaggtcgatgcccgcggcgagcgaccagtcgtcgacgagtgcgggtgccccggggacggcgtccagccaggggtcgagcattccgggccgctggactccctggcccggggcggtcacgacataggggtacgacaccgaatcctccgtttcggaaaacaagactcaattcgcgctgcctgggccctggtaggtgtctagagcgagccggcggggcgcagcagggtgatggcgcgttcgacttccaggacggtgcggccgtccccggtcctggacactccgcggaaggtggccgtctcctcgtcccggtcgaccagctccacaaagtgcacgaggagttctccggcccgggcggcgccggtcagccggacgccgcgggccgagccgaagatcagcagccggcggtcgtccggggccgactcgcgcagcaggagcagtccgcacgcctgcaggaaggactccagcgtgaggctggcggggaaccggcccggccgggcgtcgcccaggtggccgtccagctcgtggtaggtcacggccttgacggcttccagggcgcccggtgtgtgccggacgatccggtcgacctggagggccgggtagccgtacggcagcaggtcgccggggtcgggctggggcagggccttcgccgccgccgcggtcgcgctcaggtcctgggcctgcgtggacgtcgtcatgggcggcacctccaggtggcggtgatccgggccagccgctgtccgccgctgctgcacaccgccttggtgaccaggcggtcgcggtcgccgctgacggtgacgtcgaacatcacctggtcgccggcgagcgcgggccggctgaagcggaccgagccgatctccaccagctccacgccgccgagcgctccgtcgaggtggacctccagcatctgctgcaggctctcgatcaggaacacgcccggatagaccgtcagggaggggaagtgcccggcgaggtaggggtcgtcggtgacgaccgtcttgcggccggtgaagcctccgtcgaccgcctcgacgtcgtccaccgcgagcagcggcatccggcgcgcgcccggccgtaccgggtaggccgtcgtgcgtgcggggtgcgtcctcgcgcccgcgggctggggcgtggtgcgtgcgggctgtgtcgtcgtgctcatcagacccccatgccgacgccgccgccgatggggatcgacgcgccggtgatgaacccggcgtcctcggagacgaggaaggagaccagggcggccacctcctcgggccggccggtgcggcgcagtgccgtctgggacacgatctccttgcgccggcgctccgagaggtcggcgatcatgtccgtctcgatcaggccgggcaggacgacgttggaggtgaccccggcccggccgagttcccaggcgagggagcgggcgacgccgatgaggccgctcttggaggccgagtagttgacctggccgggcgagccccacagcgccacgatggaggagacgaagaccaggcgcccccacttgttggccatcatgtccggcacggtctcgcgggccacgttgatggagccggtgaggttggtgtcgagcacctcctggatgccgtcctgggactgggtcagcagcagtccgtcgttcatgatgccggcgcagttgacgacgatgtctatctcgccgacgacctcccgcgcctggtccaccgccgtgcgcaccgactccgggtcgcggacgtcgcactggacgaaggagacgccctcgacgtccggccgggtggtgcgggcggtgccgaccacgcggtacccctgcttgttcaggtccgcggcgatcgccgccccgatgccccggctggctcccgtgacgaacaccgatcgactggtcatcgctctactccaaggctgggtgcgccggagcgcacgaggtggtggggtgcgccggagcgcacgatcggatcgatccgctcgatggcggcgcgcgtggactcgccgccgccgagcacgccggtccagcccgcccgccgggcaccggcgacgttggcctccaggtcgtcgacgaggacgtgggcggcggggggcaggccggaacgggactcggcgaggcggaacatcgcggcgtcgggcttgcgggtgccggtgtcgcaggacagcaggaccgcgtcgaacagcccgtcccagtccaggaagccggcgaagggctccttccagtccacgggcaggttggagatgacgccgacgaacgcgccggcctcccgccaggagcgcagggcgccgagccactcggcgtcggtcctgcggtcgccccaccactcggggccgaggccggacaggtcggcgtcgatgccgaagcgggccgacagctcccgctcgatcccggccgtccactcccgttcgtcgagcaccccggagtccagtacggccatcccgtcggggcagccgtgccggtcggcgagggcgcgcaggcactgtccgagctgggcgggggtgaactccttgccctcgcagtaggcgcgcaggccctcgcgcagcggcggggtgagcacgccccggaagtcggtccagatcgcggtgctcatcggaccgctcccgcagtgccgggcgcgggggccgacgcgaacgacatccgggtgacgaccaggtcgtcctggacgcagtccacgtcggtccaccgctcgccgtgccgggcgacgagccggatcggggcgtcgagttcggcgaaatgctcgaaggtggcgcgcaccgcggtgaccacgtgacccgcggggtcggcggtgccggtcagggcgagctgccggccggcctcgatgagcaccatcgccgggtagtggtcgtagtcgtggtcgaagaggctggcgttggcgaagtccggcgccaggtcggcggtgcggacgccgccttcggtgcggacgccggcgatggccacgttggcggccgacgtacgggcgacgcccgccgggtgggccaggtcgggccggcggcccgcgccggagcgcagcag

SEQ ID NO: 1611 - DNA, 679 bp, Unknown
  Kingdom: Bacteria, Phylum: Actinobacteria, Class: Actinobacteria, Order: Streptomycetales, Family: Streptomycetaceae, Genus: Streptomyces
acgccgggtgcgccgccgccggcgacggtggcgaagctcggcaggacgtgcagccgggtctccagggtgtagcgcagttcgccggggtcggtcgcggggacgcccgcgccgaggccgaggtggtagagctgcacgtccttgggcgtccacgagatctcacgggtgcggggtccggccgcgagggcgcgggttgcgtcgatgggcatggcccctctgtacacccggggttcccggcccggaaagtctctgacgtgtcgccaacgcgaagtttctgacgtgtcgtcagctgggcaatggcgcccgtgacatttgtcccgcccggcgtggtgcggacgtcccgtccgactccgtacaagcgcatctgccgtgggcccggccccgatccgtagcgtcactgtcatgacacagacacgaagtgccgtgtccttcagggggacggcgaaggccttcggcgcggtacgggccgtcgacggcatcgacctcgacatcgcgcgcggcgagaccgtggccctgctcggccgcaacggcgccggcaagtcgacgacgatctcgctgctgctggggctgaacgcgcccgacgcgggcacggtggagctgttcggcacgccgcccgagcaggcggtgcgcgccgggctggtcggcgcgatgctccaggacgggcgggcggtgccccgggtga

SEQ ID NO: 1612 - DNA, 2232 bp, Unknown
  Kingdom: Bacteria, Phylum: Actinobacteria, Class: Actinobacteria, Order: Streptomycetales, Family: Streptomycetaceae, Genus: Streptomyces
cccgacggcgccggagcggccctgccccgcccgccggccggcgaccgtcgcctgccgccgggccttgcggaccagcgccgggtcggtcaggacgtcgatgccctccgggtcgttgcggaaccattgcggcacagcgcgtcgcaatgcctcgtagcggttcacggagtgttcagcagacagtgcaaggaggtgactccggcttcagtactcgggcaggtcttcgttgtcctgggtcgtggtggacgccgtgccggtcggggcgggccccgacgcgtcccggtagccgggcaggcgccgcaccaggtcgtggaactgggaccattctcgttcaccggccagccgtacggaggctatctcccgtgcgaatctctgttcctgccgcccggccgtcaggttgcgcagcaccaactgcaccgaaccggtcagagatccgctcaccgtgagcggcagcaccgaaccggccacctcccacaggccgttgccgctgaccgcggtgaacacggccgcgcccacggtgacgacgatctccacgaccggctgccaccgcgtcggccgcgcctgcctgcgctcccgggccagcttgaggatctccgcgttgagcccgacgtagcggtcgaagacctgccccacccggtcgtggaaggtctccggcgcggaggtgagcgcgccgaacgcccgcacgtactcgttccacacgggggtctgccgcagccgcacgatgtcctgcagcgtgagcgcgtcgaccgcggccggtgtcagatggtcctggacggtggcgaacgcctgccgccgcaggaacgtcagcaggtgctcggggtcctcgacgaagccggtggtggtgcgggcctcacgggcctcctggagcaccacgcgccgcaggctgccgttcggggtgagcgggtaccgtccgagcgcgtcggccaggttgacgttgtagacgaggtcgaggagctgcttgatctctgcggcgaagggcttggtccggtcgtaccggccctcggcgacgttcgtgccggggaccgtcacgaactcctcgtacaacgtgttgcgcaccacttgctgcctgcgcacgctcaggtcgttgctgaaggccaccacctcgccgagccgccgcccgaaccggtccgtgtcctcgcggtcgaccccgacctgggcggccagcacgtcgatgtccttggctgtcagcccctgcaccttctcggcgaacggctggaacagccgcagccgggtgctctcccggttctcgtggtcgtccggcgagtcgtcccaggacatgcgcacacagcgcacccggtcggcggcgggcaggccgtccagtgtctcctgccaggccgtgaacccgtcgcgccgcacgtgcagacggccgggcggctcctcggcggggtgccgctcgcccagcaggaagggcacgatcgccccggaggccagcagccgctggtgcgcggtccgaggctcaccaggccgcaccaggtcccggctgatcgcgtcgttgttgtagaagtaggcgcggttgatcacgacctggctggcgttgatgaggctgcggaagtactcggcccgcacctcccgcacccgctgccgggcgacctggtccaaggactcgccccgctcgatcatctcccgtgcgagccctgccgggacccactggttgtcgagcgactgcgcgatcaccgccccgcggtccagctgctcgggacggatcggctccatcaggccgtcactgctgtcgacgtcagtcatcttccgtttccgaggctctctcgtgtccgacgaacacctcagaggtgctccgacggagcgtgatgctgaggccaactcaccttactgacacgggatgtggcatgcagtcagattaccggccactcctgggccgggtgttgaggaagggcagctccgtccactggtccctgggcgtgccgggtgaaagccgcatcagcgtcagggccttcgcgggcaacggctcctcggtcagtgcccgtacgtcggcggtgcggggcaggtcccgtacggccgcctccaccgcggcgcgcagtacgcggcccgagcccgccgttccggccagcgcgcccgccaccagcgagccgaacagcttgcggcgcagggccctcggatcgtccgtgaggttgcgggcgggtagttcggggacggcgatgccatgccgggccagccgtgcggggctcaccctgatgtcggcgaggtcgcggtagaccaggcgcagcggggtgccgtcgc

SEQ ID NO: 1613 - DNA, 555 bp, Unknown
  Kingdom: Bacteria, Phylum: Actinobacteria, Class: Actinobacteria, Order: Streptomycetales, Family: Streptomycetaceae, Genus: Streptomyces
gttccgggccgtgcgggcgcagcagcccgggcgccatgccgaccagccacgcccaggccgccgccgcggtggccagccccaggtgggccggcacctgtccgagcgtctgcggagcgaacagggacgcggagctgatgaaggtgaggacgacgttgccgggcgggcccacccgggtcgcgtcgcacagggccttctgtgccgccgccatgacagcgcccacggcgaccaggacgacggtgtcgcgggtgagcgaggcggtgaccagggagagggcgaggccgccgagcatgccgagcaccacccaggccagcaccttggcgcgggcggcgtaggggcggttgtgggcgtacatggcgcacagcgatccggccatcgtgtacatggcgaggtcgagccgaccgagggcgagcagtgtgaggttcggcggcgccagggagaagaccgcgctgagtgcgggtttgaaccagatgtcggaggggcggccgagccgcagcgcaccggtgagcgggaggcgccggacaggccgggcctcacgggtgggagtggggggagggg

SEQ ID NO: 1614 - DNA, 5759 bp, Unknown
  Kingdom: Bacteria, Phylum: Actinobacteria, Class: Actinobacteria, Order: Streptomycetales, Family: Streptomycetaceae, Genus: Streptomyces
cgccacggccggtcgccgcggcggagccggggcgcagtccgtccaggaagcggctggggcggcggttggggcgcccgcccggcgtgcgggtcagtgaccaggacaggtggagccgctcgcgggcgcgggtgacgccgacgtagagcaggcggcgctcctcctcgatctgctcgtccgtcctggcgtaggtgatcgggatcatgccctcgccgacgccgaccaggaagacgacgtcccattccaggcccttggccgagtgcagggaggcgagggtgactccttgcacggtgggggcgtgctgcgcgttcgcgcgttcgtcgagttcggccacgaggtcgccgagggtggctccggctttggccgcggcgaagtcgcgtgcgaggttcaccagtgcggccagcgactcccagcgctctctggcggcacccgagccggccggtggctgggcggtccagccctcgcccgagagcacggcgcgcacctgtgagggcaggtcgacggcgtcgtcgaggagggagtcgttgccgccgaagcgggcggcggcccgcagggcgacgctcgccttgcgcacctcggggcggtcgaagaagcgctcggcgccccgcagctggtacggcaccccggcgtccgcgagggcctgctcgtaggtctccgactgggcgttcgtacggaacaggaccgcgatctcgctcgccgggactccggaggcgatgaggtcgtggatgcggtgggccgcgccctcggcctcgccgggctcgtccgcgtactcggtgtagtccggctccgggcccgcggggcgctgcgagacgagttccagccggtggtcggcggcgcggccgcgtgcctgggcgagcaggccgttggcgaggtggacgacctggggggtggagcggtagtcgcggaccagtttgacgaccgtggctccggggtgccggacgcggaagtcgaggaggtggtcgggggttgctcctgtgaacgaataaatggtctggctggcatctcctacgacacacaggctgtcccgctcccccagccacagctccagcaggcgctgctgcagcgggctgacgtcctggtactcgtccaccacgaagtgctggtactgggcgcggacctcttcggcgacgtcacgccggtcctgcaggatggcgacggtcagcagcaggacgtcctcgaagtcgatgaccgagcggcttcgcttgaggtcttcgtagaccgagtacagctgcgcgatctcggcgggggcacgaggcgtttcacgaccggccttcgcggctgcgagggcgtagtcggccgggacggtctgggtgaccttggaccactcgatctccgcggtgacgtcccgcagctcgccgcggtccagtcggatgcggcaggcggctgccgcgtccgccacgagctggatcttgcggtcgacgagccggggcatgcctccaccgaccgctttcggccagaagtactggagctggcgcagggctgcggagtggaaggtgcgggcctggacgccgtgggcgccgagctggcgcagccggccgcgcatctcccccgcggcgcggttggtgaaggtgacggcgagcacgctggagggctggaggatcccggcccgtacgccgtaggcgatccggtgggtgatggcgcgggtctttcccgtgccggctcccgccagcacgcacaccggaccgtgcagcgcggtggcgacctcgcgctgctcggggtcgagcccttcgagcaccgcgtcggcagagtccggtacctgcgggaagagggtggagtgcgttgctgctgtcacacaagccatgctgccaggtcgcgggagacgggtgagccggttgtccacaggcgggccctcgcggtcgtactaatgcgacgggagccacccgcttccgtcgcggaccgatacccccggcgggaatgccggagccggtgacgtacgttcatcgactgcgaccactacgtccccgacccgccgaaggagcgcgagagacatgccgggcactgtgacgatgtacagcaccacgtggtgcggctactgccgtcggctcaagagccagatggaccgtgagggcatcgcgtacaaggagatcaacatcgagcacgacccggagtccgcggccttcgtcgagaaggcgaacggtggcaaccagacggtgccgaccgttctcttcgaggacgggtcgacgctgacgaacccgtcgctggcgcaggtcaagcagaagatcggcgtctgagtccggccccggtcccgccgcggccccgttctcggtacccgcggaaggcggcccccgtgatcactggatcattcgggggccgctttctcgtgcccggcggctcagggcgtgcccggtgcgggccgcggcgaggtcagacgaaggtcctcgtcggcagcggcttgccgtaccagagttcgatgagccgggccgcgatggagatgccgtagggcggcaggacctcgccggactcgaaggccttgcgcagctcctcgcgggagaaccagcgggcctcgtggatctcgtcgccgtcgacttcgatctcggtggaggtggcgtgggccatgaagccgagcatgaggctggacgggaacggccagggctggctggcgacgtactcgacctgaccgacggcgatgccgacctcctcgtggacctcccggcgcaccgactgctcgatggactcaccgggctcgacgaagccggcgagcgtggagaagcggccctccggccagtgcacctggcgccccaggaggatgcggtcctcgtcgtcggtgaccgccatgatcaccgcggggtcggtccgcgggtagtgctcggcgccgcaggcggggcagcggcggatgtggccggccgcggcgatcacggtgcgctcgccgcagcgggagcagaagcggtgcagccgctgccagttctccagggccaccgcgtgcgccatcaggcccgcgtcgcgcggcgacagcagcaggcccgcctcgcgcagtcccgccgggcgcgcggactggtccatccggcccggcagcgcgtccttctggagcgcgaagtagctgacgccctcgtcgtcggtgccgaggaagtagcggtgcgcctcggtgagcggggcttcgaaggacggggtcatgacgagttcggtgcggccgtcgggcgtctcgtcgatgagtgcctgaccgccggagaccacgaagcagcgggtcgtggggtggctccatgccgcggcgagccaggcctcgtcgagccggtggtgggcggcccggtcgatgccgctgggcgcggtgagcgagacgggtcggtctgcggtgtggtcggtccaggtggtcacgggtgcttccaactcccccggtgcaacggttgatttgcggcggttcagcgggacgtacggcggcggggcggcgggtcagggcgtatcgggccagtgctcggcgaggtcgccccacaggtaggcgctggtctcgacacccttgaacagtaggtccagctcgaccttctcgttgggtgcgtgccagccgtcggaggggacggagatgcccaggaagagcacgggagcgccgaggacctcctggaggtcggcggccgggccggagccgccctcgcgggtgaagcggacggggctttcgaaggccctgcccatggcacgggcgacggactgcagggccgggtggtccagcggggtcaggcacgggcgggtggccgcgccgaacaccgtctcgtgccggatcccgtcgggcacctgttcgtcgatccaggcgcggacggccttctcgacgtggtcggggtcctggccggcgaccaggcggaacgacagcttcaccatcgccgtggacgggatgatcgtcttgctgccggggccctggtagccgcctccgatgccgttgacctcggcggtgggacgggcccagatgcgctccagggtggtgtgtccggcctctccgtggggcgcgtacgacttggcggtgcgcagccactgcgcctcgtcgaagggcagctcggcgaagagttcgcgttcgcggtcggtcagctcgacgacgccgtcgtagaagccggggacggccacgcgcgcgtgctcgtcgtgcagcgcggcgacgagacgggcggcggcggtcgccgggttgggcacggcgccgccgaaggaaccggagtggatgtcctggtccgggccgtggagccggatctcgcactcggcgagtccgcgcatgccggtgcacaccgtgggggtgtcctcggaccacataccggtgtcggacacgatcaccgcgtcggcgcagagccggccggcgcggctctcgaccagcgcgcggaagttcggggagccggactcctcctcgccctcgatgagcagcttgaggtggacggccggggtggtgcgcccggtggccgcgaggtgggcgcggacgcccagtgtgtggaagaacacctgtcccttgtcgtcggccgccccgcgcgcgtggagccggttgccgcggacgaccggctcgaagggctcgctgtcccagccgtcctcgcgggcggcgggctgcacgtcgtggtggccgtagaccaggacggtgggggctccggggtcgcccgagggccactcggcgtagacggccggggcgcccggggtctgccagacctcggcggtggggaaaccggtgtccttgagcttggcggcgagccagtcggcgctgcgccgtacgtcgggcgcgtgatcgggctgcgccgacacggaggggatgcgcagccactcggcgaggtcgtcgaggaaggcggcgcggtgctgctcgatgtacgtgcggacggcgctgtccggggtctggctcatgctcccgagcctatcggcccgcggtggcatccggttcgggcggttcgtcacactgcgctccgggcggcggctgcggttcctcccggacctcggcctcgccccgggggtcgtccagaaggaggcgttccagggcggcccggtccggcagcggctccgggcgtacgacctctccggtgcgcacgtacacgaacgcggcccggacccgctccaggggcaggccgtgccgctcggcccaggccagccggtacacggcgagctggagcgggtccgcggtgcgcgagcggctcgtcttccagtcgacgatctcgtacgtcacctcgtcgccgtcgccttccttgtagacggcgtcgatccggccgcggacgacgcggccggcgatctccagctggaagggtgcctcgacgcggtggggggtgcggcgggcgtacgcggtgcgttcgaaggcttccttgagggcttcgaggtcgcgttcgtcgaggatctccgcgtcggtcccgggcaattcctcgggctccagcaggggcagcgtgagcgcttcgaagcgggtctcgacccaggcgtggaagcgggtgccacggcgtgcggccggttgcgggggaagcggcatggggcgcgcgagttcccgggcgaaggcgtccgggtcggccgccaggcgcatcagctgggaggcggtcagggtcgtcggcagagggacgtcgatgacgctctgccgggcgcggcggagctctccggtgagcgcgtcgaggtcgcggtcccaggaggcgatggtgcgggcctcctccggagtgaggtgttcgggctcggggccgacgtcggggccgaggtcgggttccggttcgggctcccggtgagcttcggccggatgtccgtggccgtggtcgtgagcgtgcctgtccgcgggcgtcgcctggtgcgggatcgcgggggcggggcgggccgcggtccaggagtcccagtcgccggggtcgtcctcg

SEQ ID NO: 1615 - DNA, 5277 bp, Unknown
  Kingdom: Bacteria, Phylum: Actinobacteria, Class: Actinobacteria, Order: Streptomycetales, Family: Streptomycetaceae, Genus: Streptomyces
ggtagcgggtgcgggcgcgtccaggggccgtggggcttggccccggcaggcgggtgcgggtgcgggcgcgcccaggcgctgtgaagggggtgcccggtcggcgggtgcgggtgcgggtgcgttgtggcttgtcgcgcccttgcggcggagccgcacatcggcacggccccgcgcctccgggggttacagccagcccttctccctcgcgatgcgtaccgcctctgccctgttccgcaccgccagtttctggatggctgtggagaggtagttgcggatcgtgccctgggagaggtggagggcggtggccagttcggcgttggtcgagccgtcggcggcggcgcgcaggacctcgcgttcgcggtcggtcagcgggttggcgccctccgcgagggccgcggcggcgagcgtggggtcgatgacccgctcaccggccagcaccttgcgcacggcctcggcgagctgggcggccggggcgtccttgacgaggaaggcgtcggcgcccgcctccatggcgctgcgcaggtagccggggcggccgaaagtggtgaggacgaccagtttcaccgtgggcagttccttgtggagccgggccgccgcctcgatgcctgtgcagccgggcatctcgatgtcgagcagggccacgtcgacaccgtgggcgtgcgcggcggccacgacctcgtcgccgcgcgccacctgggccacgacctcgatgtcgtcctccaggccgagcagggcggccagtgcctcgcggaccatcgactggtcctcggcgaggagaaccctgatcgtgctgctcatgccggggatactacgtgccccgaaccggcggcgggcacccgggcgaccagccggaaaccgcgcctgccccggcccgcctccagcatgccgcccgccttctccaggcgctcctgaaggccggtcaggccgttcccgggggcgtttcccgagccgcccgagccgtcgtcctcgacggacagttcgatcatcgggccgtccagggtctggcggcggacgacctcgaccgcgcagcgccgggcgccgctgtgccgtacgacgttggtgacggcctcgcgcagcgcccaggcgagcgtggcctcgctgtcctcggggacgcccgtcaggtcggggtccgcgggcagttcggggttcacaccggccgccgtcagcgcgacccgggcgccggccagttcggcggccaggcggggccgccggtagccggtgacggcctcacgcacgtcgaccagggcctgccggctcacctgttcgatgtcggcgacctgctgggcggccttgtccgggtggccggggagcatccgcccggccagctcgctcttcagcgtgatcagggagagcgagtggccgagcaggtcgtgcaggtcacgggcgaggcgcaggcgctcctcgttggcggcgagctgggcgacggtggcacgggcctggcgcagttcgatcattgtgcgcacctgctggcgtacgccggtcatcgcgaagccgacgagcagcaccagcaggagcagcgtccacatcccgcccgagccgaccaggcggccgacgaccagcatcgccacggtggtcagggggatcgtccagtaggcgacgcgcagcgggaacgtcgcgccgcacgccaccgagacgtacacgaacagcccgatccaggcctcgccgagggtgaggcacagcaccacggcgaggatcccgagggcggcgaccaggcagccgacgaccggctcggggaagggccggcccatgttccggaagagcagagccatgtaggccccggtgaaggcggccaggccggcccagccgcccgcggtggccgccgccgcgtgggaccccgtgaccaggtcgcgcaccggcgagctgaggaagatcagccagggcgtgatccacaccagcttgcgccaggcctcgcccaggtcgcggggcggctcccccatgcgcagcagccgctgctcgcgggccgtccgcgagtggtcttccgtcatgacgctcacgccttcagcgtgtccttccggtacagccaggccgcgccgcccgcgaacagggcgaagaagacgaccaggatggcgatgtccttggcgtgcggggcctggctctgttcgatggcctgccccagtgcagcgtacgcgtgggtgggcagccacttggcgatgttctggagccactgcgggaaggtggtcgagggcatccacaggccgccgagcagggagaggccgaagtagatgatcatcgtgatcgggcggaccgcgtcgccgctggcgaggtagccgatggcgacgccgagcgcggcgaagaccaggctgccggcccagatcgcggcggtgagggcgagccactgccaggcgtcgaggcggacctgcttgacgacggcggcgacgatgaacacgacgacgatggacggcaggctcaccacggccgcgctggcggtcttcgcgaggacgtagccgcgccccggcagcgtggtcagccgcagctgccgcacccagccgctctcgcgctccttggcgatgcgctcgctgttgcccatgagcacggccgtcagggcgccgaaggaggccatggagaccatcatgtacgtcggcagggtcaggccggtgccgtcgatcttcgcggtgccgtcggaccggcccgcgatgatcaggaacaggatcgaggggtagagcacggagaagaagaggaacttgcggttgcgcagggcgcgggcgagttccagcttgatcagactgttcacgactgcttggcctcctcggcctcggtgatggcgacgaacgcctgctcgaggccgagcccggcgacttcgaggttgcgggggtagacaccgagcccgtacagggcgtggacggtcgcgtcggcgtcggtggactggatgcggacggtctggccggacacgtcgagggaggtcaggaagggcaggccgcgcagggcggactcgtcgatggcgccgtccaggtcgaaggcgatccggcgggcgccggccttcgccttgatctcggcggcggtgccgtcggcgagcagcttgccgcggtgcagcaccagcacgcggtcggcgatggcgtcggcctcttccaggtagtgggtggcgaacaggaccgtacggccctggtccgcctgttcgcgcatggtggcccagaaggcctggcgggcggagacgtccatgccggtggtcggctcgtccaggacgatcaggtcgctgtcaccggcggtggccagcgcgaagcggacgcgctgggcctggccgccggagagcttgttgaccttgcggtcgccgatctgcgcgatcccggcgcgggccagcacgtcgtccgccttgtacggcttcgggtgcagtgcgcaggcgagcttgaccagctcggcgacggtgacgtcctccatcaggccgccgctctgcagcatggcgcccacgtgtccggcgacgatcgcctcgcgcgggccggtcccgaagacggcgacggaaccgctgtcggggttcttgaggccgagcagcaggtcgagggtggtcgacttgcccgcgccgttcgggccgagcagcgccacggtctcccccgggtacagggcgaggctcagcccgtccacggcccgtacgttcccgtagctcttggtcacctggtcgaacgccaccaccgcggtcgcggtggcggtctccgctgtcgtcgtcatgcccccatggtcgccggagcgccggggcgggcggcagtgtcgggggtcctgaccgcgggatgacagatgtcatgcgctgcgggtgacagggggacgcggccgaggcggccgacgtggtcgacgtggtcgacgtggtcgacgtggtcgacgtggtcgacgtggtcgacgtggtcactgtggcgacacgagggaggggcccgtggtgcgcgtgcgcgctccgcaggcccctcgacggcaactgccgctcggctagttggggttggtgtcgatgacgccgatccggtcggtcttgctcaccagggcggggcgcagcgccccgatcacgtccgtgacggcgacgggcgtcttctgcccgttgccccgggtgatcagcacgccgtcgaaggcgccgccgtacagctccttgagcttctcctggtcgtagtactcgacgagcttgccgttgaccgccttgaccccgaggaacttccacagcgacttctgcgggctgagcaggatggagtgcagcgcgtccgcgcgcaccgtcaccttggccgacatcgccggctccgcgaactgcttcatcatccggtcgacctcggcgttggagaccgtcggctgccgggtggtcgtcgggacctggacgggtgcgggcgtgccggtctcgacctgggcgcggtacgcctgctcgaccgcctgcacggagcgggcggcgtcgatgcccttgcccgccttgccgtacacggcgacggccttgcccggctcgaaccggatggtgccgtcggtggccgaaccggcgccgcccgccgcgttccgcagcgcggcctggagcttctcctcgtcgaccggcatctgcggttcgatcacccggtggttgccgaacagggagccgatcacggagacggggttgtagtcgctctgcgccgccgcgctcgccgtcgcctgggtgtcgagctggagcccggcctggtcgggcctgagggtgacggacttgccgtcgacggacagcttcagcggctgcttctcgcgcttgccgaaggcgtcgtcgagcttcttgaccgcgtcgtcgcgactgccgccgccgatgtccacgccgagcacggtggtgcccttgggcacgtcggagtggttcatcagcagcccggcgccgtaggcgacgcccgcggcgacgacgaccaggccgccgagcagcgcgaccttgctgcggcccttcttcttggccgtcttgccggacttggcggatttgcccgacggcccggtgccctgccggcccggcccggacgacgcgggaggcgtgggggtggcgggcgagcccgtaccggggccgcccgcgcggttgccggcgccgttcgcggtgtcgggggacagcacgggcatgccgctggtgacggtgtgtccggagacgttgtccgggcggttgacgcgacccggggctcccggctcgggggcgggcttctgcggggtgaggatcgcggtgtcgtcgctcagaccgccgccggggagggcgggtcccgggtgcgcggtgggcacaccgggtacgccgagtgctccggggactcccgcgggggcgccgccatggggggacagcgggccgtcgccggtcaccgggccgccggtcggtccggccggtccgggcgaacc

SEQ ID NO: 1616 - DNA, 2671 bp, Unknown
  Kingdom: Bacteria, Phylum: Actinobacteria, Class: Actinobacteria, Order: Streptomycetales, Family: Streptomycetaceae, Genus: Streptomyces
gcgctcggccctgcggtccagcttctcctggcggcgctcctcccgctgccgctgccgctcggccttggtcagcttgcgctcgaccgccacaccgccccagaaggcgaagcccgtgatgatcacacgcggggcgcccggctcgcccggcacgccctcctcgcggtggtcgaagccgcccatgatgccgatgccgcgcacgaccacctcgacaccgggcggcacgatcacctgcgcgccgcccatgatcgcgatgcagttgatctctacctcgcggtcggcgaagttggcctcgcgcaggtcgatctcaccgccgccccagaaggagaaggaggtgaaccgcttggggaccgtccaccgtcccttgcgctggaaaccggacatgacggcgacggcccacgacgacgacccctcgccaccggtgatccgccccgcccaactcccgtccgccgcaggctccttgtgcaaggacaccgcagggggcgcgggcaccaccggggccgcgccgtgcccgaccggcaggtcgcgggtgatcggcgcaagttccccgtacgtgcgcgcgttgtacgtcgcctccagccgctcctcgaactcgcccatgtccaggcgtccttcggcgagcgcgtcccgcaggacctcggcgactcgttcacggtcggcgtcggaggcgcgcagctcggggacggggggcccggagggcgtctctcctgtgggcgggacggcgtcggtcatgggcagcagcctacgagttcgccgcgcgcgaggctacgagcccacgcgctgcgctccggactcgtacatcctggcgatcaccgcctcgatgtccggctcgcgcaccgacaggtccaccagcgggtagcggtccgcgatccgcgccaccagcggcgccgccgactcgcccgccgggaacgccagccactgccgcggcccctcgacacggacgacccgcgcgccgggcacctccaccggcggcagttcgcgctccaggtccaccaccagcgtgcgttcgccctcgccggcctcgtgcagaccggccagcggaccgtcgtacatcaggcgcccgtggtcgatcaccatcacccgcgagcacaactgctcgatgtcctgcaggtcgtgcgtggtcagcagcaccgtcgtggcacgctcggcgttcaggtcgcgcaggaactcacggaccctggccttgctgaccacgtccaggccgatggtcggctcgtccaggtacagcacctcgggatcgtgcagcagggccgccgcgatgtcaccgcgcatgcgctgcccgagcgagagctgccgtacggggacgtccagcaggtcggccagctccaggagttccacacagcggtcgaggttctcgcggtaacgggcgtcggggatgcggtacatgcggtgcatcagccggtacgagtcgatcagcggcaggtcccaccacagcgtcgtacgctgcccgaacaccaccccgatgcgctgcgcgagccgcgtccgctcccgggagggatcgatgcctgcgacccgcagccggccgccgctcggggtgaggatgcccgtcagcatcttgatcgtcgtcgacttgcccgcgccgttcgggccgatgtagccgaccatctcaccgcgcgccacggtgaaggagatcgcgtccaccgcccgcacctgccgccgctcacgcttcaggaagccggtcttcttgcgcacgtcgaagaccttctcgacccggtcgagttcgatgaacgcgccgccgccagagctgcccatgtccatgttcggccccccgtccacgcccacatccacgcccgtgtcctggtccgtgtcctggtccatgtcctgtgtcccttcagcttcccgtgctgcgatacgaccgcagtcccgcccgccaggccagccccgccagcgcgcagcacgccaccgcgaccagcggcggggcgaacgccatccaccacggcaggccgagcggatacgggcggccgagcaggtaggccgccggaacccagttgacgaaggccagcggcaggacgaacgtcaccccgcgcaccagctccctgccgaacaccgtcggcgggtactcgaggagtgtggtgccgccgtaggtgaacgcgttctgcacctcggaggcgtcctgcgccacgaactggaaggccgcgcccgccacgaacaccgcgcagaagatggcgcagccgctcaccaccgtcaccggcatcagcagcaccttggtcaccgtccagtgcaggtccagcgtgcccagcgcgtaccccagcaccaggagtccctgcgtgacccggcccagccggcgcagcgcgaaccggtccgcggcgacctgtgcgaggacgggtgccgggcggaccagcagcgtgtccagcgtgccgtcgcgcacccgccgccccagccggtccatcgagccgatcgcgaggtccgccagcccgaacgacgtgcccgacaggccgtacaggaaggcgatctccggcagcgagtagccgccgagcgcgtccacgcgggagaacatcagcaggatcgccacgaagtccagcgcggtcgccgcgaagttcccgaaggtggtcatcacgaaggaggcccggtaggccatcgtggagcgcagccacatcgcggcgatcatgcggtacgcgcgcaggccgttggcgacccggccgcgggacgcgggcgggtcgccaacggcctgcgc

SEQ ID NO: 1617 - DNA, 1288 bp, Unknown
  Kingdom: Bacteria, Phylum: Actinobacteria, Class: Actinobacteria, Order: Streptomycetales, Family: Streptomycetaceae, Genus: Streptomyces
gggcgcgctggccgcggccgacgacctggtcggctacaccacctacctggaccgggtgcccgtgcgcgccggtcagctccggcacggttcggacaaccgggtggaggccgagcgcgcggagttcgcgctgcaactggccctgcgcgggcggcgggtggccgtcgtgtccggcggcgaccccggggtcttcgcgatggccacggccgtcctggaggccgcctcgcagccggagtacgccgatgtgccggtgagtgtgctgccgggcgtgaccgcggccaacgccgccgcggcccgggccggcgcgcccctcggccacgactacgccactctctccctctccgaccggctcaagccctgggaggtcatcgccgagcggctgcgcgcggcggcctcggcggacctggtgctggccctgtacaaccctggctcgcgcagccgtacttggcaggtcggcaaggcccgggacctgctcctggagcaccgggcgccggacacacccgtggtggtcgcacgggacgtgggcggcccggacgaacaggtgcggatcgtacggctcgccgccctggacccggacgaggtcgacatgcgcacgatcctgctggtcggctcgtcccagacgcaggtggtacgacgcggtgacggcgaggagatcgtctggacgcctcggcggtatccggaggcgtgagccgggacgcgggacccaccggaataggcgcggcgggtcccgcgtcctgtgcgcgccgggcgtccgggacggagcggcttcagccggtggttccgggaacgggcccgccggtcagctcgccgagccggcggagcgcctgctccgggccggtggcgacggggacgccctcgggcacgggcggacggcggaccatgaccaccggcaggcccgcctcccgggctgccgtcagcttgggtgcggtggccgctcccccgctgtccttggtgacgaggacgtcgatacggtggcggcgcagcagttcgcgttcgccttccagggcgaacgggccgcggtcgagcaggacctccatgtccgccgggtgcggtggctcgggagcgtcgacggaccgtacgaggaaccacaggtcgtccagggcggcgaaggcggccaggccggtccgtccggtggtgaggaacacccgccgcccgagtccgggcagcagctccgccgccgcctccagcgaggccgcctcgtgccagcggtcgcccgcgacggggacccagccggggcggcgcagggcgagcaggggaacatgggcggtggccgcggcccgggccgcgtgga

SEQ ID NO: 1618 - DNA, 930 bp, Unknown
  Kingdom: Bacteria, Phylum: Actinobacteria, Class: Actinobacteria, Order: Streptomycetales, Family: Streptomycetaceae, Genus: Streptomyces
cccgagacctgccccccgaaccgggagtagggcacctcgcagacgcacggctacctcggcgtcagtgaaacgtcgcacaggctcactcgtcctcatgcctccgcatacgccgcagcacaggtctggccgtcggctggtggcgctcctgatcggcgagccggctcgggagcggggccgcgtgggcgctatgaaaaacatatggtcgagcactcgcgacccggacctccgaaccagccgtcccgcgcagtcccgagcgtcgacgccgacgatgcgctcgccgcgtacaacgagcggcgccgcccgctgctggacgtccaccgccagcaccgcccgctccacggcgttggcggacacctccgcccggacgatccgcgggccctgaaggagtggaacggatttacgtgcgagcccgcgggcaccgccgcgaacctcgcggaggccggctctgttcacgagagacggttctggtccaacgtctgtggtgggcctacgtccggtgaccgttgatctcgctgataggtcccgcgagaccgtctggaaactgccggtgccgaggtcgtccgggccgatggttctgggctgtgcgcgaggtactgctccggctggaagagctgctcttcttgtcggctccggagaggtccgcccgaaggtctaccgggccggccgagtgcctgagggcgggcgggatcgatccgcggtgacgtcctgccgtatccggcgagcggagacgcccttgaggctgtgtgactgatcgaacgatcggctgccgccgattacttgagaggaatttttgatcattcgatcaaatctcgatcgagctgtccatattgcttgaccgagatcagtcggtcaccctacggtgaggcaccgctcggggccgggccccgccgcaccacgcccccgtggcctgcccggccccgagcggtgcct

SEQ ID NO: 1619 - DNA, 1348 bp, Unknown
  Kingdom: Bacteria, Phylum: Actinobacteria, Class: Actinobacteria, Order: Streptomycetales, Family: Streptomycetaceae, Genus: Streptomyces
gggcgggttgccgtgcttgcgggagggcaggtcggcgtgtttggtccgcagcatgtgcagggagcggatgagcacgtggcgggtgtcggcgggatcgatcacgtcgtcgaccaggccgcgctcggccgcgtagtaggggtgcatcagctcggccttgtactccttgaccatgcgggcgcgcatcgcgtccgggtcgtcggccccggcgatccggcgccggaagatgacgttcgcggcgccctcggcgcccatcaccgcgatctcgttggtgggccaggcgtacgacaggtcggcgcccacggaccgggagtccatgacgatgtaggcaccgccgtacgccttgcgcaggatgagctggatccgcgggacggtggcgttgcagtaggcgtacagaagcttggcgccgtgccggatgatgccgccgtgctcctggtcgacgccgggcaggaagccggggacgtcgagcagtgtcacgagggggatgttgaaggcgtcgcacatctggacgaaccgggcggccttctccgacgcgttgatgtcgaggacgccggcgagcgagcggggctggttggcgacgatgccgacggtctgcccgtcgaggcgggcgagggcgacgatgacgttggtggcccagcgctcgtggacctccacgtactccccgtcgtccacgaccgactcgatcaccgcgcgcatgtcgtaggggcggttgccgtcggcggggaccaggtcgaggagttcctcgcagcgccggtcggccgggtcgtcggcgggcgcggccgggggcgcctcccggttgttctgcgggagcagcgagagcaggtagcggacctcggccaggcaggtctcctcgtcgtcgtaggcgaagtggcagacaccgctcgtctccgcgtggacgtcggcgccgcccaggccgttctgggtgatctcctcgccggtgacggccttgacgacgtccgggccggtgatgaacatctgcgaggtctcgcggaccatgaagacgaagtcggtgagggcggggctgtaggccgcgccgcccgcgcacgggccgagcatcacgctgatctgcgggatgacaccggacgccctggtgttgcgctggaagatgccgccgtagccggcgagtgccgtgacgccctcctggatgcgggcccccgcaccgtcgttcagcgacacgagcggcgcgccggccgcgatggccatgtccatgatcttgtggatcttctcggcgtgggcctcgcccagcgcgccgccgaagatgcggaagtcgtgcgcgtagacgaagaccgtacggccctcgaccgtgccccagccggtgaccacaccatcggtgtacggcttcttcgcctcc

SEQ ID NO: 1620 - DNA, 680 bp, Unknown
  Kingdom: Bacteria, Phylum: Actinobacteria, Class: Actinobacteria, Order: Streptomycetales, Family: Streptomycetaceae, Genus: Streptomyces
gccgccgtccgcgacgcgctcaccgccgcactcaccgaggcgggcacgccgccgctggtcatgtgccacatctcgcacgtctacgagaacggcgcctcgctctacttcaccgtcgtcagcgcgcagggcgaggaccccgtggcgcactgggcgcccgccaagcacgccgcgggcgaggccatcctcgcggcgggcggcaccatcagccaccaccacggcgtgggcaccgaccaccgcgacgcctacgtccgggaggtgggaccgctcggtgtcgcggcactgcgggccgtcaaacaacgcctggacccggccggactgctcaaccccggcgtcctgctgccccaggacccgccccccggcgtctgacacgccgggtccacacccccatggcccgggcttctgcccggtccacgaaaccggccgtccctgcccctgccctgcccctgccctcccttcgtcctctcttctcctcccgtccgcgtcatcactccgcccggaggctcatcgatgcgtcagttcaccgccatcgtcaacccgaccgcgggcggatcctccggtgccgccgcgctgctgcaggtgggcagggtgctgagggaggcgggcgccgggctggagacggagtacagccgcagcctcgcccacgcgcaggaactggcccggcgggccgggccagttcctgc

SEQ ID NO: 1621 - DNA, 614 bp, Unknown
  Kingdom: Bacteria, Phylum: Actinobacteria, Class: Actinobacteria, Order: Streptomycetales, Family: Streptomycetaceae, Genus: Streptomyces
gcggcgccggaagcggcgaccgggacgagcgcgtcctccaccacccgcgccgtcacaccgtcggccgctcccaccccgaccgccggccgcactcccaccccctcgcactctcctgagcgcgcacacgggccacacgacccgtcacccaccacccggcattccggacactcccgccgcgacgagcgctcctccgggtattcgatcagcctcggcagcagtggaccggacgtggcggacctccagcagagacttcgacgactcaacctctatacgggagaagtcgacggctatttcgacgcatcactcgaagtggctctgcgccgttatcaggtcgcccggtacatcccccaggaagacggcgcctacggccctttgacgcgcgccgtcctgacggccgagacgcaatgacctccggaattcccggaccagcgcaagtgcgggcagaagtgaaagcacacgtgcattttcaatgcgatagcacaagtgcaagtgcaagtacgagcgcatgtaccagctcaagcacatctgagaaaggacccccatcgatgaagaacgccgcgggaatcagagcgcgcgcgaccggcgcagtgtctctgagtctcctcctcggcctg

SEQ ID NO: 1622 - DNA, 2200 bp, Unknown
  Kingdom: Bacteria, Phylum: Actinobacteria, Class: Actinobacteria, Order: Streptomycetales, Family: Streptomycetaceae, Genus: Streptomyces
ccggtgccgtgtgtgccttcggcgtcccggagtcgccgtcgtcgcagccggtcagcgccagcgcgccggccgcgagcagtgccgcggtgccggctatccggcgcacgcgcagaagattcatcgaaaaccccacccctcacaccgccccgcgcacccgcgcgacggagatcactgacatgcaccgcacattttcaccgccttcacatctctcttacacatcggggtccggggcggggtgcggcgcaataccgaccaggcgcccgccaggtggcgggcggcctgcccgcgcgtacgtttgagcgttcgagagccgggctaggttgaggaccatggctgcaacgcacggtgccgaggtgctggtcgcttccaatcgcgggccggtttcgtacgagctgcgcgaggacggctccctgcacgcgaaacgcggtggcggagggctggtctccgggctgtccgcgatcggcccggacgcgggcgcggtgtgggtgtgcgccgcgctcggcgacgccgaccgtgaggccgtacggcgcttcgaggacggccggcgactgccggacgaggacaccggcgggcagcgggtccggatgctcgacatcgccccggacgtcttctcggacgcctacaacggcatcgccaactcggtgctgtggttcgtccaccacatgctctaccagaccccgctggagcccgtcttcgacgcggagttccggcggcagtgggcgtcgtacgaggcctacaaccgggcgttcgccgaggcgctggcggaggaggccgccgagggcgcggccgtggtggtgcaggactaccacctcacgctcgtcccgggcatgctgcgcgatttccggccggatctgcggatcgggcacttctcgcacacgccgtgggcgcccgtggactacttccggctgctccccgacgacatcgccgggcaggtgctgcgcggcatgctgggcgcggaccggctgggcttcctcacccagcggtgggcggacgccttcgcgcagtgctgcgagagcctggccggcgggctcggcggcacccgtgtcggggtgcacgggctgggcgcggacgccgagttcctgcgtgagcgctcgcaccgggccgacgtcaaggagcggatggcggcgctgcgcgaggagatcggcgccgctccggacggcggcgcgcgcaggacgatcgtccgggtggaccgcaccgagctgtcgaagaacatcgtgcgcgggctgctggcgtaccggcagctgctccaggaccgccccgagtggcgcgaacgggtggtgcacctcgccttcgcctacccctcacggcaggacctcgccgtctaccgggagtacacggccgaggtgcagcggctggcccaggagatcaaccagcagttcggcacgcccggctggacgccggtcctgctgcacgtcaaggacgacttcgcccgctcgctcgccgcctaccggatcgccgacgtggccctggtcaaccccatcagggacggcatgaacctggtcgccaaggaggtcccggtgatctccgactccgggtgcgcgctggtcctgtcccgggaggcgggcgcgtacgccgagctgggcgaggacgcggtggtggtgaacccgtacgacatcaccggcacggcggcggccctgcacgaggccctgaccatgcccggaacggaacgctccgaacgcaccggccgcctggccacggcagccaccgccctccccccggcccagtggttcctggaccagctgcgtgagctgaacgcgggctgaacgcgggctggaacggcgcccgggccgccgggcctcggcccgacggcccggacccgaccggcccggacccgacggctcagatgtgagccgccagtgccctcagcagctccaccacccccgccgggcccggcaccaccaggtcagctcgctgcgacagttcggtcacctccgtgctgccgctgcagacgaggacggtcggcaggccgtcggagcggagtttctcgagggcgccgaaggccggcaggtcgccgaggtcgtcgcctgcgtagaggacggagccggccccgaggtcgtggacgtggtcgaggacggcgacgcccttgtccatgcccggcgggcgcagttcgaggactgcgcggcccgctcgccgacctggccgcccgccacggcctgatcgtcgaaccgggccgcatggtcctcgaactgcgcccgccggg

SEQ ID NO: 1623 - DNA, 785 bp, Unknown
  Kingdom: Bacteria, Phylum: Actinobacteria, Class: Actinobacteria, Order: Streptomycetales, Family: Streptomycetaceae, Genus: Streptomyces
gacggccccaccgggccggcgccgaccttcgacaggcaggagcaggcgctgtgaacgagtcgacgacgcccgccggcccggtggggccgtcggccgcggtgcgcccggcacggccggggccgccggccgaggctcccccgccggtcccccggccgccgcccggcgcctcctcgatcccgtcgtacgccgccagggcgtcgcgcgccgcctgccgggcgctgtcggccagcgcgcccggcgcgacgatccggccgtcctggcccagacgcagcgccaggcgtctgagcgaggccggttcgggagtgcgcagcgtgatccgcagcccgccgccgggcagctcctcggcgctgtcgtgcgggtagtactcggcgacccagcggccgccggggccgacctcgacgacgacctcggggtcctccgcggcgggctgcaccagcgcctcggacaggtcgcgcagctctatctccggcggcgcggacggctcgtcgaggatcttgatctcggcgacccggtcgagccggaaggtgcggcgcgcctcggagcggcggcaccaggcctccacgtaggtgtgcccgacgctgaccaggcggatggggtcgatctcccgttcggtgacctcgtcgcgcgccggcgagtagtagcggatccacaggcggcgccgctcggagatggcccggtccacgtcggcgaagacaccgccctcggactcgaaggtcaccgagaggcgcgagctggcgcccgccgccgggcagctcctcggcgctgtcgtgcgggtagtactcggc

SEQ ID NO: 1624 - DNA, 2490 bp, Unknown
  Kingdom: Bacteria, Phylum: Actinobacteria, Class: Actinobacteria, Order: Streptomycetales, Family: Streptomycetaceae, Genus: Streptomyces
cccgcctcagggtgcccggcgcgccgcacgtccaccagctggtggaactgcggcccgccgggcaccctgaggcgggcaccgtctgcctcgtccgggccccgggcacctcgctgtccctgctcacccgggttgcgtacgcctaccgggggccgcaggccgtcgtactgctgcgcacaccgccgtacgcggacgccgccgaccccgccaccgacaccgccgtgagcgccctggccggcctcggcggccccctcgtcctgggcgcattctgcggcggcggcgaaaccgcgtacatgtacgcacgccggctcggcgccctcggcgtccgcccgcccggcgtggtcctcaccggtaccaccaccccacccgcgggtttcgcccgcacgctcgaaacggtcgccggccgcacccggtgaccgccccggccaccggccgaccgccccacctcacacctcaggagagtcatgacgacacgtctgttcacctcggagtccgtgaccgagggacaccccgacaagatcgccgaccagatcagcgacgcgatcctggacgccctgctcgcccaggaccccgcctcccgggtggcggtggagaccctcatcaccaccggccaggtgcacatcgcgggcgaggtgaccacctccgcctacgccgacgtgccggggatcgtgcgggagacgatcctgggcatcggctacgactcctcggccaagggcttcgacggccagtcgtgcggtgtgtcggtgtcgatcggctcgcagtccccggacatcgcgcagggcgtcgacacggcgtacgagaagcgggtcgacggctccgaggccgacgcgctcgaccagcagggcgcgggcgaccaggggctgatgttcggctatgcctgcaacgagacgccgagcctgatgccgctgccgatcgacctggcccaccgcctctcgcgccgcctgaccgaggtccgcaaggacggcaccgtgccctacctgcgccccgacggcaagacccaggtcaccatcgagtacctgggcagccggccggtccgcctggacacggtcgtcgtctccacccagcacgccgccgacatcgacctgaacggcctgctggcccccgacatccgcgagcacgtcgtcgagcacgtcctggaccagctcgccgacgacggcatcaagctggagacggacgactaccgtctgctggtcaaccccaccggccgcttcgagatcggcggcccgatgggcgacgccggcctcaccggccgcaagatcatcatcgacacctacggaggctacgcccgccacggcggcggcgccttctcgggcaaggacccctccaaggtggaccgctccgccgcgtacgcgatgcgctgggtcgccaagaacgtcgtcgcggcaggtctcgcggcccgctgcgaggtccaggtcgcctacgcgatcggcaaggccgagcccgtcggtctgttcgtcgagaccttcggcaccgccaccgtcgcgcaggagcgcatcgagcgggccatccgcgaggtcttcgacctgaggcccgccgcgatcatccgcgacctcgacctgctccggcccgtctaccgccagaccgccgcctacgggcacttcggccgcgacctgcccgacttcacctgggaacgcaccgaccgcgccgggcagctcaaggccgccgccgggctgtgacccccgcccgctgacagggacaggagttcccatgcgtatcgcggtgacaggctccatcgccaccgaccacctgatggtcttccccggccggttcacggaccagctcctcgccgaccagctcgctcacgtctccctctcgttcctcgtggacgacctggaggtacggcgcgggggagtggccgccaacatcgcctacggcctcgcccgcctgggcctgcgaccgctcctggtcggcgccgtcggcaccgacttcgccacctacgaggtctggctcaaggagcacggcgtcgacaccggcgaggtgcgggtgagcgacgagcggcagaccgcccggttctcgtgcatcaccgatcaggacgccaaccagatcgccgcgttctacgcgggcgccatggccgaggcccgcgacatcgacctcaccaccgtggtgagccgggccggcggcgtcgacctcgtcctcgtcgcccccgacgaccccgccgccatgctccgccacaccgcggcctgccgcacgctcggtgtccccttcgccgccgacccctcccagcagctcgcccgcctcgacggcgccgaggtccgcgaactcgtcgacggcgcacagtggctgttcacgaacgagtacgaggccgcgctcctgctggaacgcacctcctggacccgtgaggacgtgctgcgccacgtcggcacctgggtcaccacactcggtgccaagggcgcccgcatcgagaccgcggacggcgccccgctcaccgtgccgggcatcgccggcgtcgaggccgtcgaccccaccggcgtgggcgatgcccggcacggtgag

SEQ ID NO: 1625 - DNA, 3122 bp, Unknown
  Kingdom: Bacteria, Phylum: Actinobacteria, Class: Actinobacteria, Order: Streptomycetales, Family: Streptomycetaceae, Genus: Streptomyces
gggccggggcagccggggggttggccgggtcgatgccgagggccggggccacgtgctccagttcgcgcagcaggccctgggaggagcccagcgggccgccgccggcgaggagttcgtcgttggacagggggtgcgggaagtccacggggacgtaggcgcccgcgtggtcgtagtgccagaccaggtgcgactgctgtgccgtcgactcgaacatctccagcaactgctcgtagtcgccgcccagttcgtcgaccggcgtgaggggcaggccgcagagctggagcaggtgggcgcggcgcaggaagtgcagcgcgtcgtagtcgaagccggccaccggcgcgacgtccccggacaggcccggcatgtactggtacaccggcaccggcgggagcccgttctccgcgagcaccttgttgtactgcgcgagttcctcggcgaacgggttgtcgggggtgtggcacaacacgtcgacgagcggtaccagccacaggtcacaggccaaagagggctcctcactcagcgtgaagcacacgggaagcatggtggtcaacgaagggtagtcggtgcggagcgggtcggcgccccccgtgcaggcgcccctccgtgcaggtcccctacccatacccacaccccgcccctccactgcccgctcagtcggcggagagccgcttcaccagggccaggcagtgggcgttgtaggcggcgacgagcgcgcgggcggcggcgatgtcgcgctccgccagggcatcgacgagttcggtgtggccgcaccacagcacaccgcgcagatcaccgagccgccgcaggtgctgcaccgcgcacacccacacctgcactcgcagccggtgcaggaagtcggagaggtgcgcgttgccgtacagggcgctcaactcgcgccagaaccgcaggtcgtagccgatcagtacggccagatcgcccgcgctcgccgcgcgctgggcctcctcgccgcgccggcgcactccgccgagcacggccgctgcgcgcgcgcccggcgcctcccgcagaaacgcctgcacgcgggcgctcacaccggcgccacctcccgcgccgtccccggccccgacggcgtctgcgagggcccggaacatgctgtcggtgaccagggcgcgggcctcgatcatctcgcggaagtcggccgcggagtactcacgcacccggaagccgcggtgctggtcggcctccagcaggccctgcgcggacaggtccaccagcgcctcgcgcaccggcgtcgcggacaccccgtactgctcggctatctccttgaccgtgaactccagccccggctgcagccggccggccagcacctcgtcccggagcgcgtccgcgatctgctggcgcagggtgctgcgcgtcacggcgccggtgccgctgaagccgggcatggtcggggcgtctccctcacgcgtgcggtggcgtactcgtacgtctgctcgtacgggtcccgtacgtctgctcgtacgtctgtctgctcatgtgctcgtacgggtgcatgtgtacgagcacgccaccttacgcgttcgggttacgcgcgttgctcggtgctgctcagctgctccgtgccgctccgtgctccctgtgctcgtcggccacggacagggccgcgtccagagccgccaggccctccttcagctcggcctcggtcaccgtgcacggcgggacgacgtgcgtgcggttcatgttgatgaagggccacagaccgtgcgccttcgcggcggcgccgaaggccgccatcggcgcgttcgcctcgccggccgcgttgtacggcaccagcggttcgcgggtctcgcggttcttcaccagctccagcgcccagaacatgccgacgccgcgcacctcgccgacgctcgggtgccgctcggccagctcgcgcagccccggctccacgacttcggcgccgagccgcttcgcgttctcgacgatgccctcctcggccatcacgttgatcgtcgcgacggccgccgcgcacgccagcggatgcccggagtacgtcagaccaccgggataggcccgcttgccgaacgtctccgcgatcttcccggagatcgccacgccgcccagcggcacgtaccccgagttcacgcccttggcgaacgtcatcaggtccggtacgacgccggacagaccggccgcgaaccactcaccggtccgcccgaacccggccatcacctcgtcgaggatgaacacgatcccgtacttgtcgcacagctcacgcaccccggcgaggtagccgggcggcggcaccatgatcccggccgtgcccggaatcgtctccaggatgatcgcggcgacggtcgagggcccctcgaaggcgatcgtcgtctccaggtgctcgagcgcccgcgcgcactcctgctcctcggtctcggcgtagaagcgggagcggtagaggaacggcgcccagaagtggacggccccggccgaaccgtcgtcggaggcccagcggcgcgggtcaccggtgatgttcacggcctgctgcgtgccgccgtggtacgaccggtacgccgacagcaccttcggccggccggtgtgcagccgcgccatgcgcaccgcgtgctcgaccgcgtcggcgccgccgttggtgaagaagatcttgtccaggtcgcccggggtccgctcggcgatcagccgcgccgcctccgagcgggcctcgatcgcgaaggcgggagcgaaggtggccatggtcgcggcctgctcctggatcgcggcgacgaccttggggtgctggtagccgatgttggtgaagacgagcccgctggcgaagtccaggtagcgcttgccgtcgtagtcccagaagtacgacccttcggcaccggccaccgccggcgggtcgatcaggtcctgcgcggaccaggagtggaacacgtgcgcgcggtcggcggccttcacggcggcaccggcctcggggctcggctggagggtcccgcgggcgggggagggctgaggggtcatacgccgagcgtagaggggcggccggcggagccggtatcggcgccctgtctgcgggagcggggaattgacgacaggttgtcgacgcgtggttgccggcggcgcccggcccgcccgctgttacggaaccgtagacagcgggctgctgtccgccc

SEQ ID NO: 1626 - DNA, 2132 bp, Unknown
  Kingdom: Bacteria, Phylum: Actinobacteria, Class: Actinobacteria, Order: Streptomycetales, Family: Streptomycetaceae, Genus: Streptomyces
gcccctgatccgttcactgctccgggccggatgatccgttcactgctccgggtcggacgagccgggtgagtccggcggctcgtcccccggttccgtgtccgggccgtccccgccgttcctgtcgtccccgtcgtcggtctccgccccgggccgcagcggcttcggcggccgggcgcgtccgccgggaccgtcccgcaggaacgagccgccctcgccgccgtccgccgtcccgtgcccgccggacgacgggccgccaccgtcccggcgccgcagataccgctcgaactcgcgggcgatcgcctcgcccgacgcctccggcagctccgcggtgtcccgggcctcctccagcgtctggacgtactcggcgacctcggtgtcctcggccgcgagctggtccacgcccacctgccaggcccgcgcgtcctccggcagctcgcccagcgggatccgcaggtcgagcaggtcctccaggcggttgagcagcgccagcgtggccttcgggttgggcggctgcgacacgtagtgcgggaccgccgcccacagggagaccgccgggacgcccgcgtgcgtgcacgcctcctgcaggacgcccacgatgcccgtggggccctcgtacttggtctcctccaggtccatccggcgggccaggtccgcgtcggacgtcgtcccgctgatcgggaccggacgcgtgtgcggggtgtcgccgagcagggcgcccaggacgaccaccagctccacgcccagctcatgggcgaaaccgagcagttcgttgcagaacgagcgccagcgcatggacggttcgatcccgcgcaccagcaccagatcgcgcggtttgtccccgccgatccggaccaccgacagtctggtcgtcggccaagtgatcttccgcacgccgccgtccatgaacacggtgggtcggttcacctggaagtcgtagtagtcctcggcgtccagcgccgcgaacacctcgcccttccactccttctccagatgcgcgaccgcggtggaggcggcgtcgccggcatcgttccagccctcgaacgcggccaccatgaccgggtcgatcagctcgggaaccccctcgagctcgatcacccagcgcctccttccgacgtgccctcgcttgacccaccaaccttacggcgtgcgacgggggcgaccgcgacccccttgcacgggggagtgaacgcatcactgccccgtccgaggcactcgaacacccatggtcaccggcgctgtccgcccggcccgaggcggccacacctccgacggctgccccgcgtcacggcgttctcacagcgtcgagcgcagccactgctcgacgctcgcgatgtgcaccgtcgcccaggagcgggccgcctccgcgtcccggtcgcgcagcgcgccgaggatcgcccggtgctcgcgcagggtccggccgacggcgtcctcctgggtcaggccgcgccagatcctggcccgcgtggtgggcccggacagcccgtcgagcagggagcacagcaccgagttgcccgaactgcccacgatgccccggtggaactccaggtcggcggcgaccagttcctccaccgaggggctgccgccgagcgcgtccaactgggcttccagcgcgctcagtcgcggctcgtcgatgcgcgaggcggccagcgcggtcgcggccggctccaggatgcggcgcacggcgaggaactccagcaccgtgtcgtcgcggtggaagtcgacgacgaagctcagcgcctccagcaggagttggggatccagactggtgacgtacgtgccgtcgccctgccgcacgtccaggatccgcatcagcgacagcgcgcgcaccgcctcccgcagggagttgcgcgacaggcccaggtcggcggcgagttcgctctccttgggcagccggtcaccgggccgcagcgcgccggagacgatcatccccttgatcttctcgatcgcctcgtcggtcactgccatgctcggcctcctgccgcccctgggacacagacatgggatgtgtcggcggccattatgcgacccggtcgccgccccacgacccggccgccgctccacgacctggccgccgctccacggcccgggcggcgccaccccggacgcggcgacaggcggcgggggcgggcccg

SEQ ID NO: 1627 - DNA, 1942 bp, Unknown
  Kingdom: Bacteria, Phylum: Actinobacteria, Class: Actinobacteria, Order: Streptomycetales, Family: Streptomycetaceae, Genus: Streptomyces
acgccgtccaggatcaccggcagcttgcgcaccgcgcactggagcaggaagccggtcatcgcggccaggtcggcgccgcccaccgccgccagcagcgccagctggtccccgagcaccggccgcgcccggcgcagcgcgtcccggatcgcggcgcacttgcgcatccacgccaggtcgtcgatcgcctcgccgccccggccggtcaccaccgacgcgtccgtcccgcacagcgccgcgatcagcacggccgccggagtcgtcccgcccacgctgatgtcgccgagcaccaccaggtccgtaccggagtcggcctcctcgtcggccaccgcgaccccggcccggaacgccgcctcggcctcctcggcggtcagcgcgtcctcgatgtcgatgcgcccgctgccgcgccgcacccggtgccgtacgacgtcctcgggcagcgtcccgggcgcgcagtccacggccatgtccaccacccgcaccggcacaccgtgccgccgcgccagcacggacaccggccggccgccctccaggacagcgcgcaccaactgctcggcgccgcccgccggacgggccgacacgccgagttcggcgaccccgtggtcaccggcgaaaagcacgacccgcggccgttcgaccggccgcaccggcacgacgccctgcgccgcggccagccactcacccaggtcgtcgaggcggcccagcgcaccgggcggcacgacctgacgctccctgcgcgcctcggcgtcacggcgcactccgccgtcggggcgctcgatcagatcggtgaagtcgtcgagattcagcgagctcattcgccgaacagtaccggcccccgtcgaacacggcggagccacgtccacatgtcgccgcaacgccagtacggcctgtgctccgtcccgcccgttgcggcacgccgccgccacacccgtacggcctcttcccgcccgcgatgcggatcccatacgttccctttgcacctttacggggaattgtcgacgcggccggaccatccgcccgcccggccgctccccgccgtacgccctctcgcccaccgggagccgcccatgccgcccctgccgtacgccccgcgcgtctacgacccgcgccgcatcggctacgccgccgaactggcccagggcaccgaccggttccacgaaccgcgccgcgaggactgcccctggtgcggttcggcccggctgcgcacccggctgcgcgcccccgacctgctccagcgcaagccgggcaggttcgcactcgaccagtgccgggactgcggccacgccttccagaacccccggctcaccccggcgggactggccttctaccaccgcgacttcgacgagagcgacccggacggcctgcccgacccggtgctcgccgcgcgccgcagccaccgcaggcaccgctgggacgcccgcctgatgcggaacgtgggcgagccggagagctggctcgacgtcggcacgggccacgcccacttcccggcggcggccaaggaggtgttcccgtacacctccttcgacgggctcgacccgacaccccgcgtccaggccgcgcgcgcggccggacggatcgaggaggcgcacgtcggacacctctccgacccgcaggtggccgaacgcctgcgcggacgctacgacgtcgtcagcatgttccaccacctggcccacgcccccgacccccgcgccgaactgcgcggtgcgctcaccgcactgcgtcccggcgggcacctcctgatcgaactgcccgacccgcgcagcgccttcgcgctgctcctcggcaagtggtggctgccgcacgggcagccgcgccacctgcacctgccgtccctgcgcaacctccgcgccgaactggagtcggcgggctgcacggtcctcgtcaccgaccgccgcaccccgcacacaccgaacgacctctcggcggccctcgccctggccctcgc

SEQ ID NO: 1628 - DNA, 531 bp, Unknown
  Kingdom: Bacteria, Phylum: Actinobacteria, Class: Actinobacteria, Order: Streptomycetales, Family: Streptomycetaceae, Genus: Streptomyces
gggcggcagggcatcgcggcgggatttcgcttgcttaagtcaatcaagtccaattatcgttgcttgagtcaagcaccgctgcccacccatgccctcgacggagacctcttccatgtccgacggacctgcccggcccaccgcggccgaggccctgcccagacccaatgccatcgtggccgtcctggccttcggcggcatcgtggtctcgctgatgcagaccctggtgatcccgatcgtctcggagctgccgaagctgctgcacgcctccgcttcggacgcggcctgggtcgtcaccgccaccttgctggccgccgccatcgcgacccccgtgatgggccgcctcggcgacatgtacggcaagcgccgcgtactgctgctcagcctgggcatgctggtggtcggctcggtcaccgccgcgctcagcgactccctggccccgatgatcgtcgggcgtgccctgcagggcctggcctccggtgtgatcccgctcggcatcagcatcatgcgggacgagctgcccgccgagcggct

SEQ ID NO: 1629 - DNA, 1922 bp, Unknown
  Kingdom: Bacteria, Phylum: Actinobacteria, Class: Actinobacteria, Order: Streptomycetales, Family: Streptomycetaceae, Genus: Streptomyces
cgccgtccggtgcgcctggccgggctgcgggtggacgtcgcctatctgcccgccgagtccggtacgcatgtcggcggcgactggttcagcgcgatcgaactgccggacggcgacgcgctgttcgtggtgggtgacgtcgccgggcacggcatcgacgcggtcgccaccatggcgatgctccggttcaccgccaagggcatgatcttcaccggctcgtccctgaccggcgcgctggcccgcctcaacacgctgctgctgcactcccgtgacaccaagggcaccgccaccctcgtactggggcgctaccgggcggccgaacgccggctcgtgtgggcgcaggccggtcatctgccgccgctgctgctgcgccggggtgagtcccgttatctgaagcgcccgttcggggtgctgctcggcgcgacggagtcacctgacttcgcggaggccgagttcctgctggagcccggggaccggctgctgttctacaccgacggtctcgtcgagcggcccggtgaggacatccaccgcggcctggaacggctcgcccgcacggcacgcgccctccccgccggcgcgcgcggctccctggtgccgctgctgagcgcgatgctggagggcgaacggcgcgacgacgtctgcgtcctggacatccgcgcgccgggcgaaccggcgtagccgcaccccaccgcggcggggtgttcagtcggcggggtggcccggggtgatgtccagcgcgtccgacaggcgcagcagcggaccgtccggtccgccccggccgcccgagtcctccgggtcgaggacgaatcccacgtggtcgccgccgtcggtgcgcaggacgacgcgtccgacgaaccaggcgggcgcgtcgtcgaggacgacggcgccgtccggccgcggcgtgcagcggacgccggcgaacttgtccacgccgtcgtcgcccgtgtgcccgccgaacagctcggccagcgcgtgctgttcaggggtcagtacgtgcacggcgagccggccggcccgctccgccacccggtaggtccggttcgccttggacagccacaccacgaacctgggcggaccgatggaacactgcgaggcgaatccgaccaggcagcccgcccgctctttgtccgcggtggccgtcaccacgtacatgtcggggtccagccggccggtgaacgcgtccaagcccttcatcccgtaccacttccccgcttcgtgacctcgtaccgcgtaccccacgtcgcgccctcctaccgtgagcgtgccggcaccgcagggaactcggttccctcctggtgctgcactgagtgccttctcaccggtcagaggtgctacgttcccctccatgagctccaggagcgcggtgcccggccgcagcgagaaggcgcgggtgcccggcgcgaagacgcccatgcgggacgcgctggtggcggcggcgttccacctgttcctggaacaggggtacgagcagacgactgtcgacgacatcgtggccctcgccggggtcggacggcgctccttcttccgctacttcccctccaaggaggacgtggtcttcccggaccacgagcggtgcctggccgacatgacggccttcctcgccgccccggacgagcacgacgacccggtccgccgggtctgcgacgcggcccggctggtgctcctgatgtacgcggagaacccggtgttctcggtgcagcgctaccggctgaccaagcaggtgccggggctgcgggcgtacgagctgtcggtggtgtggcgctaccagcgggccctcgccgggtacctgcgcggccggttcgccgagcgcgacgacggcacgctgcgggcggacgtgatcgccgcggcggtggtcgccgcgcacaacaatgccctgcggtcgtggctgcgttcggacgggcgcggtgacgcgcgcgcggcggtgg

SEQ ID NO: 1630 - DNA, 946 bp, Unknown
  Kingdom: Bacteria, Phylum: Actinobacteria, Class: Actinobacteria, Order: Streptomycetales, Family: Streptomycetaceae, Genus: Streptomyces
cggcaagcaactgctggtcccggaccgcgagctggacggcaagcgcgggtactacgtcctgacgctgctgcgcaccgactccggcaaggcgctgcccgtcgtgcgcggctggcagccgggcgacgccgactcggcgaaggcccccgcgccgcccgccggcgaggtcaccgtcaccggtgcgctgcaggcctccgagtcagccagtgacagcaacgtcggcgcgcaggggggcctgccgtccgggcagaccggcgcgatcagcgcggcctcgctggtcaacctcgtgccgtacgacgtgtacgacgcgtgggtcacgctggacaaggccgactccgggatgaaggcggtgcccgcgaaggcgcccgagggcagcggcctggacctgaaggcgttccagaacctcgggtacaccggtgagtggttcgtcttcgccgggttcgtggtcttcatgtggttccggctggtgcggcgcgaggtggaggcggcacgggacgccgagctcggcctgacgcccggtgaccccgaggacccgcagggccccggcggaccgcaggaggaacacgccgccacggtgtgaccccggcccggtcggaccggttccgtccgcaccgtgctcctcgtcggccccgcaggccccaccggccccgcaacgccccgtcggccccgccggtcccgcggggtcgtcttctacggcgtggtcgccagcactccggtccggtagaccgtgcccgcgcaggcgtccgggaccgtcaccgagacggtcggtgaaccggcctccggggtgtgcgagaccacgacgctgccgtccgccttgccgctgtcctccgcgaccagctgggtcgtcgttccggtgccggtcgcggtgtcgctgcccggggccgcgccgcccgacgcgctcgcctcctggctcggagacgggtcggacgtggggttgccggtctcggtg

SEQ ID NO: 1631 - DNA, 2997 bp, Unknown
  Kingdom: Bacteria, Phylum: Actinobacteria, Class: Actinobacteria, Order: Streptomycetales, Family: Streptomycetaceae, Genus: Streptomyces
gcccagcacagccgtcgcggcgaccccggtgagcgcggccggcgtccccgcctcggccgtccagcgcgcccgttcgcgcagcagccgcaggacgaagtccgcggccagcgcgagccaggcgacgcaggccacggccaggacggcgagggacagcacctcgtagcccgtcagctgcagcccgatcgacacgatgccgctggccatcacggcggccccggccgcgggcggacgctgcgccagccaggcgcgcagaggtgaggtgacgggcatgatcccgatgctagatcccggtgcgtcgtgcgagcgggggcacgcgcgccggtgcgcaaaaccgccggcggcgcgcgtacctgtggccggcgggatcgggtccggccggtgaaaccggtcacgtttccagggcggccccgggttgtcggtggggagccctagactcgtagagcgatgagcagcctctttgacgacagcttcctggcggacctccaggccccgcggggccacgaggaagagcccccgccgccccccgaggacgaacacgctccggaaccggttccggacgatctgttcggcgggaagttcgacctgccgccggacccgggcacccacagggacgcctactaccgcgacggcgccccgcgcccggtcgtggacccggccgcgctcctggacgggctgaacgagaaccagcgcgccgccgtggtccactccggctccccgctgctcatcgtggccggcgccggctccggcaagacccgcgtgctcacgcaccgcatcgcccacctgctgggcgagcgcggcgtccaccccggccagatcctggcgatcaccttcaccaacaaggccgccggtgagatgaaggagcgcgtcgagcagctcgtcggcccccgggcgaacgccatgtgggtgatgaccttccacagcgcgtgcgtgcgcatcctgcgccgcgagtcgaagaagctcggcttcacctcgtccttctcgatctacgacgccgccgactccaagcgcctgatggccctggtctgccgtgatctggacctggacccgaagcgctacccgcccaagtccttcagcgcgaagatcagcaacctcaagaacgagctgatcgacgaggaggacttcgcggcgcaggccaccgacggtttcgagaagaccctcgcccaggcctacgccctctaccagtcgcggctgcgcgaggccaacgccctcgacttcgacgacctgatcatgacgacggtcaacctgctgcgcgccttccccgacgtcgccgagcactaccgccgccgcttccggcacgtcctggtcgacgagtaccaggacaccaaccacgcccagtacgccctcgtacgcgaactcgtcggcaccgccgagcaccccgtggacgtaccgcccggccccgacgacctgcggcccgccgagctgtgcgtggtcggtgacgccgaccagtcgatctacgccttccgcggcgcgaccatccgcaacatcctccagttcgaggaggactacccggacgcgacgacgatcctgctggagcagaactaccgctccacgcagacgatcctgtccgccgccaacgcggtcatcgagcgcaacgagtcccgccgcccgaagaacctgtggaccaacgcgggcacgggcgcccggatcaccgggtacgtcgccgacaccgagcacgacgaggcgcagttcgtcgccgaggagatagaccgcctcacggacgcgggcgaggccaaggccggggacgtcgccgtcttttaccgcaccaacgcccagtcccgtgtcttcgaggagatcttcatccgcgtcggcctgccctacaaggtcgtcggcggtgtccgcttctacgagcgcaaggaggtccgggacgtcctggcctacctgcgcgtgctggccaatccggaggactccgtcccgctgcgccgcatcctcaacgtgcccaagcggggcatcggtgagcgtgccgaggcgatgatcgacgcgctctcccagcgggagaagatcagcttcccgcaggcgctgcgccgtgtcgacgaggcgtacggcatggccgcgcggtcgacgaacgccgtcaagcggttcaacacgctgatggaggaactgcgcaccatcgtcgagtcgggcgccggtccggccacggtgctggaggccgtactcgaacgcacgggctatctggccgagttgcagtcctccaccgacccgcaggacgagacccgcatcgagaacctccaggaactcgcggccgtcgccctggagttcgagcaggggcgtgaggagggcgagtcggtcgcgctgtccgagttcctggagcaggtcgccctggtcgccgactccgaccagatccccgacgaggaggacggcgacggcgtcatcacactgatgacgctgcacaccgccaagggcctggagttcccggtggtcttcctcaccggcatggaggacggcgtcttcccgcacatgcgcgccctcggccaggtcaaggagctggaggaggagcgccgcctggcgtacgtcggcatcacgcgcgcgcgggagcggctgtacctgacccgttcggcgatgcggagcgcgtgggggcagccgtcgtacaacccgccctcccggttcctggaggagatccccgccgtgcacgtggactggaagcggacgggcggctccgcgccggtgccctccggcccggcctccggggtggcggcctcgttgtcgtcgtcgcgttcacgttcgtcggcggccggtgcctcgggcttcgccacccggcgcaccgcggagaagccggtggtgtccctcgccgtcggcgaccgggtcacgcacgaccagttcggtctcggcacggtcgtcgcggtcaagggcaccggcggcaacgcggaggcgacgatcgacttcggtgacaccaaaccgaagcggctgctgctgcgctacgcgccggtcgagaagctgtagggcgggcgggcgccgggcaccggccgggcggccggcgcgggccggtccctggtggggctc

SEQ ID NO: 1632 - DNA, 6774 bp, Unknown
  Kingdom: Bacteria, Phylum: Actinobacteria, Class: Actinobacteria, Order: Streptomycetales, Family: Streptomycetaceae, Genus: Streptomyces
cgccccgcgcaccggcagcgtccggccagcggccgtacgtctcagcatccgaaccgccttggacgcccgtggccgccgcggcatactggtcccatgctcacgcactcgacgaccttcgtctttacctatggcatccggcccgccggctgccatggtcgtgctgcttgagctactgacaagcgacttcccaggcgccccgggccgacaaggcccggggcgcctgtcgtttccggtccttgccgctccggggcaccgcacccgccttcccgtgaggagcccgcgagatgaccgccagcgcagcagagaagaccggtacgaccgccaccgccgccgagaggaccggcgcccgtaccgacgaggccgtgagtgtcatcacggacgcccgtgaacgcatcgacgcgctcgacgaccggatcctgggcctggtccaggaacggatggccgtgtcggccgtcgtccaggaggcccggatcggttcgggcggccggcgcgtcaacctctcccgcgagatggagatcctcggccgctaccgggacgccctcggcaggccgggcacggccctggcgatgaccctgctggagctgtgccgcggcaagatctgacccgcgtacgcgcgccgctcccccaccccgcgccaccccctcaccggacacgactcacccgtcacaagtcacacggcacaggtcacccgacgcaggtccctcacccgtacgggcctctcacccggacggtgcgtgaccgtcgtgggcgcagcgtcgtttgacgggatggccgtgccagccagggacgggaccgagaggaccacgcgtggctctccggagcggtgagacgtgcggatcgtgccgtacgtcgtgggaccccgctccggggaagtgaccggacggcaggggacagcagcccggtcaccaggtgacggccggctccggggacgcccggagccggccgcgctcttcccgcgggatgccgggggagcacctgagcccacatcaggcaacgtgacgcaggacacatgaagatggtgtgagaaaccgcgcaaccattgaccggggcccggggtcacaccagcggaacccacggccgtatccgcgccccacagcggaggcctcccgcaacctccgtgctgcgtttcaccgcagcacgccggacttcccgaggtcttcatgaagcttcgccgcgccctggcagccgccgccgcgacgaccgcgatagccccgctggcgctcctgtcggctcccgcagcgttcgccgcggaaccgaccggcgcctcgacgtccgcgtccgcgcccgcctccgagtccaccccgccgggcgcaccggagtcgactccggccggcagcaccaccgagtccaccgcgccctccagcccggccgaggccaccccgtcggccggcgcgtccgactcggccccgccgtccgactcggcctccccgtctgcgtccgcatcggcatcgtcctcgccctccgcttcggcttccgtctccgcctcggcgagcgagccgggcgagccctcggccgagcccacgccctgcaccgaggacgacgtggactccgactcccagctgacgatcgcggtctccggtctgcccggcaagatcgtcgcgggcagcggctggcacgccttcaagctcaccgcggccaaccacagcgaccggccgctgggccaggtgcagtggctcgccctcatcgacaacgactcgatgagcgacaacgagaaggactggctgagcacctacgcgctgctcgagtacctcaacccgacgaccaagaagtgggagtccctcgcggaccaggtcggagggggcatctacttcggtgagacgccgctcggcccgaagcagacggtcgacatccagctgcgcgtgaacatcaccgcgaaggcccccgcgggcgacggctacaccgtgggcctgggcggatacgtcgaccaggagaagaactgcgtccacagcgcgttcgactactacacgttcaccgtgctcaagcccggcagctccaacgacaaccccggcgacgccaagccctcggagggtgacaagccctccggcggcaagcagccgcagggcggggccgagaagatcccgcccaccggcagcctcgccgagacgggctccagctcgatggtgccgaccatcggtctcgtcggcggcgtagcggtcgtgctcggggcgggcgcactggtcgcggtgcgccggcgcaagggcggtgcggacgcgtaaggcgatccgccgcccagcggaacgagaaggacctgcgccaggaggggggcgcaggtccttcttcgtttcccctgctgctgcctccgctgagccttccgcttcggcggcttctgcctcagcggccgctgcttcggctgcttctacttcttcttcggcggccgctgcttcggctgcttctacttcttcttcggcgacttctgcttcggcggcaccgtcggtatgccgacgaacggcaggcgcagggcgccgaacgcgtccgccgggaccaccgggttgcggggttccaccggcttcagccgctcgtaggccgcgccctgcgccggacgcgggtccgcctcgcccttgttcggccagtacgacatcgcccgctcggcctgcgcggtgatggtcagggacgggttcacgccgaggttcgcggagaccgccgcgccgtcgacgacggagatgccgggatggccgtagaggcggtggtagggatcgatgacgccggtctcggacgagtcgccgatcgggcagccgccgaggaagtgcgcggtgagcggggtgcccatcagctcgcccacgttggacccggcgaagccgttgatctcggcggcgagcgcggaggcgccctcggtggcggccctgatctgcttggggttgggcgagccgtggccctggcgggcggtgagcaggcccttgccgacgccgtcctccttcaggtacgtcgtcagggagttgtccagggactgcatcaccagcccgatgatcgtccgctccgaccagcggcggttggacagggagcgcaggacgagcatcggatggcgggcggcgttcgccagccaggccgcgaccctggagccgccgtccgtgaacggcacctggaggatggacagtccgcccatcgagttggagcccttgccgtaacggacgggctcgatgtgggtgttctcgtccgggtggatggaggaggtgatggcgacaccgcgggtgaagtcggcccggggccggccggtcgccgcccggtagcggcggttgtcggtctgcgcgcccaccagtgcctcggagttggtgcgggtcagctcgccgagccggtccgagaggtggggcagctgacggcccgccttcatgcggtgcagcagggtctgggtgccgtaggtgccggcggccaggaccacgcgccgcgcggtgaggatgcgtcccgcgcccttcttcttgttgtcggtcggcagcgtggccaccgcgtagccgccgcgtgagtcgtcggtgaccgagacgaccgtcgtcatggggtggaccaccgcgcccgccttctcggcgaggtgcaggtagttctcgttgagggtgttcttcgccccgtgccggcagcccgtcatgcactcgccgcactcggtgcaggccttgcgggccggtccggcgccgccgaagtacgggtcggcgacctggctgcccggcttggccttcgccgtgccgtcggcgtcctcgccgtccccgaagaacaccccgaccggtgccatgtggaaggtgtcgccgacgcccatgcgctgcgccgccgccttcaggtgcacgtcggagggcgtcatcgtcgggttgagccggacgccgagcatgcgcttggcctggtcgtagtacggggcgagttcctcctgccagtcggtgatgtgccgccactgcgggtcgtcgaagaagggcttcggcggtacgtagagggtgttggcgtagttgagggagccgccgccgacgcccgcaccggccagcaccatgacgttgcccagcaggtggatgcgctggatgccgtacatgccgagcttcggggcccacaggtagttcttcaggtcccaggagttcttcggcaggctctcgcgggtgaagcggcggcccgcctccaggacgccgacgcggtagcccttttcggtcaggcgcagcgcggtgacggagccgccgaagccggagccgacgacgatcacgtcgtagtcgtacgccgcctcgtcgtacgccgcgtcgtcctgctcagggacagagttctcctgcgacacgtgctctcctcgtcgagaacgggtgtggtctggtcgagaacgggtgcggccccgccggaaacgggaccgggtggggcctaacggaacctgagggtcttcagggccttcaggctccggctcatgaacgccgcgtacgccgcgtcgtccatgccgagggacggggccatgggcagcagccgctggtgggcgatggtctgggcctcggtgtacttgaggatgccctcggagccgtgccggcggccgagaccggagtccttcatgccgcccatgggcgactggacgcttccgtaggcgggcgcgtagccctcgttcaggttgaccgtgccggtgcgcagccgggcggcgatcgcgcggccccggcgggcgtccttcgtccatacggacgagttgaggccgtacggcgtggagttggcgcgctcgaccgcctcgtcgtcggtcgcgaagcggtagacggagacgaccgggccgaacgtctcctccgtgcacaccgccatgggggcctcgacgccgtcgaggaccgtcggctcgaagaagtacgggccgacgtccgggcgggcgacgccgccggcgagcaccttggcgcccttggcgacggcctcctcaacgtgccgggtgacggtctccagctggcgctcaccgaccagcgagcccatgtcggcgccgtacgcgagcgaggcgccgagccgcatggccttcgtacgggcggtgaagcgctccaggaaggcgtcggcgacggcctcgtggacgtacagccgttcgatggagatgcacagctgcccggcggaggagaagcaggcgcggaccgcgccggccgccgccttgtccaggtcggcgtcctgaaggaccagcatggcgttcttgccgccgagttcgagggagacgccgaccaggcgggccgcggcgccctgggcgacctcgcggccggtgcgggtggagccggtgaaggagacgtagtcggcgtgctgcacgaccgccgggccgaccaccgggccctcaccgatgacgacctggaacacctcggcgggcagcccggcctcgatgagcaggtcccgggcccacagggcggtcaggcaggtctccgtgtccggcttcatgaccaccgcgttacccgcgacgaaggcgggcagcgcgtcgccgacggacagctccagcggatagttccagggcgcgatctggccgacgacaccgcgcgggtggcgcagttcggtgaccttggtcagggtcgggatggcaccggtgtgccgcttcggccgcaggtacgcggcggctcggcggccgtagtgccgggcggcgacggcgacggcctgcacctcctcgtgcgcgtgcaggcgtgccttgccggtctccagctggatcaggtcgaggacctcggcctggcgggcgagcaccaggtcgtggaagcggagcaggacggcggcgcgccggcgtaccggcgtccgcgcccagacgtcctgcgcggcccgggcccgctcgaaggcttgggcgacgtcctcgggcgtggactcgggcaggtcggccagtttcccgccggtgaacggcgtgtggtcggcggtccggccggatcccgcgacgcccttggtgagccgggcgaccagctcgggggtcaccacgtcggcggcggtgcgggcgcccgcgggggcgggggccagaggattcgtgccggtctgtgccggggcctgcgcgtccgtcatgcagcgcagcgtatgacgtgtccgggggtttgtgtacccgtcggtaacggggattcaccgagtgcacacatgacgccagcgaacactggcaacgaacgcgctgatcaggggccttccaccgagcgcgcaactccgccgcgcgggccgtgggtgatgggtggccggccggcgtcggcgtacccgaaggggcggcccggccgggctcacaaccggtcgaccgccaggttggcgatcgccgtcttcgccacctcccggccgcgctcgacgaagtcgcccttgccggggtagccgacggtgagccggtacatgttgccgtcggtggtcttgtagtagaagacgcgcacctcgcgcgggcgggggtcctgcgtgtcgtcggtggtgtagacgaccgtgttcccggcggccttcctgccgtggaacgtggcgttgccgtcgggcgaggtcttcgcctccgacggcatgtcgagcccgtagtcgccgcgcttcttgaagtcggcgtcgtcctcgtacatctgggccgccgccgagcccgcgatgtcatggctcttgtcctccgactgcttcgccagtgccagggtgacccagacgctgccgctccagtcggtgtaggtgacccagtgcttgtcgtccgtcttccggtcgggcagggagcgctggtagtcggcgggcacggcgagcgtcgcggcgacatcgccctcgtggtgggtcgcccagccgtccggcagcgggcccgcgaacggccgggcgaccgcgacgtacgcggccaccgcgcccacgacgaccgccgcgccgagcccgagccaggccttgcggcccagccgcggaacccgtccggctcccgctccctgccgg

SEQ ID NO: 1633 - DNA, 2262 bp, Unknown
  Kingdom: Bacteria, Phylum: Actinobacteria, Class: Actinobacteria, Order: Streptomycetales, Family: Streptomycetaceae, Genus: Streptomyces
cggaccgcgctgctgctggccctcggggcgggcgccgccatcgccctccagctgatctgtctgcaccaggcgccgtccgacagcggcgtcgccccgctgatcaccggcagggcggtgtcctcggccgtcaccctgaccgcggccgggatgctgcgccgcaggctgggcccggagaagcccgcctacgcgatctcggcggccgcgggcgtcctggactcggtcgccaacctgatgttcctgctcgcggcccgcagcggggacctcaccgtcgtagccgtgatcaccgctctgtacccggccggtacggtgctgctcgcccgcggtgtgctcgccgaacgcatccaccgcggccagctcgtcggcctgggcaccgccgccgtcgccgtgagcctcctcgccctcacctgaaccggcgcacgccccttcaccgacacctacggagaaccgcatgttcatccagccctgggacgccgccctggacgacgccgagtggcagacgtggatcgccgacggccacgacttcgggcagctcgccgtcaacgggccgtccggccaggcgcccctcgtcgtccccacccacttcaccaccgacgcgggtgacctgctgatccacctcgcccggccgaacccggtctgggcggcgatcgagcacgacccgaacgtcaccttcaccgtcatcggcgactacgccttcatccccggcccctggcgcgccaagcccggcacgccgcccgccgaaggcgtccccaccagctactacgcggccgtccagttcacctgccgcgcccacatcgtcgacgaccccgaggccaaggccgcgctgctgcgccaccagatggcgcacttccagcccgagggggaccacgcacccgtcgaggccggccgcgcaccctacggccgcatgctctccggcatccgcggcctgcgcctggaagtcggcgacgtacgggccaagttcaagtacgacgaccacaagcccgtcgagcaccgcaccgccgtcgcggaccgcctcaccgaacgcggccagggcctcgacgcgcccgccgcccgcggtcaactgcgccgcctgggccgcgtaggcctctggaagccctgacccgcctcacggggcacgtcggccgggtgaccgggtgggcggcgcctgccggtggtccggcgagacgtgtgtctcagacgtatgcgaggagacgttccagaggccggggcacgcgctcggcgggcaggtgctcgaccagggcccgcgcgtagagtgccttgcgaccgctgtgcgtgcccatgaaacgccgcagttggtgttccacgggccgctcccgctgggccggctggccccggaaggtgcggaaggggcgcgtctcgccctgggcgtcgatcacctgccgcaccccctcggccccgagagcgcggatcagttcgtcctccaggtcggcgacgcacacgtggaacccgagcgcctccagcccggcgggcccgggaccggagctgagcccgacccgctccagatggcgccggaaatgccgctcctcgccgatgtcgcagagaccggccagcggcagaccgagccccggcgggccgcacacgtcgaggaaacgcccgatgctcgtcgcaccgccgagcggcaccaccgcgacgccctcggcgtcgaggccccggccgtgccgcgtggccagcgcctccagcgcgacccggtcactgctcccctccacgagcacgaccgtccgcacgccgccggccagttcccgcgccgccgcggctgccgcgtccgcccccgctccgccggccgcccatacggctgccgcatggcggaatcgccccaattcgtccacgagacctcgcttcccgccgccatcgtgacacggccgagatcccgtacgcacacacgttttcgggcgctcacgccccggccagtgaatcgacgagcgccagggcgtcgtcgacggaacccgccgggtcgtcgagcggatacagcacgccgcgcaccgtgcgggaggagtcgaggacgagggtgagccgcttgagccggtccacgcccgccgcgcggaaggtgggcagccgcagcgccgcggccagttgcagttcggcgtcggacagcagcgggaaggcgatccgctcgtgctcggcgaacgcggcgagctggtcgggccgctgcgtgctgacgccgtgcacccgtacgtcgcgctccgcgaagtccgccatccggtcgcggtaggtgcacgactccagcgtgcagccgagggtgccggggatccggtcccagcccggcgg

SEQ ID NO: 1634 - DNA, 1324 bp, Unknown
  Kingdom: Bacteria, Phylum: Actinobacteria, Class: Actinobacteria, Order: Streptomycetales, Family: Streptomycetaceae, Genus: Streptomyces
tcgcggacgtcgacctgctggcgcggctccaactcgccgcccggcgggcaggcggacgcatccgcctgcgcgaccccgacccggcgctacccgccctgctgaacctcgtcggcctcgccttcgaggtggagggggagcccgaagagcgggaaccaccgctgggtgtccaggaagcagtggaacccggcgatccggcccgctgagatctccagcacctgcacggcccacggcgcgtagccgcccttgtcggggtccggcttgtactgggcgaaggcgggcaggccgttggcctggaccggcaccagccgggagttcgcgcaggccgcgcccatcgtcgccatgaagccggtgatgtccgccggacccgtcagccacaggtcgaacggcggcatcgtcatgatcgcgtcctcgtgcagcaacgcggtcagcgccgtcatgtcgtacccctcgaacgccttcacatagcgctccagaagcttctgctgctcctcgtccaggggatcggagacgtcggcgcgggcacccgcgtcctcgcgctcggcgagcgtcgcgcgggcccgctgcagcgcgctgttgaccgaggcgaccgaggtgcccagcagctcggcgacctcgcccgccttccaggccagcacctcgcgcaggatcagcaccgcgcgctgcttgggcgggagctgctggagcgccgccatgaacgccagccgcaccgactccttggcgaccgccgcctccgccgggtcctcgacggcgggcagcacccggccgtccggcatcggctccagccacgtgttgtccgggcggggcgccagggcggcctgggccagcggcgtcgactcggtcaggtccatcggtctggcccgcttgttgcccgccgtcagcatgtccaggcacacgttggtcgcgatccggtacagccaggagcgcaggctggagcggccctcgaaccggtcgtggctgcgccaggcgcgcaccatcgtgtcctggaccgcgtcctccgcctcgaaggacgaaccgagcatgcggtagcagtaaccggtcagctcgacccggtacttctccagctgcatgtcgaggtccgccgtcgccgcgccgttgcccatcgtcgtccacccacccctgtggccgtcccgtccggagtacgtcatcgcacccagcactccggaagttaccgcagcccactgacaacggtccgcgaagtgggagaaacagcagttcacagggtggtggacggttgcgggggagcccggccgccgcgacggccgggcccggccctgccgcctacgccgccgccggctccgtacgcccgtcccgcgctcccgcacgc

SEQ ID NO: 1635 - DNA, 3190 bp, Unknown
  Kingdom: Bacteria, Phylum: Actinobacteria, Class: Actinobacteria, Order: Streptomycetales, Family: Streptomycetaceae, Genus: Streptomyces
gcgctcgcgtacgtcggccgcgggccccgccggctcgaccgtgtggccgaaacggcgcagccgctgctgccacgccggccgccggtcgtgcgggcccgggtcctgccgggagtccgtggaggacgcggtactggtcaccgcgccatcgtagggaacggcgctgtgcgagtcccgtgcatggccccaccgggtgcggacgcgtccgccgccgcgcgtgcttgagaggatgggggacgtgacaggaacccttgttctggcaggtactcccatcggcgacgtccaggacgcaccgccccggctcgccgccgagctggcggacgcggacgtgatcgccgccgaggacacccggcggctgcgccgcctcgcgcaggcgctgggcgtcaccccgcgcgggcgcgtcgtgtcctacttcgagggcaacgagtccgcccgcaccccggagctggtcgaggagctggtgggcggggcgcgggtgctgctggtcacggacgcggggatgccgtccgtctccgaccccggctaccggctggtcgcggcggccgtcgagaaggacgtacgggtcaccgccgtgcccggaccgtccgccgtgctcaccgcgctggcgctgtccgggctgccggtcgaccggttctgcttcgagggcttcctgccccgcaagaccggcgagcggctctcccggctgcgggaggtcgagggcgagcggcgcaccctcgtcttcttcgagtccacgcaccgcatcgtggagacgctcgccgcgatggcctcggtgttcggcgccgaccggcgggcggccgtgtgccgcgagctgaccaagacctacgaggaggtcaggcgcggcgggctcgacgagctggccgcgtgggccgacgcgggcggcggggtgcgcggcgagatcacgatcgtggtcgagggcgccccggacaagggacccgaggacatcggcgccgaggaactggtgcggcgggtgcgggtgcgcgaggaggcgggcgagcgccgcaaggaggccatcgcggcggtcgccgccgaggccggactgcccaagcgcgaggtgttcgacgcggtcgtggcggcgaagcactccgggtgacacggcggacgctccttgacgtggacccgctggcgcgagcaccacgagaccctgctcacaccccctctgagcagggcgtatctcccatgagcgcgcgccccatcagggagtaaagcggcgtttcgggaaagcaaagcgagacctgccgttcaggggatccttgggcaagcgccgaccaaatcgggtccaacactcgacagggccggtgcgttcacgctggtggaggcgtcaactggaggaagggacgcacccgtcccttcgtccagcggacacgaggagctggcatgagcgagatcggacaggccgcccaccgcggtacggccaccgccgtcgtcaatgagtcgtactccttcgcctgcatgcgctgcgggcacggatgggagcagtcctacgagatagagcaccacacggacgccgacggcaacgagttcgtgctgtacgtggcggacggccgtatcgtgccgtcgccgctgtcgaggcccagctgcaagaactgcgacggccacgtcgtccgcatcatgcgggccggccgggtctcgtccgcgcagagccacctgcacgagcacgagcacgcgcaccagcggcagcagcagccgcccgcgggacccgtgacggttccggcgtccgagtccgcgcccggggaggaggcggcggcccggaagccggaggagcaccactggcacctgtccgacctgttgcacccgttccaccgcaaggagggctgacggcgccgggaggctgacggcgccggggccggccgccggcggatccgtgagcgcatgccccttccgtaggatcggggcatgccctcgaacgccgccaacgccgacaccactggcaacgccgacaagtccggcaaggccgacaagaacgcggcgcccccgctcccggagccgctgcgcatacccgtcgccgactcccacacccacctcgacatgcagtccggcacggtcgaggagggcctggccaaggccgcctcggtgggcgtgaccacggtcgtccaggtcggctgcgacgtgcgcggctcgcactgggccgccgagacggccgcggcgtacgagaacgtccacgcggcggtcgccctgcaccccaacgaggcaccgcgcatcgtccacggtgaccccgacggctggtcgcggcagggtgcccggcagccgggcggggacgcggcgctcgacgacgcgctcgccgagatcgaccgcctggccgcgctggaccacgtcaagggcgtgggcgagaccggcctggactacttccgtaccgggccggagggcaaggaagcgcaggagcggtccttccgcgcccacatcgagatcgccaagcggcacggcaaggcgctcgtcatccacgaccgcgaggcccacgccgacgtgctccgcgtcctcaaggaggagggtgcgcccgagcggacggtgttccactgctactcgggcgacgcggagatggccgaggtgtgcgcccgcgcgggctacttcatgtccttcgccggcaacgtcaccttcaagaacgcccagaacctgcgcgacgccctcgccgtcgccccgctcgaactggtcctggtcgagaccgacgcgcccttcctcaccccggcgccctaccgcggacggcccaacgcgccgtatctcgtgccggtgacggtgcgtgcgatggccgccgtgcggggcatcgacgaggacgccctggccacggccgtcgccgccaacaccgcacgcgccttcggctactgaaccgctccggcgcgcactgagcgtagccgctccactttggagagtgacggccgctccgctaggttctgggggcccggcccggatcacggccccaggagtgtgtcggttgagcagctcgccgtacgagacgtacgagacgtacgaggaggcgtaccggacatacgacgcgtacgagacgtacgaacggtacgagccgtacgcgccgccgtacgtgccgtatgagccgtacgcgccggcgtaccaggacacctaccggcccgcctacgagaccgcggttcagccgcccgtggcactgccgcccgtggcacaggcccccctggcacaggtacccctggcccagccgcccgtggcccagccctccggcgtcgcgccggtg

SEQ ID NO: 1636 - DNA, 2607 bp, Unknown
  Kingdom: Bacteria, Phylum: Actinobacteria, Class: Actinobacteria, Order: Streptomycetales, Family: Streptomycetaceae, Genus: Streptomyces
  misc_feature (451)..(452): n is a, c, g, or t
cgccgccgaccgcggctaccgctacctccacgtcgacgcctccagcgagagccgccccgtcctcgaacgcctcggcttcgttccgctgtccacgacgacgccgtacgtctacgcgccctgaccgcggcgacggcaggggcggccggggccgggtcagcgccggggtgccttcgcccggtccagcgcggccacacccaccgcggcgagcgcgatctggatgagccactcgatccagtcgacgcccttggtgtcggccaccccgagcgcggaggcgatcgccgcgccgatcaacgcggccacgatgccgatgacgatcgtccagatgatgccgatgtgctggcggcccggaacgacgagccgtcccaggacaccgatgatgatgccgatgacgatggcactgatgatgccgctgatctccatcttggcctctccgtgtagtggtccccgcggnngacgacacccccgcggggacctcgcacccccccggggatctccctcgcggcggaccccgtctccccgtttgacaggcaggtgatcacctgggtgactgagggggtgcgagccatgaccggccggccgagccatgtgtacgtcctctacatcgcgagcacccccgaagcggtctgggaggccctgacggacgccgacctgaccgccgcctactggggccacagcaacgtctcggactggcggccgtgctcccgctgggaacacgtgcggacggacggttccggcgtcgccgacgtggtcggcaccgtcgtcgtgtccgaccggccggcccggctggtcgtcacctggtccgcacccgaggacgagtcgcggccggaccgccactcccaggtcaccttcggcatccggccgcacggcgacatggtccggctcaccgtcacccacgaggacctcaacgacgcggaggaactcgacgccgcctcgcggggctggccggcggtgctgtccaacctcaagaccctgatcgagaccggccggccgcttcctcaggagccctggctgatgcccgaccgttgatccgccgcgccaggctcacgccgtacgtcaccggacggctccgcggcatcgcggtccgtcatccgagacctgtcgggtctctccttgactgccccaccggctgctgacacgatcgtcggcatgaccatgcgactggacctcacgcggcgacgccatgtcgacctcgtccgcgtcgccagcgcgtcctgtcgcaccgcggcctgaccgaaccgccgcgcgttccccgcgccgctccctcggcccacctcaccgcctgataccgcgagatgccgcgagggcggccgcgtagacccgttcctccatcggtgcccgcccaccggtccgccgcgcgttctcacaccccgcggcctccggccgtgcggcctgccgccgcgcccttcacccctcctctcccgtcgtgtgcccctccgtcgtgcccgaaagccagaaagaggacccatggccaccgtcctgtccgtctccggcagcccctccgcctcctcccgcaccaaccgtttgctgcgccacctcgaccagcggctgaccgcccagggccacgaggtgatcccgctcgacgtgcgcaccgtccccgccgaggcgctcctcggcgcggacttccgccacccggcgatagtggcggccaccgaactgttcgcccgcgccgacgcggtggtggtgggcacgccggtctacaaggcctcgtactccggtgtgctcaaggcgctcctcgacctgcttccgcagtacgccctcgccggcaagaccgtgctgccgctggccaccggcggctccgtcgcgcacgtcctcgccatcgactacgcgctgcgccccgtcctcacctccatgggcgcggcacacgtggtgcagggctggttcaccctggaccaggacatcacggtgcgcgaggacggcacggtgaccgtggcgccggccgcgagcgaggccctcacccaggtggtcgaccagttctccgcggccctcggcggcgttccgtcgctggccgccgtgagctgagcccaccaccgccccgccaggctcttctccccggggcccctcggggagagggaggcgggaccgcggcgtggcaccccgttgactactcttgtgtagacggtccactggagtgcaggcgaggacggggtgaggaacgttcccatgaccgacgcgaaggacgaacgcaggccggccggtgagctggaggccggtgtgatggccgtcctgtgggccgccggcgcgccccggacgccgggcgaggtccaggccggcctggccgccgagctggcccgcaccacggtgaccacgatcctgacccggctgtacgagaagggcgtggtcgagcgccgccgccaggggcgcggctacgcctactaccccgtccaggacgcgcacggcctcaccgcccgccgcatgcactgcgaactcgaccgggacaccgaccgcgagaccgtcctcgcccgcttcgtcgcccagctcagcgccgacgacgagcgcatcctgcgcgacctgctcgaaccgggtgagcgatgaccgccctgctgctcctgccgctgctgctgccgttcgccgtaccggcactggcccggcgcgcgctcgaccggctcg

SEQ ID NO: 1637 - DNA, 912 bp, Unknown
  Kingdom: Bacteria, Phylum: Actinobacteria, Class: Actinobacteria, Order: Streptomycetales, Family: Streptomycetaceae, Genus: Streptomyces
cacctggagctgggcggcaaggcgccgttcgtcgtcttcgacgacgccgacctggacgcggcggtcaacggcgcggtcgcgggcgcgctcatcaacaccggccaggactgcacggccgccacccgcgcgtacgtgcagcgccccctctacgacgagttcgtcacgcggaccgcggccctgatggagagcgtccggctcggcgacccgttcgccgcgggcaccgacctcggaccgctgatctcgcacgtccagcgcgaccgcgtcgccggtttcgtcgagcgggcgcgcgcctacgcccgcgtggtcgccggcggcgaggcaccccagggcgagctgaagagcggcgcctactaccggcccaccctggtcgcggacgctccgcaggacagcgagatcgtccagtcggagatcttcggcccggtcctggtcgtgctgcccttcgacagcgacgacgaggggatcgcgctggccaacgacaccccgtacggcctggccgcttccgcctggagccgggacgtctaccgggcgaaccgcgccacccgcgagatcaaggcgggctgcgtgtgggtcaacgaccacatcccgatcatcagcgagatgccgcacggcggctacaagtcctccggcttcggcaaggacatgtccgcgtactcgttcgaggagtacacacaggtcaagcacgtcatgttcgacaacaccgcggtggtccgcaaggactggcaccgcacgatcttcggagaccgatagccgaactccggcccgcgctgggccgaaccctcccgaaagggcaccacgcgcatggagcagtacgagcccgatcgcccgtcaccggcccgtccggacatcccacggcgggggctgccgggcggcaggcccgccctcacccgccgttcgctgctgcgcgccggcgcg

SEQ ID NO: 1638 - DNA, 1663 bp, Unknown
  Kingdom: Bacteria, Phylum: Actinobacteria, Class: Actinobacteria, Order: Streptomycetales, Family: Streptomycetaceae, Genus: Streptomyces
accgcggccagtgtgcgcgcgggctcccacaggtccagccggctcgcctccgccaccgtcttcgcccagtcctcgggaaccggagagccgagggcgcccgccagagccccggccatcgtggcgatggagtcgcagtcacggccgtagttcaccgcgccgaggacggcccgccggtagtcgccgcccgccaccagcagcatgcccagcgcgatgggcagttcctcgatcgcgtgcagccgggaggggcggcgggcgcccagggagggactgcggtagtcggggcccaccgtgtcgtacggcgcgaccgccgcacgcaatggcgccagcgccgactcgaagtccgtgtggtcgcgggccacttcgcacacgtcctcgatcgccgcccgcgtgccgtccttcgccagggacagacaggccgtcacgaccgagtcgggcgtggccccgggcgagcaggccgccgcgaccccggccgcgagcacgcccgccgcctcccggccgtacgacgactggtgggcgcccgcgatgtccagggcctccgcgtacgcggcccgcggatcggccgcgttgaccaggccgaccggcgccatgtacatcgcggcaccgcagttgacgatgttgccggtgcccgcctcacgcgggtccacgtggccgtagtgcaggcgcgccacgagccacttctccgccaggaagacgcggtgcagaggcagcgcctcggcctccagctccgggatccagcgcggggtggtcatcaggtccgggacgagacggtcggcgacggcgtaggcgtcgaggtggtcgcggacctgcgcgtacacccgtaccagcgcgtgcgtcatcagggtgtcgtcggtgacgtggccgtcgcccttgtggtacggcgcgatcgggcgggcggtgcgccactcgtcgccgtgccaggggccgacgacgccgtggacgcggccgccgtggcgctccgtgatctggtcgggggagtagccctcgacggggccgccgagcgcgtcgccgacggccgcgccgacgagggcgccggtgatccgttcgtccagactcgcacccgggctggtggttacttctgctctgggcgtcatgccccgaatcatcctcccggcggggccggttgcgcggcttccaggcgaccggcgagttccacgaggtcggtgccggtgaggcggggcagtacgcagccggacagcgtgcggcacgcgtcgcgccaggaggaggggatcgccgcgccgccgcccagtgcgccggtgagcgcgcccgtcagggccggggcggagtcggcgaccctggacaggcaggcggcggcgggcagggcccgtgcgatgcggccgtccgccgccgtgaccagggcgagcgccaccggtacggtctcggcggcggcgacgccgtagctgtagacgtggtcgacgatctggtgctcaagcagcggcaccagctcgaacgcgtcctcgcagtccgccgccagcgccagcgcgtgccgcgcgttgcggccgatctccgtgccgtcgggaagctcggcgagcgcggccgtaacgcaggcgccggcccccgctccgtcgagagccagggcgagcgccgcggccatcgcgcgggcgccgtgcacgccgtcgccgtcctgggtgtaccgggcgtcgaactcggcgaggtcggcggcggc

SEQ ID NO: 1639 - DNA, 852 bp, Unknown
  Kingdom: Bacteria, Phylum: Actinobacteria, Class: Actinobacteria, Order: Streptomycetales, Family: Streptomycetaceae, Genus: Streptomyces
cgcggtagtagatgtaccggtacacggtgtcgctgtactggtcgtagaggcggccgaacgcgtcggcctcgccggcctgggcgcgctcgacgaggtccatcatccgggcgctgtcgctgtccgcggcggggcggcggacggtggccgccggggcggagcgtgctcgtctggccgccgcccgcccgtcgccggagcgccgcccctcgacgacggcgctgcgcgcgggcacctgctcgatgccgtcggccagcgcgtagcacgggccgaccggcgcggcggtggcgaaggcggggccggcgtacgcggtggggacgagggtgcgcagcaggtcgaggaccgttgcgcggagcgtagccaggcccgaggcgtcaaccccgacgtgtgggtacacgggactcccagaggcagagcttgcatcacgtgcagtgcggaaccgttcacccgtcgtagcgacggaggggtgccggattgcgtctgaggagaataacgcttcgtacaggccctgctacaccgagttgctcaaatcaccgattacgtcgcttccgtaaccggttgacggccgatcaggtgccgcagagtgaccgtttgctgatcgttctggtccgtgttcgggatgggacgcgggcgtgttgtggcggtgtaccgccaacgtgaatggccagggcggtgcgtgggcacgttcggtcgtttgaccggaatccggagcgggcgcgccgctgggaccgctgttgtcacctgatgtcgctgtgattgccgtgaccgatggtgcggcgatcgccctgcaccggcgccgccggtaacgcttcccctcgctgcgccaccgcccacgcgtcgccgcaccatcggtcacgg

SEQ ID NO: 1640 - DNA, 941 bp, Unknown
  Kingdom: Bacteria, Phylum: Actinobacteria, Class: Actinobacteria, Order: Streptomycetales, Family: Streptomycetaceae, Genus: Streptomyces
cctgatcaccgcgcagaccccgctggcggagacggccggggcgcacaccaccgcgctcgccccgctggacgaggacaccgcgtaccggctgctctgcgcggcgagccgggcctgccgctcgcgctgcggatcgcgggcgcccggctcgccgccaagccgcactggccggtgagccacctggtcaaacggctggaggaccagcgccgccggctcgacgaactcagccccaacgagggcggggtacgggccgggttccgcctcagctaccgagatctgccgcccgccgccgccatgatgtaccgccgcctcggcctgctcaccgtgccggacttctcggcgtgggtcggggccgcggtcctcggcaccgaccccttggaggcggaggacctcatcgaggagctggtcgacgcacagctcctggaggtcgcctcggcccgccccggggaaccgccccgctaccgcttccaggccctgctgcgcctgttcgcctgggagtgcgctcaggaggaggacgcccacgaggaacgcgagggcgtgctggaccgcgccctggacggctggctctcgctgtgctgggcggcgtaccggcggctgtacggcggggagttcgtctcgctgacggacgtaccggagtcccggctgccgcagcccctggtcgaggagctgctggaggacccgatggagtggatggagtcggagcgcaccgccgtcgtcgacgtcatccggcaggccgcggaggccgggcgagtgcggcacgcctggcaactggcgctcctcaacgcctcgttccaggagtcacgcagctacctggaggagtggcaggagtgctccgaacgggcgctggccgccgctggtacatcgccagtgagcccagcgagcgctgcatgacggcctcgccctgccggtccccggcccgctgcgcggcggccagcgcccgttcg

SEQ ID NO: 1641 - DNA, 1484 bp, Unknown
  Kingdom: Bacteria, Phylum: Actinobacteria, Class: Actinobacteria, Order: Streptomycetales, Family: Streptomycetaceae, Genus: Streptomyces
  misc_feature (894)..(948): n is a, c, g, or t
ggggtccaggtcggccgccaggaccagatgaaggttgtccaggggcgtgtcgagcacgacgcgcgcgtgcggccgaagccgttcgacgaacgtccatgccgagtcggcgggtgcgtacagggcgaacatcgtcgtggcagagctctccttgagtccgagacgctgcaacagacgtgctcgcccggccacttcgaggctgcggtcgacgaccgacctgagcgccacactgtcggcggcgggcggagcatggctcagcagggccaccttcacggcgattcccaggcggcgcagcagcagcgccagttgggcgcccacctgcggcaggcgctggccatcgatccagacacgccccgttccggggaggtcgtacgcccttgcgtccggcggctgttgcccaacgcgatcgatgccgcggggagtggccgaccagacctcgccgcgcagcgtccggacaccgacggcgcagccgagagccgacgcgatccgcgtcaggagcgactccaaatcggcttcgtgctcggtcagttcgtcgatgaggtcgagaaccgcgtcgaccgcgaccgtgccctcgggcggcgggccggccttgcccaccggactgccggtgtcatgggtgtgagaaggcatcgtggtgaagcccctattctccaacgcggagctgaagcttcgcggccatcgctccccgttcgccggcggcccgttgcgtggcgccgccggcggacggggagcgtgcggctcagaagcccagtcgctgcgccacctgagcccggtggaactcgggctccccgagcagcagttggcaggagcgcgccctcttgtagtagagatgcgccgggatctcccaggtgaagcccatgccgccgtggaactggatgttctggtgagcggtactgnnnnnnnnnnnnnnnnnnnnnnnnnnnnnnnnnnnnnnnnnnnnnnnnnnnnnnncgccgccatgtgcttgagggcctggaacgcgccgatcggctgcccgaactggacgcggatcttcatgtagtccacgcccatgtcgagcgcggcctgcgcgccgccgacctgctcggccgcgagccccacggcggccagatcgaggacacgggcgagggtcttctccccgctgcccggctccccgatgggggcggccgtgacgtcggtgagttcgacgtcggcgagcttgcgggtctggtcgagggtgggccgcagggtcgtgcgaagaccgtccgtgtccgcctcgacggcgaacaggccgagcccgtcaccggtgtcggcggccacgagcagcagctgggccacatgcgcgtcggtcaccagcggcgcggtgcccgtcagccgccagccgccgtcgttccgcacggctcgtacgccgacggccttgcccggccgggggaaggccagcgtgccgatcaccgagccgtcggcgataccgggcaggtaacgccgctgggcgtcggcgtccccggacaccagcagcgtgttggcggcca

SEQ ID NO: 1642 - DNA, 3915 bp, Unknown
  Kingdom: Bacteria, Phylum: Actinobacteria, Class: Actinobacteria, Order: Streptomycetales, Family: Streptomycetaceae, Genus: Streptomyces
cgctcagcgggacggtgaccgtgccggtgcgcagggccgcggcgcggacgatcgcccaggcggccaggacggtcgcgtcgtcggcggcgccgccgggcgccgggggcaggggcacggggacggtcgtccgcgcggtcatcggcgaatcctcactgcatcctcctgggcgtcgtcggctcggtcgatgcggcgcgtcctgagcgtcagcgccgcggcggggatcagcaggatcgcgccggtcacgatgatcgacgcggcggtgccgccccagttggcgatggcgccgccgagcagcacaccgacaaccgtgaaattgaccatgagtgcgttcagcagcgcgatcccccgcccccgcaggtcctccggcagatcgcgcagcaggatgttcgcgacggggacctggaccaggctcatgccgaggccggccagcgcgcaccaggcacagatcacggcgagccaggactccccgtaccggtcgatcggccacaggaccagcagggacacggcgaagaggcccaccgccccggccagcagttccgccagcgcgaaccgcttgacgagcacggggccgaagaacgccccgaggatcgcgcccgcgccgagcatggcctgggccaggccgaagtcgaaggcggagaggtcgaaggagaccaggagctgggtgttcacgttcgtcgtgaacacaccgatcgcgatcatgaccggcaccatcatccacgccacggtccgcagtgtcgggatgctgagggcgccggtgacgccgctgcgcagggagctccagtactggccgggcgatgtggccgtgaccgaggcgcccttgaggaccgcgaggttgccgaggagcagcgcgctgacgacgaaggtgacggcgtcgatgacgaacgagaggcggacccccgccgtcgccatcagcacgccgccgatcagcggcccgaccaggttcagggtctgcaccgtgctctggaacaggccgatcgccgcggggaggctgtggttgccgacgaccttcgggatggccgccatccgggccgtctcgaagacggacttcccgatgccctccaggaagatcagggcgagcagcagtccggcgctgtgcaccgcggggatcatcgccagcacgatgacgaagcgggccaggtcggcgccgaccagcaggacgcgcggtgacatgcggtcgaccagcggcccgatgaaggtgcccaggactccggaggggaccagctgggcgatgaccacggcggcgatgaacagggccggggcatcggtgagagtggccgccacgtacaccacggtgaccttcgcgatgccgtctcccaggaaggagacgaccaccgccagccagtaccggatgtagaccttgtcgcgcagcagttctctcacgtttctgactccagggcggtgctcgggaacaggtggggccaagcaggggtcatgccggtcgtccctcgacctgttcggcgagcaggccgacggtcggggcgtcgaagagggtgcgcagcgagaaggtgattccgtgccgttcctgggcgagtgcgatgacccggacggcgagcatcgagtggccgccgaggtcgaagaagtcgtcgtccaggccgacttcggccactccgagcacctcggcccagaccgcggccagttgctcctggagcggggtgcgcggccgcaccaggggtgaggagagggcggggcgctgcgacccggggtccggcagcgcggcccggtccaccttgccgttgaccgtcagcggcagcctgtccagcgtgacgaacacggccggcagcatgtactcgggcagggtgcggcccaggtgcgcgcgcagggtgtccggtgcggtctcggccgcgtccgtggtcaccacgtacgcgaccagccggccttcggagtcgtcgggccgatcgaggaccaccaccgcctctcggacggcggggtgcccgcagagcgcggcgtcgatctcgccgagttcgatgcggtagccccggagcttcacctggtggtcgaggcggcccaggtactgcagttcgccgtcggggcggaccaggcagccgtcgccggagcggtagagccgcccgtcggacggtgaggggccggacacgaaccgggccgcggtgagttcgggccgtccggcgtatccgcgggcgacgcccgccccgccgacgtacagctcgccgggcgtgcccgcggggaccggccggccctgctcgtcgaggacgtgcgccgtccagttcgcgagcgggacgccgatcgggctggcctcgggttcggcgaggtcggccgtggtcatccggcgccaggtggagtgcaccgtcgtctcggtgatgccgtacatgttgaccagcgcgggccgctcgtcgccgtgccgcagcagccagggccgcagcatggcgggcgtgagcgattccccggcgaagacgacccagcgcaggtcgggcagcgcggccgcgtcagtgtcctcctcgtaacgtgacagctggcggaacgccgcgggcgtcaggttcaggacggtgacgttctcgtcgcgcagcagtgcgtgcaggcccgatggcgagcggcgggtgtcctcgtcgacgatgacgagccgggcgccgtgcagcagcgcgccccacatctcccacaccgacacgtcgaaggcgagggaggcgaacagcgtccacacgtcgtcggcggtgaaggcgaaccggtcggtggtcgcgtccagaagggctgcgacgttggtgtgctcgacctggacgcccttgggcactccggtcgagccgctggtgtagatcacgtacgcgaggtggtcgggccgtacgccggtgtcgggcaccggtgtctcctgcccggcggtgtcgacctccaaggcgggcagcgcggcgagcggccgcgcgggttcgtcggtgacaagcaggcgcgccccggagtcggcgcagacgaaggcgagccgctcggcggggtgggcggggtcgagcggcacgtaggcaccgcccgccttgagcacgcccagcatggcgacgaccgcttccggtgagcggtggaagcgcacagcgacggggacgtcggggccgacgcccgccgcgcgcagccgatgggccagggcgttggcccgccggtccagctcccggtaggtgacgtggcgcccgtcgtgcgtcacggcgacggcgtgcgggcgggcctgcgcctgctgtgcgaacaggtcgtgcaggcacgccttgggcccggggtccttccgcgcggtcacgatgccggccttgcgatgccgtcggtgcgttcgcgggtgcggcgtgcggcggattcgaagccgctcgtcgccgaccagtccaccggggcatccggatccccgacgagcgagcgcagcgtgtcgacgtaggcgcgcagcacggccgcggcggtgtccggtgcgtagacgtcggtgtcgtactcgacctccagccgcagctcggcgccgcggccgatgacgtacaggctgaggtcgtacttggccgttccgggcgggctgaagaaggccggtgcggtgtctgccaggtgctcgaacggcacgagcggtgggttcggctggtaggagaagaggacgttgaccagcggtgcggcgcggcgcagggcgcgggcgaggcggtcgaagggcacgtcctgcgcgtccagcgcctgccaggccgcctcgctgacgcgtgcgacgaggtcggcgcccgacggggatccgtcgaggcgagcgacgaccgggacgacgttcacgaagcagccgacggtgtcctgccattcggctcggacgcggcccgacgcgggggtgccgatgaggatctcccgctgctggtcggcccggccgagcacggtcacgaaggccgccatcaggacggcgaacggcgtcgccctgacccgtcgggccagccgtcgcacggcggcgacgtcggccgcgtggagtccgccgtgcacggcggagcc

SEQ ID NO: 1643 - DNA, 4358 bp, Unknown
  Kingdom: Bacteria, Phylum: Actinobacteria, Class: Actinobacteria, Order: Streptomycetales, Family: Streptomycetaceae, Genus: Streptomyces
  misc_feature (292)..(303): n is a, c, g, or t
gggcgccgtccgcgggtgtgcgcgggtgcgggccgtcagtggtgcaggatcttcgacaggaagtccttggcccggtcgctgcgcggattgctgaagaactggtcgggcgcggcctgctcgatgatcctgccgtccgccatgaagaccacccggttggcagccgatcgggcgaatcccatctcatgggtgacgacgatcatcgtcatgccgtcgcgggcgagctgctgcatgacctccaggacctcgttgatcatctccgggtccagcgcggaggtcggctcgtcgaacagcnnnnnnnnnnnngctggccgccggagagctgcgccgggtacttgtccgcctgcgcgcccacaccgacccggtcgagcaggccccgggcccgttcctcggccgccttacggtccgtgcggcggaccttgatctggcccagcgtcacgttctccagcacggtcttgtgcgcgaagaggttgaaggactggaagaccatgccgacatccgcacgcaaccgggccagctccctgccctccgggggcagcgggcggccgtcgatcgtgatcgtgccggagtcgatcgtctccagacggttgatggtgcggcacagggtcgacttcccggacccggagggtccgatgaccacgacgacctcgccgcgggagatcgtcagttcgatgtcctggagcacgtgcaacgcgccgaagtgcttgttgacgctcttcagaacgaccagatcgtcggtcgaggccacgtcttccttggccaccgatacttcggtcatcgctttcaggctccgtcctcatcggtttcggaggacagtagccaggccgcgctaccagcgtcagtacatctgaggtacatctgagcatcacgatccgatagcaatcggacacccgtcgtagtacgtcacacgcaggcgcgtaccggctgggtaacgacagccgccgcgcaaccggcagccccttgacgacgtcctcgtccatcggcgtgactgccatcgtgcacccacgcgcgcgtgcacaccgcttcgctgcgcccgacgtatgaccagcgttcggccgatgcatgactacatgacgatgaacgggaggggccgggttgagactgctcctggtcgaggacgacaaccacgtcgccgccgcactgtccgcgatcctggcccggcacggtttcgacgtcacccacgcccgcagcggcgaggaggcactccaggcgctcgtcccggagggggactgcttcggcgtggtcctgctcgacctggggctgcccgaccaggacggctacgaggtctgcggcaagatccgcaagcgcaccagcaccccggtgatcatggtcaccgcgcggtccgacgtccgctcccgcatccacggcctcaacctcggcgccgacgactacgtcgtcaagccctacgacaccggcgaactgctcgcccggatccacgccgtcagccgccgcaccgcccacgaggatgcgggcggcgcggccgagagcgccctgcggctcggcccggtccgcatcgaactgcccacccggcaggtgagcgtggacggcgcggccgtccagctgacccgcaaggagttcgacctgctcgcgctgctcgcccagcgtcccggagtggtcttccgccgcgaacagatcatcagcgaggtctggcgcaccagctgggagggcaccggccgcaccctggaggtgcacgtcgcctcgctgcgctccaaactgcggatgccggccctgatcgagaccgtccgcggcgtcggctaccgcctcgtcgccccggccacgtagcgggcccgggtgcgcacacgtctgctgccgctgctgatcatcctgatggcggcggtcctgctcgccctcggcttcccgctcgccgtcagcctcgccgcgggcgaacagcagaaggtcgtcgtcgaccgcatcgacgacacggctcgcttcgccgctctggcccagttcgtcaccgacccgcccatgggttcgcgccgcaccgtcccggacgagcgccttgagacgctcagacgggaactcgccagctaccacgaggtctacgggatccgggccggcgtcttctaccgcaccggcacccccatggccggcgccccggccgactgggcgctgcccgccgagggcgaggtccgcgaggccttcgacgaggccaaactgagccgccgcagccacgaccccgaacaggtctggccctggcagcggcactggctcgtcgtcgcctcgcccgtcatccgggacggcgacgtcgtcgcggtcgtcgtcaccgactcaccgaccgggcagatgcgtgcgcggaccctgcaggactggctgatcctcggcgcgggcgagaccgtcgccatgctggtcgccgtcggcgcggcactgcggctgaccggctgggtgctgcggcccgtacgggtgctcgacgccaccacccacgacatcgccaccggacgtctcaagtcccgggtggcggtggccggcgggccgccggaactcaggaggctcgcccggtcgttcaacgagatggcgggcaacgtcgaggacgtcctggagcagcagcgcgccttcgtcgccgacgcctcccaccagctgcgcaacccgctcgccgcgctcctgctgcgcatcgaactgctcgccctggaactgcccgagggcaacgaggagatcgcctcggtccgcaccgagggcaagcggctcgcccaggtcctggacgacctgctggacctggcgctcgccgagcacgccgaggccgacctccagctcatcgacatcggggagctggccgaggagcgggtggccgcgtggtcgccggccgccgaggccaagggggtgcggctggtcggggagtgcccggccaccacggcctgggccgacccggtggcgctgtcgtccgcactggacgcggtgatcgacaacgcggtgaagttcacgcctcagggtgagcgcgtcgaggtgaccgtgtccggcggcggagacacctccacgatcgtggtcgccgaccacggccccggcctcaccgacgacgaactggcccgcgtcggcgaccggttctggcgcagcggccgtcatcagaacatcaacgggtccggcctcggcctgtccatctcccgcgcgctgctcgcggcgggcggcggctccctctcgtacgccgcccaccgcgccgaggaaccgcgcgggctgaaggtgacggtgacggtcccgaggacggacccgcgtcccgagccgcggaccgccccaccgggggcctgagggccgcgggcgcgcggagaggggcctaccggtgggtggctctaaggcttgacggaccggtagtagcggcgggccccctcgtgcaggaccagcgggtcggtgtagatcgcggtgcgcagatcgaccagctgggcggagtggacgtgggcgccgatctggtcgcggctcttgatcacggcccgggtcagccactcggtgagcctcgggtccacgtcctcgcgggtcatgagcaggttggacacggcgatggtcggcacggtcgagccgtcctgcaccgccgggtacgccgactccggcatgttggtcgcacggtagtagcgcgtggcgccgccctcggcgtgcagcctggccaccaggccggcgtcgatcggcacgaaccggaaggcgaacttcgaggcgagctgcgtgagcccgtccgtgggcagcccgccggaccagaagaacgcgtcgatcgcgtgcgtacgcagccggcccggcccggtgtcgataccgtcggccatgggccgtatgcccgtgcgcggatcgataccggcggccttgagcacccgctccgcgatcagccggacgcccgactccggcggtccgaccgccacccgtctgccccgcaggtccgccaccgaacggatcggcgagtcacgcgccacgacgagctgcacgtagtcgtcgtagaggcgggcgaccccgcgcagcccggccgctcccggaccgtgttccaggacgtacgtctccaccgcgtcggccgcggcgatcgtgaagtcggccttgcgggtcgccacgcgcgcgacgttctcctgcgaaccgtcgctggtcagcaaccgcaccgtcaggtccggcatgtccttggcgaacgcggtgcgcagccgtacgccgtactcgtggtagaccccgcgtgcggtcccggtgctgaaggcgatcgtccccctcggcgggccgtcgcccaacggcaggagccaccacagcagcagcccgaggaccacggcgaggacggccgcgccctgcagaccacggcgtctgccgagagaggggaacagcttggacatgcgcgcgatcctgccagccgggtgcggtgctgaccaggcctgtgtgccgggcgggggtgaagcctgggcgctgggcggggtgaaggg

SEQ ID NO: 1644 - DNA, 1272 bp, Unknown
  Kingdom: Bacteria, Phylum: Actinobacteria, Class: Actinobacteria, Order: Streptomycetales, Family: Streptomycetaceae, Genus: Streptomyces
gggagcgcgagcagtggcgcgaccgggaccggtggtgcggcgagcggtacgcaggccgggcgcgccggcacgggctggcccgtggtgccgccgccggacatggacctgccgccgcgcccggtgcccagggctccgctcactgatgtggtgcccaagcggacgctgctgatcatcgccgtggtcgtggtgctcgccgtgatcggcaccgtgctgaccatcgcgttcagcggcaacgacgacaagggctccaagggcgacaggagcggcgccggtacgtcggccagtgcgcgagccaccgggagcgccgcggccgggcagggcaagggcagcgccacgggcacggacggctcgtccgccgcgggtgacggcacgggcgcgccgggcgatgacgcctccgatgcctccgccggcggctccggaccgggctccggtcacggttccggtgacgacggcgcggccacgacgtacaagggcgaccagggcttctccatcgggctgcccaagggctggaagtacacgaaaaccgactccgcgggcgcccgtttcaccggccccgacggacagaagctgctcgtcgcctggacgtcgacacccaaggacgaccccgtggccgactggaagaaccaggagggctacatggtgcgctccgcctaccacaggatccgcatcgagaaggtgggctaccgggggtggaacgccgcggactgggagttcacctacaccgacggcggcaccgggtaccgcacggtggaccgcgggttcgtggtcgacgatcacctcggttacgccctgatgtacacggcgaaggccgacaagtggggcggcgacctgcgccgggacacctggcggacgctgacgaagacgttccagcccaagtgagatccggcttcccctcttgcgggttgcctccggcacgtatcgtgagtgattgcggaccgtgagcatcgggaacgggacgcgtggcgaacgcatttgaccgaatgtgaggccgggggaggcaacgtggacgactacgcgggccgggttctcgccgaccgctaccgcctgccgctgcccccgtccgacgcgtacgaactcaccgagacgcgcgccttcgacacctacagcgggcaggaagtcctgctccgtcaggtgccgttgcccgaggtcgtcgaggccgaggtgctcgacgcggacgggctgcccgaagggttcactgcgcgcgagggcgcctttgggaggcctggagggcagtatccgggagggcccggcgatttcgggggtcctgagggg

SEQ ID NO: 1645 - DNA, 656 bp, Unknown
  Kingdom: Bacteria, Phylum: Actinobacteria, Class: Actinobacteria, Order: Streptomycetales, Family: Streptomycetaceae, Genus: Streptomyces
cgaggtcgagaaactggccggaacctggcagcggcgcatagccgagcccatctccaccgcatccgccgacggcgccgtgaagctcgcgacggaccgggcggcggagggcaaggactccttcgacgcgctgcgccacgcgatgtcccgtcagcaggcccagctggacggcgaacgcgcggcgtccgcacgggagctgcggcggacacagaccctgcggaactggatgttcgccgtcatcgccgtcgtcatcgtgctgctggcggtcctcgtcttcgaggggctgcgccgcggcatcaccggcccgcttagccggctgggctcggacgcccgggaggtggcacggggccgtttcgacctcgccctcaccggcaccgggcccgccgacctgcgccggctggccgcggacgtggagtcgatgcgccgccgcctggtcgaggaactgcaggtcagcgaggaggccaggcaactggtcgacgaacaggcggaagacctgaaacgctcgaacacggaactggagcagttcgcctacgtcgcctcccacgacctgcaggaaccgctgcgcaaggtgtccagcttcacacagctgctgcaacggcgttacggcggccaactggacgacaaggccgatcagtacatcgccttcgccgtcgacggcg

SEQ ID NO: 1646 - DNA, 558 bp, Unknown
  Kingdom: Bacteria, Phylum: Actinobacteria, Class: Actinobacteria, Order: Streptomycetales, Family: Streptomycetaceae, Genus: Streptomyces
cggtgccggcaccgggtgaagcggccgctcgggtacgaggccttcctcgcggctcgtcaccggaacgcgccctttccggtactcccgccgaaccggtggctgggccgcggtcgctgccggagggagcgcggacagacgtgtgtgcgcggccgccgggctgggtacgcgcacaaaacggatcaagttattccgtttttggctctgccgtcgcgctaccaggaggaacaaccgtgaacaagctgatgcggcacctcacgaccacgggcatcgccgccgtggtcgccggaggagcacttctggccggcggcggttccgcgatggcggcccccgcgcagcacggcgggtgctcccaccgcccggccgcggtggcggccggtcacgaactctcccggcggtccgctgctcaccagcgcatcgacccgtggatcctggaccaactgcgcgccttctacccggcggacgctcagctcagctgtccctcgaactggaccagctggtccctgacccagggctcgtacaccgcgatccgatgggcggccgccgggtagaaggcgcgca

SEQ ID NO: 1647 - DNA, 2581 bp, Unknown
  Kingdom: Bacteria, Phylum: Actinobacteria, Class: Actinobacteria, Order: Streptomycetales, Family: Streptomycetaceae, Genus: Streptomyces
cggccccgaccagcgaggcgccggcggcctcccgggcacataccccgaacgcctccgtgaccagcgcctcgacctgcgccgccaccgcgtccacgaccgcaccggcctccgcacccaggtccagcggcccgcaccgctcgccggtgacggtgccgtccaggtcgaccagtacggcccgcacctcgtcccgctccacgtgcacgccgaccgcgtgcccggcctccgggaccagccgcagcacggtccgcggcttgcccccggtggaagcccggcgccccgcctcggccaccagcccgcgctcccgcagccgtgcggtgatcttgctgacgccctgcggggtgaggcccgtccgctcggccagctccagcctgctgatcccggcggccccggcccggcgcagcagatcgagcaccagggcggtgttgtggctgcgcagggcgagcaggttcgccccggcgcccgcgccgccgcgcaccttcccgctggtcaccacaccctcacccttcgccgcactcgtccggccgcgtccgccgcaccgtcgcccccattctcccccgcgcttgcacttaggcaacagcgttgcgaaagtggaacgcatgactagcacccccctccgagacctccgcgaccccgacggtcccggcggcctccgcgacctccgcgtgggcctcatcggctacggcctcgccggttccgtcttccacgccccgctgatcgccgccaccgagggcctgaccctcgacacggtcgtcacgtcgaacgaggaacggcaggcgcaggcccgcgaggagttcccggacgtccgcatcgccgccggcgcggacgaactgttcgcccgctccgccgagttggacctggtcgtcatcgcctccccgaacaagacgcacgtcgcgctcgcgacgacggcactgaagtccggcctgccggtggtcgtggacaagcccgtcgccggtacggcggccgaggcgcgcggcctcgccgccctcgccgaggagcgcgggctcctgctgtccgtcttccagaaccgccgctgggacaacgacttcctgaccttgcgcgccctggtcgagcgcggcgaactgggcgacgtatggcggttcgagtcccgtttcgagcgctggcgcccgcagcccaagggcggctggcgcgagtccggcgacccggcagagatcggaggtctgctctacgacctcggaagccacgtggtcgaccaggccctggtgctgttcggccccgccacgcaggtgtacgccgagtcggtcgtgcgccgcgcgggcgccgaggcggacgacgacacgttcctcgcgctcacacacgcaggcggcgtccgctcccacctgtacgtctcctcgacggccgcccaactcggcccccgcttccgggtgctgggctcgcgggccggttacgtcaagtacggcctggacccgcaggaggccgcgctgcgcgcgggcgcgcgtccgggcccggacggctggggcgtggaggaggagtccctgtggggccgcctcggcgcgggagagtccccggtgaccggcggcggcagccccgtacccaccctgcccggcgactacccggcgtactacgccgccgtggccgccgcactgcgcgagggcgccccgaacccggtgaccgcccacgaggccgccgccgcgctcgacgtcctggaggcggcccgccgctccgcccgcgacggcgtggcggtgcggctgtgacgaacacaccgaagcccacacaggcatcgggagtcggcctcggcatcgaggaactggaggcgcaggaacgccgcctggtcttcacccggttcacgtacgaggacgcgtgggcgctgggctgcctgctggtcgagctggcgcgggcgcggcgcgccccggtcgccgtcgacatccaccgcgccggccagcagctgttccacgcggccctgcccggctccaccccggacaacgacgcctggatcgcccgcaaacgcagggtcgtggagcgctacggctcggcgtcctacctggtcggcgcccgtttccgcgccaagggcacgacgttcgaggactcctcccgcctggacccggacacctacgcggcgcacggcggctccttcccggtcaccgtgaaggacgtcggcgtgatcggcgcggtcacggtgtcgggcctgccgcaggtggaggaccaccggctggtggtggaggcgctggaggcgtatctcgacctctaggaccaccggacaggaccgacggacaggcggacaggaccgacggataagaccgccgggccggactcgccggacaggactcgccggaccggactcgccgggccggggaatgacgggcgccgccgtcgcggttggggttggctgtacgcatcgccgatcaggcatctgatcgcgcacgcatctgatcgcggcacccgcccggagggatcggaaccgatgagcgagacggcagacacggcaggcacggcagacggggcagccccgctgaaggagacggtcggacggtacggcgtctggagcatcggcctccgctcggaggacccggcccggcgcggcgcgatcgccgaggccgccgccgagctggaggagctgggctac

SEQ ID NO: 1648 - DNA, 897 bp, Unknown
  Kingdom: Bacteria, Phylum: Actinobacteria, Class: Actinobacteria, Order: Streptomycetales, Family: Streptomycetaceae, Genus: Streptomyces
tcaccgtctccgaccccacggtccgcggccaggccgtcacgacggcgctgctgccggtcgtcggcatccccgtcctcgccgccgcggccgcactgcacgacctcccggtggcccgtgacctcaccttcctcgcgttggtcggcgcgggcgtgtacgcgcgccgctgggggccgcgcggtcacagcctgggcgtcttcgcgttcatgaccttcttcgtggcccagttcctgcatgccacgaccgggcagctgcccgagctgtccgccgcggtcgtcctgtccgtgctcagcgcggcggcggtccgcttcgggctgtggtgctacgaacgccggcagccaccggccgcggtgcccgcgtcgccgtccggcaccggactggcccgggtgaccacccggcaggccgtccaggcgaccgccggggccggcttcgcgctcgtcgtgggccaactggtgtccgggcagcgctggtactgggcggtcggcgcgacctggtgggtgttcgtgaacaccgcctcgcgcggcgagaccctggtgcgcggcttccgccgggtcctcggcacggtgctcggcctcggcctcggcgccctgctcgtcgctccgctgcacggtgccgcactgcccacggccgtgctcgtcgccgtcggcgtcttcgggatcttctacacggccgccgtgtcctacacctggatgatgctctcggtcaccctgctcgccgtctcgctctacggtctcctcggcgtcctcagtcccgcgctgctcgccctgcggctgggcgagacggccgtcggggcactcggtgcctggctggccgtgctgttcgtgctgccggtcagcacccacgccgtcaccggcgcctggatccagcgcgctctgcgctgcgtccacgcctgcaccgccg

SEQ ID NO: 1649 - DNA, 520 bp, Unknown
  Kingdom: Bacteria, Phylum: Actinobacteria, Class: Actinobacteria, Order: Streptomycetales, Family: Streptomycetaceae, Genus: Streptomyces
  misc_feature (208)..(239): n is a, c, g, or t
ggcctcctcgtgccgcccctggcgctggagggtgcggcccagcatcagccgggcgtagtgctccaccgggtcgcgctccacgatcacacgcaactcggtctccgcgcggcgcagttgagccgagtggtagtaggcgcgggccagcagcagccgcgggccggtctgctccggtacctcctcgacgagtcccttcagcacgcgcgcggcnnnnnnnnnnnnnnnnnnnnnnnnnnnnnnnnacggaactaagtgattgaaaattccactactatcgccgtccttcctgcgccgtcatcggccgggcaggccctaggttgggcgccatgagcaatctggatcgccaggcggttccctcggtgtgcggcggccgggggttcgtggtggcggagcccgtacgggaactcctcagcccgcgccgggtcaggctcggcgagtccaccgaggtccgccgtctgctgcccaacctgggccgccgcatggtcggcgcctggtgcttcgtcgaccactacggcccggacga

SEQ ID NO: 1650 - DNA, 1693 bp, Unknown
  Kingdom: Bacteria, Phylum: Actinobacteria, Class: Actinobacteria, Order: Streptomycetales, Family: Streptomycetaceae, Genus: Streptomyces
gccggcctgggcatcgccgcgaggaaccgcgtaccgcaagcggtgactcgcggcgatgcccaggccggccgcggagacggcggaacagacggtctcggcaatcatccggtcctccaggcagcgctcgcgatcggggcggttcgtcccttccatcctgcaccgtccgcgggccgggcagccatgtcccggacggagatcagggacatctccgggtcgcctcctccgcaggtgccgctcggaagacccggcgccgctgcgtgccgctccgtccccctgccctctccgtgttcgctccctaccgttccgtgcgtgattgggtcctgcgcggtgggcctggaacactggagtcatgagcgactcctcccccgcacccgcggtccccgttctcgaggtgtggtgcgaactgcagtgccccgactgccgcaccgcgctggacgacctgcgcgccctgcgtgcccgctacggcgaccggctggagctgcggctgcggcacttcccgctggagaagcaccagcacgccttcgccgccgcgcaggccgccgaggaggccgccgagcaggggcggctgtggccgtacgtggaggcggtgctcgcccgggccgaggagctgggccgccagggtgagcctctgctggtcgaggtggcccgcgaactgggcctggacgccgaggagttcgacacggcgctcatcgacggccggcacatcctgatcgtggacgccgaccaggccgagggcaaggcgatcggggtgacgggcacgccgacctacgtggtgggcggcgagcgcctggacggcggcaagagccaggagggcctgcgcgagcatatcgaggagatcgtcgaccggctgctggcggaggcgaccggcccggcggaggactgacggctcccccgcggcagttcctcgcagggctcccccttacggcagcttcccgtagtcactgcacagttactgcagctccttgtagagggagtagaggaccgggcggtagccgagggagtcgtacaggcgctccgccggggtgttgcccgcgaagacgttgaggcccaggacgtgtctgccggcggcgaccgcctgcgcctcggccagcagcatcagtgagcggccgtggccccggccgcggaagcgcgcgtcggcctcgacgtcgtagacgaaggccttgtcctcgtcgatcgcgagccacagggtgccgaccggggtgccctcgtgctccaggacgctgagcagcatgccgggggtcgccggtccccgcgggagcagcctggcgtggtcggcctccgacttggcgtgcgcctcgtcggcgggcacgccgcggtcgatccagctctgcgcgtaggtggccttgccgtggtcgagccacggtccgtactcggcctcggtcatcgctctgccgcggctgcccgcgggcagtcctggcgcggtggtgcccaggtgcttctccaggccgcggttgcgctggacgtagccgagggccgtcaccagccggagtgcggcctcctccccggcgggcacggcgatctcgatgcggtggcagccccagccgcgcgccacctcctcggcggccagcgcggccaccgtgccgcggccccgcccccggtcgggtgcgtcgacgcggagttcgaggatccgggcgacggccgggccgaagacggggtgggtcgacaggtgggtcacgccgacggggcggctgtt

SEQ ID NO: 1651 - DNA, 1140 bp, Unknown
  Kingdom: Bacteria, Phylum: Actinobacteria, Class: Actinobacteria, Order: Streptomycetales, Family: Streptomycetaceae, Genus: Streptomyces
tccgacgccgacgcggacgtggcgggcgtccgcgtcggcgtcggagaagaccgccaccgagcgcacgccgagcgcgcgcagggtgcggatgacccggacggcgatctcgccgcggttggccaccagaactgtgtcgaacatgttgatgaagtccccctcacatccggaagacgccgaactgggggtcgcccagcggagcgttggcgcacgcggtcagggccaggcccagcacctgccgggtctccagcgggtcgatcaccccgtcgtcccacaggcgggcggtggcgtagtaggcactgccctggcgctcgtactgcgcgcggacgggcgccttgaaggactcctcgtcctccacggaccattcctcgccgcgcccttcgagctggtcgcgcttgaccgtggcgagcacggaggcggcctgctcgccgcccatcacggagatcttggcgttcggccacatccacaggaagcggggcgagtacgcccggccgcacatcgagtagttgcccgcgccgtaggagccgccgacgacgaccgtcagcttgggcacgcgcgtgcaggccaccgccgtgaccatcttcgcgccgtgcttggcgatgccgcccgcctcgtagtcgcggcccaccatgaaccccgagatgttctgcaggaacagcagcgggatgccgcgctggtcgcacagctcgatgaagtgggcgcccttctgggcggactcggagaacaggatgccgttgttgccgatgatcccgaccgggtggccgtggatccgggcgaagccggtgaccagggtctgcccgaactccgccttgaactcggcgaagcgcgagccgtccaccacgcgcgcgatgatctcgcgtacgtcgtagggcgtacgggagtccacgggcaccgcgccgtacagcccgtaggggtcgaccttcggctccacgctcccggtgacctgccagggcagcgtcccgcgcgcggggagggtggagacgatggtgcggacgatccgcagcgcgtgcgcgtcgtcctcggcgaggtggtcggtgacaccggaggtgcgggagtgcacctcgccgccgcccagctcctcggcggtcacgacctccccggtggccgccttcaccagcggcggaccgccgaggaagatcgtgc

SEQ ID NO: 1652 - DNA, 510 bp, Unknown
  Kingdom: Bacteria, Phylum: Actinobacteria, Class: Actinobacteria, Order: Streptomycetales, Family: Streptomycetaceae, Genus: Streptomyces
gaccgccgaggaagatcgtgccctggttgcggacgatcaccgcctcgtcgctcatcgccgggacgtacgccccgcccgccgtgcacgagccgagcaccgccgcgatctgcgggatgcccgcgcccgacatgcgcgcctggttgtagaagatccggccgaagtgctcccggtcggggaagacctcgtcctgcatcggcaggaacgcgccgcccgagtcgaccaggtacagacacggcagccggttctccagggccacctcctgggccctcaggtgcttcttcaccgtcatcgggtagtacgtgccgcccttgacggtggcgtcgttggcgacgatcacgcactcgcgcccgctcaccctgccgatccccgcgatgaccccggcggccggcgcctgcccgtcgtacattccctcggcggccagcggggccagctccaggaacggcgagcccgcgtcgagaagggtgtccacgcgctcgcgtggcagcagcttcccgcgcgcggtgtggcggg

SEQ ID NO: 1653 - DNA, 1506 bp, Unknown
  Kingdom: Bacteria, Phylum: Actinobacteria, Class: Actinobacteria, Order: Streptomycetales, Family: Streptomycetaceae, Genus: Streptomyces
tgcacgctcagcagggtcagccggtgcgcgaggacgtcgtgcatctcccgggcgatggcctcccgggcgagccgctgtgcctgctcggcacggagccgcgcctccgtctcggcgcgccgcgcccggtcccgcaggctcagcatgagctgccgcttggaccgtacgaacatgccccagccgatgacggacaaggtcagcagcacggcgaagacgacgatgcccgggtaggagaggtcggggtcgggacgcagccagtagaacagcgggatcagcgcgagctgggcaccgcccacccaggccacgtaccggaacgggcggtgcacggtgagcgtgaagagggagacgatgacggcgccgcccgcggtgttcgagacgatgccgacgggggccatggcgatggcgagcgcgaggggccagcggcggcgcagccagatcgcggcgcaggccagcgccccgagcacctggtcggtgacggccagggcgcgcggcaggtcgtgctcgtcgggcagggagttgacggcgctgatgccgatgagcacggcgaggaagaagcaggagaagtcgacgaaccagtcgcgcgcggtgcgccgggcgcggccggtgcggcccgcgtcggggtcgagttcgtcggccacggcggagggcagccaccatcgccgtccggtgaacaccgtcggttcctgcatcgtcctgtcagctgtcacagtcgacaaatctacgcaacgcgggaggtccgccagcgcgcgctgagcacatcggcgaccaaagtcacggcgcctgcgaccttcggctctccgccccgggcgggccgtggaccttggtcggtcatgtcgcgccccgcggccgatgcgcgtggggggagcgcggagcgagcgtggggttcatgaagaaggttctggaggtcgtcggattcatcgccctggtgcagggcgcgctgggattcgtgcaggagttcaccggctggcacgtgggcctggtccgcaaagtgtcgttcctccacggttacgaggtgttcgtgagcttcgtcctgatcgtgctggcctgcgccctgttcgccgccgccgacagccgcaagcggtgagcactgcaccagtgaggcgcgagcggtgaagggtgagcgggtgccggacggccgggcgaccggtggggcggtcgcccggcggcgggctcagcagccgaagtcgacgagatcgaacgtggcgtagtggtccgaggtgtagtagtcctcctgggtccgctcaccggtgacgatgcgccgggcgccccgggtgggggaaccgggggtgaccaccgtgtactcgtggtagtagccgctcgcccggctgggcaggacgccctcgcggttctggaagacgctgccgtcctgcgagtaggggaaggggccgccctggtcgatcaggtcgagcgtgtggtgggcctcggagggcagggcgccgtagcagatgctgccgaccgaggtggtggcagcaccgaccggggccgtggcggcgccggcctggccggcgg

SEQ ID NO: 1654 - DNA, 1216 bp, Unknown
  Kingdom: Bacteria, Phylum: Actinobacteria, Class: Actinobacteria, Order: Streptomycetales, Family: Streptomycetaceae, Genus: Streptomyces
gcgccgggcagccgcatggcttccagtaggcactcgtcgattccgggcacgctcgttcccctcccgcctggggtttcggctgagtgatgccgacgctacgcacggtgtgcgggggcagtgggggttacggcattttccagtggaacatgcgcccgaggaactaatgtgggtcggctgaccctcagggggcacacccgcaccgccccacgaagcccgtcctgccggtacccgacagccacccggcccggccgcgcccgccctcgcccggcgctggcctcgcccggcgctggcctcgcccggccgggccgggtggctgtcgggtaccggcaggacgggcttcgtggggcggtgcgggtgtgccccctgagggtcagccgacccacattagttcctcgggcgcatgttccactggaaaatgccgtaacccccactgcccccgcacaccgtgcgtagcgtcggcatcactcagccgaaaccccaggcgggaggggaacgagcgtgcccggaatcgacgagtgcctactggaagccatgcggctgcccggcgcgcggggcgccgcgctggtcgactggacgagcgggctggccctgggcgccgtcggggagcccccgggcggcgaccacgagaccaccgcggcggaagccgctgaactggcccggctggcagcggagcaccgcgttcgccgccgccgacgacagcgcggtcccgacgcagacgcaggtgctcggcgcgctggacgcggtggtgggcgaggaggacgtggtgatcaacgcggccggttcgctccccggcgacctgcacagactgtggcgggcccgctcgccgcgccagtaccacctggagtacggctactcctgcatgggctacgagatcccggccgccgtcggcgtgcagcaggcggcgccggacacaccggtgtgggcgctggtcggcgacggcacctacctgatgatgccgacggagatcgtcacggccgtgcaggagcgcctgccgatcaagctgctgctgctccagaaccacggttacgcctccatcggcggcctgtcggagtcggtgggcgccgaacgcttcggcacggcctaccgccaccgcgccgccgacggctccttcaccggcgccccgctcccggtcgacctcgccgccaacgccgccagcctcggcatggacgtactgcgcgccaagaccgtgggcgagctgcgcgaggcgctgcgcacc

SEQ ID NO: 1655 - DNA, 6888 bp, Unknown
  Kingdom: Bacteria, Phylum: Actinobacteria, Class: Actinobacteria, Order: Streptomycetales, Family: Streptomycetaceae, Genus: Streptomyces
gcctcggtggcaccggccgtgaccaggacctccatgtccgggtcgtaggagaggccgtagcgccgctgctggtggtcggccacggccggtgccaccgaggccatcgcggcgacgctgctgggcctgctggaacccggggacgaggtggtcgccctggagccgtactacgactcctacgcggcctgcatcgcgatggcgggcggacgccgggtgccggtgacgctgcgcccgcacgagggcgcgttccggctggacctcgacgagctgcgcgccgccgtgacggaccggacccggctgctgctgatcaacaccccgcacaacccgaccggcacggtcctcacccgcgaggagctgaccgccgtcgccgaactcgccgtcgaacgcgacctgctcgtggtcaccgacgaggtgtacgaacacctggtctacgacggcgcccaccacccgctcgcggccctgcccggcatgcgcgagcgcaccgtctcgatctcctccagcggcaagacgttctcgttcaccggctggaaggtcggctgggtgacggccgccgcgccgctcgtggccgccgtgcgcagcgccaagcagttcctgacgtacgtcagcgcgggcccgttccagtacgcgatcgccgaggcgctgcgcctgccggacgcctacttcgacggcctgcgcgccgacctgcgccgcaagcgcgacctgctcggcgacggactgcgcgccgccgggttccaggtctaccagccgcagggcacgtacttcatcaccaccgacatcacgcccttcggcgagaaggacgcctacgcgttctgccgcgccctgcccgaacgctgcggcgtcgtcgccatcccgaactccgtcttctacgacgacccggacgccggccgcgcccaggtgcgcttcgccttctgcaagaaggacgaggtcctccaggaggccaccgaccggctgcgcggcctggcgtcctgacgcgggcggcgacccggccgaggacgaaggagagcaggcagaccagggccgccaccgtcagggcggccgcgatcagcagcgggcgtggccgggtcaggacggatccgagggcgccactggcgttgacgtaggtcaggaccaccgaaccggccatggccgacggtgccaccgtggcgaccaggcggctcagccatcgcgcgggcaggacgagcgtgcccagcaggcccgccgcgcaggggcagaccacggtggtgagggcgaatccgccctgggccagccggccggtgtgggcgagggtgtgcgcgtagccgccgctgagcagcggcgacagcgccgccagcagcacgggcgtggtgagcgggctgaggagggtcgaggccaggacgaggcccaccatcgtcggctgatctccctcgcccttggcggtccacacggtggccccagcggcgacgggcatcgccacgatcaggatcagcgcggtgagcagtccgctgccgccgtcggcgtcgggagtacgccgcagcaggaaggcgacgaacggcacgaccgccagcgggatcgccaagtgcaggacgagcccggccagcagggccttcggctgccgcagcaggccggccagcgcactgacggggacctgcagcccggccgagaacagcaccagggacagcaggaacggtgcgatgtgcagtgtcaggtgtgtcagcggcaacggatggaggcggcgcagccacagcccggggccgggcaggaacagagcgagggcgtaggacatggcgacgacgcggccgagccggtgccgcagccaggatgcggcgcgagtgtgcatggccccatcgtgatcagggccgattcggcgggcggggaaagccgcgcggcagtcaggatgcgttcaggtaaccgctggcaacttcctgcccatgacctacgaactctccgggactcccggtactcacgggactcccgaggccgaaccggacacgagtgcctccgctcgcctctcccgccgtccgcgctggaacaaggtccccgaggtcaccgcctacttctggatcatcaaggtgctgtgcacgacggtcggtgagaccgccgccgacctgctcaacgagaaggcggggctgggcctgaccggcgtgtcggtgctcatgagcgcgctgctcgcggtggtcctcgtcgtccagttccgcaccacggcgtaccgcgcgggcgtgtactggctcgccgtcgccctgatcagcgtcgtcggcacactgatcagcgacaacctcaccgacaacatgggtgtgccgctggaggcgagcaccgcggtgttcgcgctcctcctcgtggtcgtcttcgtcgtctggtaccggcgggaggggaccctttccatccacagcatcgacaccaccagccgcgagtcgttctactggctggccgtgctgttcaccttcgccctcggcacggccgccggcgacctggtctccgagcgcatggacctgggctactggctctcggcggtcctgttcggcctggccatcgccgccgtggcggtcgcgcacttcgcgctgggcctggacgcggtgtacagcttctggatcgcctacatcctgacccgcccgctcggcgcctcgatcggcgactacctctcccagccgaccggcgacggcggcctcgggttcggcaccgtcgtcacgagcggtctcttcctggccgtcatcctcggcctggtggtgtacctggcggtgacccgcaaggacgtggcggaccccgcgcgcatgacgcggcaggcggtctgaacggctggaaggcgtgcaggccgagccggtcgcgaagggcggactcgacctcggcacggcgggttcgccggccgtgccgccggccgtactggcaggtctgacgggtacgcccacacgcagccgcagccgcagccgcagccgcagccgcagccgcctccgcagccgcagcctcgcctcggtccgcggccctgacttccggagacgggcgagtacgacagggccacctggcgggccgcctgagcgcgaacggcgccacgctcaccgggcgggcgcgggagagcgtcccgcgcccgcctccgcacctgactgccacagcctgtcgagagaggatgtgtctgccggactcgtccggtgaagaggagagcgccaccaggaggtggtccggtgttcaggaggcgatgtccggcccgccgggcacgagacaccaccctggggaggcgctcgtgaagcccgcccgcaccacgtctgccacgcccggaccgtcggacagacccgcccgggggctttcggcgtggcgattcgtgttggtgttcgggggcgtcagcctgctgatggacttcgtctacgagggcgctcgttccgtcaccggcccgctgctcgcccatctgggcgcctccgcggccgtggtcggcgtggtcacgggggcgggtgaggcagccgcgctcggactgcgtctggcttcgggaccgctggccgagcgcagccgccgcttctgggcatggaccatcgccgggtacgtgctgaccgcggtggccgtcccgctgctcggtctgaccggcgtgctgtgggcggcctgcgccctggtgatcgcggaacgcgtcggcaaagcggtgcgctccccagccaaggacacactgctctcgcacgccaccgctgccactggaaggggccgcggcttcgcggtccacgaggcgatggaccaggtcggcgctcttgtcggcccgctcacggtggccggggtcctcaccctcaccggcggtgactacgccccggcgctcggggtgctcgccctgcccggcgccgccgccctcgcgctgctgctccggctgcgtgccagggttcccgatccggtgggctacgagacgaccgccggcgcggcggcgcctgaggagcctcacacgcccgaggaaccggtctcgccggaggaacaggactcgcccgaggaaccggtctcgcccgaggaacccgactccgccgaagagccggactcgcccgaagagccggtctcgcccgaagaaccggtccctgccgggccctgggagaggaaactgccgcgggctttctgggcctattcggtcttcaccgcagcgaccctgaccggtttcgccaccttcggggtgctctcctatcatctgaccgtccggcacctggtgccgacagcgatggtgccggtgctgtacgcggcggccatggcggcggacgcggtggcggcgctggccacgggctggctgtacgaccgcttcggtgcccaggtcctggtcgtcctgccgctgctgtccgcagccgttccagccctggccttcacccgcacggtggcggtcgccgtggcgggcgtgctggtgtggggcgccgcggtcggggtccaggagtccacgttgcgggccaccgtcgccgacctcgtacccgtgggccgccgggcctccgcgtacggtgtgttcgccgggatcacgggagcggccgcgttggtcggcggcaccttggccggggtcctgtacgacgtctccgtcccccttctgatcgtcgtcgtcgccggaatccaggccgccgcgctcgttctgctgtgggtcacccgggccgtgcggtccacgcccgcgctctaagcggcggacgttcgggcatccaccgggcgttctcgtcaccacgccgctgtgcgggcgggcctggcggagaaacagccgccgccggttcagggcggcgggaccgccgcgcggttctgcccggtggtcacccgaagaccaccatgtgcgtggggggttgccctggcgccggggacgggccgcgaagctcaccttcgatgagtacgtcacgcactgcgtcgcgtaccgccctgacgcagtcgccccggtactgctggaacaggggagtggcctggagcagcagcgaaccgttcggaagagcgacggccgagtcgaaggcttcggagaaccgcagagcctccgcccctccgaggagttcggcgatcgccccggacaccaccatcagccaggaatatcccctgaggcgttcacgccactgcggggtgttccgggaaggtacccgtgccggcccccgcatatagcgctcgagctcggtcactcccccggagcgatcgtacgagaaatgcccgaacactacgttgtatcgcccgcacgcccaacggaccgtggtcagcaggcgcgcgtgctcgtcccgcgcggtggccgcaccggtcaacagcgcttcgtcgacgcggtaggaaagcttcacgtagtccggaagctcttcgtcgaaagagacggagagccggacgagtgggttaccggtatcgccgcccgccgaaagcctgccgatttcgacctcggcgaattcgggtgattcctcgatgcggctcctcagccaggataccgcatccgcaccgtacgggctgtgcagaacgtcgagtgaccccgaaggcgcaaccgacgcaatgctccacatactcccctcggtccgctcattcaattcattgtgcgtggcggctcgggtcactccatccgtaagccacccgagcgcggccgagacaagatccggccgttcctctccgtacacggtgagttccgccaccaagccatggctcaccgaggaattaatcgattcgaagacatccatcgcagtcacccgtagatttgaacggttgtgcagcgggcccaatggcccggggaagctcccagccgcggtgcaccgacctgccgaaggtctccttctcctcggtcctatgcacgcaccgatgtaccggtcgagcgtggccgggtgaggtgctcagggtgtggttgccgccggcagtcgacgaccgtgatcccctaccctcgtacttcgagcggggcccggcgagcggcttgcctcagcaggcgtccatgcgcttgaccaccgcctcgcccgcttccgcggcccctgcgtaaaaggcccgcagccgttcgaagtgggccgtgaggacgtccttcggccagtcgatgccgtatcccagggccgaacggtggcgcgcgaaggtcgcctcgaagtcacactcgctcaggaagccgtgcgccttcgccgcttcttccgcggacaggcagagcaggacgtcgagcgggccgcccagcgtggcgatgtggtctccgcccagcacggggaggacctgcgcgccggtccgcggaaactgttcgcccgtcagagccaggttcaccaggctccagtcctcgcccaggctgcacaggattccggcatcctgctccgcggagtacacatcggaatcctggagagcagtgaaccccgactccagaaactccgcccctttttccaggtcgacagacgcgacgcggcgcattctcagtgaggaattcatgctcagttccattctgccggtcatagtcggtgacattaccgtgccaccattccctggctttgcggtggagcagggccgcacggtggacgacccggacaccgacaccgccgcaccggaccggatgcatgccaccaaccacctcggcatgatcgccgtcatccgggcagcctcccgagcgccgcgcgcgggcggccgcatcatcacggtgagttccggactggggtcccgggccgtagccccgggccttgccgactactcggcgaccgagttgctgcaggcccctcatttcgatggcgggccccgcctgtggcctttttgtttttctggttcttctgtcctgactcgggcttcttgttcatgggcttcgttccgcgattgcctgtcttgccggatgagtcggggtccggctggcgggcgcagtaggcggcgatgtcgtcctcgccgcctgcggttttgatgaaccgctgccaggcgggtgaactcagcgctttgccgttgccttgcactgccgcatacgcgcggcagtgggcctgcacgtccttggctgtcgggggacggtgcggggcggctgcgggcttgccgaccgcggtggcggtggcggtggcggtg

SEQ ID NO: 1656 - DNA, 2451 bp, Unknown
  Kingdom: Bacteria, Phylum: Actinobacteria, Class: Actinobacteria, Order: Streptomycetales, Family: Streptomycetaceae, Genus: Streptomyces
caaggagtacgcgtggcgggtctcgcgcggcgagtcgacgcggaacctggaggcgttcacgcacctgatccagcgcccggagaactgaacgggctgactcgacgggggctcagtgactgctgcggatcaggtagcgccccggggtgaccccgaccagcttcttgaagtgccgggtgaggtgcgcctggtcgtagaacccggtcaccgacgccacctcgccgggcgccagcccgtccagcagcagccgacgcgcgctgccgacccggcggctgcgggacctgctcgacgcgcgggtggtggacggggtcccgctggaggaggccgcgcggctgctgcacgcacatcccgcgcacctggtacgggcgttcagcggcgcgtacggcatcgccccgcaccagtacctgatgtcccgccgggtcggcagcgcgcgtcggctgctgctggacgggctggcgcccggcgaggtggcgtcggtgaccgggttctacgaccaggcgcacctcacccggcacttcaagaagctggtcggggtcaccccggggcgctaccggatccgcagcagtcactgagcccccgtcgagtcagcccgttcagttctccgggcgctggatcaggtgcgtgaacgcctccaggttccgcgtcgactcgccgcgcgagacccgccacgcgtactccttgcggatcgcggaggcgaagcccagctccagcagggtgttgaaggcgccgtcggccgcctccaggacctggccgagcaggcggtcgatctcgtcggcggtgacggaggagagggagaggcgtgcggtgacgtagacgtcgcctaggcggtcgacggcgtaactcacgccgtacatcctgaggttgcgctccaggagccagcggtggacgcccgcctcgttctcgtcggggtggcggacgacgaaggcgttcagggagagggtgtgacggccgaccaggaaggagacggtcgtggagagtttgcgggtgccggggagtttgacgacgtaggtgccgggctcgggggactcccactccagctcggcgtccttgaagacggcttccagaacctgccgggcctgccctgcctcgtccgtgtcacccatggtgggagcgtacgacacccgggccgggagccctaggacaccggggcgcgacgtacgtcagccgtggtgggtgcctacgtcagccgtggtgggcgcgtacgcgacggcggtgggactgcagtgccgccgtgtacacgtcggcggtggccgccgccgaggcgtcccagccgaaggcacgcgcgtgccgggccgcggcggcgcccatgcggtcggcgaggtgcgggtggtcggcgaagtcgcccagcacgcgcgcgtaggccgccgggtcgtggccctggacgaggaagccggtctcgccgtcgcggacggccaccggcaggccgccgaccgccgccgcgagcaccggcgtgccggccgcctgcgcctctatcgcgaccagcccgaaggactcgctgtaggagggcatgaccagcacggacgcggcccggaaccagtcggcgagctgctcctgcccgaccggcgggcggaaccgtacgacgtccgcgatgcccagccgggcggccagcttctgcagcccctcgggcttggcgaggccgctgccgctggggccgccgactatcgggacgacgatgcgcgagcgcaggtcgggacgctcgtcgagcagggcgccgacggccctgagcagcacgtcgggggccttgaggggctggatgcggccggcgaagagcgggatcagggcgtcctgcggaaggccgaggcgggcgcgggcggcggcacggccgtcgccggggcggaagcggtcgaggttcacgccggggtggaccacggcgaccttggccgggtcggcggtgtagtgccgtaccagctcctcggcctcgtcgtccgtgttggcgatcagccggtcggaggcggcgacgatctgggtctcgccgatgacgcgggcggcgggctcgggcgtgtcgccgtcggccaggttggcgttcttgaccttggccatggtgtgcatggcgtgcaccaggggcacgccccagcgctgggcggcgagccagccgacgtggccggagagccagtagtgcgagtggacgaggtcgtagtagccggggcggtgaccggcccaggcctgcatcacgccgtgcgtgaaggcgcacagctgggccgggaggtcctccttggccagaccctcgtacgggcccgcgtcgacgtggcggacgaggacgccgggcgcgaggtcgacgcggggcggcaggccgccggcggtggcccgggtgaagatctcgacctcgatgccctgggcggccaggcgctgggccagctcgacgatgtagacgttcatgccgcccgcgtcgccatgctctccgtgcacacctcaccgctccaccagcccggcaccggcgacgcgggcggcatgaac

SEQ ID NO: 1657 - DNA, 1845 bp, Unknown
  Kingdom: Bacteria, Phylum: Actinobacteria, Class: Actinobacteria, Order: Streptomycetales, Family: Streptomycetaceae, Genus: Streptomyces
gggaggcacctcgggcagtgcgagatggtgcgccgcgcccgccacgagggtggcggcgcccagggcgccgcgcgccgcgtcggtcagcggcgaaccgtcccagccgatcaccgtgacccggtcggccatcgttgtcagtctccagggggatgaagcaggtcgtcaggggcgacgcccgtgtgcgggctccgtgaggttacctggtggagccgcgcggcgcgcggtggggcggcggtgcggcggggtccggtccggtcggttccggttcagttccagtccgggaacgacgtgtaaccgccggtgtcggcgagttcctcgtcggcgccgtccaggtcttccgggagcaggctccacacgatgaagtcggtgcgtacgtcggtccaggtgccgtcctcggtgcggacgcgggctatgcaggcgttgcggagaacgccctcgctgatgcagccgatcttctgggcgacctgctgggaggcggtgttgtcggcggcggtgcgcagttcgatgcgttcgaacctctggtcaccgaacagccactgggcggtggcccgggcggcctcggaggcgtagccctcgccgcgggcccagggggcgatgatgtacgacagttcggtggagcggacgcgccagttggtcttggtcagctggacgatgccgaccagccgctgggtgaggaactcggtgaccgccaggtcgaggccgcggcccgcggtgcgctcggcgggggcgtagccgccgatccagcggagggcggcctcctcggtgaagggctgggggacgtgggtccaggcggcgacctgttcgtcgttcatcatctcggccagcgcggggacgtcgtcctcgtcgagagggcgcagcaccaaccgctccgtgctgatggagatgttggggaaggtgctagtcatggcgccgctccgtaaccttcggaaataccgtcagggcctgctgaactgcccagcatgcagcatcggcgcggcgcggcgcacccggggtccgccccctgtacggaagcggaccccgggtgcgacgggcgccgggcggatcagaacgccgggacgacggctccgttgtacttgtcctcgatgaacttcttcacctcgggcgaggtgagcagcttggcgagcttcttgacgcgcgggtcgttctcgttgcccttcttcacggcgaggaagttggcgtacgggttgcccttggcggactcggcggcgagcgcgtccttggcggggctgagcttggcctccagggcgtagttgccgttgatcaccgcggcgtcgacgtcaccgagggagcgcggcaggatggccgcctccagctccttgaacttcaggcccttggggttggcggtgacgtccttgggggtggcctcgtagccggcgccggccttcagcttgagcaggccgttggcttccagcagcttgagggcgcgggcctcgttggtggtgtcgttgggcagggcgacggtggcgccctgcttgaggtccgcgagcttcttgacgctcttggagtagacgccgagcggttccaggtgcacggtgccgccgggcaccggcacgatgtcggtgccgttcttcttgttgaagtcgtcgaggtacggcttgtgctggaagtagttggcgtcgacctggccctgctggacggccgtgttgggggtcacgtagtcggtgaactccttgacctccagcttgaggccggccttctgcgccaggtggtccttgacgtagtcgaggatctcgccctgcggggtgggcgtggcggcgacggtcagcggggcgttcgcgtcgctcttgccggagtcggagccgccgcaggcggtgagcccgaaggtgagggctccgacggccagga

SEQ ID NO: 1658 - DNA, 908 bp, Unknown
  Kingdom: Bacteria, Phylum: Actinobacteria, Class: Actinobacteria, Order: Streptomycetales, Family: Streptomycetaceae, Genus: Streptomyces
ccggctgggggcgtcacgccagagggccacggcgaggggatgtccaggcggggcggccatgacgacggtcatgacaagggggcgccccggcggcgaacgacccaggcggccggccgtgccgcctccggccggaccggaacccgccgaggcgcgcgttccggccgcccggggcgagtgtcagctgttgggacggagggtccagaccacggtcatctcggtggtgacggcgccgtcctcgcgctggatctcgacggtcaccgggaactcgggccgcttgccctcgtcgagttcggcgacgacctcggcggcgggacggccgagggtcgcggtggccctcaccgggcccagggcgatcttcttgaaggcgatccgggcgtccaccggcagcggcaccgccctcgcgagctggtcaccgaaggcggccagcacgatcgcgccgctggcggactcccccagcgtgaacatcgcaccggcgtgcggcccgccgacgtggttgcggtactcctcctggtccggcagggcgagtacggcccgctccggcgtggtctccaggtactcgaggttcagggtgcgaaccatcggcaccgtggcggcgagcaactcgccgatggacatctgatctgcgctcatgcccgaaggttactcacgagtagcacggtctggccagaccggaccccggctccccgcctccgctttctggtacgtccctgacaagggccggtgaccgaatcgtgtccccggagccctagggttactgctcatgtggccaggacagcagccgcccgggggcgagcagaacccgcaggacccgcagagcaacccgtaccagcagccggggtaccagcagccgaatccgtatcagcagcccggctatcagcagcccaacccgtacgcccagcagcctccgc

SEQ ID NO: 1659 - DNA, 4011 bp, Unknown
  Kingdom: Bacteria, Phylum: Actinobacteria, Class: Actinobacteria, Order: Streptomycetales, Family: Streptomycetaceae, Genus: Streptomyces
gcccgccggcaccgggtcgacgaggctgagctggccgatgtcgtgcatcagcgccgcgtgctcgaggacggtcagctcaggctccgcgaggccgaggtcacggcccacggcccggctgagcgcggcgacccggcgggcgtgcccggccggggtgtacccggcgacctcggtggcgcgggccagcgaggcgatggtctgccggtaggtgtcccgcacggacgcgtaccgccgcagggacagctgggtgagcagcagcggcacgcagaagaccggcagcgcccacaggccggccacggcgaccgccagggccatcaccgcgcccgtcgcgcacaccgcggacccgatgccgagcaggccccgcagttcctcgcgcagcagcgggccgaacggccaccgggtgcgccggtgggcctgcgcggcggcgagcacggcgccgcacagcgacgtgagcacgagcagggcgagcagcagcagggcgtgggcggggccgccccatccccggaacgccccggcgttgtacagcggttggaagcagacggcggcgaaggagacggtgaggacgcggcggaccaggtggtcgagggtccggctctgcccgcgggcgatgtgcggcacgctgccgagcagggaggcggcgagcaccacggcgaccacctggcaggcgctgtggtggctgggcagcccggcgtcctcgccgagcagggcgtacgagagtgctcctgcggcgccgagcggcgcggcctcgccgacctcggtcccgggccagcgggtgagttccccgaccagcacgagcgccccgaaggcgagtgcggtcccgggcgcgtcgaggccggtccacagggtgacggccaggcagagcgcggcgacgaggagggcggcggggcgcaggaaggccatcaggcgggaccgccgtgcgggcgggccgcgcggagcgcggaggcgccggtgacagtactggtgcccgtgcccgtgcccgtgccggcaccgggaccggtgcccgaggtggcggtgtcggccggtggccggggcggcgcggtgtcgtccccggcggtgaccgccgggtgccagccgtgccggtccagggcccggaccagggcggtgaccatgcgcgggtcgaactgcgcgcccgcacagcgtctcagttccgtcagggcggccccaaccggccgggcccgccggtaggagcgggtggacgtcatcgcgtcgaacgcgtcggcgacggcgaccacgcgcgcgcactccgggatctgggcgccccgcaggccgtaggggtagccgctgccgtcgagccgttcgtggtggtgcaggatcgcggcgcgggcctcccccaggaaggagatgccgcgcaccatctcgtgcccgtactcgggatggagttcgatcacgcgccgctcctcgggggtgagcgggccgtccttgcgcagcagccgggtgggcacgccgagtttgccgacgtcgtgcaggatcccggcgaagcgcagcacctccacacggtcgtcgtccatgcccagctcccgggcgatcatcatggaggcctgtccgacccgttcgctgtgcccgcgcgtgtacccgtccttgatgtcgacggcctgcaccagtgcccggatggtcgcccggtgggcggcgcgctcgcggtcgtactgcgcgtacacccaccaggacacgcacatgggcagcagcacgaggagggcggcgaccggaccgtacgggctgcgccacagcaccgccatcatcagtccgcccagtccgtgcacgccgatcggcgcgagggagcgggcgaacaggccgtaccaggcgtggcgcaccggcgctctcgccggccgccgcagcgcccctgggggcccgccggccgccggcagcgggatgcctccgtccagcaccgtcagcatcaggcagaacgcggtcacggcggcacccgcggtgacgagggcgtaggggaagtcgcagccgacgacggcgtcgcggccgcccagttcccagtggacgcgggcggccgcccacaccgcgagggtgagctgcgccgcccgccagacgcggcgcagggtctcggggcgctgtccggccgcggtgagcagggctccgggcagcgggacgagcgcggcggcgggcggcggcagcaggaaggcggcggccagcaggacggggtagaagggtcccgcgaagtgccgccggacgagccggttgcagccggcgtagaccgccgcgagcgcgatcaccgcgctccagggcgtgggcatcaccggcaggggcagcaggcaggccagggcgccgagggcgatacagatgacgtacgcgcgggcgcgcggcgcaaccgcctccatgacgcccctcccggtcatgcctgtccacggccagtgggccgagcctagggcgcggggaggggggtccgcgggccgataacccgcggattagcacgtaagggtgaaccgcggggttcaggtctcctggggagtcaccggtgcggtggtcacgtcacggtcggcggagacggggcggtcggagacggcgcagtcggagacgggctggcccgagcggatcaggtccagccggcccatgaccttggcgcgcaggtccgagggcacgtcgtcatgaccgcagcaccgcttgaccagcttcttcacggcctgctccaggccgtacttctccaggcacggcgagcattcctcgaagtgctgccggaacttgtcgcgatcgacgtccggcatctcgctgtcgaggaactcgtacaggtggtcgaggacctcactgcagtccgtttcgtgcggctctccgcagctcatgagcccgagcctttcgcttcgttcgactctccggcgccggccgggaccagtccgcgctcgcgggcgtagtcctcgagcatgccgcgcagttgacggcggccccggtgcagccgggacatcaccgtgccgatgggtgtccccatgatgtcggcgatctccttgtacgcaaagccctctacgtccgcgagatagacggcgatgcggaattcctcggggatcgcctgcagcgcttccttgacgtccgagtcgggcaggtggtcgagcgcctgcgactccgcggagcgcagacccgtcgacatgtgcgactcggcacgggcgagctgccagtcctcgatctcctccgcggcgctgcgctggggctcacgctgcttcttgcggtaggagttgatgaaggtgttggtgaggatccggtagagccacgccttgaggttggtgccctcacggaactggtggaaggacgcgtacgccttggcgtacgtctcctgcaccaggtcctcggcgtcggccgggttgcgcgtcatgcgcagcgccgccgagtacatctggtccaggaactccagggcgtcccgctcgaagcgcgcggtgcgcgcggcggtcgactccgcgggcgtgtccccgcccgtgccctggccctcgggcagctccgcctggccgttgtcggtccctgcgtcggtaccgggaaccggacccacctcctcaagcgacgtcgcgggaccgaaggcggccccactcgtttcggaggatagacgacgatccggtccgcccgccgcccgaataggggcggtccgggccgcgggcagcaccgaccagtccaggtcagtacggctgctgcgggccgggcagatggtcgaacccatgcggcggactccctttcccacgacgtcggcactggggcaccagcgcttctgtccgcctcaacagtgcgcgtagggcccgcattcccgggccgtcacccgagtgacagggcccaccgcgccacaccgtcggtgatgacgccgagggcctgctcctgggtggtcgcggcgcgcttgggcaccgcgaagccgtggtcgccgtacggaacggtgatcagctcgtgggggccctcggggaactcctccggcttgccgaaggggtcgttgccgccctggacgacgagggtgggcacgccggcggcgagcagttccgcggcgcgcgacttctccggcctgcccggcgggtgcagcgggaagctcagggcgagcacggcgtg

SEQ ID NO: 1660 - DNA, 1011 bp, Unknown
  Kingdom: Bacteria, Phylum: Actinobacteria, Class: Actinobacteria, Order: Streptomycetales, Family: Streptomycetaceae, Genus: Streptomyces
ccgcgcgccccgcgagcagccccccgtccgcccgattccgctcccgcacccggcgtaccgcgaccgggaacttcgccaggggtccgcacgcttgaatacagtggcaggaccggcaggaacagggcggttcccggaccgccacagcgatcgaagggacgtacatgcccatgggtcacacggccacagccgaggcaggctccggcggcctgacagcgaccgagcaccgcctggccaacggtctgcgcgtggtgctctccgaggaccacctgaccccggtcgcggcggtgtgcctctggtacgacgtcggctcccgccacgaggtcaagggacgtaccggcctggctcaccttttcgagcacctgatgttccagggctccgcccaggtgcagggcaacggccacttcgaactggtgcagggcgccggcggctcgctcaacggcaccaccagcttcgaacgcaccaactacttcgagaccatgcccgcccaccagctggaactcgccctctggctggaggccgaccgcatgggatccctgctcgccgccctggacgacgagtcgatggagaaccagcgcgacgtcgtcaagaacgagcgccgccagcgctacgacaacgtgccctacggcaccgccttcgagaagctgaccgccctcgcctacccggagggccacccctaccaccacacgcccatcggctccatggcggacctggacgcggccaccctggaggacgcgcgcgcgttcttccggacgtactacgcgccgaacaacgccgtcctctcggtcgtcggcgacatcgacccgaagcagaccctcgcgtggatcgagaagtacttcggctccatcgagtcccacgacggcaagccgcagccccgcgacggctcgctgcccgacgtgctcggcgagcagctgcgcgaggtcgtcgaggaggaggtcccggcgcgcgccctgatggccgcctaccggctcccgcacgacggcacgcgcgcgtgcgacgcggccgacctcgccc

SEQ ID NO: 1661 - DNA, 3746 bp, Unknown
  Kingdom: Bacteria, Phylum: Actinobacteria, Class: Actinobacteria, Order: Streptomycetales, Family: Streptomycetaceae, Genus: Streptomyces
ggaggcggcgcgccgcctccgcggccgtgcagcccgcgtcgaagtacgcggtgagcgtgtccagcagcggctgggcgccgccgcgggcgacgcggagcgggccgagcgtgtcacggaccaggtcggccatggcctgccggtcgcgggtgaggacggggtagaccaggagatccgccgctcgcagcaccggatccgggagttcgaggcggtcggcgaggtcgagggcgttgagtgcctcctcgtaggagtggaccacgccgccggcgccggggtgcggccggccgatggcgaccctgccgccgtccgtggccgcgtaggcgtgcttggcgaagaacgcgagcacgtcgtcctggtcgcccggggcgacgcagaccagccggccgtccttggtggtgagcaggacccggcgctcaccgaaccgggcgagcagcgaggtctcgacgtaccgggtcgccgggtgggtttcgtcgacgggttcggtgccctgggcgaccgccacggcgtgggcgtgggagaagagcagtccgaagcgttcggcgcgttccgcgagccggccgaggtcactacggccgtagagcaggtcgtcgatgaactcgcggcgcgcggcctcctccttgcgcacggcgagtttctgggcgcgttcgtggccctcggcgaacgcgtcgatggcctgttcgacagccgcgaggacccggtccacgccggcggcctgcagggtggcggagaccgcgcgggtctccgccaggtgccggtggacgagcccgcgcaggccgtgtccggcctccgccgcccgttctccctgggcgcgcagcagttccagctcgtccctggtgaggcggcggccggtgacgcagacgtcggccaggatccgggtgtagcccctcagatactcctcgggcacctctggtggccgtgtcacggaccctcccccgccttgatcggacagccttgctcgagcggacggcctcgggtcgcacagtcctgaccggacagctctgaccggacagcccggaccggccgctgacgttttcttaacgcactccgaacggcagtaccaaaccccgctccccgcgcaccgcccgcagacggtccctgacctgtccggggcgctgccgggcaccccctgaagagccggatttccgtcgggttagcatatgagcgctgcctagctcgaaagagaaacctgtgactgtcaacgacgactcgttcaccaactggaagcaccgcgaggagatcgcggagtcgatgatcccgatgatcgggaagctgcaccgggagcgggacgtcaacgtcctgctgcacagccgctccctggtgaacaagtcggtggtgagcattctcaagacccaccggttcgcccggcagatcgccggcgaggagctgtcggtcaccgagacgctgcccttcctggaggccctcaccacgctggacctcggcccgtcgcagatcgacatcggcatgctggccgcgacgtacaaggccgacgaccggggcctgtccgtggccgagttcaccgccggggccgtcgcgggcgccatcagcacggaccagaccgagcgccgcgagggacgcgatgtcgtcctctacggcttcggccgcatcggccgcctcgtcgcccggctgctgatcgagaaggccggctcgggcaacgggctcaggctgcgcgcgatcgtcgtccgcggcggcggtgagcaggacatcgtcaagcgtgcctcgctgctgcgccgcgactccatccacggccagttccagggcacgatcacggtcgacgaggcgaacagcacgatcctcgccaacggcaacgcgatcaaggtgatctacgccgacgacccctcgtcggtggactacacggcgtacggcatcaaggacgccatcctcatcgacaacacgggcaagtggcgcgaccgcgagggcctgtcgaagcacctgcgtcccggtatcgggaaggtcgtgctgaccgcgcccggcaagggcgacgtcccgaacgtcgtgcacggcgtcaaccacgacaccctcaagccggacgagcggatcctgtcctgcgcctcgtgcacgacgaacgcgatcgtcccgccgctgaaggcgatggacgacgagttcggcgtggagagcggtcacgtggagaccgtccactccttcaccaacgaccagaacctgctggacaattaccacaagtccgagcgccgcggccgcagtgcgccgctcaacatggtcatcaccgagaccggtgccgcctccgccgtcgccaaggcgctgcccgacctcaaggcgcggatcaccggcagctcgatccgagtcccggtgccggacgtctccatcgcgatcctcaacctgcggctgcggcgcgagaccagccgcgaggaggtcctggaccacctgcgcgaggtctcgctgacctcgccgctgaggcggcagatcgacttcatcagcgcgcccgacgcggtctccagcgacttcatcggctcgcgccacgcctcgatcgtcgacgcgggtgccacgaaggtcgagggcgacaacgcgatcctctacctgtggtacgacaacgagttcggctactcctgccaggtcatccgggtcgtccagcacgtctccggggtcgagtacccgacctacccggcacccgccgccctctgatccgcggcgcctgcccgtagttcgatccggtccggcacccctcgcgcgcctctcgcgcgtccggggtgccgggccgtcccgtgtctgcgggatccgggccgcgcgcggtgcccggccgtcccgcgccccggtgtgttcgcggcggccacccggtgtgttcagggcgaccacccgcccggtgtgcggcgcgggcggtgtgtgagactgcggccatgatccgtgccgcgaaccccgccgacgtgcctgtcatccacgccctgatccgcgatctggccgagtacgagaaggcgctcgacgaggcgcgggccaccccggagcaactctccgaggcgctgttcggcgaacggcccgcggcctacgcgcatatcgccgaggacacggacggcgaggtcgtgggcttcgccctgtggttcctcaacttctccacctggcgcggcgtgcacggcatctacctggaggacctgtacgtacggccgcaggcccgcggcggcggccacggcaaggccctgctgaccgagttggcccgcatctgcgtcgagcgcggctacgagcgcctggagtggtcggtcctgaactggaaccgtccgtcgatcgacttctacgagtccctgggcgcccgtccgcaggacgagtggacggtgtaccggctgacggacgagccgctggcggccctgggccggccggcgtagcgggccctcgccacccccgggtcttccgggcgcgggagagggcgcccgatgcgaaaatgtgcccgtggggtcctgtccgtggatggggatgacagcatgggcgtcagcggtgccgcgcgcagcgcgtttccgggcgatccgctcgacagcacgtccacggccgtggcgatcgtcgacgccgaggggctgatcgtccgctggagccacggagcccaggagctgctcggccgtccggccgccgaggtgctgcgccagcccgtgggcgacctgttctcgagcggcgacccggccgcggtcgtggcccggctgcacgggatccgccgggactgggagggcgtggtggccctgcgccaccgggacggccacaccgtgcggctggccgtccgggtctcgccgctggccgccgcggccggggcccgtgag

SEQ ID NO: 1662 - DNA, 1717 bp, Unknown
  Kingdom: Bacteria, Phylum: Actinobacteria, Class: Actinobacteria, Order: Streptomycetales, Family: Streptomycetaceae, Genus: Streptomyces
ggagcggtccgcgccgggttcggccacggcacggaccgctccggcccgggtccggcggtgcggagcggctcggaagggcggtgtggagggtgtggctggtgtgtgcgggcggcgcccggtcagtcgaccaggaagtccgccaggcccgccttggcgccctggaggaacatgatcatctcgtcccgggtgtagatcagcgcgggcccctccgggtcggtggactggcgcacggccaccctgccgtcgggcaggcgcttggcctcgacgcaggagccgccgttggtgccgctccacggcttgtgccagccctcggtgcccagttcgcccgcggacatgccgttgcggaccggaccttgaggtgccgggccttcagctgccggaccttcgggtgtccggggtgcggtggacgtcatgggatcacaactccttacgcagttcggtcaggatgccctcggtccgtgacaccggctccgcctggacggccatccggtccagtacttcgagatacgcgacgacgtcctgcggccggtcgtagtagacggaacccgccaggttctcggtgtagacgatgtccggcagttccgagaagccgaagcggaagtggtggaaggggccgtaggcgccggggtggacgcccacggagtaaggcatgatctggatccgcaccttgcgcgtccgcaggacctccagcagccggtccacctgggcgcgcatcacctcggggccgccgacgggacggcgcagcaccgtctcgtccaggatggcccagacggccggggcgtccggcttggtgagcaggtcctgccgtctgaggcgcaggtccacgcggcgggcgagttcctccttcgactcgttggggaaaccgacgcgcatgagtgcgaaggcgtagccgaacgtctgcaacaggcccgggacgtagtgcggttcgtacagacggatgacgctggcctcgctctccaggctcacgtacgccttgaaccactcgggcagcacgtcgcggtacgtgtaccaccacccgggcctgttggcctcccgggccatggcgacgaagtcgtcggactccgcggccgggacaccgtaggcgcgcagcagttccctgacgtaggggatacggaggccgacctcggccttctccatgcggcggacggtcagcggggtcacctcgatggcccgcgcggcgtcctcgaaagagatcccggcccgctcccgcagctgccgcagacgcttgccgagaaccatccgcaggacagtgggtgcgctgccgccggagcggttctcactcacctctgacctcccggagcggctgtcacagcgtgcagtgtcccacgctcccgacgactcgaacagggtgatgcggagctggctgaaattatcagaacgcaggttgcgagccgagtgtgtgccacatcatagtgatccgggaagccatcgcccggaagtcttccttgtgatcaactccgggcgctggtatgggaactgatgttccgacaggtgcggtacggccatcgggtcgtacgggactgcgaggcgagagctggatgaccaccgtgaccgacggacagtcggagagccgcgacagaacctcggtcggggcgggcgcgggacctcggtgctgagccctggatccggtcatcgcacctcctgaccacgcgtcaggtcccggcccgcgcagccgcgtccgggccggtgcgcaccacccgccccgaccgaggttctg

SEQ ID NO: 1663 - DNA, 827 bp, Unknown
  Kingdom: Bacteria, Phylum: Actinobacteria, Class: Actinobacteria, Order: Streptomycetales, Family: Streptomycetaceae, Genus: Streptomyces
gtacccgtgcccgagcccacgtccgtacccgcgtcgaccggagagaaccgatgaactcctgggacctgtggtggtgggtcatcctgccctacctcgcgctcgtcaccttcgtcgtcggccacgtatggcgctggcgctacgaccagttcggctggaccagccgctccacgcagctccaggagcggcgcctgctcaagtggggcggaccgctcttccactacggcacgttcgcggctatcggggggcacgtgctgggcatcctgatcccggagtccttcacccggtggctcggcatcccggagaacacctaccgctggttctcctccgtcggcggcaccgtcgccgcgctcgcggtgatcgccggggtcgcggtcctcgccttccgccgcaccaccgtgccccgcgtgcgcgccgccacgagccccgtcgactggctggcgctggtcctgctggcgatcgtgatcgtgctgggcatcatcccgaccatgggcatcaacctcttcggcacgggctacgactaccgggggagcgtggcgctgtggttccgcggcctgttcgccggaaaccccgacgtcgcggccatcgcgcacgcgccgctgatctaccaggtccacgccaccgccgcctgggccatcctcgcggtgtggcccttcacccggctcgtgcacgcctggagcgtcccgctgtggtatctgtggcgtccgtacgtgctctaccggagccgggttgcggccccgcccgccgagccgggcaccagcggccgccgctggcgccgtatcggcgtccgctactgagcccgggtccgacccgccgcgtgcggcccgccc

SEQ ID NO: 1664 - DNA, 1332 bp, Unknown
  Kingdom: Bacteria, Phylum: Actinobacteria, Class: Actinobacteria, Order: Streptomycetales, Family: Streptomycetaceae, Genus: Streptomyces
gtgctgggtgaagtaggcatcgatgtggctgcgtgtagcgaagtcgccggtgaggagggcgagttgtatgtcgttgagggcgtgcacgggcaggggggtcgggcatggcccgggcgcgggggcggcggtgacgaagctgagggtctcggtgaacaggggggcggcggtgatgccggggacgtgggtgcggaaggcgatgccgaggtcgaggtcgtcgccgggcagggcggtttcgatgtggtcctgggtcgcctcggtcagggtgatgctgatgccggggtggcgggtgtggatttcggcggtgagcgggccgatcaggtaggcggtgaaggtgggggtgacgcccagacggaggtggccgctggagaggtcctggacgtcgtggacggcgcgttcggcggagggccaggtcgcgtagtgcgcgccgggcgtggtcggtgtagacggctccggcgtcggtgagccgaacggttcggccggagcggtccagcagctgcactcccaggcttccttccagatgtttgatctgctgggagagcgcgggctgggagatgtgcagctcctcggcggcgcgggtgacgttgccgtgttcggccacggcgagcagatagcgcgggtgacgcagttcgagagcagccatggagcaaactatagatgcggacaataagttctatccctaaccgctcttggacgctatagccacaggtcatgcatggtggatctcaccagcccacaggggccgatcaccatccgaagggagtgaccatgcaggacctcaccgagggcgtcgcccgtttccagcgggacgtcttcccggccaaggcggagctcttcgctcatctggccacgcatcacacgccgcacacgctgttcatcggctgttccgacgcccgcgtcgtccccgagctgatcaccggtgccgagccgggcgacctgttcgtcatccgcacggccggcaatctggtgccggcccacactcccggggccgacggggtcgcggcgagcatcgagtacgcggttgccgcgctgggtgtgaaggacatcgtcgtctgcggtcactccgggtgcggcgcgatgaccgccctcgccgaggaccacgacctcagcggtgtcccggcggtcgcctcctggctgcggctcgcggacgcctcggtggcccgcaccgtcgccgccggtgacgttccggctctggtgcggcagaacgtgctcgcccagctcgcgaccctggccacccacccctcggtggcccgcgccctcgcggaggagaaggtcgccctgcacggctgggtctacgacatcccgaccggccgggtcgatgacctcaccgccacc

SEQ ID NO: 1665 - DNA, 627 bp, Unknown
  Kingdom: Bacteria, Phylum: Actinobacteria, Class: Actinobacteria, Order: Streptomycetales, Family: Streptomycetaceae, Genus: Streptomyces
gcgcagcgcgcccggcgtgagcgtgtcgtcgctgtcgaggaagaagaggaagtcgccggtggccaggcgcatcccggcgttgcgggcgcggccgagcccggcgttctccggcaggtgcagcacgcgcacgcgcgggtcgcgctcggcgtactcgtcgaggatcgcgcccgagccgtccgaggagcagtcgtcgacggcgatcacctcgatgtcccggaaggactgcccgaggaccgagtcgaggcactcgcgcaggaagccctgcacgttgaaacagggaacgatgacgctgaagcggggcactgctcttgtcagctcctcacgaagggggcggcggacctcatgaagggcacggcggccggggccgggacacgccgggccagggggatcacgggcggcagagccgcctcgggctcgccgaggaacacccggcgtacgacgcgttcggcggcccgcccgtcgtcgaactggcagaaccgctcacggaacgccgcccgcagcgccgccgaccgggcgcccgcgaaggagccgtcgcggaagagcgccgccagctcgcggggcgtacgcgccaccgggcccggcggggccgcggtcaggtcgaagcagacgccccgcgtctcgcggtac

SEQ ID NO: 1666 - DNA, 2432 bp, Unknown
  Kingdom: Bacteria, Phylum: Actinobacteria, Class: Actinobacteria, Order: Streptomycetales, Family: Streptomycetaceae, Genus: Streptomyces
gcggaggcgcgcgcctccgcgttcgaggcgtcggtgtcggcggacaccgcccgctccgccgcggcggccgagaaggaactgaagggcgtgcacggcaggggcaacgcggtaggggaggtcggggtgaccggactgcccaaggaccggaccggaggcgtgctcgccgtcctggtcaacatcaccaacaagaccgaccgcaaggcgtcgtacgccgtccagatcgacttcgtcggcgccgacggcaaggtggccgagacccggtacgtcggggcgcaggacctcgaaccgggcaagaaggcgcagccgatcgcgttcagccgccagtcggaggagaagaagctgacggcacgcctggcgaaggcccagcggtactgacggcgccccgacgcacacgagtggcccgcggaccgcctcgaagggcgcggtccgcgggccactaacgtgcggggccgggagggcggttcagcaggcgccgaggtcctgccagacgccccactcaccggtggtgccgggctcctcgcccgtcgtccaccacttggccttccagttgtggcccttgtacgagacctgctggccgccggtgtagaccgcggacttggaccacggggtcgcggtgcactggttgccgttgccgccggtgacggtcagggcgtacgtcgccgagtggccgccggcggcgctggaaccggtgacggtgatggtgtacgtgcccgagaccgcggccgaggtggtggcgagggtcagtgtcgcggagccgcccgccgtgaccgaggcggggctgagcgaggcggtgacgcccgccggggcgccgctgacggagaggttgaccgtctgcgccttgcccttggtcacggccgtcttcaccgtggtggtggcggactggcccgccgtcaccgtcccggaggacgcgccgagcgacagggagaagtcgtcggcaggggcggtgctgccgctggtgaacggctcgaagatgtgggagaagtcccaggtgttctgctggatgcccgagcagttgtcggcggcggcgccgcccgcgcaactcccgttgtcccgctgcagcgcccagaaggacagcatgttgatgcccttggagacggcccagttgtagacggtggtcgcattggccaggctgaaggtctcggccggcccgaagtcgtcgacgccgggcatctcggtgatgccgaccatgctccacagctcggcggacgacttgcccgggtagagctgggtgagcgtgtcgaccaggccctgggcggcggtctgggtgtccttcgccatgtcgtgggactggttgtcgtagtagtcgaacgtcatgaggttgacgacgtcgatccgggtgccgttgctcaccgcgttgcgcagcagctggacgccgttgtcggccaggccgtgggtggtggtcggcagggtgtaggagaactccaccttgcgcccgttggcggccgcccagtcctggaccagcttgatcgccttgttgcggcggtcgatgccggcggcgttgtcgatggagtcggcctcgatgtccatgtcgaggcgcgagatgtcgtaggtcgtgatgaccttctcgtacgcggcggcgatctgctggacgtcggtgcagctgtcggcgatctcggtgcccgtcgtgtcggccgtgtagccgccgaaggacgggatgacgtccccgccgttgccctggatggtcttgatgtcgctgccgaaggtcgacgaggagacgggcatgccggtgtcgccgttccagtacggcgtgcaggagcccttggaggcggtctggaggaacgccatcgtcaggtgcttggcaccggactgggcggccagggccgcggggctctcgccggtccaggcctcgaagtagggggcgaagacgtgggcgggcagctcagtcgccgcctgcgccgtgccggtgcccgtcagggcgaggccgaccgaggccgcggtggtgacggccgcggtgaggaccgcgcggaaggaacgcatgagtctcatgtcagtcccggtgtgaggaggggggatcgccaattcccgtacggaggagaggtgttgatgcgtatgggatagcgcccgcgcaccgggcgggtcaatggtctggaccaaaatgggactagaccaatcctgcgcgtttgaggtcatccgcctgcgcagcgcccgcgggggccgactggaccacgaggaggccggttcgacaacgcggggggccggtcggcgcgtcagggctcagcgccgccgccgggatttcggtctgtcgtacgacgcgtcataccagagcgggacgctccccgggggattttgccgactgctcatcgcacaggatgcattcgtgactactgtgagtgtccgccggacgacgtagaggcgctctccatggcctggccgaccggcacagcgatggcgtatgcccgctcgcgccccccgcgcgagcgggcatacgccat

SEQ ID NO: 1667 - DNA, 1692 bp, Unknown
  Kingdom: Bacteria, Phylum: Actinobacteria, Class: Actinobacteria, Order: Streptomycetales, Family: Streptomycetaceae, Genus: Streptomyces
gcccacaccgcctccggggagaacgcgagcagcaccagccaggccgcactgaggaccgccagccacaccgccgagcggcgccgcgagcggcgcacggccgggctcagcacgccgaaggcgaagaccgcgcccgtgccgagcgccgccgccaccgccgccgggccgtcggcgcggaacgcggcgagcgcgagcaggcccgcgaacagcgcgtacaggcacaggcgcaggatgacgacgacgggggagtgcgggcggacgtccatgacggatccagcgtaggcgggccgggcgcggcgccggtcaaccgaaaggttgaaaggcggctgccaccttcgatgcggcaggagcgtgccgcggcgcgatgcgcggcacggggtgcgcggccgagtctggatgacatgttcgtcgcatggagagacctccggttcgccaaggggcggttcgccctgatgggagccgtggtcgtactgatcaccctgctcgtggggctgctgtccgggctgaccgccgggctcgccgaggagaacacctcggcggtgaagggcctgcccgccgaccacctcgccttcgccgcgccgccggccgggcagtcggtgtcgttcaccggctcgtcgctggcgccggccgccgtcgaccggtgggcgaggcgggtgccgtacgccgaaccggtggggatccgcacggtggacgccaccgccggtggccgcagggcggcactgtcggtgttcgccgtacggcccggctcggggctcgccccgcacgaggtcgcgcccggacaggcggtgctctcggtgaaggcggcctccgagctgggtgtcgcggccggggaccgggtgcggctcggcacgtcgtcgtggaccgtggcggccgtgacgggcagcgcgtcctacagccacacgcccgtggtgtggacggcgtgggacggcggccgggcgacggtgatcgcgctgcgtacgcacggcaccgacgtcgccgccggggaccgggccgccggcacgaggaccatcgccaaggcggacgcggtgaccgcgatcggctcctaccaggcagagaacggatcgctgcagctgatgcgcggtttcctgttcgtcatctccgcgctggtcgtcggggccttcttcacggtgtggacgatccagcggtcgcccgacatcgccgtgctcaaggcgctgggggcgtccaccgggtacctgctgcgcgacgcgctcggccaggccgtggtcctgctggccgcgggcacgctcctcggcaccgggctcgcgggcctggccggtgccctcgtacggggcgggacggtgcccttcgtactcgacccggccaccgtcctggtggccgccgcggtgatgaccgtcctcggcgtgctgggcgccggcctgtccgtccggcggatcaccgccgtcgacccgctgaccgcgctgggaggcgtgcgatgagcctgctgctggaagacgtcaccctgacctaccccgacggggacggcagactgaccgcgctggaccaggtgtgcctggaggtgcccgcgggcaccgtcacggcggtggccgggccctccggctcgggcaagtccagcctgctcgcggtcgcggccacgctgatcacgccggacagcggcgcggtgcgggtggccgggacaccgaccgggcggctgaccgccgcggagcgggccgcgctgcggcggtcagccgcccggtc

SEQ ID NO: 1668 - DNA, 3436 bp, Unknown
  Kingdom: Bacteria, Phylum: Actinobacteria, Class: Actinobacteria, Order: Streptomycetales, Family: Streptomycetaceae, Genus: Streptomyces
ggtgagacctaggcggagcgggttccggtgcccgttccggcaccggcgacgcccccgacgaagccggcccaggccgccgcccgcacgaccagcacgggcccgtccgggactttgctgtcccggacggggacgatgccggggactccgtcggctacctcgacgcagtcgccgccgttgccgtcgctgtagctgcttttgcgccagcgggcggcgccggggaagtcgcgggcgacttcaacgcacgattccccgccgctgccgccgctgtaactgctcttgtgccagcgggcgttggtcaggtcatacccgcgcatcgtctgaaatcctccgctgccgcttcgatcatggccagggacgcctctggtgacagggccgcggccctgagcagatcgtaatccgcgagaccccgcttcactaccaccggttcgtccagcaggctgccggacagtacggcctctgagtagacggttggcggagcatcctcgaagtccatgagcgtcatcatcttgcccatctgaggatgggcacccgccgcgaacggcaggacctgcaccagggccctgcgaccgtgcaccatgtccgcaatgtgatccaattgcttggccatcaccgcgccgtcgccgacaggcacgcgcagcaccgtctcgtgcagaagcacccaatacacagggcgtgcagcgtccctgaggatctgtgcccgctccatgcgaagggcgaccatctcctcgacccactcatcggtggcgaacggattggtcgacaagtagatcgcgcgggcgtacgccggtgtctggagaaggccggggacaactgccggagcccactcgctgatactcgtcgccagccgctccagttccgccgcgtgcgcgaagtactcggcgaatctctgctctttgatgagtttgcgccagaggcgttcgaaaaaaccgtcggtttgcaggacctcgtcgatccgctgggccacgtccagctgtggctttctgatcgcctgttcgaactggccgatgtagccgcccgagacgaacaccctcgcacccagctccacctgcgtcatccccgcgttctcccggcgtcgcttcagctccgtgccgaagaactcccagaccgcctggcgtgaaccgttggccatcaccaacccccttgtgcagccctcttcttgtagggctcgaaacccttccgagtgtagaggcggaacgtcatcgtggagacacgaagcgtaaaactccgggatgacggaaatcccggagaaaagagaaagggaggaagcacacagtggcaccacggcagcactcgacccactcgacggtttgcgttcaggaggcggaggaaacaattgttgaattgcgtaccgctctcgaaaaagccggaatcaccctgccctcgctcgggctcgacccggccgggctcgcccgcgaggcgccctgcccgctggtggagctgggccgctgctccgtggagacggccgcacggctcgccgcggtcctgcggtgagcgggccgtgtccgccggtcgggagttacgccctcgacacccgcaccggccgcgtcggcgtggtcatgggccacgagggaccgtacgtccagctgcgcccgctcggcggcggccgggagtgggactgcgcgccggagctggtgcgggcggccaccccggccgagcggctcagcgcggcgacggcgtacgcgaacgcccgcagccggggggaggtgccgtgaaggcgggacggggccgctgccgccgtgcgcgacaatggggccatgagtctgttccgcgacgacggcatcgtgctgcgcacccagaagctgggtgaggcggaccggatcatcacactgctcacgcgggggcacgggcgggtgcgggccgtggcccgcggggtgcggcggaccaagtcgaagttcggggcccgcctcgaacccttctcgcacgtggacgtgcagttcttcgcgcggggcagcgaactgatcgggcgcgggctgccgctgtgcacgcagagcgagaccatcgctccgtacggcggcgggatcgtgaccgactacgcccggtacaccgccgggacggccatgctggagacggccgagcggttcacggatcacgagggcgagccggccgtgcagcagtacctgctgctggtcggcggactgcgcaccctcgcccgcggcgagcacgccccgcacctcgtcctcgacgcgttcctgctgcgctcgctggccgtcaacggctacgcgcccagcttcggcgactgcgcgaagtgcggcatgccggggccgaaccggttcttctcggtggcctccggcggctcggtctgcgtcgactgccgggtaccgggcagtgtcgtaccctcgccgcagacgctcacgctgctgggcgcgctgctcacgggggactgggcgaccgcggacgcctgtgaggcgcggcacgtgcgcgagggcagcgggctggtgtccgcctatctgcactggcacctggagcgcgggctgcgctcgctcaggtacgtcgagaagtaagaagcagaagctagagggacacgagggagacaaggaccacatggctgtacgcgggttcctgagcggccggcgccgcgagtacgacgcgcccgagccgcatccgtccggcgcacgcccgccgaagctcccgggcgagctggtccccgagcacgtggcgatcgtcatggacggcaacggccggtgggcgaagcagcgcgggctgccgcgcaccgaggggcacaaggtcggcgccgagcgcgtcctcgacgtcctccagggcggcatcgagatcggcgtgcgcaacatctcgctgtacgcgttctccaccgagaactggaagcgctcgcccgacgaggtgcgcttcctgatgaacttcaaccgggacttcatccgcaagtcccgcgaccagctcgacgggctcggcgtccgggtgcgctgggtgggccggatgccgaggctgtggaagtcggtcgccaaggagttgcaggtcgcccaggagcagaccaagggcaacgaccggatcacgctgtacttctgcatgaactacggcggccgggcggaactggcggacgcggcgaaggcgatggcgcaggacgtggcggccggacgcctcgacccgtccaaggtcagcgagaagaccatccagaagtacctgtactacccggacatgccggacgtggacctgttcctgcggccgagcggtgagcagcgcacgtccaactacctgctctggcagagcgcgtacgccgagatggtcttccaggacgtgctgtggccggacttcgaccgccgtgacctgtggcgggcctgcgtggagttcgcctcccgcgaccgccgcttcggcggggccatcccgaacgaggagttgctggcgatggagggccgggtcggcgaggacggctgagccgccgggggcgattgcggcgccgcccggccggggccgaccaccccggccc

SEQ ID NO: 1669 - DNA, 972 bp, Unknown
  Kingdom: Bacteria, Phylum: Actinobacteria, Class: Actinobacteria, Order: Streptomycetales, Family: Streptomycetaceae, Genus: Streptomyces
cagcagggcctcccggccgccgtcgccggcggcctccttcgggcggcgtccgcgcagccactgggagagtttgccctgccggccggtacggccgccgaactccgcgccgctcatctatcccctcgcctcgctggttggacagcatgctccatggctctccatggtcccaccatcctgcgccttcggtgaccggcgcccgaatccgggggtgggcggggcggggccgcgggggtcgcgccggggctcagcgcggggcgagtccgtacagggcgtagtcgacgagggtgtcggtgtactcgtaggagagcgggccggtgtgctggagccagcgctgggcgaccggggagacgaagagttccagggcgatgcgcggatcgacgtcggggcgtacggctccggccgcctgggcggcgcgcagtcggtggacgtacagctggagctggggctccagcagccgggccacgagttgccgggcgagctgctcgttgaccaggccctcggcggcgagcgcgcgggagggtgcctcgaacttggggtcgacgagtccgtcgacggtggcgcgcagtaccgccttcaggtcggcggcgagatcgccggtgtccggaatcacaccgtgcgtctccccgagcttctccccgctctgctcggcgccctgctcggcgaggtcgaggaacgcctccaggaggacgtccgccttcgacggccaccagcggtagatggtctgcttgccgacaccggcccgtgcggcgatgccctcgaccgtggtcttcgggtagccggcctcggcgacgagcgcgagggcggcgtcgtagatggcgcggcgggacttctcactgcggcgggcggcgtcgggggcgggcttcttgaccatgggccgacggtagcaggggcgatgagacgcgccgtctcgccagccggtggcaggggttccctcccaccgcgcgggtgccgccggctggcgagacggcgcgt

SEQ ID NO: 1670 - DNA, 668 bp, Unknown
  Kingdom: Bacteria, Phylum: Actinobacteria, Class: Actinobacteria, Order: Streptomycetales, Family: Streptomycetaceae, Genus: Streptomyces
  misc_feature (495)..(496): n is a, c, g, or t
ggccgcggtaggggcgaggagatctgcgtcgtaggtgcggtggtggattgtgatgccggcgggggtgacggcctgccagcgcacggggagcagttcgaggtggtcgcgcccggtgagcgggacgggcacgtgtccggcgacggcgaccaagacggcccacatctggttcggagtgagggccttcgtccacgcccaccgccgcacccggccgaaccggcggcagccacccggatcacgccggcgctctgccccgacgcatcccacggccggttgccggtgggctgcggctccgtgatgcgggtgggtagcaggaaagttagcttggagtgggggttcttcgatgccgaggagaagccccgatgacggatcagtcactcgaacagctggcgacagaagcctgggtcttcgggtatccgctgttgacggcggccgccaccaaggaagcgatgacggcggtcccggcccgcgacgacgaccggcgcgcggctccggtcnnctactccagcgcctggcttgacctgtcccaagaaccgctggtgctgaccctgcctgacttcggcgaccggttctggatggtgcccatcctcaccgcctggtccgatgtcttcgccgtcccgggcaaacgccagaacggttcgacagccggtccgttcctgatcgcggggccg

SEQ ID NO: 1671 - DNA, 1143 bp, Unknown
  Kingdom: Bacteria, Phylum: Actinobacteria, Class: Actinobacteria, Order: Streptomycetales, Family: Streptomycetaceae, Genus: Streptomyces
gttggtcttcaccgagcccaccaggagcggccggccggcgggccgcccggcaccgagcacctcgcccagcgcccgcagttccagcgggtccagggcgggggaacccgcgccatgggcctcgacgtagtcgacgtcggccgggtccacgcccgcgtcctcgtacgcccatcgcagcacgtccaactggccctgcagggaggggttgagcaccgagtcgctggtgcggccgtcgttggcgacggcgctgccccggatgacggcgcggatccggtcgccgtcggccagggcgtcggtgagccgcttgaggacgacgacggccaccgcgtcgctcggcgagtagccgtccgcgcccgcgtcgccgaacttgacgcgtccgtccccggccatcgcgcccgcgtgcgagagcacgaggccctcgtcggggcgcagcggcacgttcacgccggccgccagggccagcggggtctcgccggcgcgcaggctctgcaccgcttggtgcacggccacgagagaggaggagcaggcggtgtccaccaggatgctgggaccgcgcaggtcgaggaagtgggacagccgggcgggcagcagggagcggaagttgttgagctgggcggccgtcaccgactccgggccgcggcgcagggcgagttccaggtggtcggcgcgggtgttgccgacgaagacccccgaccggctcccggccagccggtcggggtgctggccggcgtcctccagcgcgtcccaggccgtcatcagcagcagtcgctgctgcgggtcgagttcggtcgcctcggtggcggacatgccgaagaactcggcgtcgaactcggcgacctcgtcgacgtagccggcgcgccgggcggctatccggccgcgccggggctcggcggagtagagggcgtccacgtcatagcgatccgggggtgtctcgctcgtggcgtccacggcgtcccgcagcagagcccacagcgcgtcgggcgcggacgctccgggcagccggcaggccatgccgatcaccgcgaccgaccgagggtccacgtcggacctgttcatgagagaactccgttcatacgtcgcacggtccctacgccttggcgaagtcgaccttgccccatcgcaacatgccccacgcacttgtcccgc

SEQ ID NO: 1672 - DNA, 570 bp, Unknown
  Kingdom: Bacteria, Phylum: Actinobacteria, Class: Actinobacteria, Order: Streptomycetales, Family: Streptomycetaceae, Genus: Streptomyces
tgtcggcggcctcgcggctgacggcctgcgacacggtgctgtcgtggtcgggcagcgagaccgcgctcgcgccgtccttggtgatcttcttgatgatcgtgtacgtgccgtgcttgccgtggttggcgagggtcgcgtacgcctccgccatgtcgacgacgctggcctgggccacgccgagcgcgatggacggtgagccgatcagttccggggtgtcggaggggaggccgagggcggtcgcggtgtccttgaccttgccggcgccgacgtcgacggccatctgcgcgtacaccgcgttgacggacttgtcggtggcctcgcggacggtgatgtcgccgtaggagcgctggtcctcgttctccggggcgtagtggccgccgctccagccctgcacgggccgtttgtcggtgccgtcgtagagggtgttgggggtgatggggcgggagtcctgggtggtggagtcgttctgtacggcggaggcgaacacgaacggtttgaaggtggagccgacctggaagtcccgccgggtggcgttgttggtgtactgcttgacgtagtcgatgccgccgt

SEQ ID NO: 1673 - DNA, 4240 bp, Unknown
  Kingdom: Bacteria, Phylum: Actinobacteria, Class: Actinobacteria, Order: Streptomycetales, Family: Streptomycetaceae, Genus: Streptomyces
ggccggacctggacgcgtaccggcggctgggccgcaccgccgggcgggtacctgtcggcggcctgctccgtcggacgagtaccgccggatgggctgcactggtatcgctcccggcgggcgaaccgcagcccgggtcgcgtagcgccgggcgggccgctccgacgggcggttaatagcgggcgggccggacctggacgcgtaccggcggctgggccgcaccgacgggcgagtacctgttggcggcccgctccctcgggcgagtaccgccgggcgggccgcaccggtatcactcccgcgggccgccgctcgccctgacgggtgagcggcggcccgtgcccgtgtccggcggcggcccggcgccgttgccgaggcatgatctccactcgacgtatcgtcgccgtcgccggtctcgccgtctcggtcacgggactcgccgcgctgcccgcgagcgccgccgactccgccgtcccggtcgtcggccgcgcggtgcccctgggcgtgctcgactcgctcgcccgcaccggcatccccgccgaccggcaggccgagatgcccccggtctccgaccagttgtcctcgctccaccacgtccaggacctgaaccagctcagcgcggtcaccggccccgtctcgccgctgttcgggctggtccccgcggtccagtactgagccacgcgccttccctgcggcgaccgggtggcgacggcacctgatcccgtgccgccgccgcccggtcacggcgtagggtcgcagggacggacaacggccgacggaagggacctccaccatggcgcaggaagtgcgcggcgtgatcgcacccgggaagaacgaacccgtacgggtcgagacgatcgtcgtgccggaccccgggcccggcgaggccgtcgtacgggttcaggcctgcggtgtgtgccacaccgacctgcactacaagcagggcggcatcaacgacgagttccccttcctgctcggccacgaggccgccggcatcgtcgagtcggtcggcgagggcgtcaccgacgtcgcgcccggcgacttcgtcgtcctcaactggcgtgccgtgtgcggcacgtgccgcgcctgcctgcgcgggcgcccctggtactgcttcgacacgcacaacgcgcgacagcggatgaccctcatcgacggcaccgaactctccccggccctcggcatcggcgccttcgccgagaagaccctcgtggcggccggacagtgcaccaaggtcgacccggcggtgtctccggcggtggccggactgctgggctgcggcgtgatggccggcatcggcgccgcgatcaacaccgcaaacgtcggccgcggcgactccgtggccgtcatcggctgcggcggcgtcggggacgcggcgatcgccggggcgtacctggcgggcgccgccaaggtcatcgccgtcgacatcgacgaccgcaagctggagaccgcccgcaccatgggcgccacacacaccgtcaactccaaggaccacgatccggtcgccgccatccgcgacctcaccggcggtttcggcgccgacgtcgtcatcgaggcggtcggccgcccggagacgtaccagcaggcgttctacgcgcgcgacctggccggcaccgtcgtcctggtgggcgtgccgaccccggagatgaagctggagctgccgctgctggacgtcttcgggcgcggcggcgcgctgaagtcgagctggtacggcgactgcctgccctcccgggacttccccatgctgatcgacctgcacctgcaagggcgcctgccgctggacaagttcgtgtccgagaccatccggctcgacgaggtggagcaggcgttcgagcggatgcaccacggcgacgtgctgcgctcggtggtggtgctctgatgccggcccgcatcgaacgcctcgtcaccgcagggcagttcaccctcgacggcggcacctgggacgtcgagaacaacgtctggatcgtcggcgacgaccaccgggcgatcgtcatcgacgccgcccatgacgccgaggccatcgccgccgccctcggcgggcgccggctcaccgccatcgtgtgcacccacgcccacaacgaccacatcgacgccgccccggccctcgcggacctcaccggcgcgacgatctggctgcaccgcgacgacctgccgctgtggaagatgacccaccccggccgggagcccgacgaacacctgatcgacggtcaggtcgtcgaggcggcgggggccgatctcaaggtcatgcacacgcccggtcactcgccgggcgccgtctgcctctacgacccgggcctcggcgtcgtcttcaccggcgacaccctcttccagggcggccccggcgccaccggccggtcctactcccacttcccgacgatcatcgactcgatccgcgaccgcctcctcacgctgccgcccgggacgaaggtcctcaccggccacggcgacccgaccaccatcggcgcggaggccccgcacctccaggagtggatcgcccgcgggcactgatacacccacctgtgggcaccccccgccggggcccccgccggggtgtgcccgtacgccggagaaacacgacaggagatgtccggcttccccgtgagactcgacgtgcacaccgcaccacgagagtcacgggaggcaggacacatggcacgtccgtcacgtccactggaaggaaaggtcgcgctcgtcgcgggcgcgacccggggagcgggccggggcatcgcggtggaactcggcgtctccggggccaccgtctacgtcagcgggcgcagcacccgcgcccaccgctcggagtacgaccgccccgagaccgtcgaggacaccgccgacctggtcaccgaggccggcggccagggcatcgccgtccccaccgaccacctggaccccgagcgggtacgcaccgtcgtcgaccgcatcgcccgcgaacagggccgcctcgacgtgctcgtcaacgacatctggggcggcgagaaactcttcgagtgggacacccccgtgtgggagcacgacctggacaacggcctcagactgctccgcctcgccgtggagacgcacgccgtcaccagccaccacgccctgccgctgctgctgcgcaaccccggtggcctcgtcgtcgagatgaccgacggaaccgccgagtacaaccgcgacacctaccgggtcaacctcttctacgacctcgccaaggcgtccgtcctgcgcatggccttcgccctcggccacgaactcgggccgcgcggcgccaccgcgctcgcgctgacgcccggctggatgcgctcggaactgatgctggaccacttcggcgtgcgtgaggagaactggcgcgacgccgtggagaaggccccgcacttcgccatctccgagacgccccgctacgtcggccgcgccgtcgcggccctcgccgccgacccggacgtggcccgctggaacggacggtccctgtccagcggggcccttgcccaggagtacggcttcaccgacctcgacggcagccgccccgacgcctggcgctacctcaccgaggtccaggacacggggaaaccggcggacacgaccggctaccgctgaccgcccccgggcggctgctccccggtcaccgaccagcgggccgagtgaccgggcggcagttccagatcggtgcgtacggcggcgtagtagccctggcgcgccgcgcgttgccgctccagcagcgcctgccacgcctcgggcccccgccgtccctcgcgcaggaaccgttccatctccatcaccaccaggacccacgcccgggcccgctccacgacctgcgggctgcccagcatgatcagcgcctcaccggcggggtcccgggccagtgcggcctccgtcagcagcggctcggcgtcggcgagggccagcggatgcgggtgcgggtcgttgccgaggtgggcggccacccggtaggccagcgtgacggacttcttcagcgaccgcgcgtactccgagtacaccgcgagccgccgctcctcccagcgcgtcgcgcgctcccgggcgaaccgggcacggtcactgcgtacgaccgccaggtacgagccgagcgcgccgatcacgacgcctatgagcgcggggagttgctgcaagaacgcggacatgcggtgcacgctatctgccgggccggccgtcagggcagtaggttctggcccatgacggacacgaggcgtttcgaagggcacggggtgctcgtcaccggggcggcgcgcggcatcggcgcggccaccgcgcg

SEQ ID NO: 1674 - DNA, 1675 bp, Unknown
  Kingdom: Bacteria, Phylum: Actinobacteria, Class: Actinobacteria, Order: Streptomycetales, Family: Streptomycetaceae, Genus: Streptomyces
cagcagccccacgcgcccctccccgggcagccgcggctcgcacaggcgaccgagggcgccggccggtcgtacgccataggcgcaccggacgagaacgccgccgagggccccgaaccgctggacggaccgggcggtgccgtcgaggtcgcggacacgccgcgcccgcagccgatggacgacgaactgccgccggagcccctggacaacccgcgccggctgctcgtctggccggctccggacgtcgccacccagcaggcgctcagcgaccgcggctaccgtcccgtcatcgtgcactcgcgcgaggaggtcgacgcgcagatcgcggccttccccgccgctctgttcgtcgacccgctgaccgggccgatcacgcgcaccgcgctgcagtcgctgcgtcaggcggcggtcgccgcggaggtcccggtgctggtcacggccgggctcgggcaggcaacccgggaggccgcgtacggtgccgacccggcggtgctgctgaaggctctcgcgccgcgcgacagcgagcagcacccgccgcgcgtgctgctgatcgaggagcacgaggagatcgcgctggcgctgaccgccacgctggaacggcgcgggatgcaggtggcgcgggccacgagcgacgccgacgcggtgacggtggcggggcagttccggccgaacctggtggtgatggacctgatgcaggtgcaccgccgccaggccgggatcctcgactggctgcgggcgaacgggcagctcaaccgcactccgctggtcgtctacacggccgccgtcgaccaggcggatctgccgcgcctcgcctccggcgagacggtgctgttcctggcggagcggtccacgagcaccgaggtgcagacgcggatcgtggacctgctggcccgtatcggaaccaactgacctacccgggcggcctgccggacggtcccgcgcacccggtcacttcgcgacgagcctgcgggccgcctccttgatcgaggcccgcagccgttcctccgcgcggtcgtcggcgccgaccatgatccgcttgatctgcgggacgacgacggcccagtcggccagtgccaccagcaggaacatcaggtccggtgcggggatcacgtcactgatgacgccccggtcctgcccgtccttgatcgcggcgaccttgcggccgtagtggtcctggcgctccgactcgtcgggcagttcggcggcgccgtactcgatgccctcccagaacagcaggcgcaggatctcgggatgggcggcgtggtagtcgagcagccggtcgatgtagccctctatgtcgtccgcgtcgaccggcacggccgccgcgaggtcgaccatgcagcggccgaggacgtgggagaacagctgcgccttgttgccgaagtacgcgtagatgagctgcttgttggccttggcctgggcggcgatgcggtcgatgcgggcgcccgcgatgccgtgccgcgcgaactcggcgaccgccgcgtcgaagatacgggccttggtggcctcggggtccctcactgccatgggatcagcgtacccctttagcaaccaaccatttggttgacaggaatcgatccgcgccgcagactgttccacgatccaaccaaccagttggttgcgaccccggccccatccgtcccgtcccgtctcggaggccccgcaccatgtccccagc

SEQ ID NO: 1675 - DNA, 1805 bp, Unknown
  Kingdom: Bacteria, Phylum: Actinobacteria, Class: Actinobacteria, Order: Streptomycetales, Family: Streptomycetaceae, Genus: Streptomyces
gaccaggccgcgggccgcggcgccggccgacgggccgcccggggggcgagcaccgcgaggaccacggtgaccaggagcgggacgtagacgctgatcctcaccggctcactgcccgtcgtcgccgcgcccggcgtcctgcccgcccagcaggcggtgcagcaactgctcgtcctcctgggagagttcgttcacgaaacgggtgagcaccgcctcccggtcggagccgcgctccagcaggctgtgcatgcgcacggccgtgtcggacgcctcgtcccggacgggcgtgtaggcgtagccgcgacctacggggtgccgtacgagcatgcccttgtcgtgcaggcgcgacaggatcgtcagcaccgtggtgtaggcgaggtcccccggcagccgctccagtacctgccgcgcggtcagcggctcctccacggcccacagggcggccaggacgccgctctccagctccccgcgcgctctcctgcccatcgccccgccgctttcgtcgccgctcttccgatcgcgcaccgttcaccgccttcccacgggtggccaccctacccgggaatctactacggcttgtaggacgtcggcggggtccccaccgcaggagctactacatcttgtacgagcttacctactacatgttgtagagttcggccgcccaccccacctgcggaggaacgagcccctatgccccacctaggaagttcggtgcacctgcgcgccctggcggccgccgccctgcgtcccgagccggtgtccgtcacggcggaagccgagcgcgtcgcgatcgtctcggcgagcatcggagccggccacgacggcgccgccgccgaactggaacgccggctcacggaccacggcctcgtcgtcgaccgattcgacctgctggacctgctgcccgcgcgaatcgggcgcctggtccgggacggctaccaccgcatgctggtccaggctccctgggcctaccagcgggtctaccgcagcaccgaacgcgccggtgggggcgggccgttggcacgagcactgctgcggaccgccgaggagcgcctactgcgtgcgctgcaccccggcaccggcgcggtcgtctccacctacccgggagccagccgtgttctgggcgccctgcggctccgcgggcggctgaccgtgcccgtcctcacctatctcaccgacttctccgtgcacccgctgtgggtggccggcggtgtcgacgtccacctcgccgcacatgccgtgcccgccgcccaggcccgggccgccggggcgcgggacgtccgggtgtgcgggccggtggtggacccgcggttccgtcccggcagcgcgcgggagcgcgacacggcccgggcccgcttcgggttgccggcgagcgccccgctcgcgctgctggtcgccggctcctggggcgtcggaccggtccggcaggtcgcacaggagctgcgcgactgcggcgtcgccgtccccgtggtcgtctgcggccgcaacgaggcgctggccgagcagctccacgcggacggcatcgaacacgtccatggctgggtcgacgacatgcccgcgctgctgcacgccgcggacgtcctggtccagaacgccggcggactcagctccctggaggcgttcgccaccggtctgcccgtcgcgagctaccggtgcataccgggccacgggctcaccaacgccgccgctctggaggaggccggtacggcggtctggatccgcgacccggcccgcctcgaagccgtgctgagcgacctgatcgacggaccgctcgggctgcgccaacgcgcggccgggctcgccctcttcgc

SEQ ID NO: 1676 - DNA, 682 bp, Unknown
  Kingdom: Bacteria, Phylum: Actinobacteria, Class: Actinobacteria, Order: Streptomycetales, Family: Streptomycetaceae, Genus: Streptomyces
  misc_feature (220)..(221): n is a, c, g, or t
ggaccgcctggcgctaccgctacgaccgcttcggcttcaccacccgctccagccagctccacgagtcgaagatgctcaaggtcggcgggcccctcttccactacgccctcttcctcgtcatcggcggccacgtcatgggcctgctcgtccccgagtccctgacccggtggctgcgcgtcagcgaggagcagtaccacgccgtcgccctgaccatgggcgnncgccgccgtcgccggactcggcctgctgctgtaccggcggctgcgcgtccccgccgtacggcaggccaccagccgcagcgaccgcctgacctacccgctgctgaccctggtcctgctggccggcctgaccgccaccgtctcctccgtgaccaacccctacgactaccggctcggcgtcgccgtctggttccgcagcctgttcaccctcgacccgaacgtcagtgccatggcccacgccccgctcgtctacaaggtccacgccctgctggccatgaccctgttcgcgctgtggccgttcagccgtctggtgcacgccttcgccgccccgctcggctacctcacccgcccttacgtcgtgtaccgctcccggggcggggccggccggggcacactggccgggcgcggaccgcgccgggcgcccgtgcgctgagacacatcaccccggcgcggggcaacgcgcc

SEQ ID NO: 1677 - DNA, 6765 bp, Unknown
  Kingdom: Bacteria, Phylum: Actinobacteria, Class: Actinobacteria, Order: Streptomycetales, Family: Streptomycetaceae, Genus: Streptomyces
ggccaggaccgccttgccgcgcacgtccttgccggtgaagtcgccggtgccgacgtcgaccagcggcagcctgctgcggccctcggtcagggtgctgcccgcctggacgagcgcgtcaccgatccccttgacctccagcaacggcttgccgagccgccacacggtccggtactcgaagctgccctgcctgaccggcgcggtcggcgccgcgagcaggctgtcgtaggtcaggggcacctggacggcgccgaacaggtcggcgccgcccgccttgcggtcgtactccatgaggagctggcgctgctcggtgcggcggccggcgtcggcgcggacctcgcgcagcctgcgcccgtccagggtgatctcgcggtccttgtcgagggtgacctcgggggcggcgaggaagccgagcccgagggagtcggggccgtggctgccgcgcacgtcgaggaaggaggacacgctgtacgtgcccggcttcagccgcagccgcagcgtgccggagtcgccgacctgggcgctgaacgggtccacgccctcggcgagttgctgcacggcgaggtcggcggcggtggcggccccggaacggtccttgacgtgcacggtgagggtgtagcgctcgtcctccttgaccagcccgaacgcggtgtgcgcgacgggggtgccggcggccgtggccacgatctgcccgctggtgtcgcccaccggcgccttcgcgccgtcaccggtgacggtggtggaggcggtgccgtgggccgggacggtcagcaacgcgtcggcgagggcggccacgccgtcgggggcaccctgcacggacagggccaactcgaccggagtgtcaccggagttggtgtaggtgacggtgcgggtgacgggcttgttcccgtcgtagggccagccgtagaagccgaggtcggcgctgcccgtggcggtgacctgggcggccaccgcgtccggcacgctgacccggcccgcgcccagcgtgtacgcggaggcgtcgagccgcttcgacgtcgacatcagcgcgtccttgagccgggccgcgctccagtcggggtgctcctgcgcgagcagcgcggcgacgcccgcgacgtgcggcgtcgccatggacgtaccgctcatggtcgtgtagtcgccgctgccctcggtgaggcgggaacgggcggcgaggatgccgacgccgggggccgcgaggtcgggcttgagggcgttgtcgcccgagcgcggtccggcgctggtgaagtaggcggcctggtcggcggagtcgaccgcggagacggtcagggccgagtcggcggcgccgggcgagccgatggaggagggcgcgccggtgttgcccgcggcgatcacgaagagcgcgccggtctgcgccgtgagggtgttcacggcctgcgccatggggtcggtgccgtcgctggcctcggtggagcccagcgacatggacacgatccgcgcgtgcacgtcccgcgcggcccactccatgccggcgatgatctccgactcgctgccggtgccctgatcgtcgaggaccttgccgacggcgagcgtggcgtccggggcgacgcccttctccttgccgccggaggcggcgccgctgccgccgacggtggaggtgacgtgggtgccgtggccgttgcggtcggcgacctcctcgccggggatgaagctcttggtctgcgtgacccgtccggcgaggtcggggtgggtggagtcgacacccgtgccgaggacggcgacggtgacgcccttgccggtcagcccggcctcccacgccttcgccgtgccgatctgggcgttggactcggccatgtcggcgcggacccggccgtccagccagaccttctcgacgccgtcggcggacaggctgcgcgccgtgcccggccgggtgaactcccgccagaatgcccgtcccttgtccgcctcgacggcggcgccgtgcacgctggcgaggttccgggtccgctcggcgccgcgcgggacggccaccgcccggcccatgccgtaggtcacgatcagcggcagctcgccggtgctcgtgtcgccgaggccctgccgcagcagcccgctgacgtcgaagagccgcgggtcgagccggcccgcccgcagatagggccgcgcctcgtcgggtacgacggtgacggcgccgtcggccacgctggtgcgcacggcgccggtggccccggcgggccgctccaccgtgacggtgctcttgccgccgccgagcggggtgagcgtgacccggtcgccggtgacgagggtgacggtacgggcggcgtccggtttcgcggcttcagcggtaccggagacggcggtaccggaggcggcggcgccggtgcggtgggccgtgggctgctgggcggcggcctgcccggcgggcagcagggcgatcgcgagcccggccgacagaagggtcgctctccgtctgcctggtcctctgctcatccgtgcctctcttcgtttcggaagctgcgtcgaatggtgcgtcgagtgctgcgtcgagcgctgcgaagagtgtcaggagacttgtgcgacaagggagttgacggagactggcggatggctgccgtggcaggttcccgccatggacaaggccgtccactttacgcttatccggcgcttgtccggtggacggccacaaagtgcactcgtccagcggcaccccgcccggcccccttgaacaggcgcccactcccccgtgccgcgcacgatgcgaaagaggccgccgcccggcgaccgccacggtccgcgctctcaggaggatcagtcatgaccgccagtctggagcagttgcgccgctgccatgtcgccgtcgacctgggggcggcccggacccgtgtgtacgtcaagggtgccggactcgtcgtcgaccagccctcggtcgccgccgtcaacacccgtaccggagcgctgatcgcggtcggtgagttcgcggagaagatgacgggccgcacgcccgactacatccgcgtggtccgcccggtcaccggcggaaccgtcatcgacatcgagatggcgcagcgcatgctgcggcacctgctcggcgacaagatgcgccgctcgctgcgccgcaaggcccggctgcgggccgcggcctgcaccccgcacgacgccgacccactggcccggcgcgccaccgtcgagacgctcgtcggactcggcgcccgccgggtcgaactcgtcgacacgctcatcgccgccgccgtcggctgcggactgcccgtggaacgcgccgaggccaccatgatcatggtgtgcggtgcggcggcgacccaggtggccgttctctccctcggttcgatcgtcgccgccgtacggatgcccgtgggcggggaggcagtcgaccacgcgatcgtccaacacctgcgccaggaacacgcgttggtgctgcccagccagtccgtacgcccgctgcaactcgccctgcacgacaacgggctgaccgcgcacggcccggcggccaccgagatccacggccgcgacgtggcgaccgggctggcccgctccgtcctcgtcgacaccgccgccgtacgggaggccatccagaccccgctgaccgccgtgctcgacggcatctacaaggtgctgcgggagtgcccgcccgacctcgtggccgatctcgccgaccgcggcatcatgatggtcggcggctccgcgctgctccccggcctcgaccagatgctgcgccgggccacgggcatgccggtgcacatcgccgaacgccccgacgtgtgcgcggtgcagggcctcggcgagatgctggagggcaggatcgaaccgctggtgctcgacccgctgggggcgtagagccgctgggagcctggatctgcgcgtcctgggtcctacgggtccgggcggggctcagggcgtgagataggcgcggaccgtggtgccggcgccgtcggcgtgcagacggaccaggtcggcgaggaggttgaccatcaacaggccgcgcccgccgcgctggtcgcggccggcgggcctgcgcccggccagcggatcctccaggcgccccgcgtcccgcacctcgcacagcacctggccgcccgcggcccacacccgcacctcgccccgaccaccgccgtgcaccacgctgttggtggtcagttcggccgccaccagcgccaggtcatcaagacgcgtccccgtcagcccgagccgcgcgccctcggcgacggcgacgtgccgggcctgcgagagcgtctcctcggtgaaacggaaggacagcgcgtccgggacggcgggcagcggctcgttgtaccgggcgacgacgtccgacggggcgtacgccgcgctggtccgctcccgcgccgcaccggcggggatgacgacggggtgggtggcgtgcgcgtcggcgagggtgcgctcgtccaggcgtacggcgtcgtacgggcacaggatggtcacctcgcggccctggaacgccgcgttgatcagcgcctcgtgctgcgcgcaggccgggtactcggccgggctgcggcccgcccagatcggctcgccgatgatgtgcgcccggcacccggcgggctgggcgtcggcgaaggcgcgcagcacaccggggatgatccgcccgggattgcggccggcctcgcgcatgtccagcagccgtacgtcccgcgcgtccgcgccgagttcggcctcgatgagcctgaggttctcgcccggcacggccaccgcgaccggctcaccggcctccagcgcggcccgtacgaagggcacggtgcccgccaggtactcctgctcgtcgcggtagaacagggcggggtggacgaagggcgtcgccgtcgcggtcatgacgccgacacctcgatccccggcagacccggccagaacagctccagtatccggggcagcgcgggcggcgggcggtgcagcaccatgcggcggccgggcccgagccgccgggcagcgtccgcgagcgcgccggcaccggccacgtcgacgaacgtcacatccgaaagctccaggcggtacacgtcctcacctccgctcagcgcctgctccagcacgcgctcccataccccacgcgtggtcaggctcacctcgcccaccgcccgcaccccggcgtgccgggccagcggggacaccgacagtccgggcccggcggtgtccgggagacccaggtccggcgaggccggctcacggtaagggatgtccacaccgtctccctgtcgcccctggaccggtcatcgctgaacggtcgtcactgaacggtcttcgctgaaagctgttggagtcgaacggaagaacactacgccccggcaccggcgtcatgtgtaggccgccggggaccgggcaggcgcacgtgagcgccgcccgtgaccgcgcgggcccgcacacggccgcgccggcgcgacgacgcggcggcggcacggccgggacggaacaaggcggggacatgatctcaacggcaccaccacctctcgctcgacggctcgacgcactggcccgcaccctgaccatcggcgtccgcacgcacccggacggccgggcctcgctcaccccgcgcggtgagctggtccacggctgcgcggccgccctgaccgagacactggcccgcctgcccgcgagaaccgggcgcgtcgacgtggacatggccgcggtgacgttcatggactcggccggactcggcttcctggacgtcctcgacgcctacggccgcacgacgcccgcccgggtgacggcgacgagctggacgggccagccgcgccgggtgctggaactggccggtctggacaccgccgacccgctgaaccgcgcggtcccgccgcctcaggcgcgggcaccgctcgcaccgctcgcatcgctcggaccgcgcggatcgctggcgcacgcaccgctcgcactggcaccgtccgccgtggccgtcgagcgcacggaacggctggtggagctggagcaggaggtggagcaactgcgccacgccctcgtctcccgcccggtgatcgaccaggcacgcggcatcctgatggccgcccacgcctgcaccccgcagcaggcctgggacatcctccgcgaggcctcccagcggtccaacaccaagctgcggacggtggccgccgcggtcacggcgggcgcgcagccggacggccccgcgcccccggaggagatccgcgcggccctgcgcacggcggtcgaacggacggtgtgacgaagggggcgctggtgcgttccgcggtcgggtgacgcgtgggacggtgatgcgctccgcggtcgggtgacgcgtggggcggtgatgcgctccgcggtcgggtgacgcgtggggcggtgatgcgctccgcggtcgggtgacgcgtggggcggtggtgcgttccggccgaggccgtcgcgggtacccggccgggcgagcggccaccccgtccgcagggggccgccggcacccgtccgcaggagtcaccaccatgcgagagcacaccccttcccaggccgagggcgagcgggacgacaacgacacccggcgcaccgccgaggccccggaaacgccctatccgacgccttcccaggccgaaggcgaccgcgacgacctcccggagacggccgacgccgccgacgccgagaacggccgccacccgtgaggccccgacccaccgcccgtgaaaccgcgcgacctgcttgatctgcttgacctgcttgacctgctacggagaccggctccccgctcctggagccggtccccggcggtgctcgccccgcagccgagccacggcccgccgggtcagtcgacgcggggaaggccgcgctggtcgtggccgcgcagcagcgctccgg

SEQ ID NO: 1678 - DNA, 572 bp, Unknown
  Kingdom: Bacteria, Phylum: Actinobacteria, Class: Actinobacteria, Order: Streptomycetales, Family: Streptomycetaceae, Genus: Streptomyces
tcgacgccgacctgcgccccgccatcgtcaacgcccacgccgcccgcgcgctgggcaccggccgcaccgccctgctcggccgccccctcggcgaactcctctcccagggcgtggaggaactggagagcgtcctcacccacgtcctggccgaaggcgcaccgcccgcgcccgccgagatctgggtgggcgtgcgcaccccggagggcgagcggcgccgctgctggcgcagcggcttcgtccggctcgcctcgccgctcgccgaggaacccgtcccgctcggcgtggcctggctcttcgtcgacgtcaccgactcccggcacaccgaacaggaggcctcgctgctgcggttccgcaccaaccagctgcaccgcgcggcccgcgccgccgccgagtgcgacagccccctggaagcggccaccgtccacctcgacttcgcgctcgccggattcgccgaccacgccctgatcgaccgggtgcgcccgccggcgggcggcgaggcggccaccgcggacgaggacggcccgtcggcgccggtacgcctggtccgcgtcgtcgccactcccgccgccggt

SEQ ID NO: 1679 - DNA, 1548 bp, Unknown
  Kingdom: Bacteria, Phylum: Actinobacteria, Class: Actinobacteria, Order: Streptomycetales, Family: Streptomycetaceae, Genus: Streptomyces
ggcgagcaggtcgggctcggggagcaccgggcggcgctcggcggcggcccgctccaggcgcagcgccagccggtcgcaggccgtggtcaggtgctcgcgctcccagtcggacagcaccggcgggtggacgtccggccaggtcacgaagaccgccccgtacgcggtggcgccggtggccagcggcagcgccgcgagcgcgaagggatagggcagtacgacggcgatgcgcggataacggcgggccatctcctcctcaccgccgacccagatcagccgccgctcacgtacggcctgggcgaccgggatgggggcgctcagcccgacccgctcccagggcgctgcgaacgcccggggcatgcccgccatcaccgccatctccagcactggctggtcgggtgccagcaggtacaccgcgcccgagtgcgcgtggacctcgtccatcatggcggcgagcgcgagggacagcagcgggcggccgacgagcccgggcgcggccaccgggggctgcgcggacgccgtcggggcctgcccggacgccgccgctcgctgtgcggacgtccgacggtccggcacgccgaccacctcctcgcagggccgcaccacgaagggcccccaggcgggccgcccgtgtaccccttctgggcgcggcccatgccacatcaccgggggcgcctcgcggcggacggcatcgcaaagcgtcacaggggctgcgcatacggcccatacgcgctgtaatggccaacgtggtcagtgagggcgctacggcacgcagatcgaggactctgcgcgccgagcttgccctgagcacgctcgaccaggacccggcggcgcccgaccggccgcgccgcgtcctggagcaggccctcgtgttcacggcggccgcgttcgccggtgcctacgtccccagcgggcccgccggcgacctgctctgtctggcggagtccgccggtgtgccgcggacgctgtacggcctgcgcgactcgtactccctggccgggcgctcgccgctggccgaggcccgccgcacgggacgggccgtgtggctgggacccgacgaggtggcggaccgagccgacctgcggcggatgcccgccggtgacgtgtcgctcgcggcgctgccgttcggcggcaccgagggcggctgcctgctcgccgtcaccgacgccccgggcggcttcgacagcgaggaccgcgcctgcctggaactggtcgccgaggcctttgtgtgtccggtgcccgacgcgtccgcgcccggcgaggaactgccgccgggcgccttcgcgctcgccatggacagcgggcgcgtggaggtcggagacgacatcctcgccctgttcggcatcgaccgggccggcttcgacggcaaggtggagaccctgctggcgctgaccgtgcccgaggacctgccgtccctgatgtccgtggtcgaggccgaccacatgtcgatcggcgagcgtgaactggagttccgcgtgctgcggccggccggctcgccgaggtggctgcggttgcgcgggcggctgctgtccggcggggacggccgcagca

SEQ ID NO: 1680 - DNA, 1878 bp, Unknown
  Kingdom: Bacteria, Phylum: Actinobacteria, Class: Actinobacteria, Order: Streptomycetales, Family: Streptomycetaceae, Genus: Streptomyces
gggcggcgtgcgcgcgttctgtggccgtgggcggcgtgcgcgagttgtgtggccgtgggcggcgtgcgctggttctgtggccacgggcggcgtgcgtgggtgggactaccccgagacccggttctgccccgcccccgcgccccgccggtgccgtttcgcgcagcagccggggtgcggagcagtcctggcttccggctttctaattccaacccgggttgttcctagaatggccgggtggaggatatcgacgcgatcgcggtactgcaggatcctgtgcggcgccgcctgtacgagtacgtggtggcccagggccgcgaggtcggccgcaacgaggccgccgaggcggccggggtggcgcgtacgctcgccgcgcaccatctggacaggctgacggcggccgggctgctggagagcggcagccgccgcctgacaggccgctcggggccgggcgcgggccgtcccgccaaggtgtacacgcgggcgcgggccgagcggtccgtgtcgctgcccgcccgcgactaccgcaccgccgccgagctgatcgccgaggccgccgaagcggccgggatcgacgccgggctctgggcggtcgcgcgccgccggggtgaggccctgcggggctcggcggagccgtgcggcggcctcgaagaggccatggagctgctggccgctcgcggctacgaaccgcgcctggagggcggcgaggaagccggagaggcggcggccgggagcgcagcaggcggggccgagaccgccgccgggagcgcagcagccggggccggtgcagcgggacgcgtcgtgcggatgcgcaactgccccttccacgccgtagccgagcgcttcccgccgctcgtctgcggcatgaatctggcattgctggaggggctgctcggtacggacggtcccgtgcgcgcgcgcatggacgcccggccgggtgagtgctgcgtagtggtcgaagcttctaaagacaacgagcattgacatagaaaaaccagacgtgctgagatgaggccatgaccgcatccgagcctgccgcccacctcgcccagctcaacgtcgccacgctccgctaccccctcgacgacccgcgcacagccccgttcgtcgaactgctcgacccggtcaactccgccgccgacgcggcacccgggttcgtgtggcggctggtggaggaaggggcggccgacgccaccgccctgcgccctgcgggcgagaacgtcatcgtcaacctgacggtgtgggagacgcaggaggccctgtgggacttcacctaccgcagcgggcacctggaggtgatgcggcggcgccgcgaatggttcgaacggcacgtcgaggcacacctggtgctctggtgggtccccgccggacacctgccgaccgtcggcgaggccctggagcgcctggccgggctgcggacgcacgggccgaccccgcgcgccttcaccttcgcctccgcctacaccgcggcggaggccgccgagtacctccgggccgcaccgccggccccggtgtagagcaggaacgccccgccccgccgaggaccgcggccgctgttgacctgccgcggtccctgacggcacctcagcaggtcgccgaggaggagatgcggatgcccgtcagcgtcccggtgaagttggtggtgtacaccggcgggaggcacacgatcgagccgttgtcgaagcggatgtaggcgacgtcgtcatgacgggtgttcgtgacgacgatgggcgaactgctcgtgccggtcggtctggacggcagggactggaagcccgaggtgacgtcctggaactgaccgattctgacgccgcccttgaacagacagacgtacgggtaggcacagctcgccgctgcctgcgccggggcgaccgcggtcgc

SEQ ID NO: 1681 - DNA, 5063 bp, Unknown
  Kingdom: Bacteria, Phylum: Actinobacteria, Class: Actinobacteria, Order: Streptomycetales, Family: Streptomycetaceae, Genus: Streptomyces
gactccgtctccctcaaccgcctgtacttcctctaaggacctctgagatgaccacccccgccgccgacggcttccgcatgcccgccgagtggacgccgcacgagcgcacctggatggcctggccgggcgccaacccgaccttcgacacccccgatgagctggccgcctcccgcgccgcctgggcgacggtcgcccgcacgatccgccgcttcgaaccggtcaccgtggtctgcggccccggccagtccgccgacgcccgcaccctgctcggcgacgggatcgacaccgtcgaacgcgacctcgacgacgcctggatgcgcgacatcggccccaccttcctcaccgacggcaaggggcgactggccgccgtggactggacgttcaacggctggggcgcccaggactgggcccgctgggagcacgacgcgaagatcggcgcgtacgtctcggacctcgcgggcgccaagacgtacgcctcgcggctggtcaacgagggcggcgcgatccacgtcgacggcgagggcaccgtcctgctgaccgagaccgtccagctcggccccgagcgcaacccgcactggacgaaggagcaggtcgaggcggagatccacgcccacctcggcaccgagaaggccatctggctgccgcgcggcctcaccggcgactaccctccccacggctacggcaccctcggccacgtcgacatcgtcgccgccttcgcccgccccggcgtcgtcgtcgcccaccaccagcccgaccccgcccaccccgaccacgaggtcaccaaggaggtcatcggcatcctcaggtcggccaccgacgcggccggccggcccctggaggtcgtcgaggtgcccgcgcccaccgtcctggaggccgacggccactgggccgactactcctacatcaaccactacctctgcaacgacggcgtcgtcctgtgcggcttccacgacccgcgcgacgagatcgccgccggcatcttccgccgcctcttccccgagcgcacggtcaccctggtggacgcgcgtacgatcttcgcgggcgggggcggtatccactgcatcacccagcagcagccgaaggtctgacacgtacaggagcagcagatggccgacgcggcacgggcgcgcaggaacgcgccgccccgcgaggaggtcctcgccgccgccatggagatgatcgccgagcgcggtctggagaaactcaccatggcggcgctcggccgcgaggtcggcatgagcagcggccatctgctctactacttcggctccaaggacgagctgctgctgcgcaccctggagtggagcgagagccgcctcggcgccgaacgcggacggctgctcaccagggcctgctccgcccgcgaacgcctcgacgcctacgtcggcctctacgtccccgacggccaccgtgacccgcactggacgctgtggctcgaggtctggaaccggtcgctgaccgccgacgaggacggccgcgaccggcaggccgccatcgagggcgcctggcaccgcgacctggcggccctcgtcgccgagggcgtctcacgcggcgagttccgccgcgtcgacgccgaccgcttcgccacccggctgcgcgccctcctcgacggcttcgccatccatgtggcgatcggactgcgcggcaccgaccgggagcgggtgctcgggcacgtacgggacttcctggacgaatccctgagccagtaggccgcgccccccagctcctgatgcgtcgcccgcgtcccggcggggcaatgagggctcatgggacgagagcactggaagaagatctggatcggttcggccggcaacatggtggagtggtacgactggttcgtctacgccagcttcgccacctacttcgccggggcgttcttcccgcacgggaacccgaccgcccagatgatgaacaccgccggcatcttcgccgtcggtttcttcatgcggccggtgggcggctggctgctcggccgggtcggcgaccgccggggccgcaaggccgcgctgaccctgaccgtcaccctgatgtccgcctccgccgtcctcatcgccgtcgcccccacctacggggtcgcggggtacggcggcgcactggtgctgctccttgcccggctgctccagggcctgtcggtcggcggcgagtacgcggcgagcgccacctacctcaccgaggcgtccgacccgcgccggcgcggcttcgcctccagcttccagtacgtgtcgatgaccgcgggccagatcgtcggcctcggcctgcagatcgtgctccagcggaccatgtccgacgacgcgctgcacagctacggctggcggatcccgttcgtggtcggcgcactcggcgccgccgtcatcttctacctgcggcgcagcatgctggagaccgaggtgtacgaggccgacgacagcggcgaggagcgcggcacgctgcgcgcgctgtgggcgcacaagcgggaggcgctgctggtgatggcgctgaccatgggcggcacggtggcctactacacgtacaccacctacctcaccaagtacctgtccaactccgcgggcctgcccaagcggaccgcgaccctggtctccttcaccgcgctcatcgtcttcgcctgcctccagccgctcgccggacgcctgtccgaccggatcggccgccgcccgctgctgatcaccttcgccgtcggctcgaccctcctgaccgtgccgatcatgacgctgctcaagcacgcgggcagctactggccggcgctcggcctctccctgctcgcgctggtcgtggtcaccggctacacctcgatcaacgcctgcgtgaaggccgagctgttccccaccggcgtgcgcgcgctcggcgtggccctgccgtacgccctggccaacgccctgttcggcgggaccgcggaatacgtggccctgtggttcaagaacgccggcctggagtccgggttcttctggtacgtggcggcgtgcgcggccgtctccctggtggtgtacatcagcatgcgcgagacccgcgacctggacctgacccgggtgaagaacgccgaggcgtccacgctgacgcccgcatcctgagacgtcggtgagtacgggggcacgactgtgccagactgctcccgtgctctcgttcgccatgattattggcagcaggcgcgccggtccgcagtgaccgccacgtacgaccaggtacgggcggccaccgtcgtcctcgacccgcgcgcagacctctcgcacccgcgaggggtctttcgttttcccggcccaccttcagccgggaacggggcgcgcgggaggattggggggacggtggagccggtcattccggtacgaccgagatcccacaccaggagccttgagacatgtccgaaaccagccggctggacgattcgttccacgtcttcgacaccaccctgcgcgacggcgcccagcgggagggcatcaacctcaccgtcgccgacaagctggccatcgcccgccacctggacgacttcggcgtgggcttcatcgaaggcggctggcccggtgccaacccgcgggacaccgagttcttcgcccgcgcccgcgccgagatcgacttccgcaacgcccagctcgtcgccttcggcgccacccgcagggccggcgccaacgcagcggacgacccccaggtcaaggcgctcctggactccggcgccgaggtgatcacgctggtcgccaagtcccacgaccggcacgtggagctggcgctgcgcaccaccttggaggagaacctggagatggtccgcgacaccgtctcccacctgcgcgcccagggccgccgcgtcttcgtcgactgcgagcacttcttcgacggttaccgcgccaaccccgagtacgccaaggccgtcgtccgcgccgcgtccgaggccggcgccgacgtcgtcgtcctgtgcgacaccaacggcggcatgctccccgcccagatccacgcggtcgtcgccaccgtcctcgccgacaccggcgcccgcctcggcatccacgcccaggacgacaccggctgcgccgttgccaacaccctggccgccgtcgacgcgggcgccacccacgtgcagtgcaccgccaacggctacggcgaacgcgtcggcaacgccaacctcttcccggtcgtcgccgccctggaactcaagtacggcaagcaggtgctgcccgagggccggctgcgcgagatgacccggatctcgcacgccatcgccgaggtcgtcaacctcaccccctccacccaccagccctacgtcggcctgtccgccttcgcccacaaggccggactgcacgcctccgccatcaaggtcgaccccgacctgtaccagcacatcgaccccgagcaggtcggcaacaccatgcgcatgctggtctccgacatggccggccgcgcctccatcgagctgaagggcaaggaactcggcatcgacctcggcggcgaccgcgaactggtcggccgggtcgtcgagcgcgtcaaggagcgcgaactcaaggggtacacctacgaagccgccgacgcgagcttcgaactcctgctgcgcggggaggtcgagggccgcccgctgaagtacttcgacgtcgagtcctggcgggccatcgtcgaggaccgccccgacggcagccacgccaacgaggccacggtcaagctgtgggccaagaaggagcgcatcgtcgccaccgccgagggcaacggcccggtcaacgccctcgaccgcgccctgcgcgtcgccctggagaagatctacccgcagctgggctccctggagctggtcgactacaaggtccgcatcctggagggcaggcacggcacctcctccaccacccgcgtcctcatctccacctcggacggcaagggcgagtggtccacggtcggcgtcgccgacaacgtcatcgccgcgtcctggcaggccctggaggacgcgtacgcctacggcctgctgcgcgcgggggtcgacccggcggcgtagtcagggcgcacgccagatgttgtcgaaggccgcgtcctcgacgcgccgccgctgccgtacggcctccagctcggtcaccgcgtcgtcgacggcggccaccacggtgacc

SEQ ID NO: 1682 - DNA, 1317 bp, Unknown
  Kingdom: Bacteria, Phylum: Actinobacteria, Class: Actinobacteria, Order: Streptomycetales, Family: Streptomycetaceae, Genus: Streptomyces
gccgatgaccgcgacccgcagggcaccggtcatcgccgcctcacctcccctgccacttcggcgggcgcttctcggtgaacgcggcgtggaactcggcgtagtcctcgccgttcatgagcagggcctgggtggcggcgtccatctcgacggcggcggacagcggcatgtcgagttccgcggtgagcagggccttggtctgggcgtgggcgagggcggggccgtcggcgaggcggcgggcgagggcctgggcggcctcgtcggcgtggccctcgtcggtgagccggctgatcaggccgatccgctccgcctcgggtgcgcggaccggctcgcccagcatcagcagccgggtggcgtgcccgaggccgaccacgcggggcagcaggtaggcggcgcccatgtcgccgccggagaggccgacgcgggtgaacaggaaggcgaatcgggcgctcgggtcggcgacgcggaagtcggcggccagggccaggacggctccggcgcccgccgcgaccccgtgcaccgccgcgatcaccgggaacgggcactcgcgtacggcccggacgacctggccggtcatccggttgaagtcgagcagttcggcggtgtccatggacagggtggcgccgatgatctcgtcgacgtcgccgcccgagcagaagccgcggccctcgccggccagcaccagggcgcgcacggcgcgttcccgggacagctcggcgagcaggtcgcgcaggtcggcgtaggcgccgaaggtgagggcgttgagcttgtcggggcgggccagggtgaccgtggccacttggccgtccagctcgacgcgcaggtgccgccacgcggaggtgcgggtgacggagccggtgaagggactcatgacgtacggcctcctcggcggactgcccgtgtcgtccggcacgccggcgatgctgcctgcccggcgctcctccacgaagttatcactctactttgactgtcgtcacgagggcgcgatagagcggcgcggctctgcgccggccgctgtgacaatgcggccggatcccgtggcttcgtcacaggtcctcgatggcgcggtaacgacgggagggggcgggggaggacggacgttcgcaggggtagtccgtccgtgccggggcccgggctccggacggagggcaccgagagccgccgccgacggcccccgtaccattcccctcgtcgaaagcaggacagcccgatggtgaccactggtgcgccctgcgtcatgaacggacacacgttgtacgaaccccccgcttccgcgtggcgcatcgcgctgccgcacacggccgccgccgtgccggtggc

SEQ ID NO: 1683 - DNA, 2707 bp, Unknown
  Kingdom: Bacteria, Phylum: Actinobacteria, Class: Actinobacteria, Order: Streptomycetales, Family: Streptomycetaceae, Genus: Streptomyces
ggcctgctgggcccgggccgcgcgggtgacggcacggtcgacgtcggcctcgtcggcggcggggacggtcgccacggtctcttcggtggcggggttgaggaccagcagttcgggctcgggctgcgacacgggctcgggcaagggctggttcggcaaggcggggcccctcacatgcgttcgaaggagcggcgcagctcccagtcggtgaccgcggcgtcgaacgcgtcgagttcgacgcgggccatgttgcggtagtgcgcgacgacctcgtcgccgaaggcggccttggcgatcgggctgttctcccacagttcggcggcctcgcgcagggtcgtggggacgtgctcgtggccggcggtgtacgcgttgccggagcagggctcgggcaggggcaggcgctgctcgacgccgtacaggccggccgcgaccagtccggcgacggccaggtacgggttgacgtcgccgccgggcagccggttctcgaagcgcagggagcggccgtgcccgacgacgcgcagcgcgcaggtgcggttgtcgtggccccaggcgacggcggtcggggcgaaggagccgggctggaaccgcttgtaggagttgatgccaggggcgtagagcagcgagaagtcgcgcagcgcggcgagctgtccggccaggaagtaccgcatcacctgggacatctcccccggttcccccggcgcggcaccggccatgacgttggtgccgtcggcgtcggcgagcgagaggtggatgtggcaggagttgccctcgcgttcgttgtacttggccatgaaggtgagcgagacgccttcctgggaggcgatctccttggcgccggtcttgtagacggcgtgctggtcgcaggtgacgagggcctcgtcgtagcggaaggcgatctcgtgctggccggggttgcactcgcccttggcggactccacggtgaggccggcgccggccatgtcgttgcgcaggcggcgcagcaggggctcgatgcggccggtgccgaggatggagtagtcgatgttgtactggttggccggggtgagcccgcggtagccggtgtcccaggcctgttcgtaggtgtccttgaagacgatgaactccagctcggtgccgacttgcgcggtccagccgtgttcggcgaggcgggcgagctggcggcgcaggatctgccggggtgccgccaccaccggggagccgtcgttccaggcgaggtcggcgacggccagggcggtgcccgggtgccaggggacgcggcggagcgtggcgaggtcggggtgcatggcgaagtcgccgtaaccgcggtcccaggaggacatggcgtagccgtcgacggtgttcatgtcggtgtcgacggcgagcaggtagttgcagccctcggtgccgtgccgcaggacctcgtcgaggaagaagcgggcggcgaagcgcttgccctggagccggccctgcatgtccgggaaggccaggacgacggtgtcgatctctccgctcacgacgcctgcccgcagttcctcgacggtgagcgggggtgtgcggtctgccacgggcgagcctcctcggctgcgtcgggagccataaggtatgacccggaaccattgcctgggaagggggcgcgaccgaatggctcgggagacgggtccggccggggctgccggagcggccggtgaccggctcagggccgtgctgcggccggtgcgcgcgggcaacggcttcgaggaggcgctggaacagatcctgcaggtggtgcggctcggcctggtaccggccggtgagcggctgcccgccgagcgcgaactggcccagcggctggggatcagccgggtgacgctgcgcgaggtgctgaaggtgcttcaggaccaggggctcgtcgaggcgcggcgggggcgctacggcggtacgttcgtgcgcccgcgcaccgacgcgggcggcggggacgagctgcggcgccgcctcgccggggtcgacatcgacgacgtgctgcgcttccgcgaggtcctcgaggtcggcgcggcgggcctgtgcgcggcgcagggactgacggacgggcaggcgcggcggctgagcgaggcgctggaacacacgcgcgacgcgccgcccctggactaccggcgccaggacacgctgctgcacctgaccctcgccgagtcgtgcggttcgcccacgctgaccgcgcagtacgcggcggtccgggccgcggtgaacgacctgctcgactgcatacccctgctggtgcgcaacctggagcactcccagcgccagcacgccgcgctggtggcggcggtgctcgagcgggacgcggacggcgcgcgggagacgatgcgcgagcactgcgcgggaacggcggcgctgctgcggggctttctgacgtgaacgggcacgagaggtatcggttcacaccattgcgagcggggacgggaacagggagagccggatgagcacgacgggcgcgggacggccgctgatcggcgtcagtacgtacctggagaccggggcgcggtggggcgtgtgggagctggaggccgcgctgctgccctccggttacccgcggctggtgcagcgggcgggcgggctcgccgcgatgctgccgccggacgcgcccgagcgggcggcggcgaccgtggcccggctggacgggctggtcgtcgcgggcggcccggacgtggaaccggtgcgctacggcgccgagccggacccgcgcacgggtccggct

SEQ ID NO: 1684 - DNA, 776 bp, Unknown
  Kingdom: Bacteria, Phylum: Actinobacteria, Class: Actinobacteria, Order: Streptomycetales, Family: Streptomycetaceae, Genus: Streptomyces
gggcaggccggaggaccgccccggcccgagcgcgcgccggtccgtccggccggggcgctacgcctcggcaggctggcggacgttcgcccgcacccagtccacgatcgactgggtggtcgcgccgggggtgaagatctcggcgacgcccttctccttcagcggcgggatgtccgcctcggggatgatgccgccgccgaagacgacgatgtcctcggcgtcgcgctcccggagcagttcgatcacggcggcgaacagcgtgttgtgcgcgccggagaggatggacaggccgatcgcgtcggcgtcctcctggatcgccgtgtcgacgatctgctccggagtctggtggaggcccgtgtagatgacctccatgccggcgtcgcgcagggcccgcgcgatcaccttcgcaccgcgatcgtggccgtcgagccccggcttggccaccaccacgcggatcggaccggctgccacacccatcactgcctccatgaagcgactccatacgtccaccacgggacggacgccccgcaccacttcgtccggggaagtgaacgaacgttatcgccagcatcccgcacccggcagtttcacggtgcggagggagggggaaatcacacggagggacagttcctcaagcgcttcgcgcaggggggatcttcaccccgcgcgccgttccccgacgccccggccagggaaccgcagcgggagcaagcgtcacggcagccgcaccgagggggcaccaccgcggagcggaccgggcgccgcgcgggcgcggcgcg

SEQ ID NO: 1685 - DNA, 1800 bp, Unknown
  Kingdom: Bacteria, Phylum: Actinobacteria, Class: Actinobacteria, Order: Streptomycetales, Family: Streptomycetaceae, Genus: Streptomyces
catgggccgcggtcgcggccccggctgcggtcccggccccggtcgcggtctctgcctccgccccggcaccggccccggtaccggcctcggtcgcggccccggcttcgatcgcggcttcggtgtcggtggaccctgcggcgccggccggtggctccgccgtgcgcggccccgcgtccagttccgccgtcgacctcgacggcgaccaccgctcaccccgggcgcccgcgtccatcgcctcgttggcgaggcggtcggcgtgcttgttgcgggcgcgcgggatccactcgtaggtgacccgctcggccgggaacgcccgggccgcctcggcggcgagcggccggagggccgggtgcttgatctgccagcggccggacatctgctcgacgacgagcttggagtccatgcggacgtgcaccgtcgccgccgggtccaggccgtgcgcggcgcgcaggccggccagcaggccccggtactcggcgacgttgttggtgacggtgcccaggtactcggcggtctccgccagtacctgacccgtcacggcgtcgagcacgaccgcaccgtagcccgcgggaccggggttgccccgcgacccgccgtcggcctcgacgacgaactcccgcacgcccgactccgacacgcccgactcccgcacgtccaactcccgtacgcctgcggctcttcgcgcgcctagaggcccgactcgccggtgcgcaccaggatgcggcggcagttctcgcagcgcaggaccgtgtccggggcggcggcgcggacctcgttcagctcggtgatggccagctcctggcggcagccctggcaggtgcgctggtacagcttggccgcgccgatgccgccctgctgctcgcgcagcttgtcgtagagcttcagcaggtcggcggggacggaggcggcgacgacctcgcgctccttggtcacggaggcggcctcaccgtcgagttcctcgaaggccgcgtcgcggcgggcggtggcgtcgtcggccttcgcctggacggagccgacgcgctcggtcagctcggcgacccgctcctgcgcggactcgcggcgctccatgacctccaggacgacgtcctccaggtcgccctggcgcttggcgagcgaggcgatctcgtgctggaggccggcgaggtccttgggcgaggtgaccgcgccggagtccaggcgctgctggtcgcgggcggcgcgcgtgcgcacctggtccacgtcctgctcggccttggtctgctcgcgcgcgcagtcgctctcctcggtctgcgcggccacgagcaggtcgcgcagctgcgtgaggtccttggtcagcgactcgatctcggcgtgctcgggcagcgacttccgcttgtgcgcgagctgctgcaggcggacgtcgagggcctggacgtcgaggagtcggatctggtcggcgggcgcggcgttcagttgggggctcccatgggttcgtcggtggtggtggacgccgcgtgggcggtccaggggtcggtgaccgtcttggagacgtggacgcgcaggtcccatccgtgccggtcggagatctcgtcgagctgggctgcggccagctcgcaccagggccactcggtggcccagtgcgccgcgtcgagcagcgcgagaggactgtgggcgcgggcctcggaggccgggtggtggcgcaggtccgcggtgaggaaggcgtccacgccggcggcccgtacgtggtcgaagaggctgtcgcccgagccgccgctgacggcgaccgtgcggacgacggcgcccgggtcgccggcgacgcggatgccctgcgcggtcgcgggc

SEQ ID NO: 1686 - DNA, 881 bp, Unknown
  Kingdom: Bacteria, Phylum: Actinobacteria, Class: Actinobacteria, Order: Streptomycetales, Family: Streptomycetaceae, Genus: Streptomyces
gacggccgccgacttcgtggtcaccgcggcgggcggcgctggcttcgacgggacggcgctgaagcggctccgggccgtttccggcgccgaggtctgcgccggctcgtcgagcgccgtgtacgtgctggaggacggcgtggcgctcatcaggtccgacgcccgggccgtcgagccggcaccgctcgccgcgacggcgcgtctcccgctcgccgcgggaaaggtgagcgacctggacgacgactcgatcatcgtcaacgaggagtggcggaagcacaccgtgggcgagcgcgtggacgtgtggctcggcgacggcacgaggaggtccctgaggatcgccgcggtcatgaccaccggcaccggcgacaacggcgtctacgtcaccccgcgcaacgcccccgcggcgcccgtcgaccgggtcgacgtacgcctcgcgcacggtgccgaccccgccaccgtggccgccggtctgcgccgggcggtgcgggcgtcgggcggcgaggtccgcaccagggacgcctggctgcgggcgacgcaccccggtaccgaccggacgacccgggcgggcttcttcctggtcctcgggatcgccctcctctacaccggcatctcactggccaacacgatggtcatggcgacctccgaccgggtccgcgagctggccgcgctgcggctggccggcgccaccgaagggcaggtgctgcggctggtgggcgccgaggcgctgacggtggtcatgaccggcgggctgctgggagcgctggtcgccgggctcgacctggcgggcctgtggagtgcgctgcgcctgctctcggtgcggacctccctccaggtcccgtggacgacgctcgccgcggtgctgggcgcctgcgcggtgctcgccg

SEQ ID NO: 1687 - DNA, 2969 bp, Unknown
  Kingdom: Bacteria, Phylum: Actinobacteria, Class: Actinobacteria, Order: Streptomycetales, Family: Streptomycetaceae, Genus: Streptomyces
gctgctcgccgcgtacggcgaggtcgggcagtaagtcccgcggagcgcgatccgtccgattcgccgtacgcggcgagcagcacggccgggtcggggccttccaggacggtgggcttggcgagaccgtcgagcacgatgaaacgcagcaggttgccgcgggacttcttgtcgaccttcatggtctccagcagcttgggccactggtcgtagcggtagtgcaggggcaggcccaccgactccaggacggcgcggtgccggtcggccgtcgcgtcgtccaaccggcctgccagacggcccagttcggcggcgaagtgcatgccgacggcgacggccgcgccgtgccgccacttgtaccgctcgttcttctcgatggcgtggccgagcgtgtggccgtagttgaggatctccctgcggcccgattccttcaggtccgcggagacgacctcggccttgaccctgatggagcgttcgatcagctcggcggtgtgcggtccggccggggtgcgggcggcctgcggatcggcctcgacgaggtcgaggatcaccgggtcggcgatgaagcccgccttgatgacctcggcgaggccggagacgtagtcgttgaccgggagggagtcgagcgcggccaggtcgcacagcacacccgcgggcgggtggaaggcgccgaccaggttcttgccctcggcggtgttgatgccggtcttgccgccgacggccgcgtccaccatggcgagcacggtcgtgggcacggcgacccagcgcacaccgcgcagccaggtcgcggccacgaacccggccaggtcggtggtggcgccgccgcccacgccgacgatcacgtcggaacgcgtgaagttcgactggcccagcgccttccagcagtaggcggcgacctcggcggtcttggcctcctccgcgttcggcacctggatggcgatggcctcgtagccctgctcggccaggtcggcgcggagcgcgtccccggtctcggcgagtgcctcggggtggatgacggcgacccgctgggccttgtcaccgaccagaccggccagctccccaaggagctgacggccgaccagcacgtcgtagggctcggtgccggcggtgccgccgatgtggatccgcgtcactgcctcgctcatgcttccttcaactccacagcgtccaggacggattgggtgacctcttcgggagtgcggccgtcggtggcgaccaccgcggcggcgacctcctcgtacaggtgccggcgggcctccatcagctcgcgccactgcttgcgcgggttgacggcgagcagcgggcgggccacgttcaggccggtgcgcctgacggcctcctcgacgtccatcgacaggtagacgacgggcaggccggcgagcagcgcgcgcgtgtcggggtcgaggatcgccccgccgcccagcgcgagtacgccgtcgtgttcggcgagcgcccggcgtaccgcctgcttctccagcgcgcggaaggcgctctcgccgtcgtcgacgaagatctcggcgatggtgcggccctgctcggccacgatgtcgtcgtcggtgtcccggtagacgacgccgaggcggccggccagcagctgtccgatggtcgacttgccgacgcccatcgggccgaccaggaccacgagcggcgtgccggtcaccggatcgccaggttgtcgaggtaggagcgcacgttgcggcgggtctcgggcacgctgtcgccgccgaacttctcggcgaccgcgtcggcgaggacgagggccaccatcgcctccgcgacgatgccggccgccgggaccgcgcacacgtcggagcgctggtggtgggcctgcgccgcctcgccggtggcgacgtcgatggtccgcagggcgcgcggcacggtggcgatgggcttcatcgcggcgcgcacgcgcagcagctcgccggtggtgaggccgccctcggtgccgccggagcggccggtggcccgcttgatgccgtcggcggtggtgaggatctcgtcgtgcgccttggagccgggcacccgggcgaggtcgaagccgtcgccgacctcgacgcccttgatcgcctggatgcccatgagggcggcggcgagccgggcgtccaggcgccggtcccagtgcacgtgcgagccgaggcccacggggacgccgtaggcgaggacctccaccacaccgccgagcgtgtcgccgtccttgtgggcctggtcgatctcggcgaccatcgccttcgaggcgtccgcgtccaggcagcgcaccgggtccgcgtccagcttctccacgtcggccggggtcgggtacacaccgtagggggccttcgccgaggccagctccaccacgtgggagacgatctcgatgccggccgtctccttcaggtacgaccgcgccacggcgcccagcgcgacgcgcgcggcggtctcccgggcggaggcccgctccaggatcgggcgtgcctcgtcgaagccgtacttctgcatgccggccaggtccgcgtggccggggcgcgggcgggtcagcggtgcgttgcgcgccagctcggccagctccgcctcgtccacggggtcggccgccatgaccttctcccacttcggccactcggtgttgcccaccatgacggccaccggggaaccgagggtgaggccgtgccggacgccgccgaggaaggtgacctcgtcccgctcgaacttcatccgcgcgccgcgcccgtagcccaggcgccggcgcgcgaggtggtccgccaccatgtccgtggtgatgggcacgccggcgggaaggccctccagcgtcgcgacaagtgcgggtccgtgggactcccccgcggtcagccaacgcaacctgctcaacgatgctcctcatgctcgcgcctggaactgcgacggcgcgaccgggtgcgcggccctggcccgccacctccgatcctcccacgtccgggcccggtgtccggccgccggtccagcaggcggacgccgccggacgc

SEQ ID NO: 1688 - DNA, 1264 bp, Unknown
  Kingdom: Bacteria, Phylum: Actinobacteria, Class: Actinobacteria, Order: Streptomycetales, Family: Streptomycetaceae, Genus: Streptomyces
catgaaggcgcacagacgccgggcgagccggggatgccgcggggcgtagcgcaccatgatgtcgccgccctcccgcggcgcgagggagcgcgcggtcacgcggtggcggcggtagccgacctggatcacggtctccggccgctcgcgcaggttctggtaccagtccgccttgggcccgaagccggagacgatggtccagctgccgccggacgggtcccgcgtgaccacttcgaggaccacggtgcggtcgaggcccgatgtccgccccgtgtggtgcagcaggagcatccgctgcccgaacaacgggccgaggcccgcccggtacaggcgcagcggcagccgggcgacggcccgttgccaaccggtgggcggcggacggtgcttgaccggttcgggctgcgcctccatggcggcgagtccaggggaaggcgccgcgcgccagtaggggtcgggtcagcgcggacgccgggagcccgagcggacgccgaccatccgccagatccgcacctcgcggacgatcccggggatctccttgaccagcagcgcgagcgcgagcgcgccgatcacgccggcctccaccgccagtacctgcctgcctgtcatcccggctccttccgtctaacgccacacccggctccacacccggctcttccggctcttcccgtccttcggctccgctttcgcggcccgcggtcatccgggcgagatgttgggcatgaccttcaggatcgcgttgtgcttcttccagtggatgccggtggaccggcgggcgtcggacgttccgtccttgtgatggcccggctggtggtggtaggggcccttgttgccctggtgcagcccggtgacgtgcccgggagtgtcgggccgtacgtcgggcctgcctactctgatcctgcccatgatccgctcctcacggtcgctccgtcagctgcgcgaagaagtcctcgacggcgtcccacacccggtcgccgccggtcaggccgcgccattcccggcgtaccacggcgaccaggcggaagcagtcgtcgacgggaacgatccagtggtgctcggcgccgcgggccgtgtcgacgagcagggcctcgatgtcgggttccaggctcgccagggccgggcagccctccgccagccgtcgccaggcgccggggtcggcctcccaccgggtggcgccggccgggctgggccagtacccgctgggggtgccgtcgggacgcaccacgaagaacgccaggccgaccggcgctccgagcgcggaggtatccac

SEQ ID NO: 1689 - DNA, 968 bp, Unknown
  Kingdom: Bacteria, Phylum: Actinobacteria, Class: Actinobacteria, Order: Streptomycetales, Family: Streptomycetaceae, Genus: Streptomyces
gcgtcgggatccggggccgactgggcctcgcggatctgcgacaggctttcggcgctgaggtcgagcggcgggaagacgtccagggcgggggcgacttcggggtcgaccaggtgccgagtgctgactgggccgtcgatggtggtcatgggcgcttgttctccttctcttccaggcgaggccatgggtttcttgacggctcaggcgggccgaaccgtggcggcggccggggtgagcgtgaagccgcggtagccggcgccggcgacctcgtcgcagacccgccggtagttcccgacacctccgaggtagggcatgaagacccggggcttgccggggacgttggcccccatgtaccaggaggcggcccgcgggtagagggtgtgcgacgccacctcgttgacgtgctcgacccagttgtcctgggcctgccggtcggcctcgatccgggcgatgccggcctggcgcgcgtgggatatcgcgtcggtgatccagtcgacgtgctgttcgatcgagacgatcatgttgctcaggacggaggggctgcccggggcggtgaccatgaacaggttcgggaatccggccgccgcgagaccgaggtaggtccgcgggccgtccgcccattcctcacgcagcgagatgccgtcgaggccgcggatgtcgatggcgttcagcgggccggtcatggcgtcgtacccggtggcgaagacgatggcgtccacctcgtgatcgattccgccgacccgcagtccgctcggggtgatgcgctcgatggggtggctgcgcaggttcaccagggtcacgttgtcgcggttgtacgtcgcgtagtagtcggtgtcgacgcagatgcgcttggtgccgatcgggtggtccttcggacacagcagttcggcgacgtccgggtccttcacgatctcgcggatgcgctcgcgtacgtagtcggctgtcacccggttggcctcctcgtcgacgac

SEQ ID NO: 1690 - DNA, 573 bp, Unknown
  Kingdom: Bacteria, Phylum: Actinobacteria, Class: Actinobacteria, Order: Streptomycetales, Family: Streptomycetaceae, Genus: Streptomyces
ccccacccagcccgagatcctgcgctacgccagccatgtggccgaccgtttcggcctgcgcgaggacatcgagttcaacacctcggtgggcgacgcccgttacgacggcgcgaccgacacctggtccgtcaccctggacgacggacgccaggcgagcgcgccgtacctcgtcacggccgtcggctgcctgtccgcctcacgcgtaccggacttcgagggaatcgactccttcaccggcccgacgtaccacaccgggcgctggccgcacgagggcgtcgacttcaccggcaagcgggtcgctgtgatcggcaccggatcctccggcatccagtcgattccagtgatcgctgaacaggccgcccacgtcaccgtcttgcagcgcacacccaacttctccgtccccgcccggaacgcacccctgtccgaggaggagaagcgacgggtcagggcccattaccggcagttgcgtgccgaggcccgagtctcgtcctccggaagcgtcaatccaccggctctgggcaaggccctggagctggacgaggaactgcgcgcccgggagctcgaccggcgatg

SEQ ID NO: 1691 - DNA, 753 bp, Unknown
  Kingdom: Bacteria, Phylum: Actinobacteria, Class: Actinobacteria, Order: Streptomycetales, Family: Streptomycetaceae, Genus: Streptomyces
ctcctgcccccgccgcccccggccgtcagaccgaagatccgcgcccgccccggcttcgaggtggaccaccaggaggactggaacctgcccccggtcttcaccaccgtccccaccaaggacaaggtcctcttcctcacgatcgacgacggcgccgagaaggaccccgccttcctgcgcatgatgaacgacctgaaggtcccctacacggccttcctcagcaactacctcgtcaaggacgactacggctacttccgcaaggcgcagtccctgggcaacaccctcgacaaccacaccctgcaccacccgtacctgccgggcctgtcctacgacgagcagcggcacgagatctgcgacatgcaggacatcatgcagaagcagttcggcaaacgcccggaactcctgcgcccgccctacggcaactacaaccaggacaccctgcgcgcggccaagtcctgcggcatcaagtacgcgccgatctggaacgaggaggtctacgtcgaccactgggagttccgcgaggacgacaagcggctgcgccccggcgacatcgtgctcacccacttccgggggcgcagcgagtgggacggcaccatggccgacgacatgcgccgcttcctgaactacgcgacggccgagggatacgcggtggcccggctggaggactacctgtgagaccgcggtctgtggcagggccgtggccgtgggcggcgcggggatcgcggccgcaggcagcacggggaccggggccgggcc

SEQ ID NO: 1692 - DNA, 1447 bp, Unknown
  Kingdom: Bacteria, Phylum: Actinobacteria, Class: Actinobacteria, Order: Streptomycetales, Family: Streptomycetaceae, Genus: Streptomyces
gggccggaccgcgccacagggcgagcgcctcgcgcagcagaccggccgcgcgcgcgggatcaccgacggccagagccgcgcggccctcaccggtcaggtgttcgaagcggtggacgtcgacggaaccggggtcggcggcgatccggtagccgcccgcagtggcctcgacgggcgtgtgcgggcccaggcgccggcgcagccgggagatctgcgactggagcgcgttggccgctcctgagggcggctcggcgccgtagaggccgtcggtgaggcggtccgtgccgaccgtacggccggcgtcgagcagcagcagggtgagcagggcccggggacgcgggccgccggggtcgacggggatgccctcgtcggtacggatgtccagcgggcccaggatgccgaagcgcattccccggattctggcaggcgggcggtaccggatgcccgggtgcggcaaaaagccggcccacctgagtgggccggctcagtgcagcgaaccggcagtggccgcgcgctcagctgagcgtcagcgcgagaccttgccggccttgatgcacgaggtgcaagcgttcacgcgcttcggcgtcccgctcaccacggtacgcacacgctggatgttcgggttccagcgacgggacgtacggcggtgcgagtgcgagatgttgttgccgaagcccggccccttgccgcagacgtcgcagttggcagccacgggtcactccaaagacttcagatgcacttacggttgatcccggcatgccgggatcaggatccggaggctcgaggagcacgctgaatctgagtggcggtgccagggggaagagcccgaccaggtcgggcaaccggagcagcatacaacgcctgctcccgtacaacgaaactaccatggcggctcaggggtccgccccggccctcttccgtcgggcgccgccccctgggtctacgctgccgtccggtccagcagatcgaggaggcgcaggtggcgcaggtggcgcagacgttcgacgcgccggcggtgcgcacctggtgcggcctggcactgcgcgccctcgggcgtgcgcgcgaggagatcgacgcgatcaacgtctatcccgtggccgacggcgacaccggcaccaatctctacctgaccgtggagtccgccgtcgcggccgtcgaggccgtcttcgcgggccacgaggcgggcggtacggcgtccggcggcccctcggtctccgaggcggcgcgggcgatggcgcacggtgcgctcatcggcgcgcgcggcaactccgggacgatcctcgcgcagctgctgcgcggcatggcggaggtgctcgccgccgacggtgagagtgctcacagcgacgggcacggcctgcggctcgccctgcggcgcgccgccgactcggcccggcaggccgtggcgcaccccgtcgaggacacggtcctgtcggtcgcctcggccgccgcc

SEQ ID NO: 1693 - DNA, 1577 bp, Unknown
  Kingdom: Bacteria, Phylum: Actinobacteria, Class: Actinobacteria, Order: Streptomycetales, Family: Streptomycetaceae, Genus: Streptomyces
cacctcggccagcagggcgcgcagggccgccgtggcgacgccctgaccccagtaggcgcggtccacccagtacgtcacctcgcgctcgcccggctcgccgtacaccgccgcgctgccgacgacgtccccgtccgccaggatcgtgcgcagcagcacctcctcactggcgcgcagtttccgccagtgggtgtcgaaggcgtcgcggtcggccgggtccttcggggtgaaggcggccatcatgagcgactcggggtcgttcatctgccggaagaacaccggcaggtcgctgtcgtggatctcgcggagtgcgacgtgcatggctcacagcctccgggtggcgagcgtcagacggtcacgggcgtcgaagaggctatccttcaccatctgttcgtgcgcgggcgtcagacgcgccaccgggatcgaacagctgatcgcgtcccgggccggggtgcggtacgggatcgccacgccgaagcagcgcaggcccagcgtgttctcctcgcggtccacggcgaagccctgttcgcggatctggtgcagttcctcgatgagcttctcgcggtcggtgatggtgtgctcggtgagcgcgggcagcgtctcggggagcatcttgcggacctgttcgtccgtgtacgtgctcagcagcgccttgccgagcgaggtggagtgggcgggcagccggcgcccgacccgggtgaacggacgcaggtagtgctgcgactgccgggtcgcgaggtagacgacgttggtgccgtcaaggcgggcgaggtggatcgtctcggtggtgtcgtcggagagccggtccagcgtgggccgggacgccgcgaccacctcgtcgccgtcgatgtaggaggtgccgaccagcagcgcgcgcacgccgatgccgtaccgcgtgccggtcgcgtcggtctccacccagcccagttcgacgagggtgcgcagcagcatgtacaggctggacttgggatagccgacggcctcctggaccgcggccagggagtgcataccgggccggccggcgaagtactccagcaattccacggtgcgcaccgcggacttgacctgtgccccgccgccgctctcgcctgccgacatcgcccttgaccccttcgttcgacgagaaatagtctcctgctgcattcagcatcagagacagcgttcagtatatcgaacgactctgggcggctctggtgcaagacaacagggcagcacaggagcggcaacacatggtggagggacccgcggtggcagcagcaccagtctggagtgtcgatccccgtaccgggaagcagcgcgaacaggttgcggtggaggccacagcccaggacgtggacgccgccgtccgcgccgcgcacgacgcgcgcggcgcgctcgcggaccgcgccgtccgggcggcgttcctgcgcacgaccgcctggaggcggcccgggacgggctcgtcgagaccgccgacgccgagtccgcgctcggcccggcccggctcaccggagaactcgcccgcacctgctaccagttgcgggccttcgcggacatcgtcgacgaaggcgccttcctggacgtcgtcatcgaccaccccg

SEQ ID NO: 1694 - DNA, 3236 bp, Unknown
  Kingdom: Bacteria, Phylum: Actinobacteria, Class: Actinobacteria, Order: Streptomycetales, Family: Streptomycetaceae, Genus: Streptomyces
ccctcggcgaccccgccgcccgcgccccgtacgagcggtggcggcgcaccgcgcgcctggccgccggcgaactcgaacgcgccgactggctcaccgagaacggccacctgctcctgcgcgccctgcgcgacgtcctcgccgagtgggacgacacaccgccgtgaacccggccgcgcgccgtccgccaccggccggattccgtcagatcggcggcggctcgatgtcgcactccgcgcggacgccggcggcggcgccacggctctcgggatggtccgcgccgagcgtcgccaggtagcggcgccggacggacgtcagcagctcctcggcggcctcctcgtcgcccgtggccgccatgtccagcgccacgttggtcagcgccgccagcgtcgccgggtggcggtcgccgtaacgggcctccaacgcgcgggcgcactgctcgcccagcgcccgcgccgcctccggctcgccgccgtgggccaggtcggtggcgaggttgatccgggccagcagcagccacgggtggtcgtccgggagggccgcggccagcgcggccaccgtctcctcgtcgacccggcgggcctccgcgtgctgctgcgaggcacgcagcgcggcaccgtggtcgacgccggccacgcccgtcagcggatgcaccggccccagcacggagcggtagcggtgcagcgcgtcggcgctgtgctcgcgcgccccctggggatccccggtcagcctgaggtcgttggagatgttggtcagcgcggccagcgtgtcgatgtggtccaggccgaacagcgtccggtacagctccagcgcctcttgggccagcgccagcccctgctcgaagtcgcccgccttgcggcaggtcaccgagaagttcttgatggcgcgcgccgtgtgcggatgccggtcgccgtactgctcgcggtagcgggccaccgtgctgctctgcaggatcatcgcgtccgcgtaccggccgcactcgcgcatgtcacgtgccacgttgttgatggagaacagcgtggagcgggccgtcgggcccaggacttccagccgggcgtcgtggatgcgttcgtcgagggcgagcgcctcctcgtacaggccgttgacgcgcaggctcacgctgtagttgtggccgacggtcaggacgtgcgggttctgctcgccgtgcagctggacgctgcggtcgtaggcgtcgcggtcgagggccagcgcgtcggggaagcggcccgcggcgcgcaggtcggcggcggtggccccggccacggtgagcgtgaactcgtggtcgtcgcccaaagtggtgcgcagtctggcgagcacgtcctcgttgatccgccgcgactcctcgaactcggccagctgccagtgcgcgctcgcctgctgccggcgcgcccagagcgtctgcacgtggtccgggcccagcgtcgtgtgccagatgccggagaccttcccggccagctgggcggcgccgcggaagtcgccgcgcgcgatgacgtagccgaggatgctcagtgccgtgccgcgggccttggcgtcgccgcagtcgagcagtcccgacggttcgatgtggggcaggatgtcggcgtagttgcgccagttctccgggcgctgcgagtcgccggggtcgtgcgcggcgatgatctcgtggaccaggtgccgcagcctggtggcctcgtccgcggacagctcgtcgcgcaggacgccgctgagcagccggtgcacctggagggtgccggtggctgcgttgacgctcagcagtgagaactggttgatggcccggaccgcacggccgcgggccagctcgtcgcgggcgaccggggcgaggtcgtcgggcaggttcagcagccgtgcgtcgcgcaggaaggactgtgcgatcggctccgggccgaagaaggccagcagccgcagcagttcgagcgcctgcgggttctgggcgcgcagcaggtccaccgatgtccgccaggtcgccgccaccggctggacgcccgaggagggcggctccgccagcagctcctggcggcggtgttcgaggagatccaggtaggtgccggtgtcgatgccggactgggtctgcgccgcgaccgagtgctccagcgccagcggcaggtcgcccagcgactcggcgagccgttcggcctcctcctggctggcccacggcgtgcgccggcgcaggaacccgatgctctcctcccgggagaacacgtcgacgtgcagcgcgtgcacccggtcggcccagccggcgtgccgcgacgtgaccaggacgtgcccggcgccccgcgccaccccgagcagcgacgggatgtaggggaccacgtcctcgggtgcgcccgcgttgtccatcaccagcagccagcggcggaacggctcaccggtcgacatcgccgccagcacccggtccaccgggtcgccggggccctcggccgccgcgccgaagtccggcaccagggaggcgagctgctggcggatcacggcgggctgctcggcgtcgatccaccagatccgctcgtactcggtgtggtggcggtgcacgtactccacggccagccgtgtcttgccgacgccgcccatcccgtacagggcgtacggcaggacggccacctggtcgtccgcgtgcagcagggactgcagccggtcgagttcctcctcgcggccggtgaagtgggaggcctggggcagcagcggcatggtgcgcggcagccgggccggcaggggtgtcccggccgccggcgtgcgggtgccgcccacgggcgggccggaccgctcgacgccggcggcctgtggcgtcgtacgggaaggggcgggatccatcgacacgtcctccatgcgctgagccggttccctgggaggtggagtggtgggcgttgccgccgcgccggatggtgcggaccgacgcccgctgtcctccccacccgcgggcccggccaaagacgaatgcgcccgtgcgcgggccagtgcgcctccgtaggccggtccgagcgcggccagggcgggcgccgccgccgacagcagttcctggtcggcgggcccgagcgcggccccgtccaggtcggcgggcgcggccaccagcgtgccgagcagcccggagcgggcgcccatgacgcgcccggcgatctgcgagacctcctgcagcgtgcggagcgtctcggtgcgcccgaggccgtacagcagccggtcgcgtacgccgtccaggaactcgaagcgcggcccgtcgtcgcgcgacccgtcgtcctgcggccccgcgc

SEQ ID NO: 1695 - DNA, 2956 bp, Unknown
  Kingdom: Bacteria, Phylum: Actinobacteria, Class: Actinobacteria, Order: Streptomycetales, Family: Streptomycetaceae, Genus: Streptomyces
ggtgcagtggtgcagtggtgccgtggagtggggtgccgtggagtggggtgccgaccggccgtcaggagccttcccgccacgaccggatctgcatcccgggccggcgccggtgcaccgtcaggtagacgaggccgtccgggcccgcgccgatgctgcgcgtggacccgtgcggcagccagaccgtcgcgccctcggtcagctcccggggctcgtcgtgcgggcccgcgccgagggtgccgccgccggagacgacgtacacgagcacgtccaggtccggttcggcatgcggtgcgacccgcccgcccggtgcgaggcggacgaggttggcgtcgagctggcgcccgctctcggcgagtttccacagcacgcctgccgctgcccgcgggtcctcggccaggtcccgggcgtcgcacaggacgcgcggctccggcggctcggccttgcccgaaccggtgtcgtgcgcggcggacgacgccatggtgcacccctcttctcagcggctccgatgcatcgcctacgattgttccatgttcgactcgtgaaaaatcaccgcaggtgggaaggggtgagccgggtgtccgagaggcggcgcggccctcgccggcgtgaggtgctcgacgtgctgcgctcggcccccgcgccgctgggcgtcgcggagaccgccgagcgcatcggggtccactccaacacggtgcgcttccacctggacgccctggtcgccgaggggctggtcgagcggcgcaccgaggagttggacggctccggccgacgtcgtacgggccccgggcgcccccgcaccgtgtacgccgtccggccgggcatggaccgcggcggcgcccgcggctacggcctgctggcgcggatgctgctcggtgagctggcctcccgcggccccgagggccggaccgccgcggtcgagacgggccgggcatggggccaccgcctggcggagtgccagccgtctgtgccgtccgggccggtggtggaccggttggtcgccctgctcgacgacctcggtttcgacccggtgcccgaggggggcggccagggcgggccgccggaccggatcaggctgcgccactgccccttcctggaactggccgaggagtacgaccagttggtgtgcccgctccatctggggctgatgcagggcgcgttggcggagctggacgcgccgctgaccgcgagcggcctggagccgttcgccacccccgactcctgcctggcgcacctggccgcccgcccggccggtgcgtgcgcgcagtgacgtgaacaggcccgggccgctcggctccggcggagaacggcccggcccgcaggactgggcagaaaggcaacacatcgatgaacaccacgtcggccgccacggcgagcgcggtcaccttcgtctggctcggcatggtgctgggcatctccttcctggaggccccgctgaagttccgcgcccccggagtgaccatccccatcggcctgggcatcggacggatggtcttccgcgcgctgaacctcgtggaagccgtgctggccgtcgtggtgatcgtcgcggtggccgtgggcggcgcccaggcgccggtcatcggcctgaccgccgccgtcgccgtgctcctgctcgtgcagctcgtcttcgtacggccccggctgaaccgcaggtccgaccgggtcctgtccggcgaggaggcggtggacggcccccggtcgcacgaccatctggtctacgtggccttcgagatcgtcaaggtcgccgtcctgatcgccctgggaatcgccttgtcgacactgtgagaggcacggttcgcgcatccttcggacatgcttcggacaggcgtccacggggtaggtgctcgccctggcgtccgagcggggccggtgccggagacggtggggcgagggggagttcatgagcggcgaactggtgcgcttcgacctgggtgagggatccgccggggtctacgtcgagatggccgacgacgaccccggagtggagcgcgcccggcgacgcgtcggcggcacccggcaggaggcggtggacgggttcgagtccggcctcgaccagatccgcgacgtggcgggccgtaccctgcggcggatcaccgcgatgccgaccccgctgtccacggtcgagctggagttcggggtgaagttcagcgtggaggcgggcgcggtcatcgcacggacgggcgtcgaggggcatgtgaaggtcaaggtggtctgggagaagaccactcccgggcagcatgcgcaggaggacgacgacgaagaggacgaggacaccggcggcggccggcaggacggcccgggcgacggcggtgccggcgggggcacgcacgacggtacggccggcgtcagtgggacatcgggtccgtcgacttgaccgccagggaatccgccaccggacccgccgcagaatccgtcacggaatcggtcacggaatcggtcaccgaatccgccaccggatccgcgtcggacggctcccggcgcacaggcgccaccaccgtgcgctgcgcctgagccgccacacccaccggtggcaccggttccttcatcaggtccggcacggcaccgacccgctccagctggctccggtacagcgtggtgccgccggtgacggcctgcgcgcacagcacggcgaggatgccgggcccgagcagcgcggcgtccccgagcatctccgccaccatcaccagcaccccgagcggagcgtgggccaccgaacccagacaggccgccatgccgacggccaccgggaccagcgggctgtgcggggcgatgcccagcggctccgccagccgccacagcgcggcgcccacacccgcgcccaccaccatgccgggtccgaagatgccgccggacccgcccgagcccaccgtcagcgcagtaccgacgatcttcgccagcggcagctgctgctggacctcccgctcgccgtggtcctggcgctgccgctggcgaagatcgt

SEQ ID NO: 1696 - DNA, 2419 bp, Unknown
  Kingdom: Bacteria, Phylum: Actinobacteria, Class: Actinobacteria, Order: Streptomycetales, Family: Streptomycetaceae, Genus: Streptomyces
cggcacgcgcgcgtgccggtccggagggcgcgtcgatcgccgtcaggtcgggcaccgacgacgccgggatgtacagcagctcggcggcgaccggctggccgtggctcatccgggaccggcgtaccgtgtgcacggacgcgtcccggtcgatacccagggcgtcggcgacggacgccggcggcaccgcctggaagcagtccacggcgtgccaggcgtcgtccgccgtgcccggccaggcgtgctgctcgctgccgacggccacacccacgcgcggcggtgcgacagtggtcccgaccccacggcgccgctggagtctgccctccagctccagctgctccaaggcctggcgcagggtcgcccgggccaccccgaagcgggcggccaggtcccgctcgttgggcaggatctcgccgaccgagaactcggagtccagtgcctcactgagcacggtcttcaggtgccagtacttcggctccggcaccggttcgagctgcgtggtccccaccctgtcctccgcgatcgccgtggtccggcggcgttttagcgcccttgtttattaaaggttgttgtacttatctgcgaccatagggccgcccccacccttggtcaagaccaatcatcggacgcgtgtggagcggcggaccgccgcgcggcacagcgttcacgcggcgttcgcacaaggcgccactcgtgacatgacggcaaaacccccgtcgcgggacgggggtcgcgggggccggttccgggcggtgcgccgggacggccctcagaggccggccagggatgccagtttgtccgggttgcgcaggacgtagacggtctggacccgcccgtcggcgatctccagctggaagacgctgtcgggctcgccgccggacaggacgaggacagcggggccgccgttgacctccaggaagcggacggacggatcggggacgcccttgcgggccgcgccgaggagaaagcggcccacgtgatccgcgctctccagcacccgcagcggggccttggacttgccgccgctgtcgcccaccaggcggacgtccggcgcgagcaggctcatcagcccggccaggtcaccgccggccgcggcggcgaggaaccgctcggtgagatcgcgccgccgggccgggtcgacctcgtagcgcgggcgccgctcctcgacgtgcctgcgggcacgtccggccagctggcgcaccgccggttcaccccggtcgagcagggcggcgatctccgcgtacgggtagccgaaggcctccctgaggacgaagacggcgcgttcgagcggcgacagcgactccaggacgaccaggacggcgagcgacacggagtcggccagcacggcgcgctccgcgccgtcggcgacggtgccggcgaagtcggtgacgaggggctccggcagccacgggccgacgtaggactcgccgcgcgccttgatctgccggagccggtcgacggcgaggcgggtggtgacgcgtaccaggtaggcgcgcgggtcgcgcaccgcgtcgcggtcggcgccggaccagcgcagccaggcctcctggaccacgtcctcggcgtccgcgacccgcccgagcatgcggtaggcgacgcccatgaggacgggccggtgctcttcgaagaggtcggtccgcgtctcggtggtcaccgcaccatcccagccgacccgcccggcggtgtccaggcggctcccgccacgcgtcttcgggcgcgccggacccggcgcacgcgccccggagggctaccggtcggtagcaattgctgacaagctgtctatccggcgcccgcccagcgggttcgccgacccgacgacccaatgccccagacgtccccgccgacttcgacggccccgacgaccccgacgacctcgacgaccccgacgaccccgacgaccccgacgacttcgatgatcccgacgaccccgccacacccaacaaccccgccgatcccgatgacttcgacgaccccgacgaggagcatccatgtccgccaccgtctccttcccggtcccctccgcgcacggcccgcggaccgtgacgctgtcctacgcgcgcgtgggcagcggtgagccgctgctcctgctgcacggcataggccaccaccgccaggcctgggacccggtggtccacctcctcgcggcggagcgggacgtgatctccgtggacctgcccggcttcggtgagtcacccgcgctgcccgacgggctgcgccacgacctgccgacgatgcacgccgccctcggcgcgctgtgcgaggcgctggagctggagcggccccatgtggcgggcaactccctgggcgggctgctcgccctcgaactgggccgcgagaagctcgcccggtcggtcacggcgctgtccccggccgggttctggacgcaggccgaacgccgttacgcgttcggcgtgctccagaa

SEQ ID NO: 1697 - DNA, 847 bp, Unknown
  Kingdom: Bacteria, Phylum: Actinobacteria, Class: Actinobacteria, Order: Streptomycetales, Family: Streptomycetaceae, Genus: Streptomyces
ccgggccgctgggacgcggccacgatccgttcggcgccggccgcgtcccagcggcccgggttgaggtcggcgcccatgcgcagtgtctcggcgacggtgagctgcggatagagcggcttgtcctgggcgacgtagccgacccgggtgcgggcgctggccgggtcggtgccgaggacggtgatacggccctcggtgggggcgagcaggccggcggcgagggtgagcagggtggacttgcccgctccgttggggccgaccagggcgcagacgcgcccggcgggcagccggaaggcgcactcgcgcagcgcccagcccttggcgcgccgggcgtatcgcttgcccagcgcggctgcctggagtgccgtgccgctgtcggtcatgacgggtctccctgggaatgctcttcgcgcggggcgaagtgtcggtcgagtacggcggtgaagagtgcggccacgtcgtcgcggtcgaggccggccgcgcgggcccgcccggcccagccgtccagctccgcgcggagcggggagtcgtcggcgggggcggtgccgagagagcggcgtacgaaggtgccgaggccgcggcgggcctccaccagtccttcgcgttccagctcgcggtaggccttgagcaccgtgttgggattgatggcggtggcctccacgacctcgcgggccgtgggcagccggtcgccgggccgcagggcgcccacgcgcagggcctgcttggtctgctgcacgatctgcatgtaggtggccacgccgctgtgccggtcgatgcggtattcgagcacccccgtgcaccaccctttcactaattgagtagtgaaagagtggtgcacgggggtgctcga

SEQ ID NO: 1698 - DNA, 3948 bp, Unknown
  Kingdom: Bacteria, Phylum: Actinobacteria, Class: Actinobacteria, Order: Streptomycetales, Family: Streptomycetaceae, Genus: Streptomyces
gtgcgggggtggccgagcagcgccaggcgccaggcggcggggtcgagggccacgtcggacgcaacggggagcgccgtgtccacgggcgcgacggtgatccgtacgccgctgtccccctcgcgggccgcaggcgcgctccgtacgccgtcggacgcgccgtcgccctcctcgcgggccacgtgcacgacctgtgcctcgcccagcgcggcaccgagaccgcggctgtcctcgaacggccggatgccgagcgccgcggcggccgcccgcagctcggcctgttcacggtcgccggtcagcagggcccacaccggggtgccgcccagttccagggcgcggacgagcaggtcggcgaccaggagcacgcgcagaccggaggcgtcgaagccggacacgtgcgcctcgacacgggtcaggccacggcgggccggggcggcttccacgggctcgccggttcgggcgtcgatgatgcgcagcacggcccgagcgtaggcgtccgacgggccgcgcgcaggcaagtggcgcacattccggacggtgtggcggaacacggcagacgagtgccggggcgccagggcaggaaagcgccgggagacagagcgggggaacggcgtgtcggaccacggcgaggaatgcccggccgctgggcggtgttgccgcgtcgacgggactttccggcgaggcggcaaggagaactctggtgtacggcgatgcggcgacggtacggaagatcctgaccggactcggtgacacctgggccgtggtgggcctgtccggcaaccgcggccgtgccgcgtacggcgtcgccgaggtgctgcagcggttcggcaagcgggtcgtccccgtccatcccaaggcggagaccgtgcacggggagcagggctacgcctccctcgcggacatccccttcgacgtggacgtcgtggacgtcttcgtcaacagcgggatggccgggcaggtggccgacgaggcgatcgcgaagggcgcgcgggcggtgtggttccagctgggtgtcgtcgacgagtcggcctacgcacgcgccagggccgcggggctcgagatggtcatggaccgctgcccggcgatcgagatcccgcgcctgaccgcaccggaatgacgtccggccacctgacggccgaccaccacctgacggccgcgcttgacgacagcgggtgacgaccgctcgtgacgaccgcacgtgatcgcgtgcgcgcacgtgatcacacttgatcatttctgacaggacgccgtcataatgcctgagtgacgcacctctccccccactccggcgccggacccgcggggctcacggtcggcaacatcctccgggccgcctccgtggactgcctggtcctggagacggaatcgaggcagttcatagagcagcgcccgcgcgccggtgtcctcgaggagggcgccgtgcgcgggctgcggcgacgcggtctcgcggcgcggctgctggagcgggcgggccggcacaccgcgtgcgagttccgcttcgacggcgagcgccaccgtctgccgtacacggacctgacgggccatcaccattacgtgtacccacagccgttgctcgtgacggacctggtccacgagtacgccgacgtccggggcggcgacatccgcttcggggtgcgggacgtgacgctgcacgacaccggaacggaccggccctcggtctcctaccgctgccccgacacgggcgaacgccgggtggtgcgctgcgacttcgtcgccgggtgcgacggagcgcgcggggtgagccgggcggccctggcgtccggacccgcccggatcgcgcggcacgactacggcatcggctggctggcgctgctcgccgaggccccgccgtcggccgacagcgtcctgttcggcgtccatccccgcggattcgccggccacatgccccgcagcgccgaggtgagccgctactacctgcagtgcccgcccggcgacgacccggagaactggccgcacgagcgggtctgggacgagttgcggcagcggctcgcggcggccggcgccccgccgctcgaggagggccggctgctggagaagcgggtgctcgacatgcacgactacgtcgtggagccgatggcctgcggccggctgttcctggccggtgacgcggcgcacctcaccgcacccatcgcggcgaagggcatgaacctggccctgcacgacgccttcctgctcggcgacgcgctcaccgcccggctcaccgcgggcgacgaccgcggcctcaccggctactcggcggcgagcctgcggcgggtgtgggactaccaggagttctcccagtggctctccgacgtctaccacggcgccgcgtcgggcgatccgtaccgggcgggcacgacgctggcccggctgcgccggctgttcacctcaccggccgcctcggccgccttcaccgagcagtacctggggacggccggtcagaactgagcaccggcagccacggagcagcgcgccgcacgcgcgggcgcgtcgaccgacggcgtgcgtctgcccctccccggggaggggcgggcacgctcagacgccgagaccgtccagaacgacggctcccggcagttccgcgaacgccttgccgggcacgaggagtttgccccgccgccggccgctgccgaccaggacgtacggcagatcgacgacggccgagtcgaccaggacgggccagctgccggggaggccgaggggagtgatgccgccgtactccatgccggtctctcccgtggcgacctccgtcggcgcgaacgaggccttgcgcgcgccgagttgccggcgcaccacgccgttgacgtcgacgcgggtggtggagaggaccacgcaggccgccagccgcgactcgccgccgcgcttgcccgcgaccaccacgcagttcgcggacagttcgaggaggtcgcgaccgtagtgctcgacgaaggtcgcggtgtcggcccactgcgggtcggtctcgacgtagacgaactgctcggcggggacgctgccgcgccagtggcgtacggcgtcggcgacggggcgggtcagttcgtcgaggcagtcgggagcgggggtggcccggtcgaagtgtccgatgggtgcgcgcatgtccgcacgctacaagaacgcggcgcggcgcgaccgggcgtctcagtgcacgggcggcacggagaccgccatcaccatgtccatggccacgtcgccgcggttggcgtaggtgtgcgccgcgccggcctcgaacgacgcgctcgcgcctgagggcacccggtactccgtcccctccaccgtgagggtcagctcccccgcggtgacgtggaccagttcgacggtgcccgccggatgcgggtcggacgcgctggactcacccggcatcagccgccattcccacatctccagcgggccgggcgcctccgcgccggcgagcaggcggttgtagctgcccgcgtcggtgtgccagagacggacggtctggtcggcggggacgacgcggaccgcggggccctgttcgtagtcgagcagggtggtgatgctgacgccgagggcgtcgccgatcttgacgacggtgccgaggctggggttggtgcgggcctgctcgatctggatgagcatgccccggctgactcccgcgcgggcggcgagcgcgtcgagggtgaagccgcgctcgccgcgccagcgtttgacgttgcgccccagggactgggtcagaagttcgaggtccgacacattccgtccaatattttgaatgacagagtttatttcaatgaactacggtgggttgcacctgatcgttcaccgcactgtactgcgaggccgccgtgacagcactcttcgccctggccaccagcctcctgtggggcctggccgacttcggcggcgggctgctcacccggcgcaacccggcgctcaccgtcgtcgtggtctcccagtcgatcgcggccctggtgctgggcgcgatcgactgggaga

SEQ ID NO: 1699 - DNA, 970 bp, Unknown
  Kingdom: Bacteria, Phylum: Actinobacteria, Class: Actinobacteria, Order: Streptomycetales, Family: Streptomycetaceae, Genus: Streptomyces
gtaccgtacggcccagcccgccgcctcggccacggcgatcaccgggccgcgcccggcgaccacgacggcgcccgccgcccacgggcgcttcccggtggtcagtgcgtgcacctcgcggacgagttctcgcagttcggcggggtcgagcccggccttctgcggactgtcccggcgcagtctcgacgcgctcagcgctccgctccttctctcgacgcgttccaggggcggcacattcccacgaaggagcccagcgcgaccagcgccgccacgagttggacgacggccatcggcacggcggtgtgctccccggcgatcccgacgagcggggaggcgatcgcgccgatgaggaaggaggacgtgccgagcagcgcggaggcggaaccggcgttgtgctgggtgcgcatgagcgcgagcgtctgggtgttcggcatggtgatgcccatcgcggacatgagcacgaacagcgcggcggccaccggcgcgaggccgaccgcgccgaaggcgcccgtggccatcagcagcagcgcggtcgccgccaagatgacgacgacgagcccggctcccagcacccggtccatgcggagccggccgaccagcaccttgccgttgatctggccgacggcgaccagcccgatcgagttgagcccgaacagcaggctgaacgtctgcggcgaggcgccgtaaatttcctggatcacgaacggcgacgcggacacgtaggcgaacagggacgcgaaggcgaagccgcccgcgatcacgtagccggtgaagacgcggtcggcgagcagccgccgcatcgagcccagcgcctcgccgacgccgccctcgtgccgttcgccgggcggcagggtctcggggagcttcgtccacaccaccgcgcccagcagcgcgccgaccacggtgaggacgacgaacacgccccgccagtccgtcacccgcaggatctgcccgccgatcagcggcgcgacga

SEQ ID NO: 1700 - DNA, 1737 bp, Unknown
  Kingdom: Bacteria, Phylum: Actinobacteria, Class: Actinobacteria, Order: Streptomycetales, Family: Streptomycetaceae, Genus: Streptomyces
gcgccggtctgcgccgggcccgcgacatgctcgactacggcgacgcggggacggtcgccgccgtcctcggctgcggtcggcgcacgacggcccatgacacggtgcccttcgcgctctggtcggccgcccgttgcctcggtgacttcgaggaggccttctggagaacggcccaggtcggcggcgacgtggacaccacctgcgccatcgtcggcggtgtgctcgccgggggcaaggcgggcagcccgcccgccgagtgggtacgcacgacggaggcgctgcccgactggctgccggaccgggcctgaccgcttcacaacccgctgtgccgggctggaaccctgcggcatcgcggggcttccacgcgcgggcggagtcgagtggaggtacgcgccagggctgcctacttcgctccgcgcttccttggcacagcgttccgtgctccctcctgtgcttcgttccgcgcttcgctcagtgattcacgaatgcgacccgaaccccgcggaggggctccgtggagtcgctgctgccgcagggggccatcacgcgcggcgtggaagcgacgcgcaagaggacgggggaagggcgggcggtgcgacgtgcggccgtctcttccgtgtcgttccggcggtgatgccgcgcgctcgaatatgtgcacgagcgaaggcgtcgaccaggatcatcgggtccgcggcagcgctgcgacggttgagggaaaccggggtgtcgcatcgggatcagggcggcgtacgctaagggcgccatgccgtacgaaccacccactcacaccgtcgagcgctcccttcgcgcaacgaccggagccaaggtcatcgcaggtgtcgacgaggtggggcgcggtgcgtgggccggcccggtcaccgtctgcgcggcggtcaccggactgcgtcggcctcccatgggcctcaccgactccaaactgctcaccgtcaagcggcgcaccgaactcgccgtggaactggagaagtgggtgacggcgtacgccctcgggcacgccacaccggaggagatcgacgagctgggaatgacggcgtcgctgcggctcgctgcggggcgcgctctggaaggactgcccgtccgtccggacgcggtcatcctcgacgggaagcacgactacctcggcgctccctggcgggttcgtacggtcatcaagggcgaccggtcatgcgtggccgtcgcggcggcctcggtgatcgccaaggtgcaccgcgacaaaatgatggccgaactgggtgtcgaccatgcagacttcgggtttgcggccaacgccgggtatccgtcgcctgtgcacaaggccgcgctggaggagcgggggcccaccccgtaccaccggctgtcatgggcgtatcttgatgcgctgccgcgctggcagcacctcaagaaggcccgggtctggctggacggaaacgttccggagatcgagggccagctcggcttcgacttctgacggggccgctcgcccggatatgcccccccgcccacgcgggtcgtaccaacgtttgataaatatcagctcatgcctctcattcccgaggagcctcagattcacgagagtgcccagggtccccgcgccactccggccacaggccgcaccgcgccgaccccccgtcccgtacccggcccccgtcccgcggctccgtcgcgtcccggtcgtcccggccccgtgcggcccgcgccgccggcgcagcgtacgccgcgggacgcggccgcacggggccggga

SEQ ID NO: 1701 - DNA, 1673 bp, Unknown
  Kingdom: Bacteria, Phylum: Actinobacteria, Class: Actinobacteria, Order: Streptomycetales, Family: Streptomycetaceae, Genus: Streptomyces
gtggtgcaggtcgccgtagaagaagaccaggtcgcctacctggagctggctctgcgagtagatgcgctggccgatgttggcctgcgcctcggaggtgcgcgggatggagacgttggcctgggcgtaggcccaggaggtcaggcccgagcagtcgaagagggtggggcctgcgtgcgcgtagctgtacgggctgccgatcttgctctgggcggcggcgaacgcggcgcccgcgtgaccgctgcccggggtgatcttgcccatgtcgacccggtcggtgccgcgggtggcgcgggtctggtcggcggcggcgagctgctgcttctccttggcggtgagcgtgttgagcagcttctgcgcctcggcgagcttgccctggacttccttcttcttgctgcccagttcggtacgggtggcggcgaggtccttgagcttggcggtggcctcggcacgctgctgggcgagccggcgctgcttgtcctggatcttcttcagcgcgtccgcctgctggccgctgacctggttcagcgtggcggccttgtccaggtagtcgtccgggtgggaggagaggaagagctggagggaggggtcgatgccgccgctgcggtactggccggccgccatcgaaccgaggccgtcacgcagcttgttgaggtcctgctggccgcgggcgacgttgtcctggatggtggagatctccttctggagtctctcctgcttctccttggcgccgttgtacttctcggtggcctgctccgcctgctcgtagagcttgtcgaccttggacttgacctcgtccttgctcggcttctcactcggcgccgcgttggccgcctgcgcgctgatcgcgacggcggcggcggccgcggtggtcagcacggtgacgcgtgtgcgactgggctttttgggtcgacggtgggacgccacgaaagaaagctccttctgatgggtgaactcccgctcgggagttcgagtttaaacctagtgaccttggtccgacggcgccacggcttcaggcaactcggtgtgcggcagttccggcgcgacgtgccgacgcgtaacgtggcgccccatgaagatcctcatcagcgctgacatggaaggcgccaccggtgtgacctggcccgccgacgtgctgccggggacaccgcagtggcagcggtgccggtcgatgttcacctcggacgtcaacgccgccgtgctcgggttcttcgacggcggcgcggacgaggtcctcatcaacgaggcgcactggaccatgcgcaacctgctgctggaggaactggacgagcgggcgcagatgctcaccgggcggcacaagtcgctgtccatggtggagggcgtgcagcacggcgacgtcgacggcatcgccttcgtcggctaccacgcgggcgccggcatggagggcgtcctcgcgcacacgtatctcgcgaactccatcaccagcgtgtgggtgaacgacgtacgggccagcgagggcctgctcaacgcgcacgtggccgccgagtacggcgtgcccgtggtcctcgtcaccggcgacgacgtcgcctgcgaggacgcgctgggctatgcgcccgaggcgctgaaggtcgccgtcaaggaccatgtgtcgcggtacgcggcggtgtgccgtacgccggcccgtaccgccgccgacatccgcgcggcggccgccg

SEQ ID NO: 1702 - DNA, 2231 bp, Unknown
  Kingdom: Bacteria, Phylum: Actinobacteria, Class: Actinobacteria, Order: Streptomycetales, Family: Streptomycetaceae, Genus: Streptomyces
  misc_feature (1270)..(1344): n is a, c, g, or t
  misc_feature (1648)..(1759): n is a, c, g, or t
aaggtgctggccgcgctctgcggtgagccggacgtggtgaccggacacgcggtgggcgagggcgacccgctcccctgccggctgacggccgcaccgccgacctggcgtggcgtggtgcgcgccgcccgccgggtcgaggcggacctgctgacgcaccgcgacttcgccgtgggcgagctgcgccgcgaactcggcctgaccggaccggcgttcgaggtggtgtgcgatccggagggctcctgggccgccggtgcctggcaggacgccgggcgcggcacgagcggcaccctgctccagggcaccgtgctggccgtgggctggtcggaccgggacgcgcggatgacgctgcggctgcggtaccgcaccgacgtgctggacgcctcggcggcggcccggatctgcggctaccacctggccgcgctccggctgatggccaccgacgcggacgccgagcacgcccggcagagcctgctgtccgccgaggaggtgcgcgagcagctcgaagggctggccggagccgagcgcgagctgcccgacgcgcgggcgcacgagctgttcgagcagcgggtacgggagcatcccgacgccgtggccgccgtgcacggcgagcgctcgtggacgtacggggagctgaacgcacgcgcgaaccggctggcgcgggcgctgctggcgcgtgggctgggcccggagggcgtggtggcggtggtcaccgaacgcaacctggactggctggcgtcggtgctcgcggtgttcaaggccggtggcgtctacctgccgatcgagccgcacttcccggccgggcggatcgccgcgaccctgacccggtccggctgccgcctcgcgctgaccgagccggagagcaccgccaccctggacgaggccctggccacgcaggcgcccggcgtcgagaaactgctggtccaggccgcttacgcggaggaccacgccgacggcgacctcggtctcgacgtggcgcccggccggctggcgtacatctacttcacctccggctccacgggcgagccgaagggcgccatgtgcgagcacgcgggcatgctcaaccacctgtacgccaagatcgacgacctgggcatcggccgggagacggtggtcgcgcagacggccccgcagtgcttcgacatttcgctgtggcagttgctggccgcgctgctggtgggcgggcggacgctgctggtggagcaggacgcggtcgtggacgtcgagcggttcgtcgacacgctggagcgcggccgggtcggggtggcgcagnnnnnnnnnnnnnnnnnnnnnnnnnnnnnnnnnnnnnnnnnnnnnnnnnnnnnnnnnnnnnnnnnnnnnnnnnnnctgaagccggacgtcgccctggtcaacgcctacggcctgaccgagacgtcggacgacaccaaccacgaggtcatgcgcgaggtgccggagcgggtgctgctgggccgtcccgtcagcaacgtgcgggtcctcgtcgtcgacgagcacctgtccctggtgccgctgggcgcgcccggcctgatcgcgttctcgggggtgtgcgtgggccgcggttacgtcaacgaccccgagcgcacccgggaggcgtaccggcaggacccctaccggccgggcgagcggctgtatctggccggggactgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacagcacgcacttggtcgccttctacagtggacggcggctggagaccgaggagctgcggcaggcgctgggggccgcactgcccgcgtacatggttccgagcgccttccactggctggacgggctgccgctgacggccaacggcaagaccgaccgcaaggccctgaccgcgctggccgaacagaccgccgcggacgacacgaccgacggcgggaccgaggacgcgccgagcaccgcgaccgagcggcggctggcggacgcctggtccgaactgctgggcgtgccccgggaccggatcggccgcgccacccacttcttcgacgccggcggcacctcgctgtcggcggtcaagctgaccatcgccctggaccgggccgtctcgctgaaggacatcacccgtcatccggtgctcgccgacctcgccgcgctcctcgacggtgcctgcgcgagccgtccggagctgcggcagcctc

SEQ ID NO: 1703 - DNA, 729 bp, Unknown
  Kingdom: Bacteria, Phylum: Actinobacteria, Class: Actinobacteria, Order: Streptomycetales, Family: Streptomycetaceae, Genus: Streptomyces
gccccgcgcggcggtggccgctcccggcgccggccgccggccaggcgttccgcgctgctgaccgttgcggtgccctcggtctgcgtggtgggcgtcgccggaatcgccgcggcctccgtcgacagcttcacgggcgacgacaaggacacctcggcgtccgccgccgaggcgcaccccgtgcagccggccaccgccaacaacaagctggactcccagctccagagcctgtccgccggggcgaacgacttcgccgaccgggccagccgcacccaggagcgcatcgacctcaaggcgcagcaggaggccgagcggaagaaggccgcggaggaggcggagcgcaaggagcggctgcgccccaagttcgtgctgccggtcgcggagaagggactcagcgcctacttcggccaggccggcgtcaactggatgtccgtgcacaccggcatcgacttccccgtctggtacgggacgacggtgatggccgccaccgacggcacggtccgcacccagtacaacagcgcctacggcaacatgctgatcctgaccgcgaaggacggcactcagacgtggtactgccacctgtcccggtaccaggtcgtcaccggagccaccgtcaaggccgggcagccgatcgcctactcgggcagttccggcaactccacgggaccgcacctgcacttcgaggtacggcccgccggcggggccccgatcgacccgctgccgtggctgcgc

SEQ ID NO: 1704 - DNA, 1540 bp, Unknown
  Kingdom: Bacteria, Phylum: Actinobacteria, Class: Actinobacteria, Order: Streptomycetales, Family: Streptomycetaceae, Genus: Streptomyces
gtccccggcgacctcgatgtcgccggggacggcgaggacgtcctggaagcgggacagcagcggctgggccgcgcggtcgcggcactggtcgaccgcggccacccggtcatggtgctgggcggcgggcacgaggtcgcgtacggcagctacatcgggctggagcagacgcgggtgctgcgggagggcggccggctcggggtgctgaacctcgacgcgcacttcgacctgcgcgacgacgtccggcccagctccggcacgcccttcctgcagatggcgcagagcgaggagcggcacggcagggcgctcaactactgggtgctgggcgtcagccagccgagcaacaccgagcggctgttccgcaccgcggactcgctcggggtgcggtacttgcaggacaccgagtgcgggctgctcgacctggcgcgcaccgagaggttcgtcgacgagttcctcgcgagctgcgacgtcgtgcacctgagcatcgacctcgatgtgctccctgccgcgctcgcgccgggagtcagcgcccctgccgcctacggggtgcccatcgacgtcatcgagcgggtctgccaccgggtggcggcgagcggcaagctcgcgctctgcgacatcgccgagctgaacccggagttcgacgtggaccagcgcaccgcccgcgccggcgcccgcctgatccaccgcatggcgaccgcccgtaggtagtacccccgcgggccgggcacgcgcccggcccgcccccgaacaggccgccaggccgcgcgagcgacgaaagccgcggcctggcggccgcggctttcccgaggggacgggctatggcccggcggggccccactcgccgcacccgggccagacccgtgtacatccagtacgagggtcagggcccggcactccccaagctctccgagcaggggggacccccagggcacccatctgacgccgcgaggcccgccctgcgggcgggacgacgggaattcgacgacaggcctggcggtaggtacgagccccgtgccgacgcgtccggacacgcggcgaacctcccgggcccgcgggcccgggaggtgtgctggggtgacggctcggtcagaccagcgtgccggtgaccgtctccgcggcggccagggcgcggccggaggtgacgtactggacggtcgcctctatctcgggggcgagccagcggtcggtgccggggccgtcgaccgtctcgcgcagcccgtcgcggaccgccgccgtggccggtgccggggtcagcggagcccgcaggtcgagggcgcgggcggcggtgtagatctccaccgcgaggacgcggccgagtccgtcgatggcgcggcgcagtttgcgggcggccgaccagcccatggagacgtggtcctcctgcatcgcggacgacgggatggagtccgcggatgcgggcacggccagccgcttcatctcgctgaccagcgccgcctgcgtgtactgggcgatcatcaggcccgagtcgacgcccgcgtcgtcggcgaggaacggcggcaggccgtggctgcgcagccacggcctg

SEQ ID NO: 1705 - DNA, 1032 bp, Unknown
  Kingdom: Bacteria, Phylum: Actinobacteria, Class: Actinobacteria, Order: Streptomycetales, Family: Streptomycetaceae, Genus: Streptomyces
ggtgcccggcgcgttcgtgggcctcgccgcgcgcggcgagcgcttccgcggtgccccaggcgtccccgagccgctcgaagatctccagcgcctcctcggcgtcccggaccgcgtcccccgcccagtcggtgcggttggccagcaggttggcccgcatctgcagggcgccggccagctcccagtcgaatcccggggcgccgcggcaggtgtccacgcaggcgtcgaggaccgtccgcagccggggcatgtcgccgctcagcatcacggcgaggaaccacagcatcccgggatggcggcaggtctggggcaggccgggctcgtagacctcggcgatgacctgcagcttccgcttcgcctcgggggtctgccacgcgtccagttcggtgtccatgcaggcgaggtggaggaggtgcaggccgcggcgggcctcggcgaggacgtcgtcggccatcggcggcggggtgtccgtgcaccgctgccacaccgggccggcgcggcgcaccggctcggtgaaggggtcggggctgaacgccatcacctcggcgcaccagttgcgggcctcgatgcgcacgtcccgcatctgccagtacgtgcccagggagtggatcaggcacagcgcctcgtgctcgtcgcgttcggcgacggcgtgccgcagagcggtgcgcaggttctcgtactccagttcgaagcgggcgatggcggcgcgctggccggggccgcgcagcaacgggtcggtggtgcgggccagttcgcggtagtggacgaggtgggcgcgctcggcggggccgcgtacgccggcctcctccagccgctcggcggcgtactccgcgacggtctccaggagccggtagcgcatctcaccgtcggctgcgggcgcggccaccacgagggacttgtcgacgagggaggcgagcgcgtcgaaggcggcgggcccgcacacggcctcggcggcggcgaggtcgcagccgccggcgaagacggacagccggctcagcacgtcccgttcacccgcgtcgagcaggtcccaggacc

SEQ ID NO: 1706 - DNA, 1983 bp, Unknown
  Kingdom: Bacteria, Phylum: Actinobacteria, Class: Actinobacteria, Order: Streptomycetales, Family: Streptomycetaceae, Genus: Streptomyces
gggctgccgggtgtgggatctggggctgccggacctggggcgggcctgggtcagggccgcccccgccaggacgatcaccgcgccgaccggcgtcgaccaggtcaggtgctcgccgaggacggcgacaccggcgccggcggcgatgatcggtacgaagtaggtgaccatctgggcggtggtcggaccgacctcggcgaccagcccgtactgcacgagcatcgcgacaccggtgcccagcgcgcccagcgcggcgatcgagagcaacggcagtacgtccaggtggctcggcagccgggtgaacagcggcgtgacgacggccagttgcaccgtcgccaggagcaactgcccgccggtcagcgagaggtgcgactcggtggcgccggccagcgtgcgccggacgtagatccagccgaccgggtagctcaacgaggccagcagggccatcgccgtgccgcccgcgtccaggccgtggaagccctgccaggcgccgagcaccgtgagcaccccgaggaaaccgagcccgagacccgcgacccgcacccgggtcggacggtcctcggagagggcgaccagggacagcagcatgccccacagcggcgaggtggcgttgcagatgcccgcgagcgtggacgggatggtcagttccgagtacgcgaagagcgagaacggcagcgcgttgaggaagaagccggcgaccgccaggtgaccccaggtgcgggcgccgcgcggcagccgctcccgcttcaccgccatggccacggccagcaccgcggtgccgaacagcagccggcccagcgtcacctggaagggggcgaagccccgcgtgcccaccttcatgaacaggaagctgaacccccagatcagtgccaggaaggcgaaacgggcccgccagtgcagcgggccacgggcccggccggccggggcgggcgaggacggtgccgaggatgcggtcgcggaactcatgctcgtagcgtgcctggcgatatcctcgtagcacaatcgagaattcgcgcccggtatctcgtagtatcgcttacatgtcgactccggagggtccggaggttccggaggtctggagggcacatgctgaacctggagcgtctgcggaccctcgacgccctcgcccggcacggctccgtcagcggcgcggccgacgggctgcacgtgacgacctccgcggtctcgcagcagatggccaagctggaacgggaagtgggccagcggctcctggccaggaacggccggggcgtgcggctcacggacgccggccggctcctcgccgagcacgccgcgcgcatcctctctcaggtagaactcgcccagtccgacctggaggcccagcgcggtcaggtggtcggcggactgcggctcgtggcgtttcccaccggcgcccgcggtcttttccccgccgcgctgtgccatctgcgcgcgcggcatccggccctcggcgtcaccaccgccgaggtggaaccggcgcccgccgtacgggccgtgctgcgcggtgacgccgacctggccgtggtgctcgactggtacaacaagccgctgcccgtgcccgaagggctcacccgggcgccgatcctcgacgatcccgtcgacgtcgcgatgcccgcgacccaccggcacgcggaccgcgccgaagcagctctggaggacttcgccgacgacgactggatcacctggggcgacgacgagttctgccacgagtggctgctggacaccctgcgctccaaggaagtggaaccgcgcgtcgcgcaccgggcgcaggagcacgccacgcagctcgcgctggtcgccgcgggcctcggcgtctgtgtggcgccccggctcgggcggggaccgctgcccgccggagtgcggacggtcccggtgcgtcaggccgtacgcaggcacgtctacgccgtgtggcggtccgacgccgaccgccgcccctcgatccgcgcggcggtcgaggcgctgcgggccgcgggcgagcaggtcggc

SEQ ID NO: 1707 - DNA, 1509 bp, Unknown
  Kingdom: Bacteria, Phylum: Actinobacteria, Class: Actinobacteria, Order: Streptomycetales, Family: Streptomycetaceae, Genus: Streptomyces
gggggccagaggcgggggcgacgggcccatccgtgcggagggcgaccagttcatgaacgacctgcgcgagctgcaggagtcccgtgcgcacgccgagagcgcgcagggtgaggtcacggtccgctgggcctacgagatcgccgggccggcggtggccggtgcggtggttctggcgatcctgttggccgtgggctgagggctgctgaagggtgggccgtgtgggccccggggtctccggggcccacctttcagatgcctgccgcggccgacaggtcgcgcttgaccgactccaggagggctgtcgccttctcccgggccgccgggagggctgagcggtccgcgaccgggaccaccacttccaggtagcacttcagcttcggctccgtgcccgacgggcggacgatgacccgggcgccgtccagggtgtagcgcaggccgtccgtcggcggcagcttctccgtgccctgcgtcaggtcctcggcgcgggtgatcggcagacccgccagctgggtcgggggctgctcgcgcaggcggcgcatcgcgtccgcgatcagcgagaggtcctcgacgcggaccgagagctggtccgtcgcgtgcaggccgtgctccacggcgaggtcgtcgaggaggtccaggagggtacggccctgttccttgagctgtgaggccagttccgtgatcagcagggccgcggtgatgccgtccttgtcccgtacgccgtccgggtccacgcagtagccgagggcctcctcgtagccgtagcgcaggccctcgacgcgggcgatccacttgaagccggtcagtgtctcctcgtagggcagggccgccttctcggcgatcctgccgaggagggaggaggacacgatcgactccgcgaacgtgccgtgcgctccgcggctgaccaggtgggcggcgagcagcgcgccgacctcgtcgccgcgcagcatgcgccagtccgcgccgtccttcacggccgccgcgcagcggtccgcgtccgggtcgttggcgatgatcaggtccgggtcggtctcgcgggccttcgcgaaggccaggtccatcgcgccgggctcttccgggttggggaaggcgacggtggggaagtccgggtccgggtcggcctgctcggcgaccagggcgggcgcggggaagcccgcgcgggcgaaggcggcgagcagggtctccttgcccacgccgtgcatcgccgtgtagaccgtgcgggccgtgcggggggaaccctcggcgaggacggcgtccgtgcgggcgaggtacgcctccaggacgtcgtcgccgagcgtctcccagccggtgtccgggcgggggacctcggtgagggtggtgatcgcgtcgatctccgccgcgatctccgcgtcggcgggcgggacgatctgggagccgtcgcccaggtacaccttgtagccgttgtcgcggggcgggttgtggctggccgtgacctccacgccggcgaccgcgccgaggtgccggatggcgaaggcgaggacgggggtgggc

SEQ ID NO: 1708 - DNA, 548 bp, Unknown
  Kingdom: Bacteria, Phylum: Actinobacteria, Class: Actinobacteria, Order: Streptomycetales, Family: Streptomycetaceae, Genus: Streptomyces
ccgacgccgacggcaaccagagcatcgacgcggacgagtaccgggcgctgttccgcaccgccttccggcgcgaggtgcccgacggcggggcggcgtactcgcgcggcgcgttcgtgcaggacttcctctccttcatggcgggccgcaggcgttccggcgcctacgactccctgctggccgattcctgaggcggcggtcccgcggcagccccgaaggggcggggcagcggccccggggttcaggcggcggtctccttcttccgccgtccgccgcccgccgccggacagcgcgtcgacgagctgctcgcggctcgtcttcgaccggccgggaagacccccgtcggccgcgcgctggtacggctcggccctgctcagcccatgtggtcggggccgacctcctcgccggtgcgttcgttgacgcgccgcgctgcaaccggtggaagtgggcggtgtggtcctcggtcgtggtgaacagcccggccggcaccgtgaccgtgaccagcccgaacgtgatcgcaccggtcgagatcgcccgagcgcatggcgcac

SEQ ID NO: 1709 - DNA, 2169 bp, Unknown
  Kingdom: Bacteria, Phylum: Actinobacteria, Class: Actinobacteria, Order: Streptomycetales, Family: Streptomycetaceae, Genus: Streptomyces
ccccaggcctggtcgggcggcgcctgccagccctgcccgggctgctgcggcggcgcctggtccgcacccggaccccacggctggccccaggactggccaccggccggagcatgggccggtccctgcccggcgggcggtccggcgggctgcgcgggtgtcagaccgccctgcccgcccgtcgtgcccggcagcaggggctgcccaccgtcggaaggcagcacgatgccttcgcgcgcgggccgcgccgagggctcctcgccctgtccactctgcgtcaccgggactcctacgaatgggggactagcggaatcgtcggctcacgctaccgggtcccccgagccgggtgctacgcagcacagggcgcgatctccttcccggcctcctcggtaacaaaacccgcggtcggcacgctgttatatggctcacgccaccgggtcatgtggctcacgccaccgggacgtccggctcacgccaccggcctcaccccgccatctgcacctccagccgggccccgaactcccttaccaccgcctcgtcccggtacggatccaggcgttgctgaaagtcctccaggtactccgccccgcggttggaccgcagcgtctccagcagatccaccgccttcaggccggtggcgcaggcctgttcgacctcgcgctgctgcacctgcgccgtggcgaggagcacgtacccgatggcccggcgcctggcccgcgtcaccggatgcgccgtcagcgcctgttccgcgtaccgcgccgccgcctccgcctgccccaggtcccggtggcagtgcgccaactcgtccgccaggtaggcctcgtcgaagtgcgcgatccaggcgggatcgtcccccgcgtccggcacggcccgctccagcgcgcccaccgcacgcccggacgacacctgcgtcgcccgcacgtcccccagcagcgcgtgcccgcgtgcctccgcggcgtggaacatcgcctccgcgcgcggagtcacacgaccgcgcgccccctcctgcgccgcgcgcgccaactgggcgatctcccgcgggtttccgagctgcgcggcgagatgactcatggaggcggccagcacatagccgccgtaaccgcggtccccggccgcctgggcgagccgcagcgcctggatgtagtaccgctgggcgaggccgggttgaccggtgtccacggccatgtacccggccagctccgtcaaccgcgccaccgcggcgaacagatcgcggcccaccgcctcccggtacgacccggccagcagcccggagacgacactgttgaggtagtgcaccaccaccggacgcacgtgcccgctgccgtaactgtggtccaggtcgaccagtgcctgcgtcatggcccgtacggccgccacgtccgactgccccacgcggggccctgcggagcgcgcgacctggccgtccggcgcggtgatcagccagtcgcggctcggctccaccagcgccgaggaggcgacggaggagccggacaggaagtcgcggcgtcccacgtcactgcgccacagctcacagacctgctcgatggctcccaggaccgtcggcgagaactggaggcccacgcccgaggcgaggttcttgccgttggccatgccgatctcgtcgatcgtgaccgtccggcccagtttgcggcccagcgcctcggcgatgaccgcgggcgcccgtccgcgcggctgctgtccgcgcagccagcgcgccacggacgtcttgtcgtaccgcaggtcgagtccgtgctcggcgccgcacatgttgacccggcgggccagcccggcgttggaacagcccgcttcctgaatgagcgcctgcagccgttcgttcggctgccgcgcgacgagaggcctggcggccatggcgtaaaccccctgctttctggcggctcgcgtggctgcggtgccctgcccacgcaccgacgttgacgtgtcttgcgcggccggatcccgccgggttcggcggagttgtcctgccgtgaagatcaatgccccacggacataacgaaaatgcgggacatgcgaagattgccggaataccgaacccaaaagtgcagcggatccccctcggtccctcttgatcccgctcggccccctcgatccccctggggctgcctgaggctccctgacggaccgccccccgggccgccccgcacaggcctaccc

SEQ ID NO: 1710 - DNA, 1189 bp, Unknown
  Kingdom: Bacteria, Phylum: Actinobacteria, Class: Actinobacteria, Order: Streptomycetales, Family: Streptomycetaceae, Genus: Streptomyces
ccccggtggtgccggcccggcggcggacgcggggcgcgtgtccgcgggcggggcgacgggcggcggtccgtcccgcaactgggccaggtgctcgtccagatcgctgagctggtgcagggcgaggtcgcacagggcccgctcccaccggccccgggggtccgtcatgtcgtcccggtcccgcgcctcccgtcgcacggcgtcgacctcgcccttgagccggcgcgcctgggagatcagggcgtcgacagcgccgcgccccggcggctggccgggcggacggtccgcgaagaggtgggacggcatgacgcactccgatgaggggacggggtcgcgtggaggcgggagggaccgctacgactgtggcacagcggacgacggcccgtaagggattcggcgacacacgatacggtggtgcttctggcatatgccacagtcttcgcggagcgactccactgcgccttcggcctacttcgccgggcggtcaagtcgtacgtcggctacgggaattgacggaaaacgcggtgctcggcgggggttattcacgcgtgtgttcgacggcgaagcgtccgccatggcaccggtgcggcgcccagcagtgccgtagtgacgcaggtcacatgaattggtgggcggtcaggcgtaatgcaaacggcacctgcgggctcctaagaacacacggcagaaccggccgacctttgacccgcaggggagaccgaccatggacaccaccctcgagcagtccgcccgcgcccgtctgatcaccgcggacggacaggaactcaccgtgcccgccacgctccgctacgcctccgcggacccgctggccgtgcacatcgacttcccgcccgaggcctccctcgacggggaggaggtcacctggaccttctcccgcaccctgctggaagaaggcctcggacaaccggccggcgccggtgacgtgcacttctggccctgcggcggctcccgtacggcgatcgaactgcactcccgctcgggcatggccctgctgcagttcgacaccccggcgctgcgccgcttcctgctgcgcagctacgccgtcgtcgcgcccggccgggaggatgtcgaggcggccgtcgaccgcggcctcagcgccctgttcggcacggtgtgaggggcgcccggagccccctccctgctcagcggggagccggggcgtacagctccgggc

SEQ ID NO: 1711 - DNA, 7204 bp, Unknown
  Kingdom: Bacteria, Phylum: Actinobacteria, Class: Actinobacteria, Order: Streptomycetales, Family: Streptomycetaceae, Genus: Streptomyces
gacgcctgaggggcggcggcccgcctgccggagatccacgcgcggcgggagtgagccgcgtacgggaccggcggtctcagtcgcggccgtctcagtcgcggccgtccgcgctcttggccggccagaccccggtcgagcgcgcgatggccgccgcccctcaggcgtcccctcggccgcggatctccgccaggcgggccgccgccgcgtccagcaggaggtccagtgcggccgggtacgcgctgcggcccatgtcggtgaccaggtggcgggcggtggcggcgatgtgcgggtgggtgccggcgggcaggcaggcgtacgtggcccgccacacggcggcttccgcctcgcgcgcggccctgggcagcgcgatgctcgccgagtccagcgcgccgaaggccagcgcctggtcgacgtaggcgtggtagatccggacggcctcctcgtccgggaagcccgcgccgcgcagcacgccgaggatggtctccacggtctggatctcgtggacccggccggtgacccggtaggagccgaggacggcggcccgggggtgggcgagggcgccggcgtgcatgcgcaggccgagttcccgcaggtcgcggtgccagtcgccggtggggcgccaggcgcgcagcgagcggccgatgagttcgtcggcgatggcgagcatcaggtcgtcggtgtgccggaagtagcggtagagcgagctggggtccgcgccgagggcgcggccgaggcgccgcaccgacagggcctcggcaccgtgctcctcgatgagccgcagcgcggtggagacgatcagttcctcggacaggacgacgccctgtttggtggggcgtctgcgccgccgtgcggcgggcgggacgacgcgttcgctcatggcgggcactttatgacaacaccgttgacctgttgccggtgcgggcggttccatgtgctttcaccggggtcggcagggccccctgggaccgcgctcaaggaaggcaccatgcacgcagatctcctcttcaccggcggtcccgtcctcacgccggccggccgcaccgcgaccgcggtggccgtcaccggcgaccgcatcaccgcagtggggcacgacgaggtgcgggagctggccgggccgcgcaccgaggtcgtcgagctggccgggcggctgctgctgcccggcttccaggacgcccacgtccatcccgtgtcggccggccgggaactcgcccagtgcgacctgacgggggcgctgagcgccgaggagaccgccgcccgggtgcgcggttacgccgaggcccacccggagcgggagtggatcctcgggggcggctggtccatggaggcgttcgagggcggtacgcccgccaaggaactgctggacgccgtggtgcccgaccggccggtctacctgcccaaccgcgaccatcacggcgcctgggtcaacagccgcgccctcgccctggccggcatcacccgcgacacgcccgacccggcggacgggcggatcgagcgggacgcgtccggcgagccgagtggcacgctccaggagggcgcgatgcagctcgtcggccgccacgccccgcccgccacggccgcggacaagctggcggccctgctgcacgcgcagcgccatctgcacgcgctcggcatcaccgcctggcaggacgctctcgtcgggaacttcctgggcatggacgatccctccggggcgtacctgaccgccgcccgggacggttcgctcaccgcgcgggtgcgcggcgcgctgtggtgggaccgggcgcgcggcgccgagcagatccccgaactggtggagaagcgggaggcgttgagccacggccggttccgggcgggcagtgtgaagctgatgctggacggggtcgccgagaacgggacggcggcgctgctgcagccatatctggaccgctgcggctgcgccaccgccaaccggggcaccagcttcatcgacccggaccagctcccgaagtacgtcaccgctcttgacgccctcggcttccagtgccacttccacgcgctgggcgaccgggccgtacgggacgcgctggacgcggtggaggcggcgcgggcggccaacgggcccagcgacacccggccgcacctggctcacctgcaggtggtgcaccccgacgacgtgccccgcttcgcccggctgggggcgacggcgaacatccagccactgtgggccgcgcacgagccgcagatggacgagctgacgatcccgttcctcggtgccgaacgggccgcgtggcagtacccgttcagggcgctgctgcgggccggggcgacgctggcggcgggcagcgactggccggtgagcagtcccgacccgctggaaggcatccacgtggcggtcaaccgccgcgagcccggcagtgacgcgccggtgttcctgcctgctgagcggatcgggctggcggaggcggtcagggcctacacggcgggctcggcccgggtgaaccacctggacgagacgggcgaggtgcgcgagggtgcgctcgcggacctggtggtgctggaccgggacccgttcgccggaccgcccgaggagatcgcccgcacgaaggtgcgggagacctatgtgggcggggtgcgggtgttcgccgccgagtgagccgagcgaggtgacgcaccaccgcgaggtcagcggcaattcacggacatatgtcaatcgaccatgctggaattcactccatcgagggtaacttgctgagcgggggcgggtggtgtgctcgctgagcgcaccaccgtcacagcccggacaccggttggaggcgaagtcgacgtggcgaacgtggtacccgcgccgctcacccggcagctgcgcgtccgccggcaccgcggctgcaccgtgctggagttccacggtgagatcgacatcgccgcggcggcgcggatccagccgcgcctggaccgggtcacggcccggcccggcgcgcgggtggtgatcgacctgagcggggtggagttcttcgactgctcggggctgcgcctgctgcaccggctccgcgaccgcgtgctgggccagggcggcgagctgctgctggtgtgcccgcatccgctcaccctgcgcgtcctcgccgtcacggggctgtcgcggctgctgcccccgcggcccaccctggaggccgccctcgcgtgggccggggccgggtctactcgtcccgcggcgcgtcgaagagcgcgctgaccgactcaccgttgtggatccggcgtaccgcctcggcgagcgccggggcgatggacagcacccgcagcttgtcccggtaggcccggtactcctcgtggtcctccaccggcaccggcacggtgttggtgcacacaatctccagcacgtcgctctgctcggtgagccgtttcagggcgcccgccgcgaacaggccgtgcgtacaggcgatccggatcgagcgcggccccgactcacgcagccggtccaggagttcgagcaccgtgctgcccttggcgatctcgtcgtccagcacgatcacgtcccgcccggcgacgtcgccgatgaccgagctgatcgtgacccggtcgtcggcgaagcgctgtttggcaccggcggccacctgggcgccgatcatccgggcgaacgcggcggcctccttggcgttgccgaggtcgggcgagacgaccgtggtgcgcgtcaggtcgtactgccggaagtgcgcggcgagttcgcgcagtgcgtgcaggtggtcgacgggcaccgagaagaagccgtgcacctgcggcgcgtgcagcgtcatcgccaggacccggctcgcgcccgccgccaccagcaggtcggccacgaggcgcccgccgagcgagatgcgcggggcgtccttcttgtcggagcgggcgtaggagtagtgcggcatgacgacggtgatgcgccccgcggaggcgccacgcgccgcgtcgcacatcaggagcagttccaccaggtgctcctggaccggcttgaccagcggctggatcaggaacacgtcccgttcacggcagttggcctccagctgcacctccaggcagtcgttggcgaaccggctgacccgggtggggctgagcggcacgcccaggtgcgcgcagacctccgccgccaggtcgggatgggcactgccgctgaacaccgcgatgtctcgcacgatccgctcctcgcatgatcattccggactgccgcgctcatgctactgacccgtgctactgactcggcggggcctctgccctccccatgatgccgggcaggttcaccccaggacgccgggcagggcgagccccgcgagcagcgcggtgcccaccagcagccaggccacgtagtcgccgacgtgcccggactgcaggcgtctgagcggcagcgcccagtccggtgcggccagcaggccggggcggcccacggccacggcggcgagcgccacggccagcagactcgacagcagatccagcaggacaccggccgccgtccagtgcacggaggagaacaccccccaggtcccggcctcgtcgacggcgtgccccaccgtgtcggcgaagccggggaccgcgccgacggcgagcgccgcgagcagcagtacggccgggaccgtccgcatggtgttcggcaccttgtcgaggcgctgcctggtctcgggttcctcctcggagccggacgtcttgtcctcgtcgcgctcctcgccgtcccgttcccgggggcgggggccgagcccgaggaagacccgggcggcgacgcgcagcaccgctcccccggtgagcgcggaggcggcgacgtagagcacggtgagcgggccgccgacggactcctcgctcaccgccttgcccaggcccgtgccgaacggcggcagcccggccagggccagggcacccacggcgaacatgaccccgacagcgcgcaggcgccgggcgcggccgtgcaggtagaactcgtcgacgctgccgtagcggtcgagcaggatgcccgcgcaggcgaacagggcggccttcacgccgccgtgggcgagaatgtacagggcggtcccgtcgtccgcgtcggccttcagcacgccgatgccgaccaggaacaggccggtgtgggcgatggtggagaaggccagcaggcgcttgatgtgccgctggtaccagcacatgaccgagccgacggccgcggtcagcacgccgagcaccaccagcgcgcgcgtcgcgtcgggcgcggggacgccgcccgggccggagaaggcggtgccgtacacgcgccacacgccgtagacgccgagttccaccatcacgcccgacagcagcatgcacacgggggtgggcgcgacggcgtgcgcgtcgggcagccagaactggaagggcacggcggcggccttgaccagcagcccggtcaggaacagcacgaaaccggccagggcgagcgcgtcggggccgtggtggcccgcggcggcgtccaggccgtggccgatcctcgccatggccagttcgccggtgcgggcgtagagcagggcgatgcccatgagcatgaagtacgcgccgagcgagttgaccagcgcgaagcccagcgcgccctgcacggccttcgcctcgtcgatgcggtacccggtcagcgcgtaggcgacgacacccatcagctcgaagaacacgaacgcgttgaacaggtcgccggcgatcgcgaacccgcacatgccgccctggaagagcagtatcagcgcggggaaggaaccggcgtggccgcgtggcggctcgtcgaagtagtgccaggagtacgccagcgcggcgagcgtgagcagggagaccagcgccgccatgccgaggctcgcgccgtccccgatgaccacgatgccgacgctctcgccgcccaccgggaaccagccgccgacccactcggtgaacggcggcgaggagttgacgagcagccagatcgccagcgcggcggtcgtggcgcaggccagggaggcgaaggcctcggcgatcaggcggggcaggtggcgcccggcggccacgaggagggccgcgcccagcagcgggacggcgggcagcagcggcagcagttggtgcatcagccgcgcagctccctcagctcgtcggggtcgaccgtgccgtgccgtttggagatctgcacggtcagcgcgagcagcagcgcggtcaccgtggcgccgacgacgatgtcggtcagggtgagcgcctgcacgacggggtcgacgacgggccgcgagccgggcttgatgtcggagaagacgggcgcggtcccgccgtcgcggtacccgacggccagcagcaggatgtacgtcgccgactggcacacggcgaggcagcccacggcgtggatcaggttccggctggtggccaggccgtagcagccggtcaggaacacgtaggcggcgatcaggtacggaaggacgtgcatgacgtcgctcacggcgcgctcactccccgctctcctcctcgatctcgacggcctggtccaggaagcgggcgagcagcacgacgacggcgcaggcgacttccatgccgatggccgcgttcagcagcgggacggtgccgccggaggacagcgtgttgaacgtgccgtacggcagcagcgtgttggcgaggaacgcggtgcccgccagcacgccggcgaagccgaggacgagataggcggaggccgacagcgcgtcgccgatctcgtacacgtcgacggggcggacgcgttccagggcggcgtagtcggcgcccaggtacatcaggtgcagggcggtcgccgccacgactccgccctggaagccgccgccggggctgagctggccgtgggcgacgacgtagaggccggtgaccagggcgacgggcaggacgatgagggcgtagcggcgtacgggggcggcgacctcggagggctggggcgggtcgcggtgttcgtcgcgggcctggcgcagcaggacgacacagccgaggacggccccgaagaggatcgtcatctcgcccatcgtgtcgaaggcgcgcaggtcgaagttgacggaggcgacggtgttggcggtgtgccgggcgagggcggcgcggacggctcggtcgccgtaggggtgccaggggccaccgaaggcggggagcctgaggcaggccgcgacgagcagcgcggcgagcgagccgccgccgaggaacaccagccacagccgggcgcgcggggtcactgcttgccgtccttgccgtgggcggagcgccgccggaccttgcggaccgagagcatgatgagcagcggggtgagggcggagcccacggc

SEQ ID NO: 1712 - DNA, 2240 bp, Unknown
  Kingdom: Bacteria, Phylum: Actinobacteria, Class: Actinobacteria, Order: Streptomycetales, Family: Streptomycetaceae, Genus: Streptomyces
ctgcgggcgctgctggaaccggcggcggccggggaattcgtacggcgctacggcaaggcgctcgacgcgccctgcggcgccctgacccacctgttccccgaaccggccgccctcgccggggccgagcccgccggccccctgggcgcgctggccgccgccctcgccgacggcaccgtacggctcgacccgggcgccgaccgcgacgaggcccaccgggcgctgctcgccctgcccggcctcgacgccgccacggccgccgccatccgcacccgcgccctcggcgaccccgacgtggcaccgcccggcgtggccgcccccgacagctggcgcccctggcgctcgtacgccctgcaccacctgcgtgcggcgaagcactcggagacccgatgaccaccgaaacgaccaccgagacgaccaccgaaacgaccaccaagacgaccctccagacgatgagtgaggtgactgcggagacgacgtactggacgcggtgcgaaagccccctcgggccgctgctcctcaccgccgacgccgacggcgtcctcacctccctgtccgtgcccggtcagaagggcggccgcacggtgggggaggactggcggcacgagacgggccccttccgcgcggccgaggagcagttgcgggcctacttcgccggtgaactcaaggagttcgacctgccgtcgcgcagccacggcaccgcgttccgggaacgggtgtgggcggccctcggcaccgttccgtacggcacgaccacgacgtacggcgagatcgcggcccggatcggggcctcgcgggccgcggtccgggccgtcggcggcgccatcggcgccaaccccctcctcgtactgcgcccctgccaccgggtgatcggcgcggacggctcgctcaccggctacgcgggcggtctggaacggaaggtacggctgctcgccctggagggcgtcccgctgccgtgaggccgcgcgcccctcagctgtcctccaggccccagctgtggatccgccggggatggatgcggatcacctcctcgctgaaccgcgggcccaacgcgtgcggcccggtgaggagttcggcctctccccggatgtcgacgcctctgacccgccacggatcgaggctgacgatgtcgtcgaccaccagggcgaccttcgggttctgccgcaggttgcgccatttcttcgtacggcccatcgcctgaccgccgatcaggagggtgccgtcgtcctgcgggaagaagccgacggggttggcctgcggctgcccgtgcggatcgacggtggccagccgccccagccgctgcgtcctcaggtaggcgcgttccgcctcggtgaattcggtcatggcagcagccaaccactccgccccctccgtcttccgctcccctccgtcttccacccccttccgtcttcctccgtcttcctccgtcttccctccgttccggtcccggccgggctcagccgccgtgccgttcccgggccacccagccgcgttcgtaggcgtgccagcccagttgtagccgggtggtcacaccggtcagctccatcagccgcttcacccggcgctgcacggtccgcagacccaggtcgagttgcttggccacgctcgcgtcggtcaggccggccagcagcagggacagcacctcgaggtcggtggtgtccggtccgtccgggctctgctcggtgacgccggacgcgcccaggcgcagcggcagcgcaccctgccacaccgactcgaacaggcccgacagcagctccagcaggccgctggagtgcacgaccagcgcggcgggctccgccaagcgggacgtgagcggcaccatggccagtgcccggtccgcgatcaccagtttggtcggcacctcgtcgaccacgcgcacctgttcgtcgcggcccagcgcggcggccagctccgtgatgccgtgcggcaggtccagcaccgcgcgttcgaccaccacccggtaccgcaccccgcggccggccgcctgctcctcggcgtcgttctccatcccggagacgaccgtcggactgcccgtgaccagcgcgcacacctcgtcgaccgcgcccagctgcaactgcacgaagcgctgcgtgaccgccggggccccggtgaccacctcgatcagatcgtgcaccgacggctcggccgccgccgcccggtactcctccgagagcagcgcggcggccagctccgccttctccagttcgtgccgctgctgggtgagcagcggcacgaactggaga

SEQ ID NO: 1713 - DNA, 1061 bp, Unknown
  Kingdom: Bacteria, Phylum: Actinobacteria, Class: Actinobacteria, Order: Streptomycetales, Family: Streptomycetaceae, Genus: Streptomyces
gccgccgagccgggaggcggtgtccgcgtggcggacggcgtcctggagtctgcgggcggcctggacgagcagttcgtccccggcctggtgcccgatggtgtcgttgacggccttgaagccgtcgaggtcgatgaagaggacggcggtgccgcggtcggtggagcggcgccctgacagcgcctgctgcacgcgcttggtgaacagcgagcggttgggcaggtcggtgagcgggtcgtgctcggcgttgtgctggagctgtgcctgcaggcgcacgcgctcggtgacgtcccggctgttgaagatgaggccgccgtggtggcggttgatggtcgactccacgttgagccagcctcccccactctcggcttctcccccagcctccggccgggaggtgcccccagagcgggaggtgcccccacccccggaccggaagcggcactcgatgcgcgtagtgggttcttccagcgggctggcggcgaggaaccggcgcacctcgtgcaccactcagcccaggtcctccgggtggatgagaccggccagttcggtgccgacgagttcttcggcgggccggccgtacaccccggcggcggcaggggagacgtacctcaggatgccgttgggcgcggcgatcatgatgacgtcgctggagccctgcaccagggagcggaagtggttctccttctgggcgagttcctgggtgagggtgatgttgtcgagcagcatgatgccctggcgcacgacgagggcgagcaccacggcaccggcggtgatcagcaccacccggtcgacgctgtggccgttgagcacgttgtacaggactcccagcgtgcacacggcggcggcgaggtagggcgtgagggcggcgagggaaccggcgatgggccgggcggcgggataccgctcgtggtcggcctccggtgcggtgggcgggcggacgtgtccgctgcgcggggcctggcgctggccgggcacccgctcgtgcggcacgcgcgcgtgcgcggcgcccgcgtgcccgtcggtcgtgtgggcgccgcctgccggggcgtgggctgcgtgggcgt

SEQ ID NO: 1714 - DNA, 1133 bp, Unknown
  Kingdom: Bacteria, Phylum: Actinobacteria, Class: Actinobacteria, Order: Streptomycetales, Family: Streptomycetaceae, Genus: Streptomyces
cccgggccggcgggccccgccacggcggggcccgccggcccgggagcctcagctcaccacgtggcacgcacctggcggatgatccgccggcgcaaccgcaccctgcggctgccgtcccgcagcaggctcaggcggtacaactcccagtgtccgtactcggcgtggtccgtcagcagccgtgtcgtctccttgcgggagaccccgcgcgggacgaacacgtcgacaaattcgtattccggcatcgcatctattgtgcgggctggggcccggtacggatagcgtctgcactatgtctgatgctgcgcagcccaccgctgccgaggtacgcgccgccgccgaggcggtcaagaccgcgctcgaccgtcacctggcggcggtcgaacgcaggtcgggggacgacgacccggccgtctacgaggcgttcaaccagctggccgcggccgcggaggcgtacgacgagctgctctacgaccactacgacgaggtcacgcccttcgagatccccggtgacgacgcgctgccgccgtacacgggtcccgaggagccgaacgcgatcagtgtgctgatccgccgcgactacgccgtggccgagccgcagcggctgctggcccaggccagccgggtggaggccgcggacgcccagaccggcacgggcgtcggcgcgggcacccccgacacggtgcacggggcgctcggtgtgctgttcggtgagttcgaaccggacgagatcgcctcccggcacaaggagttcggcctggaggagggcgactccaccctgtgggtcacggcagcggacgaacccgccgacccgggcgactggctcgaagcgccgttcgagcaggccgacccggagcgcgtggtctgccgcttcgacgtcagcgcggtcttcgacgacgagctggacgaggacgacgaggacctggcggacgaggaggacgccgacgccgacgacctcgaatccgacctcgacgacgacgacctcggctccggcctcgacgagcaggacgacgaggacctggagccactggacgcgacggaccgctgagcccggccgttccgcccggcgccggcgctgggctcggggccaaggcccgggccagatctgggcgatctggcacgtgtcccgccctgcc

SEQ ID NO: 1715 - DNA, 1587 bp, Unknown
  Kingdom: Bacteria, Phylum: Actinobacteria, Class: Actinobacteria, Order: Streptomycetales, Family: Streptomycetaceae, Genus: Streptomyces
tactcgccggtcagcgcggcccccgagacggccgcgctgaccggcgagtacacgatcgacccggcccacaccacgctcggcttcgtcgcacggcacgccatggtcaccaacgtcaagggctccttcacccagttcacgggctccctgcacctggacggcaccgacccggccaagtccacggccacgctcgacatcgcgatggacagcatcgacaccggcaacgcggaccgcgacgggcacctgaagagcgcggacttcttcaagaccgacgagttcccgacgatgaccttccgctccaccgcggccgagtccctcggcggcgacgactaccgcatcaccggcgacctctccatcctcggcgtcaccaagccgatcagcatcgacctggagttcaacggcgccgccaaggaccccttcggcaacgagcgcgtgggcttcgagggcaaggccgagatcctgcgctccgagtggggcctgacctggaacgcggcgctggagacgggcggcgtcctggtctccgacaagatcaagctgaacttcgacatctcggcgatcaagcagggctgagcgctcgcggggaactttcttccggggaactgttatccggttccccgctcccggtctcccaggcatcggacatcatcgaccgacgtcgaaggacagggaagttctcctatgagcacacagcacacggtggacccggcggccctggtgaccgccgcccgtgcgggcgatccggcggctcaggacgccctggtcggcgcgtatctgccgctggtctacaacatcgtgggccgtgcgctgaacggctccgtggacgtcgacgacgtcgtgcaggacaccatgctgcgcgccctcgacgggctggacgggctgcgtgaccccgcgagcttccggtcctggctggtggcgatcgcgatgaaccgggtccgcgcgcactggcaggaccggcaggccgccccgcacgccgtggaggacgcgggcgaggtcgccgatcccggcggtgacttcgtggacctgaccatggtccgcctgcaactgtccggccagcggcaggagacggcgcgggccacccgctggctggagcccgacgaccgggcgctgctgtcgctgtggtggctggagtgcgccggtgagctgacccgcgcggaggtcgccgcggcgctggggctgtcgccgcagcacacggcggtccgcgtccagcggatgaaggcgcaactggaggccgcgcgagtggtcgtacgggcgctcgactcccggccgcgctgcacggagctgagcggcgtcctggcggcgggctgggacggccacccgtccgcgctgtggcgcaagcgcatagcccggcacgcgcgggcgtgcgtccactgcgcgggcctgtggagcggcctgatgcccgcggaagggctgctggccgggctcgcgctggtcccggtgccggtcgtgctgctgtcacacatacgccccggcttcgacggtgcgcccgtcggccacccgtccacgtccgcgtccggtccgacagcgtcctccgcatccgctcggtccggtggccgggccgccgcacgcaacgcggcccgccgtcgtcgcggt

SEQ ID NO: 1716 - DNA, 1615 bp, Unknown
  Kingdom: Bacteria, Phylum: Actinobacteria, Class: Actinobacteria, Order: Streptomycetales, Family: Streptomycetaceae, Genus: Streptomyces
gtgcgccccgggtcgaggccggccgggtcgtgggcgaccaggagttctccgtcgacgaggtagatgtcggcctcgacccggggcgcaccctcgaatccctctacctcgacccgctggccgcccgcgtcagcgccaaccgcggatcggtctaccagggccggcgcagaccactgcagctgctgatcgacatcaagaccgagggcgccgcaacctacctcgaactcgaccgtcacctgacgcgctaccggcacctgttcaccacgtacgcgcacgggcgcgtccgtcccggccccgtcaccgccgtgatctccggcgaccgcgcggcccgcgcgcccatggaggcacagacggtacgccgggccttctacgacggccggctcaccgatctcggcaccccggctccggcgtccttcgtcccgctgatcagcgacaactggacgtcgaccttcacctggctcggcgtcggccccttcccggagaccgagcggcgcacgctgcgcggcatcgtcggtcaggcgcacgcccacgggcagagggtgcggttctgggccactccggacgaggccgggccggcccgcgacgcgctctggggcgaactgctctgcgcaggtgtcgaccacctcaacaccgacgacctggccggcctcgaagccttcctcgacgcccgcgagggccgcgggggcgaggcgtgagccgaccgtagcccaggcacggaccgttccgtcgcgaaaccacacgttcggcggacacgtcagccgcccggaccaaccctccgctacgccacacttgcggccgaaagccgcgaagtgggcgtggcggaggaggttgacgatggccatttccatctctgtggtgctgttgctcgcgatcctggcgatcatcttcgtgcgcaacggcgccctgaagttctcgcacgccctcgtctgcggcctgctcggcttcttcctggccggctccagcatggcccccaccatccacgagggcctggccgccaccgccgagatcgtcagcggcttgcggccctgagccgtttctccgtcgaagcgtcgaagcgtcgaagcgtcgaggcgtcgaggcgttggtgcgtcgaggccgcgcgcggacgcagcgttgggcccgttcccggtgaggcggacgggcctcacgcgccggggaacaccccgatcccgttcgcgaccgcccgttcggcgccaccgctcggatggttgcgcacactgaccttcgtcccgccgggcttccgggcgaccagcgtgctggacccgccgccgtccaggttgaagccctccgtcgtacccaggccgcgcagcgtggcggccacctcggcgacggtcatcccactgcggtactcgggcgcgccgtccagcgccaggagcagcagcctgtgcccgccgtccgcgatccccaccgccgtccgcacggccgacgtcgtgctgtcgagacccggcagcgcggcaccccggcgcagcaccggaaaaccgccgaccgcgaaggtgtacgccatcccggaggccgccgtcaggcggtgctcgacgcccaccgggtcgcccttggacagcttgcgcaggtgctgcgcccccgcctccctgcccaccagcaccgtggtgcccgcgggcac

SEQ ID NO: 1717 - DNA, 1707 bp, Unknown
  Kingdom: Bacteria, Phylum: Actinobacteria, Class: Actinobacteria, Order: Streptomycetales, Family: Streptomycetaceae, Genus: Streptomyces
cccactccgccgtccgccgcctgttcggcggcggacggcggagtgggaggggtggtggctcccggaacaccggtgtcatcggcccgggggtgatggtgcacgggcagcttgtcgccgggccctgcggactcggcctgcggtgccggagccggcgccggcggcgcccccagcagtgcccgcccgtgcgcggacagcgtccaccgggcgaggcgttcgcgcagatcgtggtcgtggtcgcgctgcgccccgcgcagcggacgctcccagcgcagccgggccaggaccgactcggcgaccggagcggcgccctccggcagaccggccagcagggacagcacgcggcgccgtacctccggggcggccgagcggtcgaggcccgggccgagcgcggacagcgtgcggtccttcgcgtcccgcccgccgaccacacccggcgtccgcgtcgccgacagccacgccccggccaggtgcgcccagcggtcggccgcgggccgctccagccactcgtcgtacgcgggcgtcgccgcgtaccgctcctcgacgtcaccgtcggaggccagcagcccggccgcgtaggcgagttcggcccagaaggcggcgaccggttcggacacgtccagggcgacggcggtgcgcttgaggtcgcgcacgctcaggccgcccgcgcgcagcacgttcggaccgccctcgtcccattccttcagcagttcctcgacggtggccagcgcggtgtacgcctgcccggccgccgtcgcgtccacgatctgcgggcggtgcgtggccgcagccgtcacggcgggcggcaccggctcgggcgcgcggtgcgcacggcccgcccgcaggtgcagcgccacctcgcggggcaggacgaccgtgccgggcgccgtgggcagcagcagcccgcggtccatcagcagccgcagccggggcgcgggatcggcggtgacctgcccgtacggcggtccccacacgagccggtcgaggacgtcgagggagtcgtccggtacgtcggcgagcagcgcggccatccgcttccggtcggtgaacagcgcggtgagcgaggccaccgcggagaccgagtcatgggtggagggcagcccggcggcggtcacgatctcctggatccggccgggcgacatgcccgcggtggcctcctgcaccgtcgggccgaggccggtgggcgagggatgctgcgcggagggggcgaggagttcccgggcggtgcgcaccaggcgcagccggtcgtcgtcaccccagaccagtgcctgctcgcgcagcgtgccgagtgcgcggggcagcgcggcggcgacggcggtgtccccctcgtcgccggccgtcaggctgagcagttcgccgtacgtcgccgggtcggccgccacggccagcgcctccgccgtctggagggcgaaccggtccagccgctccagggcccgcaccaccgaggcacgggtgccggcgcgggtggcgagctgggtgaggtcggtcgggaccggcgtgatgaggtccggacggctgcgcaggagcgcgcgcagggaggcgtcgtcccgcgcgcgaagcgcctccgcgagcgagcggggggctgccgccggtttctcatcgctgctcatccgacccacggtagcgggtgcctacgacagcacggcaggcgtcggcgcctgccggacggcatccgtccgccgccgcccgcagccgtccgccgcgtgggcg

SEQ ID NO: 1718 - DNA, 3003 bp, Unknown
  Kingdom: Bacteria, Phylum: Actinobacteria, Class: Actinobacteria, Order: Streptomycetales, Family: Streptomycetaceae, Genus: Streptomyces
actcctctgcggcttccgggcgccacggcgccggaccgcgttcggcgagttcggcccggaagccgcagaggagttcgcccggctcaccggggtcaccccgaccatggcccggctggtggcctccggactgcccatgatcgacgacgagcgcgagcccgtacccacggccaccttgaaggccatcggcgtgaaggcggccgacgcgcagatcgccaagggcctcctgaaggccgtcgacggcgacgcgcgccgggcggtcgtggcggcgctcctgcccgccgacccctcccggctgtggacgcacggccccgacacggccgccgcggccgaggtctggaacgagcgggtgggccggcgcagccccctgcccgaggacgtactccacgacacggtccgcaccctgtccccctcgtggtgggagccgtacgaggcgctgcacggcttcctccacccggagcgcgaaccgaagctgacccgcgacctgcagtgggccatgaccggttacggcgctccgtcggcccagggccgcggtttcgactccgacgcgctcaagggcgcggtggccctggccgcctggctcgcccaccgcctcccctccggtgacccgctgcgcgccaccctccccggggtactggccgcggtacgcgagcgactggcccacccgggcctgctcatccggatgcacaggtggaacggcctggacgacctccgccgcaacctcggcgagcccacggagaccggcgaggacttcgaacgctacggcgcggtcgtcctgagcacccggatcctgaacacggggagccaggcggtgcaccccgccgtccgtccggtgctgctcgacgagtccggcggcgacccgcacctgccgctcctgttccccgaggagggcccgaccgccgaggagatggagcgcgcacaggcgcagctggagcgcgagtggctggaccggctcggcacggtcgcgggccgcgccgacgaactgtgccgctacgccgtcctgttcggcgacccgcagctcgccctgaccgcggtgaagcgcgtcctggaggtgacgcccgaggaggtccaggaggtcgccaaggcccggctgcggcccgacaaccgcgcggtcctcgtctacgagccgaccgcccccgaggcagcggccaccgacgcacaggagcaggcaccggacgcggacgccgcggccggcgacgacaccgaggagacggcgaagtgaccgagctggccaccatggacttccacccccgcccccaggcgggcgaggcccggccgtgggcgttcccggcccccgagcgcggcaccctggacaacggcctgacggtgctgcgctgccaccgtcccggccagcaggtcgtcgccgtggaggtgctcctcgacgcgcccctggacgccgagccggccggcctggacggcgtcgccacgatcatggcgcgggccttctccgagggcaccgacaagcactccgccgaggagttcgccgccgaactggagcgcgcgggcgccaccttggacacgcacgccgaccaccccggcgtacggctcagcctggaggtccccgcctcccgcctggccaaggggctcggactgctctccgacgcgctcagggcgcccgcgttcgccgagtccgaggtcgagcggctggtgcgcaaccggctcgacgagatcccgcacgagctggccaacccctcgcgccgcgccgccaaggagctctccaaggagctgttcccggccaccgcgcgcatgtcccgcccccgccagggcacggaggagaccgtcggcgccgtcgacgcgtccgccgtccgcgccttctacgaccggcacgtacggcccgccacggccaccgccgtggtcgtcggcgacctcaccggcatcgacctcgacgagctgctcggcgagaccctgggcgcctggaccggctcgccggccaagccccggcccgtgccgccggtcaccgccgacgacactggccgcgtggtgatcgtggaccggcccggcgccgtccagacgcagttgctcatgggccgcatcggccccgaccggcacgaccgcgtgtggcccgcacaggtgctcggcacctactgcctgggcggcaccctcacctcacgcctggaccgcgtcctgcgcgaggagaagggttacacctacggtgtgcgctcgttcggtcaggtgctgcgctccgcgcccgacggcaccggcgcggcgatgctcgcgatcagcggctcggtcgacacgccgaacaccggcccggcgctggacgacctgttcacggtgttgcgcaagctcgccgccgagggcctcaccgaggccgagcgggacgtcgccgtgcagaacctcgtcggcgtggcgccgctcaagtacgagacggccgccgcggtggcgagcacgctggccgaccaggtcgagcagcagctgcccgacgactaccaggcgacgctctatcagcagctcgcgcagaccggcacggtggaggccaccgcggccgtcgtcaacgccttcccggtggaccggctggtgacggtgctcgtcggtgacgcggcgcagatcaaggagcccgtcgaggcactcggcatcggccccgtcaccgtcgtcgccgcggagtagccgagcagccgagcggcggagtggcccggcagtggaggagccgagtcgcggacgccgtgcggcacgcgcgcgtggggccctggtgaccgaagcgtcatcagggctccctgatgtccggattgaggcggaggctgcctgtctgccctgtggcctgcgctacaaaaacgcggatccgtttgggaatggaaagcgagcccgtctagcgtcggtccggctgttcgtcaggcagtgcgccgcacccgcggcaccggacagtcatcgccgagtccccgtacggcgcgagccaggggagccggggacccactcagtccctggggtgaatcgggcgtcgcgcaccgcgcgcggggcccgtaggagaccttcctgctccgaacccgtcagctaacccggtaggcgaga

SEQ ID NO: 1719 - DNA, 552 bp, Unknown
  Kingdom: Bacteria, Phylum: Actinobacteria, Class: Actinobacteria, Order: Streptomycetales, Family: Streptomycetaceae, Genus: Streptomyces
cgcggtgacagcggagacgatcgcctgctcacggctggcgaagtagttgttgtaggtacgcggcgagaccccggccgcctcggcgatgtcctcgacccgcacctggtccggaccgcgctccacggccaggcggagggccgcttcgcgcagcgcctcgcgcgtggcctgcttcttccgctcccgcagccctggtggtcgaggtgtcgtcacggcgccagcgttccacacggcagacgcaccagtaaagttgcgtgcacgcaaacttgcgtgcacgcacttttcctgccagcctcgtcccggccgggaagtcggcaggaccgacggacgggaccggcggacgcgaccgacaggaaggacggcttgccatgcgcgcaagaggaatgacctacgacaccggattcgtcgtacacgggcagatgtcccgcgagcacttcgaccccgcggtggtccggcgcgagctcgccgtcatccgcgacgacctgcactgcaacgccgtccagatcatcggcggcgacccggaccgcctggaactggccgccggtgccgccgccg

SEQ ID NO: 1720 - DNA, 4850 bp, Unknown
  Kingdom: Bacteria, Phylum: Actinobacteria, Class: Actinobacteria, Order: Streptomycetales, Family: Streptomycetaceae, Genus: Streptomyces
cgtccgccgaccgccggtccgaggagttccgcccatgcgccgtaccgtcgtcccccgcgccctgtccgccgccgccctggccggcctcatagcgggctccgccgcgtcggctgtcgcggcggccccggcgacggaccccgcggcgcacacgaacgcgccgggaggcggccgcgtacaggtccaccggaccggcggtcggcggacggcacatcgctcgtgccttccccgccatcacagccccgcgcgtcgccggccgcgcgcggccgagccccattcgcgggacaccggcggcctatcgggtgacgccgctggccaccggtacccctgcccggggcctcgccggcgcgtggtccggccgggcccgtcatccgggccggaaaggccgtgtcggttccgtgtgcacgggtacgcggcagccacccccgacgatctggagggagacatgcagcgaggcagtgaccggctgagtgtccaccgtgacgacgagatgaagcacgagctgcagggactgctccggtccggccatcccacgcggagcgaggagtggcacgacccggagccgaccgccgaggacgaccccgaggtctggggcggaccggtggcaccgggcggttcccgggcttccctggagaccgtgcgtcttgaactggccaggatcctcggccgcagcgccttcccggcgggcccggccgaactggcccgcgtgttgcgccgcaagaacgcgcccgacgcgctgatcgacgcgctggagcggctgccgcgcaaggcgcagtacgccaacgtccaggaactggccaaggaactgacccacaccgggccgtgaacggacgtacgggagaggagatcgccaccgaccgggatccgccctcgaccgcgatccgccctcccgacgggcgacgaaaggactccgaaccatcatgcgcatcgcttttctgaccgcgcccgagggcgtcgagcaggtagagctgaccgatccctggaaggcggcgaaggacgccgggcacgagcccgtgctggtgtccacggcgccgggtgagatccaggcgttcgaccatctggacaaggcggacacgttcccggtcgacgaggtcgtcggcgacacctcggccgactccttcggcgcgctggtcctgccgggcggcgtggccaaccccgacttcctgcgcacggacgaggcggccgtggcgttcgtgaagggcttcttcgaacagggccgcccggtcgcggcgatctgtcacgcgccgtggacgctggtcgaggccgatgtcgtacgcggccgcacgctgacgtcctggccgagcctgcggaccgacatccgcaacgcgggcggcacctgggtcgacgagcaggtgaaggtctgcgagaacggcccgaacgcgctggtcaccagtcgcaagccggacgacctgaaggcgttctgcgagacgttcctggaggtgttcggccggcggaccggctgaccgcccgcacaacggcaggaaacggccgagaagaaagaagacgggaagacaagtgcccgtcggcccaccgcaggaagcgggccgacgggcacgactccgaccgggcacggtacaacggagagcgcgccctcagcggtaccgcgtagcgccctcagcggtcccgcgtagccggccctccgccgcaccgctccctggcgccctccctggtgcggcccgcggccacggggcggcgcggattgcggcgcaggtactcgccctccagttgcgccatgcgctcgttgtggatgcgcagggcgtcgttggagccgtacagcagcgtgtcgtggcgtgtgcggtggatggtctccagctccttcatgagctgttggtcgtccaggcggcccgggtcgactccggtcatggtggtgccccgctcgtcgtgttcgtccatgccctccgggtacccgcccggcgtctactgccaccggacggcacccgggagagagccatggatctcgcctttctgcatccactgtacgaacacccgggcccgtgggcctctgtgtacgtcgacacctcccggcacgcggaggacaccgcccacgagctgcacctgacggctcaggcgatggcgcgggagctggcgcagcgcggcgccgacgaggcgacctgccgcgccgtcgaggcggcggtcgaggagctgcgccactcgcccgacccgcacggtcgggccttcttcgcgcgggccggggcggtggtgctcgacccgcgcctggcgcgtccgccgctgggcggcagccgggcggagtggggtccgctgccgcgggtggggccgctgctcgacctggcgggcgaggatccggtcgcgatcgtggcgtacgtcgaccgcaagggggccgacttcgagctgcgcagcgcgctgggcaggcgggaggccggcacggtggtcggccagcagtggccggtccaccgcaccagcagtgtcgactggtcggagcggcacttccagctgaaggtggagaacacctgggagcacaatgccgccgagatcgccgacgcgctcagcgtctgccaggaggagacccgggccgatctgctgatcatggtgggtgagcagcgcgaacggcacgaggtgcgcgggcggctgcccaagcggttgcacgaccgcgtggtggaggcgacgcacggcttcggcagcaggctgctggacgaggacgtggagcagttgcgcgccgagcacgtgcgggaccggatcgacggcgaactggaccggttccgggccgcccgcgcacccgacgacgagggccgctccggcgcggtggagggtgtgcccgcgctggtggcggcggcccgcgaacaccgtcttgaggagctgctgatccgccccgaggcggcggacgcccaccgcgaggtgtggatcggcggggacccggaccagctggccgcgcgccgtacggagctgaaggcgctcggcgagcagcacgcgtggtcgacgcgcgccgacgacgccctgatccgctccgcggtgatgacggacgccgccgccctgtccctggccccggtgacgcctctgccggaggacgacgcgccgaccggcggcctgggcgcgatcctgcgctggcggtgagcgcgtcgtccgagcgccctcgttaccgcgcccgctccacccggcgttcgtcccagaccggctcggaggtctcgcggacgcggccgtcgctgccgaagaccaggtagcggtcgaacgagcgggcgaaccaacggtcgtgggtgacggcgaggacggtgccctcgtaggcttcgaggccttcctggagggcttccgcggactccaggtcgaggttgtcggtgggctcgtccaggagcagcgcggtggcgcccgccagttcgaggaggaggatctggaagcgggcctgctggccgccggagagccggtcgaaggcctgttcggcctgcccggtcagctcgtagcggcgcagccgggacatcgcggcgccccggtcctgtgcgtgctccttccacaggatgtccaggagggtgcggccctccagttcggggtgggcgtgggtctgggcgaagtggccggggaccacgcgggcgccgagcttccacgcaccggtgtgcgcgacgtcgccgccggccagcaggcgcaggaagtgcgacttgccggagccgttggagccgagcacggcgacccgttcgccgtagaagacctccaggtcgaacggtttcatcaggccggtcagttccaggccctggcaggtgacggcccgcacgccggtgcggccgcccttcagccgcatccggatgtcctgctcgcggggcggctcgggcggcggtcccgcctcctcgaacttgcgcagccgggtctgggcggcccggtagcgggaggccaggtccgcgctgttctcggcggcctggcggagggtgaggacgagcttcttgagctgggcgtgcttctcgtcccagcgtctgcgcagttcctcgaagcgcgcgaagcgctcgcgccgggcctcgtggtaggtggcgaagccgccgccgtgcacccaggcgtcggcgccggccgggccgggttcgacggagacgatcttctcggcggcgcgggcgagcagttcgcggtcgtgggagacgaacaggacggtcttacgggtctcccgcagccgctcctccagccagcgcttgcccggcacgtccaggtagttgtcgggctcgtccagcagcagcacctcgtcggtgccgcgcagcagcgcctccaggaccagccgtttctgctcgccgcccgacagggtgcgcacctgccgccactgcgccttctcgtacggcacgccgagcgcggcggtcgtgcacatgtcccacagtgtctcggcctcgtagccgcgggcctcggcccagtcggcgagcgcctgggcgtagcgcagctgggcggcctcgtcgtcgacggtcatgagggcgtgctcggccgcgtcgacggcgcgcgcggcctgccggatgcgcggcggggcgaccgagacgagcaggtcgcgtacggtcgtctcgtcccgtacggagcccacgaactgccgcatcacgccgaggccgccgctgacggtgacggtgccgccgtgcggtttcagctcgccggagatcaggcgcagcagggtcgtcttgcccgcgccattgggcccgacgagggccaccgcggcgccctcccccacccggaaggacacatcgcctagcagcgccctcccgtcgggcaggtagtactccaggtgcgcggcttccaggtgtcccatgatcccgcattctgctggcggcggtgcgagcgcggcaaacccttatccggccgcaccccggccccccgcctcacaggcggtcgctcaccgctcgccgacgggagagccgatcgacgcgggacccgtcggcgagcggtgagcg

SEQ ID NO: 1721 - DNA, 5212 bp, Unknown
  Kingdom: Bacteria, Phylum: Actinobacteria, Class: Actinobacteria, Order: Streptomycetales, Family: Streptomycetaceae, Genus: Streptomyces
ggccacgagaaggaggcgggcgcgctcctgcggggcgtgctggcggcagcccaggcattcgggcaccggttgcccgagatgttcgccggggagcagcgcgcggacggcagtgcacctgtgccgcacccggcggcctgccgtccctcggccacggcggccgccgccacggtcctgctgctgacatcgctcgccggtattcgtcccgacgcccccgccgggacggtcaccctgcggccggtgcgggcagccccgctcggggagatcggcttcacggggttgcgggtcgccggcgcgcccttctccgtgcgggtcagccgactcggcctcgctctggtggaggaggcggccgacggactgcaactcggggcctgacctcgtacgacaccgggccgccatctgacggccgcagccggggaaggcgcgtggaccggtcatcgctacggccgacgaagggagtgtttatcgtcaggcagacgactatgatcgccgcatgccctacgacccgtcagcctttctgcccttcgccgtcaccgtggacctggtcgtgctgaccgtgcgccaccactcgctgtgcgcgctggcggtgcgcaggggagagccgccgttccagggacggtgggcgcttcccgggggcttcgtgcgggcggacgaggacctggcgcaggcggcggcacgcgaactggaagaggaagcggggctgcgcgcccacgaccccgccgcacccgtccaggacaacggcgctcacctggagcagctcgcgacctacggcgaccccgagcgtgatccgaggatgcgcgtcgtcagcgtcgctcacctcgccctggctccggatctgcccgcgccccgggccggcggtgacgccggggacgcgcggtgggcgcctgtggaggagctgctgcagcagggtggatacggccgcgacggtgaaccggtggccccgctcgccttcgatcacgcccagatcctggccgacggcgtggagcgggctcgttccaagatcgagtactcgtcgctggcgaccgccttctgcccgcccgaattcaccgtcggtgaactgcgccgcgtctacgaggcggtgtggggggtggcgctcgatccgcgcaatttccaccgcaaggtgacgggaacgctgggctttctcgttccgacaggaggcacgaccacgcggcagggaggacggccggcgcagctcttccgcgccggtggcgccacgttgctcaacccgcccatgctgcgtccggaggtctgattcccctcactgtctgtgcggcgcgaaggcgccgttcccgcggaccggggaaccagggggtgagcgggggcggtagcgcacgcggtacgcgcgtcgcgaacccgagaaaccgaaaaaaaggacataacgcgctatcttgctgcgggtgatccaggccttcggactgaccagcgactcccgcaagagccttccgcccgccgtcgacgacgtctccctcgaagcgcgcgcggggcgcgtcaccgcgctcctggggaccgcgggcgcaggcaagacgacggcactcagactcatgctcgaactccaacagggccgaggcatcacctacttcaaggggcgccctctgcaccgcatcgcccacccggcacgcgaggtcggtgtcctcctgggtgatgtccccggtcatccctcccgtaccgtccgaggtcacctgcgcatgctgtgcgcggcggcgggacttccggcccggcgggccgacgaggttctcgaagccgtcggactcgtcagcttccgggaggaacgcctgggcacgctgtcccgcggcatggaccgcagactgggcctggcctgcgtcctgctgcccgatccgcacacgctggtcctcgacagtcccaccgacggactctccgcgcgggagggccgttggctgcacggcatgctgcgggcccatgcggaccggggcggcacggttctgttcgccacggccgaccccaaggaggccgcgcgcacggccgaccgcgtcgtcacgctggagcgtggcaccgtcgtggccgaccaggaggccgaggagttcggacgccaccgactgcgcccgcgtgtcgcggtccgcacgccgcatgccgcccgcctcgcggctctgctggccaaggaggcccgcaccgctcaccgctccgtcgaggtcgtgcgtgagaagggcaatcgtctgtccgtctacggcagtacatgtgccgacgtcggtgagaccgcgttccgccacggcattctcgtccaccaactggccgacgagatcggagacatgggagcaggggcgggagcgggagaagagcagtcggtcaccggtcaggccgtcaccgaagagccccgcagcaccgcggcggccaccacgacggcggaccggcgtgcgacgcctgtcaccgcctccgctgggcgcgccgcccgcgaagcggccgacgcggcgggcagcggtgtgcgcgccacggcggacctcggcaccgtgttcgccgcagtcgcaccgagcggcgaatccggctccgcggccggtgaggaagcgaccgccgcgggtgcccgtgacaccggcctccaggacggatccgaggaacgaggcgtgtccgcggggcgcggagcggcatccggcaccggcacggtgcacgcggtagacaccgtggagaccgtggacccggcggacacagcgaacatggcggtcacggcgtccggaccgtccgaggtcctggccgtggccgcgcgcgccgacagcccgacgctcaccgcgcactccggcactgcgcactccggcactgcgcactccggcaccgcgcactccggcaccgcgcactccggcgctgcgcacgccggcaccgcgcacgccggcggcgcgccctcggcggcgcgtgcgcacggcggctcggcggtgcgggcacaagcccgctccgacaccggggcccccgccgccggccgcgagggtcccgccccggcgcctggcaacggttgtggcaacgcatccggagccgcccatccacctgagaccccgtccgcagcggtgcgccccggcagcgagccccgcacccgcttccagagcggcgggcacgcgccggaggacgccccgcacgagcccggccgaccgaagccccaggaccgcgtccctccggtcggcgcgcggccctcggcacggggccgcccgactcctccccgggaaggggcgcagcgcccccgccccgaagaagcggggccgccctcctcggcgaccgcgggttccaccggccgtgccacggcggagtcgtccggcacgcccactgcggctgcacagccctcgatccccactccgcggccggcggaggccgtcacgctggacccttcgtcgccccttcctcctcccatctccgtctgtcccggcaccggccccctgcggcccgtgcgctatgaactgcgccgcgccctggggatcggcaccgggttcgtcatctgcgccgccgttctcgtcgtctccgtgctgacggcgctggtcgtgggccggatcggccacacccctcagcctcggctgctggcggcatggccgcagcagttcccgctgccgccggccgcactcggcgcgggtctgatcggtgcgctctccttcggcgacgagttccgccaccccgcgttggcggcggaccggggcaccgtcccccgccgcctcggactgctcgccgcgaagctcctcgtcaccaccgccaccgcgttgtcgctggccttcctcacggtcggctgcgatgccgaagtgctctatgtcgtatacggacgggaactcacgcaggttcccggcgactggctctcgcccactgtgagttgggccggcctcgtggtcggctgcggctgggcaggagtgctggccgcggggctgttccggtccaccaccgccggtctcgcggcggtcgtcgccgtaccggtcgccgtcgcacccctcgtgcgccaggcgctcggaggggcggactgggacgcggccggactgcccgcacggttgcgcgaagcgttcctgctgccgtggcccttcggaggtgatcgctacctcgccgccgcggcccgcgtgatcgctcaacccgtcggtggcgcccttgcgttgtcgctggccacgctggtgggcgggtacctgctgacgactctgcgcagcagggttcgatgacaaccgttcgtactctttcagtcgcacaccgtgcgcaattcctcgcggaaagcacaattctttccgataaggcgtcaattgcgacggagggagcgatcaccctttcgtgtgcttttcaccaaagacctcaagggagttgaaggcagcgccgacaaaggatccgtgagtacccttgcgcacaccatgatgaccgccgcccgctcctcagactccggtcttgccggcccgggcggactcgaccgctacccctatgccgaggcgcctgtccccgaccgcgtcggaagccccgcctgggagagcgcggaacccgagctgggacgcgtcggccggcgagccgcgggcagccgcggccgcggactgcacggccaactcgtccagcagctcggacagatgatcgtctccggggacctgggagccgaccgcccgctggtgcccgaagagatcggccagcgcttcgaggtctcccgcaccgtcgtccgtgagtcgcttcgtgtcctggaggccaagggtctggtcagtgcgcgaccgaacgtcggcacgcgtgtgcgtccggtcagcgactggaatctccttgatccggacatcatcgagtggcgggccttcgggccgcagcgcgacgatcagcgccgggagctgagcgagctgcgctggacgatcgagccgctcgccgcacggctggcggcgggccacgggcgcgaggacgtccagcagcgtctctccgacatggtcgagatcatgggccacgccctggctcagggtgacgctctgaccttctcccgcgcggacacggagttccactcgctgctcatccaggtcgcgggcaaccggatgctcgaacacctctccgggatcgtctcggccgccctccaggtgtcgggcggcccggtcacgggctgtgagcggccgaacgaggcgtccgtggcccagcacgcccggatcgtcgacgcgctcgcggcgggcgatggcccggcggcggaggcggccatgcgccagctgctgacggtgcaccccgagatcgagcgcgtggtgccggcgccccgcgagcactgagccgcgagtgccgcaccgggagcgggcgcacggccggagcc

SEQ ID NO: 1722 - DNA, 1173 bp, Unknown
  Kingdom: Bacteria, Phylum: Actinobacteria, Class: Actinobacteria, Order: Streptomycetales, Family: Streptomycetaceae, Genus: Streptomyces
cgcgggtgtgccgtacggcacggtcgtcggatacggcgaactggccgggcgggtcggccagcccggcgcggcccaggcggtgggcgtggcgatgggcgccaacccgctgccggtcgtggtcccgtgccaccgggtcgtcgagaacgacggcggcataggcggcttcggcggcggcctggagaccaagcgcgcgctgctcgcgctggagggcgtgctgcccgagccgctgttctgaggcgggccgggcagggcgcgctgttggctcagtcgtagtgccgggcctcgaagacgttcccgtccgggtcgcggaagtagaagctgcgccgggccgttccgcgggcaccgtaggagtcgtgggagaagccggacacgggcacgtcggcctcctcgaggcgggcgcgcagggcgtcgaaggagtcggcgggcagggacaggcagacgtggttcaccgggtggcccgcgctgccggccgcgccgggaagcatgttcatgccggggacgaggtccagcggagcgaggtcgaagatcgtctcctcgttgaggcgtacggaggggaaggatgccttgcccgcggcgaactccgtgactctcagcggctccaggccgaccgtcttctcgtagaagccggccgccgcgagcgggtcgcgcacccagaggacgacgtggtcaagacgtgcggtgtggtccgtcatgggtcccaggctggtgccgcaccgtccgggccgcaagggtttgaccgggcccggggcccgccagagatgaggggagagcggcagacgggaggcaggcacgtgctggtggtgtccgaagaggtacgggaagcgctcgccgggcgacgccccgtggtggccctggagtcgacgatcatcgcgcacgggctgccccgcccgcgcaatctccaggtggcgctggagctggaggaggcggtacgcgaggagggcgccgtaccggcgacgatcgccgtgctcgacgggcggccccatatcggtctggacaagcagcagctggagcgggtggcgaacgaggaggggatgcgcaagctgggccaccgcgacctgccgccggccgtggcgtcgggggcgagcggggcgaccacggtctcggcgaccgcgctgctggccgcgctcgcgggcatccgcgtcttcgcgacgggtgggctcggcggggtgcacc

SEQ ID NO: 1723 - DNA, 744 bp, Unknown
  Kingdom: Bacteria, Phylum: Actinobacteria, Class: Actinobacteria, Order: Streptomycetales, Family: Streptomycetaceae, Genus: Streptomyces
aagatgaagcgcttcatcttcaccgagcgcaacggcatctacatcatcgacctgctccagtcgctgtcgtacatcgaccgcgcctacgagttcgtcaaggagaccgtcgcccacggcggcacggtcatgttcgtcggcacgaagaagcaggcgcaggaggccatcgccgagcaggccacccgcgtcggcatgccctacgtcaaccagcgctggctgggcggcatgctcaccaacttctcgaccgtctacaagcgcctgcagcgcctgaaggaactcgagcagatcgacttcgaggacgtggccgcctccggcctcaccaagaaggagctgctggtcctctcccgcgagaaggccaagctggagaagaccctcggcggtatccgcgagatgcagaaggtgcccagcgccgtctggatcgtggacaccaagaaggagcacatcgcggtcggcgaggcccgcaagctcaacatcccggtcgtcgcgatcctcgacaccaactgcgaccccgacgaggtcgactacaagatcccgggcaacgacgacgcgatccgctccgtcaccctgctcacccgtgtgatcgccgacgccgtcgccgagggcctcatcgcccgctccggcgccgctgccggtgacaagggcgagaaggccgcgggcgagccgctcgccgagtgggagcgcgacctgctcgagggcgagaagaaggccgacgaggctccggccgccgccgacgaggctccggccgcc

SEQ ID NO: 1724 - DNA, 1395 bp, Unknown
  Kingdom: Bacteria, Phylum: Actinobacteria, Class: Actinobacteria, Order: Streptomycetales, Family: Streptomycetaceae, Genus: Streptomyces
caccgccggcgcgccctgctcggcggccagccgccggtccagggccgcgttctggaggcgttcggcgcgggcccactgcgcgaggacggccagcaggaagggcagggcgaccagttccgcgatgctgagcatggctccgccgccgatctgctggtcgtggcggacgtccggggaccaggcgggggcgtggtgcaggtaccaggcgcccgcgatcagcgtgccgtgggtcatcaccacgacgccgggcaccgcgtcgacgaggccgtccaggaacaccagcgcggcccgcaccgggtgcgtgcaccaggcgggcagcgtctgctctcgggtgagcaccgggacgacgaacagggacccggccgccagcaggtgcaggtacatcagctcgtgcagccagcccacgcgcagcgcggtggcgaagtacggcgtgaagtagatgaccagctcggtggtgagcaccagtgccgtgctgaccagcgggaaggtcaggaggcgcaccaccttgcccgagacggcccgccggacccgctcggcgcgggccccgggcagcgcctccacggcgagccgcagcgggtcgccgagggcgaggccgagcggcgcgagcaggtcgagcaggacgttctgcacggcggccggccagaacaggacgtggtcgtagacggccagcgccgacatcgtggccaccaccagcgcgccgagcccgagcagcgtgaacgcggccagccgggccaccggccaggaccgcccctggcggcgcagccgcagcacaccccagccgtacagcccgcccaggacggccaccagaaccagggcgggcacgtccggctgccacgaggtcagcaggcggcccaccgtcggctccgccaggcgggccgccgacatcggcatgccggtcatcgcgtcggccatcatgcgtatcggtctccttcgcccatcgggggacgagtcggtacaggtccctgcgggacggtagcgcccggcgctccggtgcccggcggcggggtggccgccaccggacagcgggcgccgggcgcccgggtcgtgcggatacggcgtgcggctacggtatgcgattgcggtgtacggctccgggatgcggccacggagtgccccgcttgccgccgaacgcgacgacgaggcggccgtcggcggcgaaggaccggcccaggaccctgccccgggcgatcaaccggggcctgatgcccggccggcgccgcacccgcgacctggtcgaggtccgcacctgcggggagggcgtccgcgcccgtccggccgcagagcgtgccaccgacgacgatgtggccctgctggaggaacacctccagcacatgcgcgacgccgacgccgacggcgacgccgacgccgacggcgacggcgacggcgacggcggcggcg

SEQ ID NO: 1725 - DNA, 2325 bp, Unknown
  Kingdom: Bacteria, Phylum: Actinobacteria, Class: Actinobacteria, Order: Streptomycetales, Family: Streptomycetaceae, Genus: Streptomyces
gtccgccggaggcagggcggcaaccggaggcgccgccctgcctccggcggacgctgtgtctccggcggctgccgtagctcgcgtgtcatgtcactgccaccccgcttccgatacacgaacgtatccgatgcatcgctgtatcgaaaaggggccggacggcacggccgccgacaccacggcccgcaactgggtggaggcgttcggcagggccgccggtggcaaggtgacggcggacttctgcaacgacgggtccacccgccaggtcgtggtgctgcccttcgccgccggcggccagaagaagaaggccgaggtgcgcgtcggcgagaacggcacccggggcgtcaccctcgacgagacggaccccgccgaggcggcccgcgcatccggctgggcccggcggccccgggcggcacgggctcccgttccgccgcctcctgaccacctctgctcggggttcccggctgccgggccggtgatcacatctggtttgctgtccccgcgggggtcatccacgacttggggagatcgatgactgcggacgtgcggcaagtggccgacggcacctacctggtgcacggcagcaacaccaactgggtgatcctcaccgagggcgacgcggtgaccctcgtcgacaccggctaccccggtgaccggcagcaactgctcgactcgctggcagcggtgggcagttcgcctcaggcggtggcggccgtgctgatcacccacgcgcacaacgaccacctcggctccgccgagtacctgcggtccacgtacggcacgcccgtccagctgcacgaagacgaagtgccgcacgcgcgacgggagttcctgcaccaggtgagcatcaggacggtgctgcgcaacagttggcgcccgggcgtgctgccgtgggtggtgcacgcgctgcgcgtcggcggcaccgagcacctgcccgtcgccgcccccgagccgttcccggtggcgggagcgctggacctgccggggcggccggtgcccgtgcacacccccggccacacccgcggccacgcggtgttccacctgcccgacgcgggcgtggtgatctccggtgacgccctggtgagcggccaccccacctcccggatcaccgggccgcagctgctgcccgacatgttccaccacgagcgcgcccgggccctggcgtcgctggagatactcgaaggactcgacgcggacgtgctgctccccggccacggccccgtccaccggggcgcggtgaaactggccgcccagcgcgcgcgggaacacgcgctctagagtttccgccatggcattgcagatcagcgccaccaacccggagcaccccgcgctcctgctcgaactgccctgggagacgccgctggaggagtggcccgaggaatacctcgtgccgctgcctcgcggcatctcccggcacgtcgtgcgctactcccgcgccggcgacgaggtgatcgcggtcaaggagctggccgagcgcccggcgctgcgcgagtacgagctgctgcgcgacctggaccggctcgcgatccccgccgtcgacccgctcgccgtggtcaccggccgcaccgaccgcgcgggcgccccgctggagccggtgctgatcacccggcacctgggcggctcgatgccgtaccgctcgatgttcgagaccaccctgcggccggccaccatgcaccggctgatggacgccctcgcggtgctgctggtgcggctgcacctggcggggttcgcctggggcgactgctcgctgtccaacacgctcttccggcgcgacgcgggcgcgtacgccgcctacctcgtcgacgccgagaccggcgacctgcacccgcggctgagcgacgggcagcgggactacgacctcgacctggcccgggtgaacatcagcggcgaactgctcgacctggaggcgtcgggagcgctgcacccctcggtggacccgatcgagttcggcaccgagatctgcgcccgctacgacgggctgtggcgggagctgacgcgcacctccgtctacccggcgggcaagtaccactacatcgagcgccgcatccgccgcctcaacgacctcggcttcgacgtcgccgagatgcagatcgagcactcctccaacggcgacacggtgaccttcgtgcccaaggtcgtcgacgccggccaccaccagcggcaactgctgcggctgaccggtctggacaccgaggagaaccaggcgcggcggctgctgaccgacctggagagctggatggccacccaggacgactacgccccgggcgaccccctctcggcccgccccgaggtcctcgcgcaccgctgggtgcgcgaggtgttccggcc

SEQ ID NO: 1726 - DNA, 2029 bp, Unknown
  Kingdom: Bacteria, Phylum: Actinobacteria, Class: Actinobacteria, Order: Streptomycetales, Family: Streptomycetaceae, Genus: Streptomyces
cgtgcggtcgccgtccgcgccgaaccgcgccagcgcggacggcgaccgcacggaacacgcggcggcgaggacgggagcggtcacggagaccgcccgtacgacggcgtccgccgaggtcgccgagggtgacgaagcaccctccgcgcgggaggacgatccgcaggggaagcccgaggcgggcggctcggcggcggccgtgccgggcggaccggtccggcagcccgccggtcactacgccgtgccgaccgccgtggccgtcgtgccgcccgcgcccgcccggcgtccggtgaccgagggcgggttcgacttcttcggtatgcagaagggggcaccgcccgccgccctggaagccgtccagaacgaggacctcgccgacgtcgtcggtccggaggccctcgcgctgcacaaggccgagtccgagtccgcgtacaagccggccgacgcggagaccgacgcccgggccgtcggtcaggtcatcgacctgaccgcccacgacgagacggaacagatcgacctccagggcctgcgtacggcggcgtcctgagggcggccgcgcccgccgggggcgccgcacggcgacagcgggcatgagtgccgacagcgggcatgagtaaggggcgtggcgcaaggggtcacgccccttactgctgccctgcctcagcccctgctccggtccccgccgctgaggtgctctgggccatccaccggtccggccgggctccgcggcgtcccgtccgtgaccgctcggcctgcgcccgcagcagccccgccgcctcctccgcgtcccgcagccgtgccgtcaccgtcttgttcgcgcccgtgtccacgtggacgtcggcgaccttccagagccgcttccagggcccctgcgtgagccgtacgctctgcaccttggcgtgcgggaccagcgcgagccggcgccgcagcagtccgtgccgggcggcgaacaccgcgtcggtcacggcgaccccgtaccccctccaccacagcggcacgcaccagccggcgcttcggcgcggccgggccagcgagccggtctccggaaccgtgacgcccggcagcacccgcgcgatcaccgactcggcgatctcccggggcgccaccggcagcagcacggagttcgacgatccggccacgtccagctccacccggacccagccgcgcccgcgtccggcgccgtccggtgcgggcgacctccagcgccgccacagcagcggttccacgatgcgtacggtctgcacccgtcccggcggcaccgtctcgtgggtgcggtccagcaggccccggtcgatgcgcagcccgtcgggcgactcgctcagcgtccagccgtaggcggcgacgaagcgtccgacgctgctcgtcacggccccgccgagcaggggcagggcggtggccagcaccgtccacaggctgtgggtggccagccacagcagggacggcacgacgagggcggcgaccagcgagccccaggtcgcgccgatcagcagcagcgataccgctatcacgcgcgcgggaacacggacgagctcccgcgcgggtgcctcgccgacctcgcgtgccgtgtcggaggtgaagccggcggcccgtgcgagcagttcggcgcgcagggcgcgggcgtcgtcctcgccgaggaaggcgagctcgtccttcttgtcggtccctatgacgtcgagtttcagcttggccacgcccgcgatgcgtgcgagcagcggccgggtgacgtcgacggcctggatgcgctcgagccggatgtgggcggtgcggcggaacagcagcccggtccgtatgcgcagttcggcgtcggtcaccgcgaagtgcgtgaaccaccaggacaggaatccgtagagcgcggcggccgcgacgagcaccgcgagcccggtcagcagccaggccgtcgtcagcctggtcagctgctggtgtgcctgtccggggtcgtgcaccgcccagccggcgagcacggcgaccggggcccaggcccggcgcagcggcgtcacggggtgcagccgccgttcggtgacgggcccggaag

SEQ ID NO: 1727 - DNA, 3585 bp, Unknown
  Kingdom: Bacteria, Phylum: Actinobacteria, Class: Actinobacteria, Order: Streptomycetales, Family: Streptomycetaceae, Genus: Streptomyces
tgccgcgatcccgtgacccgccgtgcggatctcgcgctgcggccgcacgccgccgttcaggcgcagcagccgggtcacggccaccctcagcagcgtgtcggcggcgagcgcgttgccctcgtccgccgcgcgcagcacctggtgcaccagtcgtgcggcgtaggggtcgtcgagcaccgggttcacgaaaccaggtgtcccgcggagcgtcgtggtctccgcggcgatctcggccaccagttcgggcgccgggtacaccgcgccgtaccgccacccctcgggcacgcccgcgcggcccgtgtgcggtgtgtccgggttgaccagcgcgagggcgcccggccccgcgtactggtcggcaccgcggtggtggaacacctcgacgccctcggcgatggcggcgatcacgaagtgctcgtgggtgtgccgtacgaactccttgcggacatagcgggcacgcagcagatcgacgtcgggcagttcttcgtactgccagtgccgtgcccgttcctcgcctcgtgccgccatacgtcgattctccgccgccgccagccggacgcgtccctttacacctccgaggtggcggcaaatgcccaggtcagcccgcattgtcagtgaccgggtgcaggatggacgcatggtcagcgacgcacaccgagccctcgacggcttctcccccgcgacccgcggctggttcacgggggcgttctccgcgcccaccgcggcccaggccggcgcgtggcaggccatcggcgcgggctcggacgtcctggtggtcgccccgaccggttccggcaagaccctggccgccttcctcgccgccctcgaccagctcgcctccaccccgcccccggccgacccgaagaagcgctgccgggtgctctacgtctccccgctcaaggccctcgccgtcgacgtggagcgcaacctgcgcagcccgctcaccggcatccgtcaggaatccgtgcgcctgggcctgcccgaaccggaggtgaaggtcggcatccgctccggggacacgcctgccgccgagcgccgcgccctgtccacccgcccgccggacatcctgatcaccactcccgagtcactgttcctgatgctcacctcggccgcgcgcgacgcgctgacgggcgtggagacggtgatcctggacgaggtgcacgccgtggcgggcaccaagcgcggcgcccacctcgcgctgtcccttgagcgcctggacgagctgctgccgaaaccggcccgccgcatcgggctgtccgcgaccgtccgcccggtcgacgagatcgcccgctacctgtcgccgcgccgcaaggcggagatcgtccagcccgcctccggcaaggagttcgacctgtcggtcgtcgtcccggtggaggacctgggcgagctgggcgcctcccgggccgccgacggcgacgacggcgcggagcggccgtcgatctggccgcacgtggaggagcggatcaccgacctggtccaggcgcaccgctcgacgatcgtcttcgccaactcccggcggctcgccgagcgcctgtgcaaccggctcaacgagatcgcctacgagcgggccaccgggcagcccctggacgaggaccactccccggccgagctgatgggcggctccggcgcggcgcacggcgcgccggcggtcatcgcccgcgcgcaccacggctcggtctccaaggagcagcgcgccctggtcgaggaggacctcaaggcgggccggctgccggcggtggtcgccacctccagcctggaactgggcatcgacatgggcgccgtggacctcgtcgtccaggtcgagtcaccgccgtccgtggcctccgggctgcagcgtgtcgggcgcgcgggacaccaggtgggtgccgtctccaccggtgtggtcttcccgaagtaccgcggtgacctggtccaggccgccgtcgtcaccgagcggatgcgctccggtgccatcgagtccctgcgggtgcccgccaacccgctggacgtcctcgcccagcagctcgtcgcgatgacggccctggacacctggcaggtcgacgacctgctcgccctggtccgccgggcggcgccgttcgcctcgctgccggagtcggcgttcacggccgtgctcgacatgctcgccggccgctatccctcggacgcgttcgcggagctgcgcccgcgcgtggtctgggaccgcgtggcgggcacggtcaccggccgccccggcgcgcagcgcctggccgtcacctcggggggcacgatcccggaccgcggtctgttcggggtcttcctcgcgggttccgaccccaagaagggcggcggccgggtcggcgagctggacgaggagatggtgtacgagtcccgggtcggcgacgtgttcaccctgggcacgagttcctggcgcatcgaggacatcacccgcgaccgggtcctggtctcccccgcgccgggcgtgccgggccggctgcccttctggaagggcgaccagctgggccgcccgctggagctgggccgcgcggtgggcgcgttcctgcgcgaggtcggcgccctgtccgacgaggacgcccggctccggctcctcgcggccggcctcgacgcatgggccgcggacaacgtcctggcgtacctggccgagcagcgcgaggcctgcggccacgtccccgacgaccggacgatcgtcgtggagcgcttccgcgacgaactgggcgactggcgggtcgtcgtgcactcgccgttcggcgcccaggtgcacgcgccctgggcgctggccctgggcgcccgtctgtccgagcggtacggcatggacgcgcaggtcatgcacgccgacgacggcatcgtgctgcgcctgcccgacgccgacctcatgggcctggacctgctcgacgcgcagcccgtgaaggccggtgcggagtacgacgccgagcaggcgccggtcggtgcggcggacgtcgccttcgacaagggcgaggtcgaccagatcgtcaccgatcaggtcggcggttcggcgctgttcgcctcccgcttccgcgagtgcgccgcccgcgcgctgctgctgccccgccgcaaccccggcaagcgcaccccgctgtggcagcagcggcagcgcgccgcccaactgctgcaggtggcgagcgagttcgggtcgttcccgatcgtcctggaagcggtccgcgagtgcctgcaggacgtcttcgacgttccgggcctggtcgagctgatgggggacatcgagtcccgcaaggtccgcctggtcgaggtcaccaccccggagccgtccccgttcgcgcgctcgctgctcttcggctacatcgcacagttcctgtacgagggcgactcgccgctggccgagcgccgcgccgccgcgctctccctggactcgcggctgctcgcggagctgctgggccaggcggagctgcgtgagctgctggacgccgaggtgctggccgagctggagcgcgagctgcagtggctgaccgaggaccgccgcatcaaggacgtcgagggcgtcgcggacgtcctgcggctgctggggccgctcaccgacacggagctgaccgcgcgcggggccgagcccggctgggccgaggagctggccggccgggc

SEQ ID NO: 1728 - DNA, 638 bp, Unknown
  Kingdom: Bacteria, Phylum: Actinobacteria, Class: Actinobacteria, Order: Streptomycetales, Family: Streptomycetaceae, Genus: Streptomyces
cgtccgccgggtcgaggccgcggggcgaccggtcgagcggctgttcctgggcgcctcctacccgttctacgagccgcgtcgcgtcgggcgtgcgctgcggcgggtgctcggggctctggtgcagcggggatggctgcgggtgggtgcgcggacggtggggacgacccgcgggagcgtgcccgaggccgatgaggcggaggtgcgctatctgcgttccatcggcggattcggcagtgaggtcgacgacgagaccatcgcgttcgtgatgcgtgccttccggcacgatgtgaacgagggcggacgctacttcgccgaggtgtggacgcgcggaaccgagccctggctgagcgagccggcccagccgccgacgccgctcgcgacaccgatcacgttcatcgcgggcaccgctgacccgatgaccgccggatacggtcgcggagtgcgactgtgggaccggttcagcagcagcgtcgacctcgctgtgatccccgaggggagccactacttcctccaggaccaggccgaggcgctggccgctgtgatcgagaggtccctggacgctcactgcggccgctgcggagcggcgacggcagccggctgagccggtcggccgctcgcggcggccacggtcaccggcc

SEQ ID NO: 1729 - DNA, 1296 bp, Unknown
  Kingdom: Bacteria, Phylum: Actinobacteria, Class: Actinobacteria, Order: Streptomycetales, Family: Streptomycetaceae, Genus: Streptomyces
ccggccagccaccgcacccgcacgatgcccttccgcaccacgctctcccactaggacctggacgtaccgggcaaccaggccaagctcgacgccgccaccgaactcgccggcgtcgccgccgaagcgggcctgacgctgatccagctcgcgctggcgttcgtcaccacgcaccccgccgtcaccgcggcgatcatcggcccccgcacggccgcgcatctgcgcgaccagctgagcgccgcggacatcgtcctggacacggccgtactggaccgcatcgaccgcatcgtggcgccgggcaccgacctcaaccccgaggacaccggctaccacgcggacgtcctggccgatccggcacgccgccgccgcgccgtcgtccggtgagccgggcgggccagccgcccggctcacctcgtcgccgcgcgggtcgcctccgccccggctctcggcgtccggcccgtcaggcgctgtagccgtagcccgtccagttctccaggacgtgctcctgcaactcgcgggggtacgacgtgcggaaggaggcggtggtgccgcggaaggtgtccggcagcaggcagtccgtgaccgacttgccgccccgggcggcaccggcctcctcgggggtgaggtaggggaccatcggaatgcccggggcctgcgggaaggtgtggtggccggtgtccgggtggctgcgcgtcgccatggcccagacgagttggcggatgtcggtgatgtcgatgtcgtcgtcgacgacgatcaccttgggcaccagccagccggcgtgcgaggcgaacagcacgtcggcgatggaccggaccaggtcgtcgcctcccaggccgagttcgaggcgccgggcacggtcgacggagacggcgagccagcaggtggcggcctcgtacggacaccacgcgagggtgaccggcagcccggcggcgcgcagcacgtcgagggcggctgccgcgatcatggtgccccagatcgtgtggttctcctccggcggcaccccggccgcgcagaccggcaggatcgggtcgtcgcggtaggtgaccgcctcgacgtggaagacgggctgcttcttgccgtccgggaacgcgtacccgtggtactcccccatcggcccctcgtcggcactctcgtcgctgctgaggtaaccctccaggacgatctcggcgttcgcgggcacgtacaggccgttcgtctcggtgcggaccacctcgaccgggctgccggtgagcgcgccgacgtagccgtcctcgtcgacgtgtgccgggagcggcatcccggccgcggcgagcgcggcgg

SEQ ID NO: 1730 - DNA, 656 bp, Unknown
  Kingdom: Bacteria, Phylum: Actinobacteria, Class: Actinobacteria, Order: Streptomycetales, Family: Streptomycetaceae, Genus: Streptomyces
cgcgcgggcatgccgggaaagaggaaggggaagtcgtggacggcgtcgaccgcgtacaggtcggccaggtcgtctgcggacttgttgagcatcgcccgctggtagcgggccaagacctcacgagggccaagggtggccgaggttgtgtccgacatgacggctggactccgttcaagtgggccaggacttcagcgctttggcagcgcggaccagtcgagggccgccaaggtctcttcgtgacacctgacttggagaccctattgacggcactctatgtgaagaccgacgtcgagatcggaggaacacgatggagggggcgcccccccagttcagtgactccgagctcgtctgcctggcggtggcccaggcactgctcggctgccactccgaggcacggtggctgcgctccgtccgcaagggcttgggcgacctgttcccctagccacgcatgcccctgcggaccgcggccgggcggccctcacccctgcaggtcgatcagtgtctttcccgcgcgtccggcatccgggctcgcgaggtggcccacgagttcgctgagcccgacgcgggcccccacggccgtgcgcaggtgccctcggcgcaggctctcgaagaccggcgcgaacagctcgggcaggtgccggccgccgtcccgctgg

SEQ ID NO: 1731 - DNA, 823 bp, Unknown
  Kingdom: Bacteria, Phylum: Actinobacteria, Class: Actinobacteria, Order: Streptomycetales, Family: Streptomycetaceae, Genus: Streptomyces
tcggcgccggtcgactcggcgttgcgcaccttgtcggcgcccatcgccgccgagacgtcgcagttcttcaccgcgaacgtgccgccgaagccgcagcactcctcggcaccgggcagctccaccagctcaaggcccttcacggcccccagcaggcgccgggggcggtccccgagacccagggcgcgcagcccgtgacaggtcgggtggtaggtgaccgtgtgcgggtagtacgcgcccacgtccgtcacgccgagcacgtccaccaggaactcggtcagttcgtacgtcttgggcaccacgggcgccagcgtccgggccagggtgtcgccccgcccctcggcccgcgcccgctcgcccatgcgcggatacagctcgcgcaccatcgcaccgcacgacccggacggcgtgacgatcgcctcgtagtcccggaagacatcggagaactgccgggccagcggctccgcctcatgccggtacccggtgttgtagtgggcctgcccgcagcacgtctgccctctcgggaagtccacctcgacgcccagcctggtcagcagtttcaccacggcacggccggtgtccggatagagcgtgtcattgacgcaggtcaggaacagggcgacacgcatcgcggctccttgtcgtcggtcatcggacgggtgaagcgtagtcaggccgggagcggcccgggagacccgggcccgctcccggcgcggcgatgcgaaaggcccggtcccggcggggccgtgggcggccctggctgccgccggggccgcaggcgggtgccgtcacggcgtggtggcgagccgggcatcggccgcgcgcc

SEQ ID NO: 1732 - DNA, 1450 bp, Unknown
  Kingdom: Bacteria, Phylum: Actinobacteria, Class: Actinobacteria, Order: Streptomycetales, Family: Streptomycetaceae, Genus: Streptomyces
gcgggtgccggcggcgcgcctgcgggcggggcgtgtcgtcagccggggtccgcccggggcaggcggggcgtgccctggcacggcgtacgagggaccactgaggggtggcgcgggcgtgcggcgacggtgctgtgctgtgccggtccggtgggttcggcagggggcggccgtgccgcgacgccgtggatcgggcaagctgtgcctctcaggacgtggactggaggcgcgtgtgcaggcggaggcggggcccgaggccgattcctggccgggcgagcggctgtcgcggcggaccttccgggacgagacgctgctcgtcctggcactctcgctcggggcgagcggtgtctccgccctgatcagcttcgtcggatcggtcacgaaacccggcggcctcaaggaccaggccgccaccctcaacgcctccgccgcgccgggccgcccctggctcgacctggcctggcagctcttcgggatcgccaccgcgctcgtgccggtggccctcgtcgcgcatctcctgctgcgcgagggacagaacctgcgcactctcggtttcgaccgctcccgtccctggcccgacctcggccgcggcgccgcgatcgcggcggtcatcggcagcaccggcatcgccttctacctggccgcccgcggcctgggcttcaacctcaccgtggtgccggaggcgctgcccgcggtgtggtggaagtaccccgtgctggtgctgtccgcgctgcagaacgccgtcctcgaagaggtcatcgtcgtcggctatctgctgcgcagactgcggcaactgggctgggccccggggtccgcgctggtcgccagttccgtactgcgcggttcgtaccacctctaccagggcatcggcggcttcctcggcaacctggccatgggagtggtcttcgtctggctgtaccggcggtggggccgggtcgggccgctggtggtggcccactcgctgctggacatcggcgcgttcgtcggctacgccctgctggccgggaaggtgggctggctgcccacggcctgaccctgcccccggcctgtacggggcaggatcaggccggcttcaggcgtgcagttcgccctcgatgaccgtgaccgcgtggcccgtgagcagggtgcgtgcgccgcgcacctcggtgcgcacgaggccggagcgcggtgaggcctggaggccggtgagggcggggcggccgaggcgctcggaccagtagggggccagggcggtgtgggcgctgccggtcaccgggtcctcgtcgatgccgaggttcgggaagaagcaccgcgagacgaagtcgtaaccgcggccggggtcctcggcccgtgcggtggcgatgacgccgcgcgccgagcaggcggccagcgccttgtggtcgggggccagggcccggaccgtcttctcgtccgcgagttcgagcaccaggtcgccgacgtccgggccctggcc

SEQ ID NO: 1733 - DNA, 2175 bp, Unknown
  Kingdom: Bacteria, Phylum: Actinobacteria, Class: Actinobacteria, Order: Streptomycetales, Family: Streptomycetaceae, Genus: Streptomyces
gcaccggaggggggctctgcgcggggctcacaggctcagcgccgcctggatcccggcgccggcgaccgcggccgcgtagacgccgaccgcggcggtgacgatccgcccgcggacccgctcgtcgagggatgtgcgggacagcagcgaggccagcgcgggcagcaccagcaccgcgtgcagactcacgccgtgcagcggcttgagcggggccgtcgagtggtacgccgcctcctggtgcccggtcctggtgagcaccaccccgcgcgcgatcatcgcggcacccgaggcgagggcgacgagcaggatcgcgaaccccgagcgcagcgccagggccattcccgcgggcccctcgggacggcggcggaaggacgccaccgcgaacgcggtcaggaggaccacgaggatcccgccgcccacggcgagtgccatcgacaccgccgtgtcgaagggcgtctccatgttcaggtgcgaggggacccggcgccacgcctggagggtgatcccgcccacctcgacgacgcagtcggcggcgaggaccgcgagcagcgcggtgcgcgggcgttccccgacacgcaggtacgacgtgacccaggtgagcgcgatcagcgtcagtccgaaggacagcccgaaggtgacgggcttgcgccaggacacgggtccgtcccacgggccgccgtcgaccgcgaacaccagcaggtggaccagcccggagaggacgaggaggagcccggtcgtgtggcacagccgttcgacggggcgcagcgcgcgggcgtgcgtcaccagagccgacgggcgcggcgggagagtgccgggagaggagactgccatgaccccagccttccggcggtgccgtgccccgtcgtcgtcccggtgaaggcacccggcgtaccccgcgcggagtaggcgggggcggggccggcctcggggccggcacccgggccgggtggcgcgtggctcgcttgacacgaaaatcgaacatccattcttatggaggctccggtgaggctcaaccgaggggatttcgccccgttctggggtgtttcgccccctggttatccacaggccggacgggcgtcgaggcgcattgtcagtggcaggcgttagcgtctttgacgtgaagcgatcgactcaagcaaaccgggtggaacccatggcaggaaccgaccgcgagaaggcgctggacgccgcgctcgcacagattgaacggcaattcggcaagggcgcggtcatgcgcatgggcgagcggtcgaaggagcccatcgaggtcatcccgaccgggtcgaccgcgctcgacgtggccctcggcgtcggtggcctgccgcgcggccgcgtcgtggagatctacggcccggagtcctccggcaagacgaccctgaccctgcacgccgtggcgaacgcgcagaaggccggcggccaggtcgccttcgtggacgcggagcacgccctcgaccccgagtacgcgaggaagctcggcgtcgacatcgacaacctgatcctctcccagccggacaacggcgagcaggcgctggagatcgtggacatgctggtccgctccggcgcgctcgacctcatcgtcatcgactcggtcgccgcgctcgtgccgcgcgcggagatcgagggcgagatgggcgactcgcacgtcggtctgcaggcccgcctgatgagccaggccctgcgcaagatcaccagcgcgctcaaccagtcgaagaccaccgcgatcttcatcaaccagctgcgcgagaagatcggcgtgatgttcggctccccggagaccacgaccggtggccgggcgctgaagttctacgcctcggtgcgtatcgacatccgccgtatcgagaccctgaaggacggcacggaggcggtcggcaaccgcacccgctgcaaggtcgtcaagaacaaggtcgcgccgcccttcaagcaggcggagttcgacatcctctacggccagggcatcagccgtgagggcggcctgatcgacatgggcgtggagcacggcttcgtccgcaaggccggcgcctggtacacgtacgagggcgaccagctcggccagggcaaggagaacgcgcgcaacttcctgaaggacaaccccgacctggccaacgagatcgagcggaagatcaaggagaagctgggcgtcggcgtgcgtccggaggagcccgccaccgagccggacgc

SEQ ID NO: 1734 - DNA, 757 bp, Unknown
  Kingdom: Bacteria, Phylum: Actinobacteria, Class: Actinobacteria, Order: Streptomycetales, Family: Streptomycetaceae, Genus: Streptomyces
cgccgcggcgccgcaggggcgctgcggcaggtccgtccgaagtcgcgtgcgaggtcatggccccatgctacgtccaacgcaggtcgccttgcgttggccggggcggcgtcgtacggttcaaagcaaggcagcctgcgatacgagtacgggccgccgcaccgaggaggtcgccgcccatggaccggatgctcgccgcccgcctgcacgtgccgagccgcaccctgcgcctggaggaggtgccccgcccccagcccggcccgggagaggtcctggtgaaggtggaagcggccggggtgtgcctgtccgacgtgcacctgatcgacggcacgctcagcccgctgctgctgcggggcgacaccgtgaccctgggccacgaggtgtcgggcacgatcgccgagaccggagcgggtgtcacccactggaccaccggtcagcgggtcgtgctgtacgccggtgagacgcgtgacggcgtcacctacacccggggtgtggactacgacggcggctgggccgagtacgcgctgtcctcggccgacgcgctgacgccgctgcccgacgccattcccttcgagcagggcgcgatcatcccggacgccgtctcgacgccgtggggcgccatcaccgccaccggcgcggtacggcccgccgaggcggtcggcgtgtggggcgtgggcggcctcggggtgcacgcggtgcagctgctgcgcgccgtgggcgcctgccccgtcatcgcggtcgaccccaaccccgtcgccag

SEQ ID NO: 1735 - DNA, 1322 bp, Unknown
  Kingdom: Bacteria, Phylum: Actinobacteria, Class: Actinobacteria, Order: Streptomycetales, Family: Streptomycetaceae, Genus: Streptomyces
gcccggcaccacgccgcccgccccggaccaaggcacggcccccgggccgggcatcgcttccggcaccggcgcagccccggggccggccggagcccccggctcgggcccagcccccggcaccgctcccgtgtccgcgtccgccccggcagtcgctgctgccgtccccgtcgcccctgtcgccgtcccggtcccggtcaagccggtcggtgcgccggcggcggcgctcgcgctgcccgtcccgcacgtcgaccccgccgaccccgacgcgggtttcctggcgggtctgctggcgtccgcgcccgccgagctgatcaacgccctggccgccgcgcccgcccggtcgaccgagacccggctgcgggaggtccgtgcccggctggagaccggcgaggcggcgaccgccctgcaggtgctgcgcacgctggaggagcagcaccccgacgactggcgggtcgtctggtaccggggcctggcgtcactggtcaccgccgaccacgaggaggcggcgctggccttcgacgcgatctacgacgccttccccggcgaggtcgcgccgaagctggcgctcggtctgtgcgcggaggtcctcggccagctcgacaacgcggccgagtactaccgcctggtctggtcgaccgaccccagttacgtgagcgcggccttcgggctggcccgggtccagctcgccggcggcgaccggcaaggggccgtacggaccctggagtcggtcccggagtcctccatccactacacggcggcccgggtggcggcggtgcgggcgcggttgcgccaccgtacggcgctcgcctccgacacgccgttcctggaggacctgacggccgccgccgggcaggtggaggcgctgcgggcgtacggtctcgacccggcgcggcgcgagatgctgtcggccgaggtactcggctgcgcgctggactggatactctccgggggccgggccaccgacccgtcctcccggcgggtgctgctcggcagcgacctggacgagcggggactccgcttcggcctggagcgtacgtaccgcacgctggcccggctggcgcccggcggcgaggagaggatcgacctggtggaacgtgccaaccgttaccgcccccggacgtgggtgtagttgatgtcgcagatgcaccagcaggccgccctgtcgaactgcccgagctgcgcggagccgcttgagtcgggtgaccgtttctgcggggcctgcggatacgacctgtccgtggccgccgcgcccgcgcccgacacgccgacggtccagctgaaccgcggcgcggtgccgcgccgcggttcagctggaccgccgg

SEQ ID NO: 1736 - DNA, 1428 bp, Unknown
  Kingdom: Bacteria, Phylum: Actinobacteria, Class: Actinobacteria, Order: Streptomycetales, Family: Streptomycetaceae, Genus: Streptomyces
gcatgatggctctggtcagagcagggccattacgtcgggcggcggtcatgtccccatgctataggcacggcacgtgccgttcttgacaagtttccctcacccaggcacgcttccggcgaacggcacggcacgtgccgtattgtcgaggggagcgagcgcgtggacgctgccgacgatccaccaggcggtgctgcggcggcgttacggcaccgcgtccggccgctggcagcgttaccgcaccgcttccggcctgcggtggtgtcgcagtgccgtgctcgaccggtggcggcggaccgaggacgcgcggatcggaccggcacagggcagtgcggcgcgggccgatgccgcccaggcctgagcggcgcgggccggtgcggcaaggcccgggggagcacgggccggagaggcgcgggccagtgcggtgggggtcgggtaggtccgggccgctccgcggtaccggggaggtccgatgaggctgcaccggctcgacatcaccgccttcggccccttcggctccacccagcgcgtcgacttcgacgccctgtcggccgccgggctgttcctgctgcacggacccaccggagccggcaagacctccgtgctggacgccgtctgctacgccctgtacggctccgtgcccggcgcccggcagagtgcccagggcgccaccctgcgcagcgaccacgccgcccccggcacccgcacccaggtcaccctcgacgtcaccgtcgccgggcggcgcctggagatcacccggcagccgccctgggagcgcccgaagaagcgcggcaccggcaccaccgtggacaaggcgcagacctggctgcgcgagtacgacgcgaccgcgggcgcctggaaggacctcagccgctcccaccaggagatcggcgaggagatcacccagctcctcggcatgagccgcgaacagttctgccaggtcgtcctgctgccccagggagagttcgcccgtttcctgcgcgccgacgccgaggcccgcggcaaactgctcggccgcctgttcgacacccgccgtttcgccgaggtcgagaagagcctcgccgaccgcaggcgcgccaccgaggcccgggtgcgcgagggcgacaccgcgctgctcgccgacgcccaccgcatgcagcaggcggcaggcggcgccatggaactgcccgacctcgcacccggcgaacccggcctggccgaagcagtactgaccggcgccgccgtcgcccgcagcaccgcacgcgaacagctgaccatcgcccactgccgactcaccgccgccgaggccgcgcaggtcacggccgagcgcgccctggacgacgtacgtgaactggcccggctgcagagccggttcgccgaggcgcagcagcgggccgcgcgcctcgcggagcgggccgacgcgcaccgtgcggcgcaggagcggatggagcg

SEQ ID NO: 1737 - DNA, 1421 bp, Unknown
  Kingdom: Bacteria, Phylum: Actinobacteria, Class: Actinobacteria, Order: Streptomycetales, Family: Streptomycetaceae, Genus: Streptomyces
ccgcggcgacctcccggtaccgctggatcaactccgcccggcagccggccggagttgatccagcggtaccgggaggtcgccgcggagttccccgcctccgacctgcccccgctggagacggcgtactggctcgtcaagccacgtaccgcggtccggggcacgtggccggacccggaaggcgcggcggcctggctcggtgagcggctggccgaacacgcgccccggttcgcgtccccggccgaacgcaccgccgcccgcctgtccgctcacctcaccgccgccgccgaacggctgcggtcgggcggtgacgtctccctcggcttctacctggaacggccctcgtacctctcactcgccctggtgacctgctcgcccagccgggcgcggccccacctgccgtgccccctcaccccgggcaccggttgacgaggccgcccacccaggcaccccggagtccgcgtcctcatccgacgccgtcgcggacgatgcggcgggccacctcggtgcgggcgccggtgagttcggcggtgatgcgtcggcggcggtcgtcgtccaggaggacggccgcttccgagggcgggccggcgaggaggcaggcgcgtcggagatgggtcggcgggtgggtggagtccacgctgtggccgcgccgggcgcccgcacgccgctgccgctcgtactcgtgctccgggacggacgccacgtgcgcggccagccgggtccagaggccgcccgtggggtccgtggagaccgcttcggctctgcgggccgaacgcgaacgcgccccggccaacgccacgttgttcctctcgcgccgcaggaagacgtcgatggactccgcgatcaggagtcggtccatgaagcccgccgcggcctcggtggatgcggcgcgggcggcctcacggtcggccaggtactcggcgcgctgggtagcccgcagcgtcaggtggtcgaggagggtcagcgtgccctggacgaacagcagcggcacggcgtagaccacgttcacgaccatctcggtggcgttcggccgcgggatcggcaggaagtagtagcgccatgtgaccagtgagcgcaatgccgtgcccaccaccaggccgtgccgggtgtcgccgttgccgtagtggcccagctcgtggccgaggagggcgacctgctgctgcgggctcagcacctcccacaggggcagacccagggtcagggcccggcggccgcgcagcccccgggacatgacgctcgcgttgatctccttgccgaccgtgatcgtgtccacgccgcgggtgccgacgaccccggcgacctcgtcgatcagcgcgtacagctccggcgcgtcggcacggtgcagcacggtcctgtcggcggccggcccggacagccgcggccgcagggccacggccatcgccagcagcaccacgcccagcacc

SEQ ID NO: 1738 - DNA, 2151 bp, Unknown
  Kingdom: Bacteria, Phylum: Actinobacteria, Class: Actinobacteria, Order: Streptomycetales, Family: Streptomycetaceae, Genus: Streptomyces
ccgagggactcgatccgctgccagcagaagtcggtcgcccggaacagccacgcgtgccacacctcgttgcggtgcagcaggcccaccaccggaccggtggccaggaggtcgcccggcggatcgtccacgatcgggacgaagggcgccgccggacagccgcgccggctgggacggaccgcggggagcgcgccgtcggcggtggagacggaggtcagatagcggcacacgcgctccacacgccggccgtcgcagcgccctacggcgtccagtacgcgcagcgcgtgcgcggtgtgcagcggctggctgaccggaccgcgcagatcgggctccagggcgtggccgtacccgccgtcgtcgttggcgtaggcgtccagtgcggtctccacggggtccgcgccgccgttcaggaagtggtgcgcgaagagccgctgctccagcacgcgcgcgctcagccacacgaagcgctcggcgcgcagcagcggtgaggccgccgggggcggcgggggtgaggggaacgctcctgtctcggccatggatcagaccgtagggcgccccgccgtccgcacgcgccgtcccggcctggggtcactcccaggggcgggatactgggggcatgcggttgacggtcttctgggagcggatggcggagtacttcggtgccgggtacgccgacaccttcgcacgcgatcacgtcatgtcggagctgggcgggcgcacggtgcacgaggcactggcggcgggctgggcggccaaggacgtctggcaggtggtctgccaggtgatgaacgtcccaggagagaaacggtgatcggtcacaaagaaggacgggccgtacggggctgtcggtggcgtgggcgacactggcatggtggcacccactgacgagtccgggcagacggccccgcacaccaccccgatcggtacgacaccgcctcccaggcctcccgccgagggcgctgcccggccgaccgcgcgcatgccgcgctggctgccccgcgccatggtgctcgcactcgcgctcgtggccgccttccagttcggcagctgggccttccacgaggtgaccggcctgctgatcaacatcctcatcgcgttcttcctggcgctcgccatcgagcccgcggtgagccgtatggccgcccgcggcatgcggcggggagccgccaccttcctggtcttcctggggctgacgatcgccgcggcgggcttcgtcaccctgctcgggtcgatgctcgccgggcagatcatcaagatgatcgagggcttcccggagtacctcgactccgtcatccactgggtcaatgccaccttccacacagacctgcggccggtcgacatccaggaagggctgctccactccgactggctgcgcaagtacgcgcagagcagcgccgcgggcgtgctcgacgtgtccacgcaggtgctcggcggcctgttccagctgctgacgatcgggctgttctcgttctacttcgccgcggacgggccgcggctgcgccgtgccctgtgctcggtgctgccgcccgcccgccaggccgaggtgctgcgcgcgtgggagatcgccgtcgacaagaccggcggctacctgtactcgcgcagcctgatggcgctcatctcggggatcgcgcactacatcctgctgcaggcgctcggcgttccgtacgcgcccgtgctcggcgtctgggtgggcctggtctcgcagttcatccccaccatcggcacctatctcgcgggcgccctgccgatgctgatcgccttcacggtcaacccgtggtacgcgctgtgggtgctgatcttcgtcgtggtctaccagcagttcgagaactacatgctgcagcccaagctgaccgcgaagaccgtcgacatccacccggcggtcgccttcggctcggtcatcgcgggcaccgcgctgctcggcgccgtcggcgcgctgatcgccatcccggcggtcgccacactgcaggcgttcctcggggcgtatgtgaagcggtacgccgtcaccgacgatccccgcgtccagggccaccgcacccgggccccggcaccgggcctgctcgcgcgcgtacgacggctgtgggcggcgcggcccgcggcggacccgtcgacggcaggggtgcgggacggcgcgcaggaggagcccggtactccggc

SEQ ID NO: 1739 - DNA, 2018 bp, Unknown
  Kingdom: Bacteria, Phylum: Actinobacteria, Class: Actinobacteria, Order: Streptomycetales, Family: Streptomycetaceae, Genus: Streptomyces
cgggcgcgcccggaagctgctggcccagggcggcgggctgccgcaggaccaggcgatcatgggctggggtgccgacaaccccgaacccgtcaagggccgttacgacttcgccgcgctggaccgccgcgtcgacttcatgcgctcctcctccgccacccccgtgatcaccctgtgctgcgccccggactggatgaagggcggcaagggcggcgccggccgcacggactggagccagagcgccctggagaccgcccccacacccgcccacttccaggactacgccgacctcgccgcgaccgtcgccaggcgctacccggacgtacgccacttcgtcgtctggaacgagttcaagggcttctggaacaacagcgcgggccgctgggactacgagggctacaccgagctgtacaacctggtccacaaggcgctgaaacgcgtcgacccgaagatcatggtgggcggcccgtacctcgtcatggacagcgtcgacccgcggcagaaggagaacgcctcgaccgcgctgcgcggcccgtggggtgccatggaccagcgggtcctggacgccttcgcctactggaacgcgcacaaggccggcgccgacttcgtcgtcgtcgacggctccagctacaccaaggacgacgacctgctgccggacgagttcgccgccaccgacaagctgacggccgtcggccggtgggtgcggcagcagacgcacggcctgcccctgtggtgggccgagtactacgtcgagcccgccgaccgcaacgacgaccgcaaggcctggacggagccgcaccgcgtcgccgtccaggccgccggcatgatcgccatggtccgcggcggcgcctcctccggtttctactggaaccccgaggaggagaaggacaccgcctgccccggctgtctgtggacacccacggacacggccggcggcggccggccgctgcccatgtacgggctgctctcgcgcttcgcccgcgccttcccgccgggcacggagtaccgggccgtgtccgtcgccccggacgacaagcccaacgtccgcgtgctggcgagcgaccggatgatcctggtggtcaacaccctcgaccgcacgatcagcgcccaggtcgacggccgccgcttcgacatgaaggcgtacgaggtgaagtggctcggacggtgaggagtcaccgtccgagccgcctcagcgggcaccgcccgggccgtgccggcgggcagtgcccgggccgtgccggcgggcaccgcccgggccgtgccggcgggtagtgtccgggccgtgccggcgcgtgagggtcacccgcgtcccatcgtcatgaaccgctgcaccagggaggcgagcagcaccgccagcggcggcagcgtgaaccagaagctcccctgcagccaccgcagtcggcgcacgctcggccgtagcgcgacccgggtgatctcccgggccgtcagtatcacgaccagcgccagcgcggccaggccgccgaccacggaccacggcgtccacgtcacctgcgggccgatcggccccgggtccggctgcggcaccgcgcccgcgggccgctcccgcagcgtgtacagcgtcacgtcgtcgttggcgaggaccttcttcagctcctggcggtcgtcgaggttcttcaccagccgcgacttccaggtggccgaatacccgacgtccagttccagatacgtgacctggctccggttgaccatcaggtacgagttcggaccggcgtcctcgagcgacttgaccaggcccgagaccaggaccgggtcgggcggcgcgagggccggcacgtagttcacgcgctccatgtccttcgcgccccacggcatggccggggtgacgtcggtgagcgggtcgttgctcagccacagcagccgtacggtcggcttgtcgtgcgcgtacacgtagtccatggccgcgacctcgccgggccggatccgctcgaacggctcgttgccccagcgggccaccaggaagccgcccatgagcaccagcccggccagcagtgcggcgagcg

SEQ ID NO: 1740 - DNA, 642 bp, Unknown
  Kingdom: Bacteria, Phylum: Actinobacteria, Class: Actinobacteria, Order: Streptomycetales, Family: Streptomycetaceae, Genus: Streptomyces
gccccgccccctggacagtgactgaggttaggctaacctaccttcgaacctgtccggcggtgctccgccccgttcgaaagtggccatacccatgtccaacgcccgtgccaccaccctctcccgtcgcggcatcctggccgccggcggcgtcctcggtctcggggccgtgctcgcggcctgcggcagcgatgacgggaagagcaggaatggcggcggcgcggcgggggcgaagtccgggccctggacgttcaaggacgaccgcgggcagacggtcaaggccgacaagaccccctcggccatcgtcgcgttcgtcggcgtcgccgccgccctccacgactacggcgttccggtcaagggcgtcttcggcccgacgaccaccaaggacggcaaggccgatgtgcaggccggcgacctggacgtcaccaaggtggtgagcctcggcaacgagtggggccagttcaacatcgagaagtacgcggccctcgcccccgacctcctcgtctccacgatgttcgacggcgtcggcaccctctggtacgtccccgaggagcagaagaagaagatcctcggtgtgggcgccccgaccgtcggcatctccgtctacgaccggcagctgacccagccgctggagcgcatgctcgc

SEQ ID NO: 1741 - DNA, 2409 bp, Unknown
  Kingdom: Bacteria, Phylum: Actinobacteria, Class: Actinobacteria, Order: Streptomycetales, Family: Streptomycetaceae, Genus: Streptomyces
tgccaggggggtgcggctgttcgaggcggcgcagaccgtagccggtgatcacggcagggccgccgaggcggtccgggcggcgtggaagccgctccatgacgcactggtcgagcgggagctcggcaccatcccggtcgccaggctccaggacgtcaccgaggggcggctgcggctcgggaacgtcgagaagagcggactcggcacggtgggccgggtcctggaggcgggcccgtaccgtctgttgcagatcccgggcgtcgggcagcgcacggccgaccagatgctcgctgccgcacgccgcctctccgaggccgtgcacgagaccgtggcggtccgtatcgacgtggaccggccggaaccgggcaccacggccctggtcatggccctgcacgtgctgctggaggcagggccggaagcccggcgcgcggtggacaaggccgccgctctggcggagcgcctggggcccctgctggccgaggccaagcccgccgccgggcgtctgcgcatgcttgtggcgggccgcgagaagagggcgcgcgcgtcggccgcggtcgcggagatccggtcgctggcggacgacgcggtccaggagggcctggccgaagcgttcgcccaggcgtcggcggacctgctgcggccctcgaccgacctcgcggcctggacggacttcgaactccgctcggccgagtactacagcctgctcgcggagatcaccgggcggcagcccgacgccgcggcggccgagggcttcctgcccgaggaggtcgcggagcgggtccgcgcgcagcagctcgacgactcccgccgacgggtctcgctacgtggctaccaggcgttcggcgcgcagttcgccctggcccagcgcaaggtgatactcggcgacgagatgggcctcgggaagaccatccaggcgatcgccgtgctggcccacctggcggccgagggacagagccacttcatggtcgtctgcccggcgagcgtcctcgtgaactggatccgggagatcgaggcccgcagcgacctggccgtcagagtgctccacggacccgaccggcacgccgcgttcgccgactggaaggggcggggcggggtcggggtgaccacgttcgaggcactgcgcgggttcccggccccgggcggcggcgaggtcgggctgttcgttgtggacgaggcgcactgcgtgaagaacccgcaggccaagcggtcccaggcggtcgccgtgtgggcggagcactgtgaacgtgcccttttcatgtccggaacccccatggagaaccgggtcgtggagttccgcaacctggttgcgatgctggaccccggtgtcgcggactccctgggcgagggggaggtgctggccggatcggtcgccttccgcaaggccgtcgccccggtctacctgaggcgcaaccaggaggacgtgctgacggaactcccgagcctccagcagaccgacgaatgggaggagttgagcgactcggacgaggaggcgtaccgcgaggccgtgcgcgccgggaacttcatggcgatgcgcagggccgcgtacgcgcgccccgagaagtcggccaaactggaccggctgcgggagatcgtccgggaggcgggcgagaacgggcagaagacggtggtcttctcctacttcaaggacgtcctggacgtggtccgtcagacgctcgccggggccgccgacggcaccgcgctgttcgggccgctcagcgggagcgtcccggccggccggcgccagcagatcgtcgacgacttcgccgccgctgccggcccggcggtgctgctggcgcagatccaggcggcgggcgtcggcctcaacatgcaggccgcctccgtcgtcgtcatctgcgaaccccagatcaagccgaccatcgagcaccaggccgtcgcccgcgcccaccgcatgggccaggtcagaccggtccgtgtgcaccgcctgctggccaccggcggcgtcgacgaacgcatggtgcggatgctggaggagaagacccgcctgttcgacgcctacgcccgccgcagcgccgtggccgaagccaccccggacgcgctcgacgtctcggacgtggagctggcccgacggatcgtcgaggacgaacaggcacgcctcggaatgctcgacggagggaccacggccgccgggtgagcggaggatcgccccgtcccggtcctggcccgcggcggaggctccgggctgtcaaccggtccgcgacggagccctccgcctgtcatccggcccgcggcggggtcttccgggctgtcatccggttcgccgcggagctttccggctgtcattcggcctgcggcggggccttccggctgtcaaccggtccgcggcggggtcttccgggctgtcatccggttcgccgcggagctttccggctgtcatccggcccgcggcggggt

SEQ ID NO: 1742 - DNA, 597 bp, Unknown
  Kingdom: Bacteria, Phylum: Actinobacteria, Class: Actinobacteria, Order: Streptomycetales, Family: Streptomycetaceae, Genus: Streptomyces
ggcgctgcacgcgggagagggcgacgagttcctcgaaccggtgggcgtccaccagggactccggcatctgcagctcgtacgcggtgccctgcgtggtcagctcgatcccgtagtcccgcgcaccgtgcgcggcgagcagggcgcgcagccgcgagacgtggccctgcaggaccgtcttgaagtgggtgggcggctcgtcctcccacagcgcggccgtcagctggtcgacgctgaccgcggtgttgggccgcagcagcagcatggccagcaggctggagcgcttgacggggccggggaccaggtctccgttctccgtgatcacggcgacggatccgagcagccggaactccacctgcctgacacctcctgatccgcggcccgtcccgtgccgaggatacgtggggacgaccgggacagcgtccgccacctgacgtccatcgaggacgagcacggcgcccccggcgcccccgtccacgaactcgtcgaacccgcccgctcctacgcccccgccggcatcttccgcggcagcctcaagcaccccgtgcccttcgagatcacctggacctcggcaggctcaccccgccgcgggccggatga

SEQ ID NO: 1743 - DNA, 3941 bp, Unknown
  Kingdom: Bacteria, Phylum: Actinobacteria, Class: Actinobacteria, Order: Streptomycetales, Family: Streptomycetaceae, Genus: Streptomyces
ggccgtccgggtgccgggggcggcggtgcgctcggcgtcgaacagcgactgcgccatgccgtacggcgccgagtacgggcggtaggtcttgcggaacgtgatcaggtcggtgtcgacgccggggacgacgacggagatccgccgggcccggggcaggtcgccgaagacctcggcgatccggccggagccggccgggtcgaaggcgaggatctgacggcccggggtcatcaggttgccgaagcgctgcatccgccggcccgcggcctgctgtccggcgggggagagcctgctgtcgtgcgtgcgcgcctgctcggcgtcgcgcgcctggccgagcgcgatgtggttggccaggtagcgcagcgggatcggggcgccgttcatgttgccgaccgcgagcgggtagcggtgggcgagccgggtgcggtcctgggcgctgagcgaggcgaagaagcgggtcagccgggcggggtcggcgtccgggtccggcagccggtgcccgtgcaggcggccggtgtcccaggcggacagggaggcctggagggcggtggtcccgcggtggtggcgcacggcggtccagccggtggtcgccagcatcacgaagaccacggccagcgcgagcagcgcgcgccagacgttgagctgcggggaggtctcgaaagaagtcactgggaggacacactaggagaacgaggcggtctcgcgttaaccgagtgacgggtatcacgtttcgcgtggcgtgacgaagttctccgaccgtacacacgttcaagatcggtggcgtgtacggcagttcatgatccgcggctcaagtgccgctgggtgcgggaggggtggtgcgccagtccccggccagcgccggtcccacctgatcgaggtacgcggccgtgagcgcgcggatggcctccaggctgagatccgggcccgtgctccactgacggcccgtcacccgcatcgccccgccgaagacggccaccagcagccgcgggcgcggatcggtgtccacgtcgagcccctcgcgcgcggcgagcagccgcgcgatctgctcctcggtctccaccgaacggcgcaggtgcgcggcgagcagggcgggcgtcgactcgatcacctggaacatgcgcaggtacagcgcgacgggcacgacgctcagcacggcgtcgctgatcgtgtcccagccctccatgaccgcccggcgcagcgcctccagcggcgcctcctgggccgggcgggcgcgcagcgcctcgacgaagtgcgcctcgaccatgtcctgcacggcgaaggcggcctcctccttgccggggaagtagcggaagaaggtgcgctgggagacgccgacggcctccgcgatgtcgtcgacggtcgtgcgctcgtagcccactgtggtgaacagctccagcgcggcgcgcagcagggcgtcccgggtgcgttgtttcttgcgctcgcgcagccccggccgtggtgccgcctcggcggtccccgccgtctccatgtacctcagtacctctccggacctctccaggtacccatccggacctctccagcgaactgtttccgcagttcagcccaagttcagcctataggagggtgaagtgtcagttaccgactactgaattcgtttgtcatttgtcagtggctgacattagcctcgaatgtatgactagtcagaccaccgtcgacacgacagggccggggggcaaggcgtcagccctgtcggaccccgcaccggccaaggggatgcgcggacacccgtggttcacgctgatcaccgtcgccgtaggggtcatgatggtggccctcgacgggaccatcgtggccatcgccaacccggccatccagaaggacctcaaggcgagcttcgccgacgtccagtggatcaccaacggctacttcctcgcgctcgccgtctccctgatcaccgcgggcaagctcggtgaccgcttcgggcaccggcagaccttcctgatcggcgtgaccggcttcgccgccgcctccggcgccatcggcctgtcgaacagcatcgccatggtcgtcaccttccgcgtcttccagggcctgttcggcgcgctgctgatgccggccgcgctcggcctgctgcgggccaccttcccggccgagaagctcaacatggccatcggcatctggggcatggtcatcggcgcctccaccgcgggcggcccgatcctcggcggcgtgctcgtcgagcacgtcaactggcagtcggtgttcttcatcaacgtgccggtcggcgccctcgccctcgtcctgggcacgctgatcctgctcgaccaccgcgcggagaacgcgccgcgctccttcgacgtcctcggcatcgtgctgctctccgccgcgatgttctgcctggtgtgggcgctcatcaaggcgccggcgtggggctggggcgacggcaggacgtgggcgttcctcgccgggtccgtcctcggcttcgcgctgttcgcgttctgggagacgcgggtcaaggaaccgctgatcccgctcgccctcttccgttcggtgccgctgtccgcgggtgtcgtgctgatggtcctgatggccatcgccttcctcggcggcctgttcttcgtcaccttctacctgcagaacgtgcacgggctgagcccgatcagcgccggtctgcacctgctgccgctcaccggcatgatgatcgtcggctcgccgctcgcgggcgcgctgatcaccaaggcgggcccgcgcatcccgctggccggcggcatggccctcaccgccgtcgccatgttcggcatgtccacgctggacacgggcacgggcagcgccacgatgtcgctctggttcgccctgctcggcctcggcctcgccccggtcatggtcggcgccaccgaggtcatcgtcggcaacgcgcccatggagctgtccggtgtggccggcggtctccagcaggccgccatgcagatcggcggcagcctcggtacggccgtgctgggcgccgtgatggcctccaaggtcgacaacgacctggccggcaactggaaggacgcgggtcttccgccgctgagcccggcccagtcggcacaggcctccgaggcggtccaggtcggcgtcgcgccggtgccgaagggcgttccggcggaggtcgccgcgaagatcacctccgtcgcgcacgacacgttcatctccggcatgagcctcgcctcgctggtcgccgccggtgtcgcggtggccgccgtcctggtggcgctgctcaccaagcgcggggccaacgcggaggcgggcgcgggcgtcgggcacatctgaccggagcggacccgcgcgctcaggcgcggacccacgcagtccggcgggcgcggtccggtgcgggtcggcgcggtccggttcccctatcagggtgaccgcaccccggaagcgtcgcctccggcccgttcggcaggtgacagtgggtcaagtcctccgcaggggaacggaggtgacgggcgtggcgcgctgctggaggggggcagcgcgccctcgcccggcccggtcacggacgggggtgcgataacccggcccggacgggggtacccgctgtggtgaaccccgaaggaacctggaactccaacccgacccggggttcagggagttgatgatggcgggcttcggacacggaacgcgcgggtacccccgctcgcggggccggacgtggcatcgcgaggggccggaccgcgcgacgctcggaatcatcggaacagtgtgcgcggtcgccgggttcttcgccctggggatcgtgctcggcccggtggcggtggcctgcggctggctggccatgggccgcagctggacgggcgcgagccgctcggtcccggcgctggtggccctggcgctcggcgccgtcgacacgctcctggccctggtcgcgctcgccggagcggcgacctggggccacggcgtgttctgacacgcggaagcgacgcacgccgaaggggcggtggagc

SEQ ID NO: 1744 - DNA, 1135 bp, Unknown
  Kingdom: Bacteria, Phylum: Actinobacteria, Class: Actinobacteria, Order: Streptomycetales, Family: Streptomycetaceae, Genus: Streptomyces
ggagcgcgcccaggagcgaatacgacgccggggcggcgcggggcggctttcgcacccctaggttcccctgtgaccgcctaggttctccgggcctgccgaacctttcgggtcttcaggccctgcgcgctcctctcctcggtgaaggggcggccgtcaggccgggcgcttgaacatccgcgtggcggtgatctcgctgtgcaccgtttccccggccggggcctgctgcgggagtccgggccgcaggtgttcctccacgctgatgtacttcagtccggcccgcaggtcggcgtcgttgcgcagccggatgaccagcgggaactcggccagcgcggtcgtgtcgaacaggccggtggtgtagaggagctggacgccgagcgcgtcggagacggcgcgctgcagctccagcaggtaggtggcgttggcgcggccgatgggattgtccaggaacagggtgcccgcgtggcggtgcttgtcgcggccccggtcgttggagcgcaaggcggccatcgtgcagtacagggcgatggccgcggtgagcagctggccgcccgagaagacgtcgcccatctgcccgacgggtacgcgctcggcgcgcagcacggcgtccggcttgaggatctccacggcgacgcccttgggctggagggcggcggccacaccgcgcagcagcagggacatgccgtcgcggcgcaggtcggagttcttcttgacggcggcgcgggtcgcctcgtcgatgacctcgccgaggcgttcggtgagggtggcctggtcgggttcctcgaagcggatgcgcaggaactcctgcccggaccactcgccgagcccttcgggcaggcgggacaggcgctgggcggagcggagcgtggcgagcgccgactccacgaggccgcgcaggcggtccacgatcgagtcgcggttgcgttccagctgggccagttcgtcggtgaggacgcggagccggggtgcgaaggcctcggcccacttgcgggcgtgttcgggcagggcggcggcgggcagttcgcggatctgctgccgggcgggcgtccgcacctgctcgtagcgggtggagttggcgtgccggacgaggacgtcgctcgcctcgcgcacggcggattcggcggcggacaggtcggcg

SEQ ID NO: 1745 - DNA, 622 bp, Unknown
  Kingdom: Bacteria, Phylum: Actinobacteria, Class: Actinobacteria, Order: Streptomycetales, Family: Streptomycetaceae, Genus: Streptomyces
gctgggcggcgcatcacgggtgcccgcaggtgcggctgctcggccgggtgggcgcggacacggccgcctggcacgagcgggaactgaccgcttcgggggtgcgtccggggctcgtcgtggacccggaagcaccgaccggcacggtggtctgcctggtcgacgatgcggcagcggccgagcggacgttcctcacggacagcggggcatcgttgcggctggagcccggcgactggtcggacgtgctgctcgacggggtggcccggctgcatctgtcgggctacctgctgttctcccggccgagccgggcgttcgtggcagtggccgtcgcatcggcacgcgcgcgtggtgtgccggtgagcctggatccggcctcggcgggtttcctggcggcgctgggcacggaccggttcctgaccctcacgaaggaggtggacgtcctgctgcccagccgcgacgaggcgtgtctgctgacggggctgtccgatccggcggacgccgctgccgagttgagccggcggttcccgctggtggtggccaaatgcggccgggacggtgcgctggtggcccgcgcgggggccgtgtgcgcccgggtgcgggcccggcccgcggtgccgatggacac

SEQ ID NO: 1746 - DNA, 1009 bp, Unknown
  Kingdom: Bacteria, Phylum: Actinobacteria, Class: Actinobacteria, Order: Streptomycetales, Family: Streptomycetaceae, Genus: Streptomyces
ccccccggccgtcgaacccctccagctcacggaaccggagcctccgtcacccgtcgttccccgccccgtaacccttcaacaggccgcgctcacagggctcatgacggggccggtcacggggcgcgtggcggacaggtaacgaagtcgtgccggttggcgcgtccgcctggatttcgcccgaggtgtgccggttacactcgcccggctgtacgaaagatgatgttgacggggtgagttctttccgatgagcgacgccagcacgacccagccgcttccgaccgacgcccagaaggccgagggccacggcaagcaccgcggcccggtctcctcccgagacggcgagacggcccccagcggccggcaccgcaagacgggccaggagcagaccgaagtggcggcctgacggcacggagagcgagacacggccctgtcctccccggaggacggggccgttccgtttcccggccgggctgctcagtcgtgcgcgacgaccgtatcggccagtacggccgcgtcgccccgctcgaccgtactcaccgccacccgaaccacgcccggccccgaggccggcggcgacggccacatgcgcacgcgcagcgtctcccccgggtacaccaccccggcgaagcgtgtggcgtaggagcgcacgcgggtcacgtcaccgtcgagcagcgtgtcgacgaccgccttgagcgtcatgccgtacgtgcacaggccgtgcaggatcggacggtcgaacccggcggcccgcgcgaagccgggatcggcgtgcagcgggttgtcgtcgccggtcaggcggtacagcagggcctggtcctcgcgcacccgcagctccaccgtgcgcagcgcgtcgccggtgggtgccgcccgccgggcggaggggccgcggtcgccgccccagccgccctctgagcgtacgaagacccgcgcatcctcggtccacagcggaccgccggggccggcggcgtcggtgcgcaggacgaggacggccgccgttcccttgtcgtac

SEQ ID NO: 1747 - DNA, 1656 bp, Unknown
  Kingdom: Bacteria, Phylum: Actinobacteria, Class: Actinobacteria, Order: Streptomycetales, Family: Streptomycetaceae, Genus: Streptomyces
gcgccgaggagttcgtgttcgggttcctcggcgcccgcggcccgcatgtcgcgcacgacccccgccagcctgtccacgcccccggcaccgcccgcggcgaacccgtccgcgaggcgcaccatcacgcgcagcgggatgtcgacggcggcgcggatcgcggcgacggtcgcgaccggcggggtgagcccgtcggccgccatgtcggtgaccagctcgaggcggtccgcgcctccggcctgggcggcgaccgcgtcctcggcgtcgagggcgatcacctccaggactgcacgcatgctcataggacccctttcctcggattcccctggagcttgacaggtctagtccaatatcagggtacgccgaacgggcccccgagcgcagaaccggtcggcagaaccggccgacggaatcggggaccggccccgccgaagaaacccgccgaaggaacccgccgaaggacccgtcaacggaaacggggagcaggacccgtcacccgaagatgttcagctcgctctcccgggcacccgccagctcgtagcccgtctcgcgcaccggacggcccgcgcagagccgtacgagcgtggcggcgtcgccgatgtagcgcgccggggtccgctcgccgctcacgtcgccgagccggagcggttcgtcgacgtcgtccaggtcggcgtggagcggcaggtggcccctctcccgggtgaggcgggcgagcagcggcagcgcgtacggcagccccgccccggcgtacgcgcccggcgcgccgaaggcgtcgcgcacgtccccggcgtgcacccactcgcccagcgcgagcacgtccagcttcccgcccgccgccgcgatcagcggcccggcctcgctcatcccgcgctccagctcgtccaccacctgcgcgtggctccagtcggcccgctcggcgatgtcccgcgcgttggacgcgggcgagaagacgccctcctcgaaccggctctccaccacgcgcgtcagcgcggcggagcagtgcgcgagcacgtcccgcaccgtccaccccggacacccggcggccggcagcgcgaagtcggcctccggccgcgcccgcagcaacgggatcagcgcgtcccgctccatggtgagcagccgcccgggcagctcggggtcccgtacctcgtgcagcagatcagcagaagtcatggggtccacgctagggcctgcccaggtgttccggcccggtgttccggcccgccccgcgacgggacaatgagcgcatggccgatcatgtcgacatcgaagccctgcgcatccgatggacccgcgccctggacggcgcccgtggccccggtggcggaccggacccggtgccgtacgccgacaacctgctcgcccgctggcgggaaccgcagcggcactaccacacgctcacccatctcgccgcggtcctggaccacgtcgacgtactggaggagtacgccgaggacccggacaccgtccggctggccgcctggttccacgacgccgtctacctgcccgaacgctccgagaacgaggagcgctcggcgcggctggccgagcgggcgctgcccgaggccggggtgccggcggcgaagaccgccgaggtggcccggctcgtccgcctcaccgtcggccacgacccggccggcgacgacagcgacggccaggtgc

SEQ ID NO: 1748 - DNA, 1679 bp, Unknown
  Kingdom: Bacteria, Phylum: Actinobacteria, Class: Actinobacteria, Order: Streptomycetales, Family: Streptomycetaceae, Genus: Streptomyces
tgcgtcgtggcggccgccgccgacctcgccgccctgctggccgaggcggttccgccgagcccactcatggcgtcgagccgctgcagggcgatgctgttcgccgccgtacggggaccggacgcgaacagcaaactggccacgttcatggcgtaccacgatgagtgcctgataccgcccaacccgctgcccctcccgccggaactggccgtcctcgtcgtggtcgtggccggatgcctgctcatgtacggactcacgccctacgtgatcatcctgcgccgcggcctcgtccggatcgaccggatgcccaagttgagccgggaactctcccgcctggcgcggaccgccggcgtccgggtgcggtttctcgccgacccgctcaaccccgggatcggcggcctcgccttcggacacgtgggcgcccgccacgtcgtgctcaaccggggactgctggcgctcgcccggaccgaccggcccgcgttccgtgccatcgtgctccacgaactcgcccacgtccgcggcggcgacctcgacgtcagctacctcacggtgatcctctggcgggtgttcgtgggggttctgctgctgcccctcctgctcctcttccacaacaaggtcgacggcgtcgaccagtcaccgctgggcggcgccggtttctgggggcagctgctcgccctcgcggccgtggtcctcctcaaccacaacgccgtactgcgcgaacgggagttgttcgccgacgtccgcgcggcgcactggaacggcagcgggaaaccgctgctcgcggtgctcgcggcagccgaggcggcccagagcggcggcggcgagcgcggggcgagcgaccgccaaaagccgtgggggtggccgtggttgcgccgtctgctcgccttccatccactgcccgcggcacgccgccgggccatcgccgatcccgccgtggcgctggcccccagcgtgtggcagtgcttcgccgtgggtctcaccatcggcctcacctgggccccggtgctcaagaaggtctcgctgggcctggcgcacctcggagtgcccccggccatgcggtcgttctccctggaggccatgacggccctgcccgtggcggtcgtccccgccggtgccgtggtggccctgggcgtgtggcggacgttgctcgggcggtacggcccgcgcccgctggtcaggtcccagctgttcggtgtcgccgtgggcgcgggcatgacggccgcgggtctcctcaccgaccaggatgccttcctggggccgtacctgttccgtctgcctctgccgacgcgcgtcgcgtggtgggggctgctgatcctgctgagctgtgtgtgcgtgctctggacggccctggcggccctggcgtggcggccggcgctgcggggctcccgatcggcacggatcgtgtccctgctcggttcgtcgctgggcgcgacggtgttcggtctggtgctgtcctgggcgttcagcctgcgggtcgaagtggacacgctgggccttccgccgcgcgagttcctgcggcggtcgctgcacggtgccgcacccctgctgtccctcttccccggccgcgctgtgacggtcacgctcctggcgctgctggtcgccttcccgttcgccggtctcgcctccgccgcggtggtccgtcttcgcggccgggccggcggggccggctgaggggggacgct

SEQ ID NO: 1749 - DNA, 1162 bp, Unknown
  Kingdom: Bacteria, Phylum: Actinobacteria, Class: Actinobacteria, Order: Streptomycetales, Family: Streptomycetaceae, Genus: Streptomyces
gggcctctcctgtggggggtggcggccccgcgtccgggaccgccgaggcaacggccggggccgccaccccccacaggagaggccccggccgtcgcgcggcacgggccgcgcggcggcccgtatctccttcagcgtcatgagtgcgttttctgtcacacctcgcctacggagtggttggttgcacgttgtacggtcatggacgagaggcggttcaagccgtaacgtgcctttcgcgccgggcgcggaagatgcatgatcaccgcacgtccgacggccgcgacgccgcgacgacgctgcccgatctactgaggaaccacggggtgctgggggacgacgcggagctgaccgccgcggtgcttgccgcacagaccggggacgagaccgcgttccggactgtgtaccgcgccgtgcacccgcggctgctcggctacctgcgcaccctggtcggcgaaccggacgccgaggacgtggcgtccgaggcctggctccagatcgcccgcgacctggaacgcttcagtggcgacgccgaccgcttccgcggctgggccgcgcggatagcccgcaaccgcgccctcgaccacatacgcatgcgcggccgccgtcccgccatcgccggcgacgaaacggaactgaccggcagggccgccacgtccgacaccgcgggtgaggccatcgagtcgctcaccaccggcagcaccctctccctgatcgcgcagctgccccaggaccaggccgaggcggtcgtcctgcgcgtggtcgtgggcctggacgccaagaccgccgccgagacgctcggcaagcgaccgggcgccatccgcaccgccgcgcaccgcggtctgaaacgcctcgcggagctgctcggcgacgatccggaatccgtggacgcgctcagtaccatgccgcccccgcgagaaccacgcggccacgcggtgacgtccgccggtgtgacgcatacgcgcgcccggacgcagaaggacatgtgatggccgacgagcagtaccgatggctggaccgcgacaccgcggagcgcctgctccgcggagagccaccggacaccgtcgacgtcaccgtccgtgaccaggcggaacgcctcgccgacgtgctgaaggcgctgtccgcccaacccgccgcgcccgctgccggggccgccgccgaactgccc

SEQ ID NO: 1750 - DNA, 910 bp, Unknown
  Kingdom: Bacteria, Phylum: Actinobacteria, Class: Actinobacteria, Order: Streptomycetales, Family: Streptomycetaceae, Genus: Streptomyces
  misc_feature (369)..(370): n is a, c, g, or t
cgctgctgctggccgccggagagctggttgggccggtgcttgagccgcccggccaggcccaccgtctccaccacccggtccagccaggcccggtccggcctgcggccggcgatgtccatgggcagggtgatgttctcgagcgcgctcagcgtcggcagcaggttgaacgcctggaagatgaagccgatccggtcccggcgcagctgcgtgagcttcttgtccttcagaccggtgatctcggtctcgtcgaggtatatccggccgcccgacacggtgtcgagaccggcgaggcagtgcatcagcgtggacttgccggaccccgaggggcccatgatcgcggtgaactggccgcgggcgatgtccacgtcnngcgcggcgacggccgtgggatttccagtacccccgtgcctgggaatggtcacagccgatgtcacggtacgtctcctatgtcggtcttgctgcgagcagggttgcgcggcgatgggtcgtgagctgggtgcgggagcggcgctccggcacgacgacgagtctgctgtgcgcatgccccccggcgcgctggtgctcagcgcagtcttccgctggggaaaaccccacccccgtcggtgcggtccaccgccccccagcggcgtaaagccagattaaggacggcttccggtcgtcacgtcctccgtcggtacgacccctccccgaccccgagtacggagctacccctaggggctgtccaccgacgggcggagtccgtctcagggttgtctccacccaccggcccagcgagcctccaccctgtgacgtcgggccgcgggccgccgctactccgcccgcgcgcggcccgtcagtgcgctgatgtcgccctgcacggtgtccatctgcgtccgcatgcggtcccagagttcaccgtgttcgcgcagcg

SEQ ID NO: 1751 - DNA, 757 bp, Unknown
  Kingdom: Bacteria, Phylum: Actinobacteria, Class: Actinobacteria, Order: Streptomycetales, Family: Streptomycetaceae, Genus: Streptomyces
gacgtctcccacctcgactccggccggcggcgcgtcgggaaccgcgtcccgccgcccggcggagtcgaggtgggagacgtccacgcggatgcggcagccgcgcgcgacgccgatcaggctgccccgtgagcgcggacgaggtcgaagccgaggtgcccgccgacgggttcgtgcaggccggggtggccgggtcgggccgggtgaccgtgctgtgtccgggcgcagccacaggccggcaccggcgcccggatcatcccgtaccgtcgagtacgtcgtcgtgccacaggcggcgtcgcaggaacgccgtgtggggcaggtccacgggccggtgggcaccgggccgttccagtgcggcccagtcgatggcgagtccggcgagccacaggcgggtcagctgggcgaggcgcccgccgcgccacagtgcgtcgaggaagtcgcgggtctccggcaccgcgccgaggccgagcgggtcgcttccggcgggcggttccacgtcacccgactcggtgaactcctgtaattcttcgatgagttgggcaacggtacggacggtcagggcgaggcggcagggcagcgcggagcgggtggcgcgggtggctgccgccagctcggcgagggccggccgcgcggcatcggatccgtccagccacgtcgcgaagcgggacgcggtggcccgcaggtgggcgggcgacggcgcggagagcagcaccagctcctcccccgcggggacggcggccccggcgcactgctccccggc

SEQ ID NO: 1752 - DNA, 2929 bp, Unknown
  Kingdom: Bacteria, Phylum: Actinobacteria, Class: Actinobacteria, Order: Streptomycetales, Family: Streptomycetaceae, Genus: Streptomyces
gggccggacggacccggcgcgtcgtccgcggcagggccgccaggcccgtcaggcccgaccggggcgttcgcatccccgtcgtacgcttccattccgccccgtctcccgattccggtccgtgtcccggccgtgcgtccccgggccacccggaggacgccgggcgcagccgtagcacctcgaccgcgtcgcccgggacccgggcgacgcacggaacggtactcagggccgcccgcgcggcacagcccccgctcccgctcggccccggtccgcttccgtaccgctctgccgactgcccgcacggcccccacaggcgcgccgccgaccggcgttatccgctctgtccacaggtcccgcccgcagttgtccacagttgtccacagcggttgacaccctacggcggcgggccgcaccatggaatgcgaccgaaccgaacgatcggtcgggagaatacggagcagccgaggtcaagggggaccgcatggcgacagcagccgcacagcagacggtcggcgcggcggcgtgcgacgcgccggacaccgctgcggaagccgacgcccgtcggcgcgccttcgacgcgaccctggccgcggacgagcgcatcgagccgcgggactggatgcccgacgcctaccggtcgtcactggtccgccagatcgcgcagcacgcgcattccgagatcatcggcatgcagccggaggccaactggatcacgcgggcgccgtccctgcgccgcaaggcgatcctcctggccaaggtccaggacgaggcgggacacggcctgtacctgtacagcgcggccgagaccctgggcaccagccgcgaggaactgctcgacagactccacagcggccgccagaagtactcatcgatcttcaactaccccaccctcacctgggccgacgtcggcgcgatcggctggctggtggacggcgcggcgatcaccaaccaggtcccgctgtgccgctgctcctacggcccctacgcccgcgcgatggtccgcatctgcaaggaggagtccttccaccagcgccagggctacgagctgctgctcaccctcagccggggcacgcccgagcagcacgcgatggcgcaggacgcggtggaccgctggtggtggccgtcactgatgatgttcgggccgcccgacgacgcctcccagcactccgcgcagtccatggaatggaagatcaagcgccattcgaacgacgagctgcgccagcgtttcgtcgacatctgcgtcccgcaggccgagtccctcggcctcacgctgcccgacccgcacctgaagtggaacgaggagcggggccaccacgacttcggcaccatcgactggaccgagttctgggacgtcctcaagggcaacggcccgtgcaacgagcagcgcatcacccagcgccgccgggcccacgacgagggcgcctgggtccgggaggccgccgcggcccacgcggccaagcacgccggcagcacgggacacgacggcgggacaggagcggagcaggcatgacgaacaccgactggcccctgtgggaggtcttcgtgcgctcccggcgcgggctgtcccacacccacgccggcagcctgcacgccccggacgcggagctggccctgcgcaacgcccgtgacctgtacacgcggcgcggcgagggcgtctcgatctgggtcgtcccgtccgcggcgatcaccgcctcctcgcccgacgagaaggacccgttcttcgagccgtccgccgacaagccctaccggcatccgaccttctacgagatcccggaaggggtgaagcacctgtgacgcccgccgtccccaccacagccgcgaccacggccacacccacggccacggcggcgctggccctgggcgacgacgccctggtgctctcccaccgtctgggcgaatgggtgggacacgcgcccgccctggaggaggaggtcgccctcgccaacatcgccctcgacctgctgggccaggcccgcgtcctgctgtccctcgtcggcgacgaggacgaactggcctacctgcgcgaggagcgcgccttcaccaacctccagctcgtcgagcagccgggcggcgacttcgcgcacacgatcgtccgccagctctgcttctccacgtaccagcacctgctgtacgcccgcctggccgaggcggaagggcccttcgcgccgctcgccgcaaaggccgtcaaggaggtcgcgtaccaccgcgaccacgccgagcagtggacgctgcgcctcggcgacggcaccgacgacagccacgaccgcatgcgccgcgccctgaccgcgctgtggcggttcaccggcgagatgttccagccggtggcgggactggacgtcgactggcccggcctggaggccgactggctggaatccgtcaccgccgtgctggaccgggccacgctgacgctgcccgagggtccgcggaccggggcgtggtcggcgggcgcgggccggcagggcctgcacaccgagccgttcgggcggatgctcgccgagatgcagcacctgcaccgcagccacccgggggcgtcatggtgaccaccacgaccccgctcgaagccgaactgctgcggctggccggctcggtgcccgacccggagctgcccgtgctcaccctggaggaactgggcgtgctccgcgcggtgcgcctgcgcggcacggacgcggtggacgtcgagctgacccccacctacaccggctgcccggcgatcgaggccatgtcgctggacatagagcgggtgctgcgcggccacggcatgcgggaggtcgccgtacacacggtgctctcaccggcctggtcgacggacgacatcaccgccgaagggcggcgcaagctgcgggagttcggcatagcgcccccgcgcgtccgcacgccctcggcgcccgtccccctggaactcggcccgacccgcacccgcacggaccggaca

SEQ ID NO: 1753 - DNA, 506 bp, Unknown
  Kingdom: Bacteria, Phylum: Actinobacteria, Class: Actinobacteria, Order: Streptomycetales, Family: Streptomycetaceae, Genus: Streptomyces
gctggtgggtgcccatgcccaggagcagctgccgctgcgcggaccgccggccgccgtcctcggccgggctctgcgagacgctgacggtccggaccgcgcggccccgggcaggggtgtccacgccgtccgcgaccagtcggcggatctgctccaccgggaccgtgtgcccgtcgagcgtgcggatctcgaaggagccggagcggcgggagcgcgaggggcgcggcagcagccgcgacaacggcgtccggccccgtcgcgggccgcccgcgacggccggggtcacgccgtgcggggagaccacgacagtgcccggggcagcggtcgtgggggcgggggccaccgggtccggtgcgtccgtaccggactccagacgcacgtcgaccgccggctcgtccccgtcggcgtcctgccggacaccggcggccgttgcccctggtccggcggtgtgcccggcgccgagaggcgcggggagggcggtcacgtggtccgcggccgggttctccggc

SEQ ID NO: 1754 - DNA, 732 bp, Unknown
  Kingdom: Bacteria, Phylum: Actinobacteria, Class: Actinobacteria, Order: Streptomycetales, Family: Streptomycetaceae, Genus: Streptomyces
gagcgggaggacgcgctgttccgcgacccgctggcacaggccttcgccgccgccggcggactgtggccctcctcgccgccgcccggtgacgaggccgcgcgacgccgccggcagggagtggcgttctccatcgtcatcaggacgaagttcctggacgacctgttgctgcgggcctgcgcgtccggggtccggcaggtcgtgctgctcggcgccggcatggacagccgggccttccggatggactggcccgagggcacccggctgttcgaggtcgacaccgccgcgcccctggagttcaaggcttcggtgctgcgccgggagcgggccgtcgcacgctgcgagcggatcaccgtcgcggtggatctgcgggaggactggccagacgcgctggccgccgcggggcacgacccggcggtgccgaccgtgtggatcgccgaaggactgctgatctatctgcccgaggacgcggtggagttgctgctggcccggatcagcgcgcagtcggcggcaggcagccggatggggctgacgttgggctcgcgcggcgtgatcgagcgcttcggcgcggacgccgtgccgggatcggcggcgtccatgtgggtctcggagatgcccgacgacccggtgggctggctggccgggcacggctgggaggccgacagccacaccctgcgtgagcgcgctgccgcctacggccgcccgatcagcaccccgccgcggagcgaggagcgg

SEQ ID NO: 1755 - DNA, 860 bp, Unknown
  Kingdom: Bacteria, Phylum: Actinobacteria, Class: Actinobacteria, Order: Streptomycetales, Family: Streptomycetaceae, Genus: Streptomyces
gctcggcggcggccttcctgcggctgtgcgaacgcgcaggcgtccccgtcgccgtgcccgacctgtccggcctgtgctgcggcaccccctggcagtccaagggctacaccgccggacaccgcaccatggccgcccgcaccctcgacacgctctggaaggccaccggccacggccggctgccggtggtctgcgacgcctcctcgtgcacccacggcctggagcaactcgccgacgccctcccggagtccgaacgctcccgcttcgcgtccctggacttcgtcgacagcgtcgtcttcaccgccgagcacctgctccccgcgctgcccgagccccgccgcctgagcagcctcgccctgcaccccacctgctccaccgtgcacctcggcatcgacgacgccctgcgcaccgtggccgcggccgtgagcgagcaggtcaccgtccccgacagctggggctgctgcgcgttcgccggcgaccgcggcctgctccacccggagatcaccgcgaccgcgaccgccgcccaggccgccgagatcaccgcgcgcacccacgacgcgtacgcctcctgcaaccgcacctgcgagatgggcatgacccgcgccaccggccgtccctaccgccatgtcctggaactcctcgacgcggccacggcctgacgcggatcacgcaggacccctccgccgccgtgcgccgcggagccgatgccgcgcacacctccgccgcgccgggcgcttccaggcgaacgggtgtcgcacgcgggtccgggggcatcggtgacccatggacacagcggcagtggcaacgcacggacgcgggcagggccgccgggcggccctgcccgcgtccgtgcgttgccactg

SEQ ID NO: 1756 - DNA, 979 bp, Unknown
  Kingdom: Bacteria, Phylum: Actinobacteria, Class: Actinobacteria, Order: Streptomycetales, Family: Streptomycetaceae, Genus: Streptomyces
  misc_feature (524)..(637): n is a, c, g, or t
ggccggaggactcggcggtgacgtcgtccacgccggcgaccacgagggtgtccccgccgcgttcgagcagcaggtggcggttgcgcagcggctcccagcccagctcgtccatcaggtcgacccagccctgggcctcgctgtagtactcgtggttgccggtgacatagacccgggcccgggtggcctgcacggtgccgagtggggcggcctgggcgcgacggcgttcggccgtgccgtccgcgatgtctccggtgtggcagaccaggtcggccttcagggtgttgaccgtctcgcagacccgcgccgaccagcgggcgcggtcgagcgggccgtagtgggtgtcggtgatgaggacgacgcgtgtgccgtccaaccctgctcccaagcgcggaaggtgcacgtccaggcggcgtacccgtggtacccggcgtgcctcggtgtacccccaggtgagcagcacggtggctgcgccgaggaccgcccaggtgacgatccgggcccggtcctggccgtcgccgacgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggcgaacagggcggtgccggcgagcgtgacagggagcggccagtgctggccggtgtgcagcagcagccagcagggcacggtccacagcaggacgggggcgatcagggggaggtagcgcatcaggcggtgcagtcggctctgccgagtcgcgtgcgccgcactgtcggcggatcgggtttcgctggtgtcggtcacgcttcccctcctcgatcaaccaggctgccgtcgcgcgcactgtatccggccgccccgggccggtcgcacggacggggtctcatggcgggcagccccatgtggcgaggtggtccccgagttcccccggctcccgcagtgggtgact

SEQ ID NO: 1757 - DNA, 984 bp, Unknown
  Kingdom: Bacteria, Phylum: Actinobacteria, Class: Actinobacteria, Order: Streptomycetales, Family: Streptomycetaceae, Genus: Streptomyces
gcagaccgagggggtagccgccccggccgcatgagcgtccgccgcctccggaccccgtgagcccccagccgccctcagccgagtggctctcccactcctcgcggccggcgcggctaccccctcggtctgcggcgcagcagatacgtgtccatgatccagcccttgcgttcacgggcctcggcgcgcagccgctcgatgcgtggcgcggcctcggcgatcgggccggaggccaggatctcctccggagtgcctatgtaggcgccccagtagatgtcgatgtcctggtcggcgtactcccggaacgtctggtgggcgtcgagcatcaccaccacgtcgtccactccgtccgggaacccctcggcgagccgtcggccggtggtgatctgcacgggccgggcgatccggttcagcccggtgcggtggcgggccaccagcgcggagacgctgctgatgccgggcacgacgtcgtacgcgaaggcgacggatccccgcgccagcacctcctccaggatcccgagcgtgctgtcgtacagcgccgggtcgccccagaccaggaacgcgccggtcccgtcctcacccagctcctcggcgatcagccgctcgtagacgtcggcgcgggcgctgcgccactgcccgacggcgggggagtactccgcgccgcccgctgtccggtcgcgctccgggtcgcgcgcctccaccacccggtacgcgccctccggcaggtgtgcgcgaaggatgtcccggcgcagccgcacgaggtccgccttcacctcgcccttgtccaggacgaagaagacgtccgtgtcgcgcagcgccttgaccgcctgcagcgtgagctgttcggggtcgcccgcaccgataccgatgacatgaatcttccgcacaccccgagtctgccgcagcccactgacaacgccggcaccggccgtcacgcaccggcggccccgccctaccggcggccccgccgcaccgagcggccccgcc

SEQ ID NO: 1758 - DNA, 2104 bp, Unknown
  Kingdom: Bacteria, Phylum: Actinobacteria, Class: Actinobacteria, Order: Streptomycetales, Family: Streptomycetaceae, Genus: Streptomyces
ccgcccatcccgccgcacgccaccctcgaccagatcgaggccgccgcgacctccgtcctcaagggcgacagcgaccgcgccggcatggtccgccagggactgaaggccaaggtgcaggagttcctgcccggcggcctcgatctggtcgagggtggcgtgcggcgggatgggcggcacggccgggtcggtgacgaagtccagcacgcacggcttgtcgctcctgagcgcgctctcccaggcgccgcggacgccgtccggttcctcgatccggatgccgttcaggccgagggagcgggcgaagtcggcgtaggcgacgtcggggatcgactgggagggcaggaactgcggggcgccggccatggcgcgcatctcccaggtgacctggttgaggtcctggttgttgaggacggcgatgatcaggcgcgggtcctgccactcgtgccagtacttggcgatcgtgatcagctcggccatgccgttcatctgcatggcgccgtcgccgacgagcgcgatcgccgggcggtcgccgtgcgcgaacttggcgccgatgacgtacggcaccccggggcccatggtggcgagcgtgccggagagcgagccgcgcatggccccgcgcagcttgaggtggcgggcgtaccagttggcggcggagccggagtcggaggcgaggatcacgtcgtcgggcagcaggtcgctcagggagtgggcgacgtactcggggttgatggggtcggcgtcgacggcggcccgccgctgcatcacctcccaccagcgcgagacgtccttctcgatggtcttgcgccagctcttgttcttgttggccttgagcagcggcagcagccgggtcagcgtcgcctgggcgtcgccgacgaggttcacctcgaacgggtagcgcaggccgaccatgtgcgggtcgatgtcgatctgcacggcgcgcgcctgcccgaactccggcatgaactgcgtgtacgggaacgaggagccgatgacgagcagggtgtcgcagttctccatcatctcgtacgacggccgggtgccgagcaggccgatggagccggtgacgtagggcaggtcgtcgtcgaggacgtccttgccgagcagcgccttggcgactccggcgttgagccggtcggccaccgccatgacctcctgccgggccgcgcgggcgccctgcccgacgaggatcgcgaccttctcgccggcgttgagcacctcggcggcgcgggtcaggtcctcgtcggaggggaccggcgcgtagtgcggcatgccgaggctggaggggaccatcttgaaggcgtgctcgggcggcgagtagtcgagttcctgcacgtcggcggggatgatgacggcgcacaccgagcggcgggccatggcggtgcgcatcgcccggtccagcacgttgggcagttgttcggggacggtgaccatctcgcagaagtcggaggccacgtccttgtacaggctcagcaggtcgatctcctgctggtaggagccgcccatggcgctgcggttggtctggccgacgatcgcgacgaccgggacgtggtcgagcttggcgtcgtacaggccgttgaggaggtggacggcgccgggtccggaggtggcggcgcacacgccgaccttgccggagaacttggcgtagccgacggcctcgaaggcggccatctcctcgtgccgggcctggatgaagcgggggttgtcgtcggccctcccccaggcggcgagcagcccgttgatgccgtcgccggggtaggcgaagacgtgctccacaccccagtcgcgcagacgctcgaggacgtggtcggagaccttcttcgacatgttcggaaaacctttccggagaggtgcgttcagagggctcggtcggggcggcgcagccgtcgggcggccgtccgggcgccttgccgggctgcttcccggccggcggctgcggcggccgtcgcggtgagggccacggcgcccgcgacgcccgcggtggccgcccaccgggccgcgcgggagggcccggcgggccggacggccagccgttcgggctgctcctggggcaggttcccgtccaggccgagggcaagcacctcggcgaggtgcagggcgcggcggccgg

SEQ ID NO: 1759 - DNA, 973 bp, Unknown
  Kingdom: Bacteria, Phylum: Actinobacteria, Class: Actinobacteria, Order: Streptomycetales, Family: Streptomycetaceae, Genus: Streptomyces
cgggcggcggacgccctgagctgggcggcaccgggccgggccgccgcccgctgccaccgggcggcgcgcgcccgaacatgccccggcagcggccaccggaaccccgctgacgtcacagtccgccgcgcgtcactgcttgtcgtacgtcaccgcttgtcgtacgtcaccgcttgtcgtacgtcaccgcttgtcgtacgtcaccgcttgtcgtacgtcaccgcttgtcgtacgtcaccgcttgtcgtacgtcactgcttgtcgtacgtcactgcttgtcgtacgtcagtttctcgccgctgtccttgttgatgcgctggaggccgccgccgggcagcaggacgatccgcgtggccgcgcccggcttgcacgaaccgcccggcccggacgtcaccgtcgagggaccgatctccagcgagccgtcggcgtccggctccccggcgagccgggcctcgaacacgcagtggtaggtggcaccggacccggtgggaccgtcggcgaccagcgtgagcacggtgtccccgaccgcgccctgggtgatggtgagccgccgggggttcgcgccgagcgcgctgtcgatcgacgacctccaggtgccgaggtatcccgtggggatggcaccgtccgacggcgtgggcgagtcgggcgcggaggtcgtcggggacgggcctgggccggtctcggtggatgcggtgaccgtcggggaggggcctgggccgccgcggtcgtgccggccgccgccctgcatcagggcgtagaccgagccgcccgcgccgagcgcgaccacgaccgccacggcgacgagcgccgccgtggacagtccgccgcggcgcggtccgctctgcgccgggtacgccgtgggcccgaacggcgtggattcgtacggcgtggactcgtacgacgtggactcgtacggcgtcggcccgtactgcggatgtccgtgcggtgtgtgtccgtactgcggatgtccgtgcgg

SEQ ID NO: 1760 - DNA, 2139 bp, Unknown
  Kingdom: Bacteria, Phylum: Actinobacteria, Class: Actinobacteria, Order: Streptomycetales, Family: Streptomycetaceae, Genus: Streptomyces
cgagcgccgcgcccaggccggccgcggcgatgaggttgtgcccgcacgcgtgaccgaggccgggcagggcgtcgtactccaggggcaacgcaacggcggggcggccctgacccgagcgggccgtgaacgcggtcggcatgcccgccaccccgcgctccaccgcgaaaccggcctcttccagccgggccgtgagcagggcggcggcccggtgctcggcgaacgcctcctccgggtcggcatgcagcgcgagagcggtctcccacagcgcatccgcccgctcggcgacctccgcgcgcagcctgtcgtgcacggcagggccgagcccgtcgtcgccgccccccacgtcgtcgtacgtacgggccacctgcgcctcctcgtgccgctgtccggtgccgcggaacgggtgccaccgtccggcgccgcgacacccgcgggtttcgatcgcgccaccggtgcaacacgatcggtgttcccgtacggcggcggacccggtgttcccgtccggcggtgggcgccgaggcggccacgcgacgagacgggagcgcgaaccggaaccggctgggaggaacgatggatcactcgcgggtacccgtgctggaggcgctggaggagttcaggcgccggggagacgtggccttcgggccaccggggcacaagcaggggcggggcgcggacccgcgggtggcggagatcgtcgggatcgacgtgttccgctccgacgtcctctccctcaacggcctcgacgaccgccgccagtcgcagggcgtgctcagccaggcgcaggacctgatggccgacgcggtcggcgccgaacagaccttcttctccacctgcggcagctccctgtcggtcaagacagccatgctcgcggtggccggcccgggggagaagctgctgctgtcgcgcaacgcgcacaagtccgtgatcgcggcggtcgtcgtcaacggcgtcgagccgatctgggtgcacccgaagttcgacaccgaacggcacctcgcgcacccgcccgagccggacgacgtacgccgccgcctgcaggaacaccccgacgccaagggcatgttgctcatcacgcccaccgagtggggtgcctgcgcggacatcgcgggcgtggcccgggtgtgccacgagttcgacgtcccgttgatcgtggacgaggcgtggggcgcccacctccccttccaccccgacctgccggcctggggcatggactccgaggccgacctggtggtcaccagcgtccacaagatgggcggcgccatcgagcagagttccgtcttccacctccaacacgaccgggtctcccccgaggtgctcaagcagcgcgaggacctgctgggcaccaccagtgcctcgtccctcgtctacgccaccctcgacggctggcgccggcagatggtcgaacaggggcacaccctcctggacgccgcgctgcaacgcgccgaacgcgtccggacggccgccggggaactgcccggcctgcggccgatgggccgggaggtcgtcaaggaagggtgcgccgccgacctcgatccgctcaagatcgtcatcgacgtacgggaactcggcatcaccggcatgcaggccgccgagtggctgcgcacctaccgccacgtggacgtcggcggctccgacagctgccggatcagcgcctccatcacgcacgccgacgacgacgagaccgagaaggtcctgctggacgccctgcgcgcgctcagccgcggcgccgagtccatcgagaagcagtcgccggtccggctgcccgagcccttcgccctggaactggagcaggcgatgctgccgcgtgaggcgttcttcgccccggtggagcacgtacccgccgagcacgccgccggacgtatctccgcggagatgatcagcccgtatccgccgggcgtgcccgtcgtcgcccctggcgaggtcatcaccgacgaggtgctggactacctgcgcagcggagtcgaccacggcgtcctgatcccggacgcggccgacccctcggtcgagaccctgcgcgtggtggcgcgggactgacccgtcccgggcgcggggcgccgccggagcccgggcgcgccggtcctcacgggtgggagcgcgagttcgcggcgaccccgccgaccacgtccagggtgccggcac

SEQ ID NO: 1761 - DNA, 517 bp, Unknown
  Kingdom: Bacteria, Phylum: Actinobacteria, Class: Actinobacteria, Order: Streptomycetales, Family: Streptomycetaceae, Genus: Streptomyces
gcccggcacccaggaacggacgcccgatgaccacgaccctgcccgccaccgagacacagggcaccccgggcatccctcgtacgggcggcaccctcgcgccggacccggcctccgccgccgggaccgcaccgcccgtcggcgggccgctgctgcggcgaatacggcgcacaaccggcaggctcaccccgaccgacctgcgcgtactgcgcctctacctcttcacccggctcggactgtggctcgtcgcctacgccagtgcctggctggcccccgccggagccccggacaaggcgcccgccggctggctgtcccgctgggagcagtgggactgggtccacttccagcacatagcccagtacggctacttcgacccgttccccggcgtcgaccctctgcaggacaaccgtgtcgccttcttccccggcttccccctcgcgctgcgcgccgtccacaccctcgtatccgactggaccgtggccggactgctgatctccctggtgagcggtgccgtcgccgt

SEQ ID NO: 1762 - DNA, 1226 bp, Unknown
  Kingdom: Bacteria, Phylum: Actinobacteria, Class: Actinobacteria, Order: Streptomycetales, Family: Streptomycetaceae, Genus: Streptomyces
gccgccgcgcggcggctcggcggggtggacctgctggtgcacaacgcgagcgctctgggcgcggagcctctggtacggctggaccggctgccggtggaggggctgcggctggcgctggaggtgaacacggtggccgcgctgggtctggtccaggaggcactgccgtggttgcgggagtcggcggcgggcacggtgatcacgctcagctcggacgcggccgccgaggcgtacgagacctggggcggctacggggcggcgaaggcggcccttgaccacctcgcggcggtgctcgccgtggaggagccggggctgcgggtgtgggcggtggatcccggagacatggccaccgacctgtacgcggcggccgtaccggaggacgactccccgcgtccggacccggccgacgtggtgccggccttcctgcggctgctggagcggcgtccggcgagcggccgctacagcgccccggcactgctggaggagcggtgacggcggcgaggggggttcggcaggccgggtccgcggcggaagatcccgtgctcgggagcgcgcgggagtggctgcgggtgccggagggcccggccgcgcgggtgccggcggagcagcgcgggccgggcctcgaccgggatgccgtacggctgctggtgtcgtgcgggacggaggtctcgcaccactccttcacggagctgccgggcctgctgcgggcgagtgacgtgctggtggtgaacacctcccccacgctggccgcggcggtggacgggcggatcgggcacgcgcgcgtggtggtgcacttctccacgcgcggggacgacggacgctgggcggtggaggtgcgggatccggacgggaggggcaccacgcgcgcgcgtgcccgcggtccggaggcgagcgaggtgctgctctccggcggcgtacggctggtactggaggagccgctgagcgcgcgcagtgtgcggttgtggtgggctcgggtggcgggggctgccgacgtcctggagctgctgcgggagcgcggccggcccattcgctactcctatacggagcgcgatcagccgttgtcggcgtaccagacggtgttcgcggagccgtccgccgacgggacgggcagtgcggagatgccgagtgcggcgcggcccttcacgcggcggctggtggcggagacggccggtcgaggagtgcggttcgcccccatcacgctccacaccggggtggcctcggccgaggcc

SEQ ID NO: 1763 - DNA, 2606 bp, Unknown
  Kingdom: Bacteria, Phylum: Actinobacteria, Class: Actinobacteria, Order: Streptomycetales, Family: Streptomycetaceae, Genus: Streptomyces
cccgccacctggaagtggccgacggcaaggtgacggagcgctaggcgctgcccggaggcggccacttccaggtggcgggtggtccgtacggcctggagcatgcggcggtcgtgggtgaccaggaggagggtgccgtcgtaggcgtcgagggcggactccagttgctcgatggccggcaggtcgaggtggttggtcggctcgtccaggaccagcaggttgacgcccctgccctggagcagggcgagtgcggccctggtgcgctcgcccggtgagagggtcacggcggggcgcagcacgtggtccgccttcaggccgaacttggcgagcagggtgcgtacgtcggccgggtcggtgtccgggaccgccgcgcggaaggcgtccagcagcgactcggagccgtggaagaggcggcgggcctggtcgacctcgccgaccaggacgccggagcccacggacgcgtgtcccgcgtccagggggacgcggccgagcagggccgccagcagggtcgacttgccggctccgttggcgccggtgacggccacccggtccgcccagtcgatctgcagggagaccgggccgagcgcgaaggagccgcgccgtacctccgcgtcgcgcagcgtggcgacgaccgcgcccgagcgcggggccgccgcgatctccatgcgcagctcccactccttgcggggctcctcgacgacgtccaggcgttcgatcatgcgctgggtctggcgggccttggcggcctgcttctcgctggcctcgctgcggaacttgcggccgatcttgtcgttgtcgttgcccgccttgcgccgggcgttcttgacgcccttgtccatccaggcccgctgcgtctgcgcgcgctcctggagggaggccttcttgtcggcgtactcgtcgtagtcgtcgcgggcgtgccgccgggcgacctcgcgttcctccagataggccgcgtatccgccgccgtagaggttgatctgccgctgggcgaggtcgagttcgaggaccttggtgacggtgcgggtgaggaactcgcggtcgtggctgacgacgacggtgccggcgcgcaggccggtgacgaagcgttccaggcgttccaggccgtccaggtcgaggtcgttggtcggctcgtccagcaggaagacgtcgtagcgggacaggagcagcgaggcgaggccggcgcgggccgcctggccgcccgacagcgacgtcatctcctggtccaggtcgacggcgaggccgagcgagtcggcggtttcctcggcgcgttcgtcgaggtcggcgccgccgaggccgagccagcgctccagggcggtcgcgtaggtgtcgtccgcgccgggggcgccgtcgacgagggcctgggtggcctcatccatcgcacgctgggcctcggcgacgccggtgcggcgggccaggaacgcgcggacggtctcgccggggcggcgctccggttcctggggcaggtggccgacggtcgcggtcggcggggagagcgtgagttcgccctgttcgggcctgtccagcgcggcgaggaggcgcagcagggtggacttgcccgcgccgttggcaccgacgagaccgatcacgtccccgggcgcgacgacgaggtcgagcccggtgaacagggcgcggtcgccgtgtccggcggcgaggttcttggcgacgagggtggcagtcatcagaccgccgatcttagggcttctcctgcggctcctgctcagggctcttcccgcggctcgtgccgggcccacggggtccgggggcgggccgagggtgccgtgacgccgtcggttacggtcgccgtatggacggtggactgagcggtgacgtggtggtggtcggcggaggcgtcatcgggctgacgaccgccgtggtgctggccgagggcggccggcgggtacgggtgtggacgcgggagcccgccgagcggacgacgtcggccgtcgccgggggcctgtggtggccgtaccggatcgagccggaggcgctcgtgggcgactgggcgctgcagtcctacgccgtgtacgcggagctggccgcgcgtccggaggagacgggcgtgcggatggtcgagggggtgcacggcgggacccggctggaccggctcgggccgtgggcggcgcgggttccggggctgcgcgcggcgcacgccggggagtacgcggggaccgcgctgtgggcgcggctgccactgctcgacatgtcggttcatctgccgtggctgcgggagcggctgcgggcggcgggcggcgcggtggaggagcggacggtgacggacctggccgccgtggacgcccctgtggtggtgaactgcgcggggctcggcgcgcgtgacctcgtaccggatccggacgtgtatccggtgcgcggtcagctggtcgtcgtggagaacccggggatcacgacgtggctgaccgccgtcgacgacgtgtcggcgtcctccacgtacttcattccgcagccgggcggtctgctgctcggcgggacggccgacgaggacgcctggtcggtggagccggatcctgaggtggccgagcggatcgtcgcgcggtgcgcggcgctgcggcccgagatcgccggggcgcgggtgctggagcaccgggtcgggc

SEQ ID NO: 1764 - DNA, 765 bp, Unknown
  Kingdom: Bacteria, Phylum: Actinobacteria, Class: Actinobacteria, Order: Streptomycetales, Family: Streptomycetaceae, Genus: Streptomyces
gtaggcgccgagcgcaccgccgccgcccagcacgaaggcgcgggccggcggccgggcgggtcggctgtcctccatgaccgaagggtgcccccacacagctgcgcaaaccagcgacggccctcctcatggaccgcaccggccgaccgcggcggcggccacccgcaccccgacaccaccgcgccggactgccgcgtgccgcacccatcgagtcgggcggccccttacggtgtggcggtgtcacgctcttacggtgtggcgatgcgcgcccccccggccgcgtggtgatccggttcaccggccggatgcggccgcgcgggacggcgaccggccggcggctcgccggtcccaccaggccggcaggagggccgtcagcgtcaggagcgcggtcaggacgaacgcccagggatagccggtcaagccggccacagtcccgaagccgaccgcaccgaggcccacccccgcgtcgtaggcgacgttccacagcgcgctcaccgtcccgtacccggaagccggaacccgtgcgtacatcagtgtgatggtcgcgctctgggtgacgccgaagccggccccgaacacggccgcacccgcgacgaccgcgacggggacgcctgtgagggcgacggcgaggattccgacggctgatgcggtcagcccgggcacgaccagtccggtggctccgcgccggtcggcgcggagccaccggactggtcgtgcccgggctgaccgcatcagccgtcggaatcctcgccgtcgccctcacaggcg

SEQ ID NO: 1765 - DNA, 2138 bp, Unknown
  Kingdom: Bacteria, Phylum: Actinobacteria, Class: Actinobacteria, Order: Streptomycetales, Family: Streptomycetaceae, Genus: Streptomyces
cgccgtgcgctccggctcgcgacgcagcaggcgcagcgcggccagggcagcgcccgccgccgccggggcgagtcccgtgtcgaagatgaacgtccgtgccgtgttgaccagatggtcgatcacccgggccggcccgagcaccgctccgccctgactgcccagcgacttggacagggtgacggtcacgaccacgtcgtccgcgcccgcgagccccgccgcgtacggggcgccccggccgccggtgccgaggacgccgagaccgtgcgcgtcgtcgacgaccagccccgcgccgtgctcgcggcagacctcggcgaaccggccgagcggggccgcgtctccgtccacggagaacacggtgtcacagacgaggaccgcctggcccgcgtgcgtgccgagtgccttgcgcacggcctccgggtcggcgtgggcgacgacctgcgtggtgccgcgggccagccggcagccgtcgatgagcgaggcgtggttgcccgcgtccgaggcgatcagcgagccgtgcggggcgagcgcggtgaccgcggcgaggttggccgcgtacccggaggagaagaccagggccgcctcgaacccgcagaactccgccagttcccgctccagttcgcggtggagtccggtggtgccggtgaccagccgggagccggtggcgccgccgccccaggtgcgcaccgcggccgtggcgccctcgatgacctcgggatggcgggccaggcccaggtagtcgttgctcgccaggtccagcagcggggagtcggccgggcggggccgcagcgtccgtacgagcccggcgcggcgtcgtgcgtccgcctgctcgtcgatccagccgaacgccatgggtcctccgggacttttgtaggcaatggacagacactagccggacgagacgccccgcatggtgtggcaatacccacacgtcgaaccgtcttggttgtgcaaactctccttggccgcggacggccccgtaggacaggatcggctttcatggacctgctgaacacgctggtggacaaggggcttcggcgcgagatgccgacccgtgaggaagctctggccgtcctggccacctccgacgacgatctgctcgatgtggtggccgcggccgggaaggtgcgccgccgctggttcggccgacgggtgaaactcaactatctcgtcaacctcaagtcgggcctgtgccccgaggactgctcctactgctcgcagcggctcggttccaaggccgacatcctcaagtacacctggctcaagcccgacgacgcttccagggccgctgcggccgggctggccggcggggccaagcgggtctgcctggtggccagcgggcgcgggccgaccgaccgggacgtggaccgggtctcggagaccatcaaggcgatcaaggaccagaacgagggcgtcgaggtgtgcgcctgtctcgggctgctctccgacggccaggcggagcggctgcgcgcggcgggcgccgacgcgtacaaccacaacctcaacacctccgagtcgacgtacggcgacatcaccaccacccacacctacgccgatcgggtggacacggtgaacaaggcgcacgcggcagggctttccgcgtgctcggggctcatcgccggcatgggcgagagcgacgaggacctggtcgacgtcgtctactcgctgcgcgacctggacccggactccgtgccggtcaacttcctcatcccggtcgagggcaccccgctggccaaggagtggaacctcaccccgcagcggtgcctcaggatcctcgcgatggtgcggttcgtctgcccggacatcgaggtgcgcatcgccggtggccgcgaggtccatctgcggaccatgcagcccctcgcgctgcacctggccaactcgatcttcctcggcgactacctgaccaccgagggccaggccggccaggccgacctggagatgatcgcggacgcgggcttcgaggtggagggcaccgaccaggtgacgctgccggagcaccgggtgaaggccggggcgggctgcggctcgcacgcggacgcgggctgcggttcgaacgggagcgccgggtgcgggtcgcacgaggacgccgggtgcggatcgcatgcgggcggtggcgtctgcggctcgcacgagagcggtgg

SEQ ID NO: 1766 - DNA, 915 bp, Unknown
  Kingdom: Bacteria, Phylum: Actinobacteria, Class: Actinobacteria, Order: Streptomycetales, Family: Streptomycetaceae, Genus: Streptomyces
  misc_feature (757)..(758): n is a, c, g, or t
tctgtccgccctgcccgccgtgcccgccgccgcctccaccggtgcgccgccgcccgcccgtgacgaggaccggggcggcgaccacctcaccgtcaccgttcgtcacgcgggggacggcagggacgggacgtacgagctgtactgccatcccggcggcggcagccacccggccgtgcggcgcgcctgccgggcgctcgaccggaacacgcgctggggccgggacaccttcgcgcccgtgccggagggcagcgtctgcaccctgcagtacggcggtccggccaccgcacggatcaccgggacctgggcaggacgcccggtcgacgcggcgtacgaccgtggcgacggctgtgcgatcgaccgctggaaccggctcgtgccggtgctgcccgacctcggttcctgacaggtacggtcacaagttcgacgtcacttccccgtgcgacctccctggcatccggcgtcgcgagcgcaacctcagcgcttagactcgctcgcgtgacactccgcgggccggttggcaagatggcccccgcggtgggcaaggtgcggtaacagggaggaagcgtctcgtgagcagcaggccatcccgaggcgctgctcgcctcgctgccatactcgacgcgctgcccgacgcgttgctgctggtcaacgccaacggcaccgtcgtcaacgcgaacaccatcgccctggaggccttcgagacgccgggcaccgctctggtggggcgcgggctgctcgacctgctcccgcagttcgnngccgacccggatgaccgcgcggcgcaccgacgggaccgagttcccggtcgaggtcacgagcgcgaatctgcagaacggccagcaggcctacgacgcctccggctacaccggcgacgaactgctgatgctggtcgtccgcgacctggccggcaccgtc

SEQ ID NO: 1767 - DNA, 2800 bp, Unknown
  Kingdom: Bacteria, Phylum: Actinobacteria, Class: Actinobacteria, Order: Streptomycetales, Family: Streptomycetaceae, Genus: Streptomyces
cagcccgccggcgggacgcggggccgggcctcaggccggggccggcctcccgcgcccgttcacgcctccgcgcgggccggcctgcccgtggcggcgccgcccgcgggctcgcgcccggtgcggcccgccctcttgctctcctccgcggcgcggtccgtcttctcgggcttctccggggtgacgaagcggtacccgacgttgcgcacggtgccgatcagcgactcgtgctcggggccgagcttggcccgcagccgccgtacgtggacgtcgacggtccgcgtgcccccgaagtagtcgtagccccagacctcctggagcagctgggcgcgggtgaagacccggcccgggtgctgcgcgaggtacttgagcagctcgaactccttgaaggtgaggtcgagcacccggcccttcagcttggcgctgtaggtggcctcgtccacggacaggtcgccgttgcggatctccatgggcgagtcgtcgtccacgatctgccggcgtcccatcgccagccggatccgcgcctccacctccgcggggcccgccgtgtcgaggagtacgtcgtcgatgccccagtcggcggtgacggccgccaggccgccctccgtcacgacgaggagcagcggacagcccggaccggtggagcgcagcagctggcacaggctgcgcacctgcggcaggtcgcgccgcccgtcgaccaggatgacgtcggcacccggggtgtccacgagcgcgggcccctcggccggggccacccgcacgctgtgcagcagcagcccgagggccggaagcacctccgccgagggctggagtgcgttggtcaggagcagcagagaactcatcgcgacccccctgtcggggtcgtcgtatggtcgtgcacggttcgctcgtccatggcgtctggttcctcctcgggtccctgcgaggacgtgggcggcactgttcgtcgcttcgtctgtggtgcggaccccgcgcccctgggacccgccgcggatcccgggcctgtgcgggaacccaagagccactgtgcccccgcgggccccgtacacccgcggtttcccgcgtcgcgtaccacgcccgccgaaagcacaaaaggacccgggggcttcactgcccgagtcctcttcgcagcagaatagccgacatgagctcggattcggcaggtcatgtggcgcgttcgacgatcgtcccggagtccgagacgccgtcgcgtacacgtgtcaggaggttcctgcgcacggcggacggggtctcggtcgacgcgctgtacgagccggggacggcggcgaacacggcagccgtgtccgtggcggccccgcccgtcgtgttcgtggtcgcacacggtttcacgggcgacctggaccggccgcacgtgcgccgtgtggcggaggcgttcgcgcgccacggcgccgtggtcaccttctccttccgcggccacggcgcctccggtgggcggtcgacggtcggcgaccgtgaggtgctcgacctggcggcggcggtggagtgggcgcggagcctcgggcacgcgcgcgtggtgaccgtcggcttctcgatgggcggctcggtggtcttgcggcacgcggcgctgtacggcgcggccggcgccgccggagcagcggaggccgccaccggagcaccggacggcgggacaggcaccggggggcgcacaacggcgcactcggcagcgggccacgcggcgcacaccgacgtcgtggtgtccgtgagcgccccggcgcgctggtactaccggggcacggcccccatgcgccggttgcactggatggtcatgcgccccgagggccgcctggtcggccggtacgcgttccgcacccggatccaccaccgcgactgggaccccgtcccgctctccccggtggaggccgcggcgcacatcgcgcccgccccgctgctgatcgtgcacggcgaccgcgacgcctacttccctctcgaccacccccggatgctggccgccgcagccggtgaccagggcgaactctggctggagcccggcatgggccacgccgagaacgccgcccccgaggacctcctgcaccgcatcgcacgctgggccaccagccgggagggcctaacctgaccatgttcattaccgagtggtccatcaccgaatgactcgaggaacggcatggcaaaggtcaccgtgcgctactgggcggcggcgaagtccgcggctcaggtcgccgaggagccgtacgaggggcagacgctcgccgaagtgctcgacgcggtgcgcgagcggcaccccggcgaactcgtccgcgtcctgcggcgctgctcgttcctcatcgacggtgaccctgtgggtacgcgcgatcacgagacggtacggctgaccgagggcggcacggtcgaggtgctccccccgttcgcaggagggtgagcgatgaccgaccagccgtatgagggctccggatacgacggctcccagcagggcccgtacgagggctacggcccgtacaccccccagcaccaacaacagcaccaccagcagcagtaccaccaacagcagtaccaccaacagcagcagtacgggcaacccgccccgcagccctacccgtatgcccagccgcagccgcagccgcaggcctggcccggtcagcagcaggcgtacgacgaccagtactccgaccagtacgccgaccccgcccagcagcacacccagcactggcagggcgagacctgggacactcagacccacggacagcccgtcgtcaccgcgccggaaccttcgccggcccagacggcgtacctgcccccgctgacaccgcagccgcagccccagccg

SEQ ID NO: 1768 - DNA, 1931 bp, Unknown
  Kingdom: Bacteria, Phylum: Actinobacteria, Class: Actinobacteria, Order: Streptomycetales, Family: Streptomycetaceae, Genus: Streptomyces
gcgggtgtggccccgtgccttccacgaccggctcaccgccccgctgcccggcctgaaggccttcgcccggttcgcccgggaaggcgcggtccggcccggcaaggaaggcctcgccgacatctcgctgctgccgtacgagccgggcccgctgccgcgcgtggacagccgcaccgtcgcggtcacctgggcgggacacgccagctgggtcgtgcggatcggcgggctgaccgtgctgaccgacccggtgtggtcgcgccgcatcgtcggcaccccggcccgcatcacccccgtcggcgtcgcctgggaggccctgccacccgtcgacgcggtcgtcatcagccacaaccactacgaccacctcgacgcgccgaccctgcgcaggctcccgcgcgacacgccggtgttcgtcccggccggactcggccgctggttccagcgcaggcgcttcacccgtgtcaccgagctggactggtgggaggcggcccggctctccggtgtccgcttcgacttcgtgcccgcccaccactggtccaagcgcaccctcaccgacacctgccgcagcctgtggggcggctgggtgctcaccgcgcccgacgggcagcgcgtctacttcgccggtgacacgggctacggccactggttcgggcgcatcggccgccgttaccccggcatcgacctggcgctgctgcccatcggcgcctacgacccccgctggtggctcagcgacgtccactgcgacccggaggaagcggtccaggccgcccaggacctcggcgcgcgccggatggccccgatgcactggggcacgttcgtcctgtccgccgagccggtcctggaaccgctcaccagggtccgcgtggcctgggacaaggcgggcctcgcccgggacgacctgtgggacctgccggtcggcgcctcacgggtgctggactgaacgccgggcgggcggcgccccaccgtggcggtgcgccgtggcagtgcgcccccactgtggcggtgcgcccccggcacagtggcgctgcgcccccggccggtcagttcgagcgatgggccggggccgagcggcggatccggcgccacacgctcggcaccgcaccgaccagcaccgtcagcgcgatcgcggcgaccacgccctcccacggctcggggaacagcgaaccgccgaggatgccgatcacctggtacgtcaccgcccacgccagacacgcggggaggttgccgcgggcgaaccggcgcagcggccacttcgccagcagacaggccagcatcaccggtatccgcccggccgggaccagccgcgacagcaccagcacggcgaccccgtgctcggcgagcttctcctgcgcctgtgcgagccggtcctcgggcgcgcgggagcggatcgcctccagccagcgcgagccgttcttcgagccgagcccccgccgccccagccagtacagcgccgcgtccccgaggaacgcggccagcgacgccgtcacgaacaccagtgccagcgagaacggcgccgtctggtgcacggccaccaccgccgccgaactgaccagcgccccggtcggcaccaccggaaccagcgccccgaccagcaccagcaggaacagcgagggatagccgatcgcctgctgggtggactccaacggcaccaccgtcgtgacggcggcggcgagccgtatcaccgggcgacctccagccgcacactctcgccgtgcccgagccggtgcaccgccacacccggcgcccgcagcgcagcatggcgcacgaactcctcacccggcgcatggaactcatgggggcgcacggcgtccatcccgatcggccagtacgtgccgtagtgcaccggtacggcgctgcgcggcgcgaggcgggccagcgcctgcgccgcccgctgcgcgtccaggtgcccctcgccgaggtagggcccccagccgccc

SEQ ID NO: 1769 - DNA, 1078 bp, Unknown
  Kingdom: Bacteria, Phylum: Actinobacteria, Class: Actinobacteria, Order: Streptomycetales, Family: Streptomycetaceae, Genus: Streptomyces
gtgccgcgggcaccgcgcgggacgccgccaacagcgcggccggccacgcggacaaggccgcggacgcagccgagtgggccgtcaagtacgcgggccaggccgtcgagtacgcgaagaagtccacggagttcgccaacgaggcgaccaaggccgccgacaccgccaccgccgccgtcaaccaggcggtcgcggtggagaagcaggcccgcgacgccgagtggcagcgcctggacgaggacgtcaagcaggcgctggaggaggcccgcgacctcgcgcagatcgaggagcgggagcgggcggagtacgccgagaggcgcactcaggcctcgcaggccgagcaggccaccaaggacctcgtcgcgcgggccgaggcggcgctgaagggcggcgacctgggtcttgccgcgaccctcgggcgcaaggcggcgctcgcccacatggactcccgcggttcctggtcgcgtgaggcggcccggttcgcgctgtccggcggggacgccgacgtgcacggctggatcgacaccgaccgggcgctcgcgcagaagcaggacgaccgggagaccgtcctgtacctggcgcagatcaccacgccggacgtggccgacgccgcgaccagggcgctggaggcggacgacccggacgccggtaccgcgttcctcgccaccggcgtggtcgaggccgccgccaccgacaaccgcgtcgcggtctcccgcgtgctggcggccggtccgggcagcgcggtgacgaaggcggcgaacgacgccctgaacgccgggaccgccgcggccctgcacgagttcctcagcgtcacctacgaggcggcgcagcgcgaggacgacgcggtcgccaccgcggccctcatcgacaagggcggcccgtacaccaaggcgcacgcccaggccgcgatggagggcccgacgtggatgcgccgcaacttcatcgcctcggtgcagtacaagacggcgcagctcgactacgactcggccgcgcacatcgccgccgtgcagggcgcgatcgccgccgctgcgaagatcgcgaacaaggcgcaggaggacgccgcccgtgcgcaggaggcggc

SEQ ID NO: 1770 - DNA, 1410 bp, Unknown
  Kingdom: Bacteria, Phylum: Actinobacteria, Class: Actinobacteria, Order: Streptomycetales, Family: Streptomycetaceae, Genus: Streptomyces
gccggggcgtggctgtcggcgtacgtcgactccaccggcacggaggccgcgcccggcgacctggccgaggcggtggccgccgagctgtgcgcggacctgccccgctacgagtccgacgcctcaccggtggccgtggccgagggcctcctcggcacccacccgcgcatcaacggccgcgccctcgctctgcggatcgacgagttcctggcccgtacggaacgcttcgcgctcagcgacgtacccgccttccgggagcaccagcgccgccgggccgaactggtcgcggccgaacgcgtccggctccgcctcgacgagcaccgcccgcgctccatggcggccttcgtgcgcaaccggctcatcgacgaggtctacctgccgctcgtcggcgacagcctggcccgccagctcggcaccgccggggaggacaagcggaccgacaccggcggtctgctgctgctcgtctccccgcccggctacggcaagacgacgctgatggagtacgtcgccgaccgcctgggcctgatgatggtgcgggtcagcggcccggcgctcggccacgccgtcacctcgctcgacccggccgaggccccgaacgccaccgcccgccaggagatcgagaagatcaacttcgcgctggcggcgggcaacaacacgctgctgcacctggacgacatccagcacacctcaccggagctgctgcagaagttcatcccgctgtgcgacgccacccgccgtgtcgagggcgtgtggaacggcgagccgcgcacctacgaccttcgcggcaagcgcttcgcggtgtgcatgaccggcaacccgtacaccgagtccggcgaccgcttccgcgtgcccgacatgctcgccaaccgcgccgacgtgtggaacctcggcgacgtcctgaccggcaaggaggacgccttcgcgctgagcttcctggagaacgcgctcaccgcgaacccggtcctggccccgctggccggccgcgaccgccaggatctggaacttctggtcaggctggcccagggcgacccggcggcccgcgcggaccggctcacgcacccctacgacccggccgagctggagcagatcacgggcgtgctgcgccatctgctcaccgcgcgtgagaccgtcctcgcggtcaacgccgcgtacatcgcctccgccgcccagtcgcaggacacgcgtaccgagccgccgttccggctccagggttcgtaccgcaccatgaacaagatcgcgcagcggatccggccggtcatgaacgaggccgaggccgccgccgtcgtcgacgaccacttcacggccgaggcgcagaccctcaccaccggggcggaggccaacctgctgaagctggccgagctgcggggcacgctcaccggggagcaggcggcgcgctgggccgagctgaaggcc

SEQ ID NO: 1771 - DNA, 1551 bp, Unknown
  Kingdom: Bacteria, Phylum: Actinobacteria, Class: Actinobacteria, Order: Streptomycetales, Family: Streptomycetaceae, Genus: Streptomyces
cctccggggcgaccggagtacgtcccgctgcgtcggcgtcggcgtcgggcggtccgaaggctcgggcgtacggcccgagtcgaggaaggcgcgcagcatccgctcggcctcggcgctctccagccgccgttcaggatcgcgttccagcagcccgtgcacgacgggcaggatcggcccggcctgcgcgggcggccggatctcgtcgacgacgaccgcgtgcaggatcccgcccagcgagtcgcgccggaagggcgaggcgccgctcagcgccgtgcacagcagcgcgcccagcgaccacaggtcggcctgcgggcccgcactcgacccggacatccgttcgggcgcggtgtactccggggagccgacgaaggacccggtctcggtgagcgtggtggcgcccgccacctgggcgatgccgaagtcggtgaggacggcccggccggtgccggactccagcaggacgttcgccggtttgatgtcgcggtgcagcaccccggccgcgtgcgccgcgcgcaacgcgcccagcagggcgatgccgacgcgggcggcctcgacggcgtccagcggcccgtccgcggcgatccggccggccagcgagccgccctcgatcagctccatgacgatgtacggccgtccgtcctgctccgcgatgtcatggacgacgatgatgttcggatgccgcaactgggcgaccgcgcgcgcttcccgcagcgtgcggtcgcgcaggtgcccggcctcctcgtcggacagggtctcgtcgaaggcgagttccttgacggcgacggcgcggccgagcaactggtccgtcgcccgccacaccactcccatgccgccgcgcccgatccgcgtctccagacggtaacggcccgcgatcacacggcagtcggccccctcggtccccatacgccccatcatgccgcatcggaccccccgcttccggggccccgaccggccaagcgggggtcctcatcaggcctttgtcgcccgcccgcccgccacggtcaggacgagcccggccgccagctctgcagcaccgacttgaactgcttgcgcgtggtcgcccaggacgcctcgggcgaggacatgtagatcgcgtactcgactccgtcgcgggagaagtacatctcctcgatggcgtgccgcgggcccgggaaggacgtgtccttgggcagcgccgtccaggtgtactcccacagggcccccgggcggtcgcggaaggtctcctcccgcagcgacagccgctggtagtcgaccaggcgcttcaactgcacttccaggtcgagctggtgatcgtaggcgctgctgaactgcggggagtccgccacggcgatgcgcaccatgtgtttgccgccgtcgggcgtgtagtcgacctggtggagcgtgctgttggacaccacgcgctgccagttcgggccgggcagggcgatgctgaagccgtacgggtcgcgcacgcgcacccatccggccgggaggccgtccgcagggccgtccttgccggccttacccgtcttcttgggggccggcgcgggggacgccgaggggggcgcggac

SEQ ID NO: 1772 - DNA, 2289 bp, Unknown
  Kingdom: Bacteria, Phylum: Actinobacteria, Class: Actinobacteria, Order: Streptomycetales, Family: Streptomycetaceae, Genus: Streptomyces
gaaccggcggggccggtgcggccgtggtgggcgtgggcccggcgccgtacggcccgggtgatccgcgggacggcggcgagcacgagcagggcgagggccagggcgtaggcggccgccgcgccgtatccggcggtgaagttcttgaacgcctgctcccagatgaagtagacgatgaccgtggtggagccgagggggccgcccttggtcgtcacgtacaccaggtcgaagacctgcagggcgttgatggtctgccacagcaggaggaagaccaggaccggggcgagcgcgggcagcgtgacgtggcgcagcacatggcggcggccggcgccgtccagccgggccgcctcgaccagcgagggcggtacgtcctggagggcggcgagcaggaccaccacgcagaagccggtgccgctccacagcgatatcgcgacgagcgcgagcagtgcctgcccggggtcggtgaggaagccctgcggtgagatgccgaccttgtgcaggatcgagttggccgcgccgaactcggggtcgaggatgaaggagaacaggaccccctgcgccgtcgccgagacgacgaacggcacgaagaagagggtgcggtagagggccaccagccgcagccgctggttgagcgcgagggcgaggaacaggccgaggccgatgctcagcggcacgtacagcaccgtgtacagcagggtgttgcgcaccgcctgactgaagtgcgggtcctgcgcgagcgcccggtagttggcgagaccgacccagcggctgggcgtgaccaggtcgtcggcctggaaggacagcagcagcgaccaggccaccgggacgacgctcaggccgaggatcaccaggaccgcgggggagacgaacgcccaggcggtggcggtctcccgggtgccgcgacgacgcgcggaccccgatcgcgccggggtgttcggggcggtgccgtgacggtcgtcgtcgccacggccgcggcggtcggtgcgggacttccgctcggggccgcggtccgcgagggtgaggggcgagggcaggcggggcatggtggtcctctcaacgcgggatgagcagggcggcgttggcctcacgcgcgcagtcgcgcagggccttggcgggagtgctccggccgatgagcaccgcggcgatcgcctggccgagcgcctgcgagatctgcgggtacgccgggtggacggggcgcacccgggccgaggtcaacgcctgcgtgaacacccgcagtccctcggtccgctcctcctgcgcgtgccacgcgggcagtgcctgcgtgctgcggctcagcgggaggctgccggcctgcacgtcccagcggacgtcctgggcgggctgggccagccaggtcacgaaggtgcgggccgcgcggacccgggccggaccgttgtcgaacacggtccaggtgtcggggcccgagatggtcaccggccggccgctgtagctgggcagcggcaccacgtggtggtcgatcccggcctggcggatgtccggcagctgccacggcccggtgacgaccatgcccatgcggttcgactcgaacacctggtacatctgttcgctgcccggcttcggatcgacgtagacgctcctgtccccggcgagcgccgccaccgtctggagggccttcacaccgctctcctcgaacccgatgcgccgcccgtccgggccgatgacgtcgccgcccaggtcccacaccatcggccacagccgccacacggtgtcctcgtcgccgacgccgggccagccggtgccgaagacaccgcgccgccggtcggtgagcctggcggccgtggccacgaactgctcccaggtccagccgggccggggcagcggcaggccggcgtcgcggaagagcttcttgttgcagacgacggcgagggagtcgagcagcgcgggcgaggcgcggacgtggccgttgagggtgaccgcggcgcgggccggtgcccagaagccgtcccaggccgtcggcccggaacggacggcgtcggtcaggtcgaccaccgaggggctgcgggcgacgctggccaggtcggagccgaagacgtaggcgacgtcggggaaggaaccggccgcgagcgcggcggtgatcttctgcagcatcgcgtcggcgaggacaccgccgcccgcgtcgaccctgatgccggggtgggtgcggttgaactccgccaccagtttctcgatcgccgcgcggcccgtgtccgtctggccgtgccagagttcgacggtgtcggcgccgacggccgggtcaccgtcgaactctggcacggccagacggacacgggc

SEQ ID NO: 1773 - DNA, 2512 bp, Unknown
  Kingdom: Bacteria, Phylum: Actinobacteria, Class: Actinobacteria, Order: Streptomycetales, Family: Streptomycetaceae, Genus: Streptomyces
gccggagccgtagaggcaggcgagcagaaccgccgccctgccgcgcggcatgaccgcctccaggctccgcagcacggcctcgtgcgccgccgacagcgccaggagcccgcacagcccggaaccggcggccagcgcgccgcccgccccgaacgcgcgcaggccggccatcaggtcgttccgtacggctctgatctcgtcgcgcgccagttccgcggcgtcctggccgagccgggccgccgcgtcacccgtccggcccgcacccgccgcgccgccttcgcccggtgttcccatgtccgcgcctcctgttccgtcatgtgtccgtgtcgcctgcccgcgtccgcgtcgcctgcccgcgtcgcctgcccgcgcggcgtccgggtgccacctgaggggggcgtggaaacaccgaaggcgcgcccccggacggcggcccggtgctcaccgcgcctcaccgcgtcaccgcggcagaacgcgcggtcaggggcgacctgtgtgagccttgggcagggacggaccgtcgtgcctgctccgggcgacgtccgtccagggccccgtgcccgagcccgcccgccgtgccgcggatcgccgccccggacgaggaaagaagcgatggacgcgatcgagctgctgcagcacgaccaccggatggtggagcaactgttccgcgactaccacgccgcggcctcgccgacgcagcggcggggagtgatcgagctgatggtccgcgaactgtccaagcacgcggcgctcgaggagatgatggtctacccgctggccaggaaggccctgcccgacggcgcgcaccgggccgacgagcacctcggcgaggacatggccgtcaagaaactgctgctggacctcgacaggctgcccgccggcgacgcacgggagagcgatctcatggcgcagctcaggcgggaggccgaggcgcacgtgcgcgcccaggagaccgacctgttgcccgccctgcgtgagcacgtcgcccagcaggacctcgacgaactgggccggctcctggaccaggccaagcagagcgccccgacccggccccacccgcacgcccccgaccaacctccggccctgacggtgatcgccccggtggcagccgcctacgaccggctccgtgaccgtctccaggggaggccgaccacatgaccatcgagagcggtaccacccacgtcgggcaggatcccgcacgcgccggagaacgggacggcttcgacgagatccacatcctctggatctccgagggcatgagctgcgacggcgacacggtctccatgacggcgtcggggcagcccgcgatcgaggacatcgtgctcggactcgtccccgggctgcccaaggtgcacctgtacaacaaggtgctctcgccgagcctgggcggcgaggactacctcgcccccttccgcgccgccgcccggggcgagctggccccgttcatcctcgtcatcgagggctcggtccccaaccagaacatcatcgagggcgacggctactggacctccttcggcaacgacctcgagaccggccagccgctcaccctcaactggtggatcgaccagctcgcgcccaaggcctgggccgtggtcgcggtcggcacctgcgccacgtacggcggcatccacgcgatggctggcaaccccaccggctccatgggcctcgcggactacctgggctgggacttcaagtcccggggcgcgctgcccatcgtgaacgtgcccggctgcccgatccagcccgagaacttcatggagaccctgacctgggtgctccagcacgccgccggctccgcgccgcccccgccgctcgaccacatgctgcgcccgcagtggctgttcggcaagaccgtgcacgagggctgcgaccgggccgcgtactacgagcagggcgacttcgccaaggactacaactcgcccaagtgccaggtgaaggtgggctgctggggcccggtggtcaactgcaacgtgcccaagcgcggctggatgggcggcgtgggcggctgccccaacgtcggcggcatctgcatcggctgcacgatgcccggcttccccgacgccttcatgccgttcatggacgagcccacgggcggcagcctgtcctccgtcctcatcaggccctacggcgcgttcatccggcggatgcgcggcatcaccagcatggcggtcaacagggaaccgaagtggcggcacaacgaggaccggctgaccagcggctacgacccccactggcgtgcctgagcacggaacggagccacggacatgaccggtacgctggcgcgcctgatccgcggtgccgccgacgcccgcacgaacaccgccgaatgctgcgacctgtgcggcgcgccggtggcggaggaccatccgcacctgctcgacaccggcacgggcgacggagcggacctgctgtgcgcctgccggccctgcgggctgctcttcgtcgacggcggggcaggcggcgggcgttaccggccggtgccgtcgcggcgcctgcggctgcccccggtggatac

SEQ ID NO: 1774 - DNA, 603 bp, Unknown
  Kingdom: Bacteria, Phylum: Actinobacteria, Class: Actinobacteria, Order: Streptomycetales, Family: Streptomycetaceae, Genus: Streptomyces
ggcggcggggtcggcgcggcggccctccagatcgcgcgtgccttcgggctgcgggccgtgggcgtggcgagcgcgggaaagaaggacttcgtggaggcgctcggcgcggtgcacgtgccctccgggcccggctgggccgagcgcgcgcgggccgccgcaccgagcggcgtcgacggcgtctacgacctggtcggcggcgagatcctgaaggaggcggccgagctggtcgccgaccgcacgaagctgatcaccgccggtgcgcccgagccggacgtcgaggcgctgggcggcgcgcgggtgcggcgtgcccggaccgccgccgtcctggacgcgctcgcggagctggtcgtccgcggcgcccttgacccgcacgtcaccgcggtgttcgcgctggagcgggccgccgaggcgctgcgtgccgtggaggacgggcacgcccgcggcaaggtcgtgatcgaggtcgccgcgtgaacgtgagcgggcacacggacgacaccgccgccgggccggtgcgcgggcacgtcctcgacaacccggccctggcctccctgaccggcccgcacgccctcttcgccgagcggcgcgggccggtcagggaggcca

SEQ ID NO: 1775 - DNA, 2344 bp, Unknown
  Kingdom: Bacteria, Phylum: Actinobacteria, Class: Actinobacteria, Order: Streptomycetales, Family: Streptomycetaceae, Genus: Streptomyces
gcgggccgggctgctcgggcacgggggtgatcagccggatcagggcaccggcccgcttgaccccgtcgcgcaccgcggccaccgtccgggcgcgggggtcgtcgctgtccggtgtgagggagagcagttccgccagtccgtccgcccggagccagccgtcgggcaggaagcgtgccaggccgacggccagataggcgccctgggtgagggtctgggcacccgggatctcgggcaggcccgcccggcggcggaaggcttcgggcagcgaggccacggtgatggtgccgatgaccggcccggcgagggcccggccggccgcccagacggtgggcagaccgtccaggagcggcggggcgggcaggtggtcgaagagcctgtacaggatgatgcgcagcgcctccgtgttctccagttcctcctcgaccacgcggtcgtagtactgccagaactcgtgcaaggtgggcggcagttggccggcctcgtcaccgagggccgcgaggaacccctggtactcggcgtacaggcgctccatggtggtctgttccagcggctggccgctgagcctgcacatggtgacggtgctctcgaagagggtcgccgccacccacgcgcggacctgggggtccatggcgtcgtagggccggtcgcggtcgtcggtgccgctgaaccgtgcgtgcatccggttcagccgggccgcctccctcagccgcacctgctcgtcggcgccgaacatgcgctggaggctgcggaaggtgttccacagccgccgccaggggtgggccacgaagacggagttgtcgatcagggccgcgccgatctgcgggtgggcggcctccagcacggtcgcccggatcatggccagggcccagcgcgggtcgtcgaagaactggtggaactgcgatccgggaccgaagagcggtgcctcgtcggcgtcgtggccctgccgtgcggggccgtccccgtcggcgggggtctcggaaccggggctgtccggggggcgggcggtggcatcggtcacggtcggggttctccgttcgcgttcggtgtgatgccgccgaagcggcggtcgcgctgctggtagctgcgcaggcactccaggaagtgcggcgcgcggaagtccggccagagcacctgcgggaagatccactcggcgtaggcgacctgccagagcatgaagttggagatgcgctgctcgccggaggtgcggatgacgagatcgacgtcgggggtgtcggggaagggcaggtgcgcggcgaactcccgctcgtccacggcctcggccgccaccccgctgcggatgagcgaccgagccgcctcgacgatgtcgccgcgcccgccgtggtcgaacgccacggtcagcgtcatgccccggttggcaccggtcagcgtcgtcagatcctcgaagtcccgggccagggacggcgggatcctggagtcggccgcaccgaggaaccggcagcggatgccgcgcgcgagcagcatcggcgcgtgcttgcgcaccacacgccgtacgaggtgcatgaggaagtcgacctcggcgtccgggcgccgccagttctccgtggagaaggcgtacaggctcagccactccaccccggccgaccgggccgcctcgatgacgtcgatcaccgtcgtctcggccgcgcggtgcccggacgtgcgtggcagcgccctgcgcgccgcccagcggccgttgccgtccatcacacacgcgacgtgacgcggcacgcctctcgtcgtcacgcgcgcaccctcccccgcacggcttccccccggtccgacaggcagcagggtggccgacggcgggcacggacacgcggaactccgcgcacattcacccgttcggggatgtcaggccaccgacggcagcttcaccaccgccctcacccacaccgccggccgcaccgtcgtcctggtcgacaccgaccacacgccccgcgaaccgaccgccacgacgctggcggagctgcgcgacagcgtggtctgacaccacctgcccgcccttcgcgggccgcggtgcaccagaacgcgccgcggcccgcgatccgtgcggggtgccccgcacgtacacgggccgcgtccacgcacgggcaccgcgtacgcccgtccctcagcccgtgcccccgcgcccctcggtgagcaactccgccagcgtgtcggcgaacgacgtcagccggtcgcgtaccgctcccccgcgggcgacgcggaatccgtggcgacggccccggaacgcggcctggaccgcgtggaactgcgcccaccgccggacgcgttcgcggtcgagcccggccgcctcggcgaagacgtccaggacgcggtgggcggcgccggcgaggtcgtcggc

SEQ ID NO: 1776 - DNA, 588 bp, Unknown
  Kingdom: Bacteria, Phylum: Actinobacteria, Class: Actinobacteria, Order: Streptomycetales, Family: Streptomycetaceae, Genus: Streptomyces
cggtgcggtcggccttcgcgctgccggtgacggtgcagtccgtccagccgtcgccgccgtgcagcacggccgcaccgtccagcaccccggcgtcggcgacgagccggcccgcctccacccccacaccggtgctgcggcgcagatcgagcgcggcggggccctcgacgacggtggtggaccgccacagcgccttcagccgcaggtcgggccggggctcatacgtgcgcgagcccaccgtgccgcccttgacgatgtactcacccgcccggccgctcgggaagtggtcgtcgttgaacagccacacccgcataccggtgcgctccgcggtgcgcaggacgtgcccgacgatgtcgaaccagccctcggtgaagaacgccggttccatctctgcgttgtcgaaggagaagagcaccacctcgtacatgcccttggcccgcaggtcggcgagctgacggtccaccaggtcaggggtgaccgggccgttccagtaccagtagacggtgggccggctgtccttggcggggtcggcgaagccgcgctcggtgtaccgggccgtcgcggcggcgtgctcgggggccgcgccgtcgg

SEQ ID NO: 1777 - DNA, 1318 bp, Unknown
  Kingdom: Bacteria, Phylum: Actinobacteria, Class: Actinobacteria, Order: Streptomycetales, Family: Streptomycetaceae, Genus: Streptomyces
gtcgtagaccgtctcggtgcgcgtcgacttggcggcgtcgcgcttgctggtcttcgcgtcgaagaccccgccgctgcggctgcggccgctctgcacggccggctggaccgcggcccttgcccggcttgtggcccgcgccgcggtgggcggcggtggcgtcggcggggacgtggtgccgcttgccctcggcggtgccggactcctggtgcggcagcttgccccagtgcgggtcggtgaaccaggacgccagtgatgccaggctcatgctcggcagttcgacgcggcccagctccaggccctcggcgagggcctggtcggtcgtcagcatcagcgcgagcgcggtgagcgccagcacggcggcggcccgcactccacgccggtggtgacggcgtgtgctgcgcgcgtagagcgcggtgtccgcggagcgcgcggaatgcgcggctcgcgcgggcggcgcggggcgtgggcggcggctgagcggccacagaggcacggcttcgactccagtagtcaagaaagcgacaaagaaacgcgccgatcttgcccactgtgaacaagctgtggatagtttcaggagacgatcttgtacggatcttgaccgcctcttactcaacctgaccgatttgctgcggggcacccctttgcgtcttgtgaacgcctttgccgtaccgtcatgacatccgtatcggtcctatatctgacggtgactcaagcgtaggggctcactccggttttgggcaggacggtcgtcagcctccgcactgcttcagcatcatctgcttgtccgccgtcgtcaccggcagcttgtacttcagcgagacctgagcgaaccgcacgctgtacgcgcagcggacgttcttgttcggcgggagccaggtcgccgggccggagtcgctcttggaggagttggcggggccgtcgaccgggaggaggttgagggggtcgttggcgatctgctcgcgcttgtccttggtccagtgcgcggcgcccatctgccagtcgtaggacagcggcatgacgtggtcgatctggacggtggtcgcgtgcgccttgatccactggatcgtcttgccggtgtacgggtcgtgcagggtcagccccacgagcacgcagtcggagcccttgcggaagctgaggttctgcccgtcgcgcttcagtacgtcgtcgcgggtgtcgcagccgttgtgcgcgaacggcacgccgtccacggagtccatccaggcgtagccgaactggtcccgcttgtagcccgtcttgggtccgcggcccgcaagctcataggcaccgtgaccacgaagggccgcggacccaagacggg

SEQ ID NO: 1778 - DNA, 756 bp, Unknown
  Kingdom: Bacteria, Phylum: Actinobacteria, Class: Actinobacteria, Order: Streptomycetales, Family: Streptomycetaceae, Genus: Streptomyces
cgcggccttcatcagggtgaaccgggggatgtccgcgaccggccggctcaacggcttgcgaaggccgccgccgctcacctcgaaccggccctcgcgggggcctagctccgccacctggtcccaggggagtcgtccgccgtcgatcacgatcccgtccggcgccacggtgatgtccccgaagcgctgcggctcaccgcggcggagcgcttccagggtggcgggcaggccggcctcggccaggtggtcgcacaccatccggcagatctcggagcaggcgtaggcctgcggcggcccgaacccgtcggtcggcggccggtgcatcctcccgtcccggaaggtgctcgcgagggtgaggaagactccgtcggtgcgcgtgagggcgtacgagaaccgcgtgtagcggtaggtgccgttctcgtagtgcagcgtcgtggactcgcgccagtccacgacgtcggaccagcgcatggcctgctccgcctcgccggggttctgccagaccacgcccgcgtagaacacgtagacgcggcgcacgctcttgcggcgcaggcccactttcacggggaaggcgttctgcagttcgccgaggcggtactgctccgccagcgccacggccccggcggtcggcaccgcccactcgctgctgcggggcaggatcaggatctccacggggtggcctccgtaagggagttggcggcgtccgggcacccggaccgagcagcgcacccggcccggccccgccgaagacgccgacgc

SEQ ID NO: 1779 - DNA, 2135 bp, Unknown
  Kingdom: Bacteria, Phylum: Actinobacteria, Class: Actinobacteria, Order: Streptomycetales, Family: Streptomycetaceae, Genus: Streptomyces
  misc_feature (1494)..(1495): n is a, c, g, or t
caccctgcgctgcgcgtggtccgcgaccagcgggcagcagccacgggtcgccgagcacaccgcccgcatcccgcagcaggccgggccgcccgcggaaccgtcggcggcctccgtggcggacacgaccgccggccgcaccgaccggcacgagccgggcccggcggccgacgagtaccacaccgagcagttcgcgttcgtcgaggagccgaccgacgactccgaagacgtcatcgactggctgaagttcaccgagaaccgcaccgagcgccgtgaggaggcccgccgccgggcccgcagccgcgtgatcgccctggcggtggtcctcgccctggtcgcggtcggcggcgtcggctacctctggtacgccgggaagctccccggactgtcctcctccggcggcggcagcggcgcgggcagcgccgtcggcgcccagaaacgcgacgtgatcgtcgtccacctgcacgacaccgccaagggcggcacgtccacggcgctgctcgtcgacaacaccaccaccaagcagggcaccaccgtcctgctgcccaactccctggccgtggcggccgacgacggcaccgcgacgaccctcgccaagtcggtcaaggacgacggctcctccgggacccgcgaccagctcgacaccgtgctcggcaccagcatccagggcacctggcgcctggacaccccctacctgcagaacctcgtcgacctagtcggcggcatcgaggccgacaccgacaccgacgtgcccgacccggacacgaagaagaagggcacgacggtcctcgtccacaagggccagagccagaccctcagcggtcgcatggccgtcgcctacgccacctaccgcgccccgggcgaggacgcgaacgcccagctgaagcggttcgggcaggtgatgcagggcgtgttgcgcaagatctcctccgacccgcaggccgccacgaccaccgtgcagacgctggcccagatcctcgacccctcgctcaccgacaaggatctcggcacgttcctggccaagctctccgagctggccaagggcggcgacttcaagacggcgctgctgccggtccgaagcgacggcacgctgtccgcgcagaccagcgacagcgtggtcaaggccatcctcggcggcaccgcgaagagcccggcccagggctcggccgtccgcgtcgcggtccagaacgcctccggcaccaaggccggcacggagaaggcgcgcgtcgccctcctcaacggcggcttcaccttcgtcgagggcggcacggcgtccggggcccggtccgcgtccgaggtcgtctacgccgacgccgcgcacaaggacgacgccgtcgaggccgccaagacgctggggctgcccgcgagtgccgtgacgaagggcacggtcaccgcgaacgccgacgtctcggtcgtcctcggccaggactacaagcccgcgtccgcccagtgatcccgtaatggcgtggggcgctgtcggcggtccgtgagaccctnngaccgccgacggaaagccctgtagtgaccgcgaccgaccgttccctcgagctgatcaacaccgccgcgcaggcggccgccgacaagctcgcgcacgacatcatcgcctacgacgtcagtgacgtcctgtcgatcaccgacgccttcctgctggcgtccgcacccaacgaccgccaggtcaagtccatcgtcgacgagatcgaggagcggctgctcaaggagctgggcgccaagccggtgcgccgcgaaggcgaccgcgaggcccgctgggtcctgctcgactacgtcgacatcgtcgtccacgtccagcacagcgaggagcgcgtcttctacgccctggagcgactgtggaaggactgccccgagctggagctgcccgaggacgccagggcgacccggggcaaggccgaggagcacgccaggctgcaggccgccgaggagccggcccagccggacggtgagtggcggtgaccggcaccggtgaggcggcgccccggccccagggccggggccgccgcgtcatcctgtggcggcacggccagacgtcgtggaacgtggagcgccgcttccagggctccacggacgtcgagctgaccgagacgggcgtcggccaggcccgccgcgcagcccgcctgctggcc

SEQ ID NO: 1780 - DNA, 3276 bp, Unknown
  Kingdom: Bacteria, Phylum: Actinobacteria, Class: Actinobacteria, Order: Streptomycetales, Family: Streptomycetaceae, Genus: Streptomyces
cgccgccgtcggccaccggcagcgcctcgacctccagatccggcacgaccctgcgcagcccggccgtcacccgctcggcgacctgtacggccgtcagcgagcccttgaacttgtccgcggcaaccagcaccctgcgggtgccgtgcactgcagcgtccgccaccttgccatccccttgctctttgggccccgcacgtcagggggccagccgcgccgctgtgaccataaccggcgacgcccctcgccgtcatgccccgcccgctccctgagaagcccccgcgacctctcgccgggtggccttacccttcctggatgaccactgcggactacgccacgtacatcgccggcctgccccgggtgctcgccggtgccgccgctctcttccgcgacgagcggggaagggtgctgctcgtcgagccgaactaccgggagggctgggccctgccgggcggcacgatcgagtccgacaccggcgagagcccgcgccagggcgcccgccgcgagaccctggaggagatcggcctcgaccgcccgctcgggcggctgctcgcggtggactgggtgcccggcaccggacgcccgccgctggtcgcgtacctctacgacggcggggtcctcgcggaggaggacctcaaggcgatccggctccaggaagaggaactgctgtcctggcgcctggtggcgcgcgacgatctcgccgcccatctgacgggctccctgggccgccgcgtcctggccgccctggacgtgctcaccgagggcacgggcacggcggagctggagaacggccaccgcgtcggctgaccgcgccgcagcccccacggggtcgctccccctgatatccgttcgccgggcccgcccgctcgccctaccctcggtcccatggccaagcccctcgtcgccctcctcagcggggccggtgtctccaccgactccggcatcccggactaccgcggcccgaacgggctgtggcgcaaggaccccgaggccgagaagctcgtgacgtacgagtactacatgggcgatccggagatccggcgacgttcctggcagctgcggcgcaagaaccgcgccctgcgggccgagccgaacgccgcgcaccgcgcggtggccgaactggagcggtccggggtgcccgtacgggtcctcacccagaacgtggacggcctgcaccagctcgccgggatgcccgcccgcaaggtgctcgaactgcacggcagcgtccgcagtgtcgtgtgcacgcggtgtcatgcgcgtggccccatggaggacgcgctcgcccgggtcgaggccggcgaggacgatccgccgtgccgggagtgcggcggcatcctcaagtcggccacggtgatgttcggcgagcgcctcgacccggtcgtgctgggcgaggcggctgcgatcgccaaggcctgccaggtgttcatcgccgtcggaacgagcctccaggtgcagcccgcggccgggctcgcgcaggtcgccgccgaccacggcgcgcgtctcgtcatcgtcaacgcggagccgacgccgtacgacgggatcgcggacgaggtgatccgcgagcccatcggcaccgcactgccggcgttgctcggccggctgcgcgacgacggggccgaggagcgctagggtctgtccgtctgcggcatgatccgccggaccggccctagaacagtccggcgccctgttcgaagtccagcaggcggcgcttgcgggcgaggccgccgccgtagccggtgaggctgccgttcgcgccgatgacacggtggcaggggacgatgatgccgacggggttcttgccgttggcgaggccgaccgcgcgggaggcggccgggctgccgagggcgtgggcgagttcgccgtacgtgcgggtctcgccgtaggggatcacgcgcagttgctcccagacgcggcgctggaagggcgtgccggccaggcgcaacgggagggtgaactccttcagggtgcccgcgaagtaggcggcgagctggtcggcggcctcgccgaagcagcggtcgtcgcgctcgccgaaggtctcctgggccgggcggtggcgctggtcggtcatgtacaggccgcacaggacgccgtcgtcggcgacgagggtgagcggaccgtagggactgtcgatgacggtgtgctgcttcacggcgcatcgccccgtggtgtgctgcttcatggctgaacgtcctcagacgggaaggaagttgatggggtggctgtccgtcgcccacaggtactgcacggcgtaggcccgccaggggcgccaggccgcggcgcggtcggtgagggcggccggggtggacggcaggcccagttcgcgggcggcgcggcggatgccgagatcggtggggaggaaggcgtcggggtcgccgagggcgcgcatggcgatgacgtcggcggtccaggggccgaagccgggcagggccaggagctcggcgcgggtctggggccagtcgctctccaccccgaggtgcagggtaccttcggcgagccggtggacgagggtggtgaaggtggtgcgccgggtgcggggcatggccagggactcggggtcgagggcggccagcgcctcgggggccgggaagaggtgggtgaggccgccctcggggtcgtcgacgggctcgccgtgggcggtgacgaggcgggcggcgtgggtgcgggcggcggccgtggagacctgctggccgagcacggcccggacggcgaactcggcctcgtcgacggtacgcggcacccggcggcccggggccttgtcgaccaggggcgcgaggaccgggtcggtgcgcagttggtcgtcgatggcgaccgggtcggcgtccagatcgagcatgcggcggcagcggctgatggctacgggcaggtcgcgcaggtcgctgagggtgagccggcaggcgatgtggtccgggcgcggggtgagcgtggcgatgccgtggccgtagggcaggcgcagggtgcggcggaaggcgcccgcgcgccactcctcgacgccgggtacggcggtcgcggcgaggtggccgaagaggttgtccgggttgagcggggcgcggaagggcaggcgcagggagagggcgccgggggtggccgcccgcgcctggcccgcggcggcttcccggggcgcacggccgcgcagctcgctgggggtgagtgcgaagacctcgcgcacggtgtcgttgaaggcgcggatcgaggcgaagccggcggcgaaggcgacctccgccatgggcagggcggtggtctcgatcagcagccgggcggtctgggcgcgctgggcgcggg

SEQ ID NO: 1781 - DNA, 828 bp, Unknown
  Kingdom: Bacteria, Phylum: Actinobacteria, Class: Actinobacteria, Order: Streptomycetales, Family: Streptomycetaceae, Genus: Streptomyces
tcgagggccgcggcgggggccgggacggaggcggcggcgggggtggtctcggtctcgttcttgcggccgaagatgctcatggcgtgctccttggggacggggtccgctcggcgtcaggggggaacgccgaggacgttgaatgttcaactagaaccgacaggggcgacagtagacccattccgttcaactttcaacatcattcgcagcgcgttttcggactcacccacagtgaccgctgccgccctctggcggacgcgcgtagacctcgggcaccatctccctgcaccacctgcacagccgccccacaggaagcccggccaaccgcaggaaggggtccctcatgaaggtcatgaagagaggcaacgccaccaaggtcaccaaggcccgagccgccctcaccgcgctcgccctcgtcgtcgcccccggcgtcgccgtcgtcggcagcgcgaccgacgccttcgccgtcaccaagatcagtcacgccaccgcgaccgggatgttccgccagtcgggcatcacctggtcctcctccggcaactgctcggaccgcaacaactccacctgcacctccttcgaccagctcaacctgcccaccgcacaaggcgcccagaccctcaagagcgccagccgctgcgccctcaacatcacgggcggcaccgagaccggccacgcctccggcacctactcccactggaacggctacaagctcgactacggcaagaacacctgcgtcaccgcctacatcaagaactcgttcacctacatcgggctgcgcggcgacggcgccccgcagtacaagtccggctccggcaacatctacgccgacga

SEQ ID NO: 1782 - DNA, 521 bp, Unknown
  Kingdom: Bacteria, Phylum: Actinobacteria, Class: Actinobacteria, Order: Streptomycetales, Family: Streptomycetaceae, Genus: Streptomyces
tctcccgggccctgggcggcgagcacctggccggtcccgacgggctccacctcaggcccggcgacgcggtcctggtcgcgccgccgccagggggcagcctcagtcccgaccaggccgcgctcgatcacgtgcggctcctggcccgcacggccgcggcgctcgccgggcacggcacgccagcggccctgtgggcggtgactcgcggggcgcggaagcccggtgacgtgcgcgcggccgcgcagggcgccctgtggggtctgggccgcaccctggccggtgaactcccgcacctgtggcgcggagtgatcgacctgccctcccgtcccggcccggacgacctggcagtgctcaccgcactgctgggccgcgcgggcaccgaggacgtcatctgcgtcgaggcgggcaccgcctggtccacccggctggtgccggccccgcccgtcccggacggcggtccgcggtgcgcaggcccagcgcgcccaggccgccggtgatcaggtaggtgccgtcagggcggcacc

SEQ ID NO: 1783 - DNA, 928 bp, Unknown
  Kingdom: Bacteria, Phylum: Actinobacteria, Class: Actinobacteria, Order: Streptomycetales, Family: Streptomycetaceae, Genus: Streptomyces
ctcccacgcgctgcggccccggcagccgtcgaggacgaccctgccctgccgcacgccgcgcagcgcctcctcgaccgcgtggacctcggcgcggccgtacgcgtagccgtgcgggaggacgagcagcgtgggggagaagcggtggccgcccaggtgcgagacttcccaggcgcctcgcaccccgccggaggcgagttccgcggcgaggggccggcccagcagtgcgcagcaccggtcgcgcttgccgttggtgcagacgagggcgagtgggcccgccgtgtgcggcccgcccgtcaggaccgtgtcgaaggtgtggtggtcgcccctgccgagggcggcgaagtcgaggctcagcaactgttccggtgccgcggtcagcgcgccgtgcagccaggcggcgccgggcagggtgtgggccgcgtacacatgccgcaccgacggggagtggcagtcggcgtgccgtccggggcggcggatgagcgcgacacggacgccggtgccctgtaccgcccgctccagcgcgcgtcccagggccgggtccagatggcttgacgtgagcgccttggcgccccaggggcccggctgttccagcagcagccacgtcgtcgccgtgggtgcggtggcggacagcggttcgccgagctgccgggaagcggtcgcgcacgtactcacagaggcgagcctactgcggccggcgccgccggatcgcccgggcccgccaggccgtcggcccggacgttccaggtggccgctcgccgtcttccgggccggtgagcggctcgtatgctggtgcggcagtcagtccgcgcgcctgcgccggggcccgtcgccccgggcacgcaccgctgggagagaggtcgcacggtgagccagccgctccggaacccggacccgtccggtcccccgagtacggtccggccgcgggagg

SEQ ID NO: 1784 - DNA, 1031 bp, Unknown
  Kingdom: Bacteria, Phylum: Actinobacteria, Class: Actinobacteria, Order: Streptomycetales, Family: Streptomycetaceae, Genus: Streptomyces
atcaggcgaccggtcaccggtcaccggtcgcctgatcaacgccgaccgccccgcgtcagacgcgctgccagagggccgaaaacggctgcgcgccggtggcgcctcatgcgggtgcggcgcgagcatcgcggccggctcgccgcccggtctccaggatcgcgggctcgcccccggtctccaggaccgcgtcgaggtgacgccccagtccacccctgagccgtgccgacggacagggcccctcccggacgaggctcgcgcctccggccgtgggacacccggactccgccttaccgctaccggacagcacaggtgagctgcgccgctgcggcaatcgggtgggcggaacagccgccgaatcggtctctaccaggtgttcaaaatgttcgaaaagggtgatcccgggagatacgccgtgaccagggcgacggggtggcgttgaacggaaagtgcggtggcgcgtcctgctgccgcactcaccgagcaagttaggagaacgtgatgtctcgcatcgcgaaagcggctgccgtcgccctcggcacgggtgccgtggtgatcagcggggccggtctcgccatggcggacgccggcgcccagggcgcggctgtcggctcgcccggcgtcgtgtccggcaacacgatccaggtcccggtccacatcccggtcaacgtgtgcgggaacaccgtcgacgtgatcggcgtcctcaaccccgccttcggcaacacctgcagcaacaccggccacctcggcactggcgacaacaagccgggcggctacggcggctgacgtaccgccggaccctgcgaccgttccgccggccactgcggctgacgtcgtccccgcaggtgccggcaggttcccgtaggttcgagcaggttccacaggaaggccccggcacctcgagcgccggggctctcccctgtccgggggcctgagcctccgcaccggcttcagacgtaccggtagacgccgctcacgtcctccagcgcgtccggggtgacgtcccagggcggcagtttctggtgccgggcgac

SEQ ID NO: 1785 - DNA, 4760 bp, Unknown
  Kingdom: Bacteria, Phylum: Actinobacteria, Class: Actinobacteria, Order: Streptomycetales, Family: Streptomycetaceae, Genus: Streptomyces
accccaacctcgcccccaccccgcccatgggctggaacaactggtcgtactacggctgcgacatcagcgaggcgaccgtcctcgccaacgcccgcgccctggtctcctccggcctggcagccaaggggtacgacaccgtcaccaccgacgactgctggatgacccacagccgggacgccgacggcaacctcgtccccgaccccacccgcttcccgcacggcatggcctacgtcggtcgccaactgcacgcgctggggctgaagttcggcatctacgaggacgccggcacgtccacctgcggcggctaccccggcagttacggccacatcgagcaggacgcggacctgttcgcgaagtgggaggtcgactacctgaaactggacggctgcaacgtccccgttcccgcgggacagagcgccgacgacgcgtaccactcgatctacggcgacatgagcaaagcgctgctcggcaccgggcgccccatcgtcttctcggtctccgcgcccgcctacttcgagggcggaaaagactggcaccacgtcatctcctggtccgcccaggtgggcaacctgtggcgggagggccgtgacatcgccatggagcccggctcggcccgcggcaagtggtcgtccatcaagtacaactacggctacaacgtgaagctggccgacctgcagagccccggccgctggaacgaccccgacttcctcctcgccggtcagtcccgtctcaccggcgacgagatccgcagccagatgtccctgtggtcggtcatggccgcacccctgatctccagcaccgacctgaccaaggcgtcccccgacgcgctcgcggtcctcggcaacaaggacgtcatcgcggtcgaccaggaccccaagggcctgcagggccgcatcgtgcaccagggcgagggctacgacgtcctgtccaagccgctggcgaacggcgaccgtgcggtggccctgttcaactcctccgaccaggcgcagacgatcacgaccacggccaccgaggcaggactgcccgccggacagtcgtacctgctcaaggacctgtggtcccagcggaccacgcagagcaccggcaccatcgccgcgaacgtccccgcccacgccaccgtgctgtaccgggtgcacccgggcaccgccccccgcacccagcccgccaccgccctcacctggaccaggaccggcggcgacggcaccgcctccacctggaaggtgagcctgaccgaccacgggcccaccggactcaccggcgccgaactgctcctggaggcacccggcggatggaccgtcagccccgcgaaggtgtcactgggccgcatcgcgcccggcgcgaccaagagcgccaccgtcaccgctcagggccccgacgccaagcccggcaccaccgtcaccaccctgaccgcgaaggccgcctaccgcgccggcggcgccgggcagggcaccgtctccggtgagacctcggtcgtcaccgacgtgccctacccgagcctggccgccgccttcgacaacaccggcgtcaccaacgagtccgcacccccggccgagggcaactacacgaccggcgacttcgacggcgacggcaacacctactccgcccaggcgctcgccgctgccggtgcgaccccgggcgccccgctcacgaagaacggcgtgacctggacgttccccgacgccaggccgggcatcccggacaacgtcgccgccgcgggccagacgatcacgatgtccggcagtggctcgaagctgtggttcctcggcgccgaggccggagccgtctcgggcccggtcgaggtgacctacaccgacggcaccaccagcaccggaagcctcggcttccccaactggtgctgcaccgccgggaccgagtacggcgcgaccaccgtcgtcaccaccgaccaccgcaacaccccgtcagggccggccaacttcggcaacggctacaagctcttcggcaactccgtaccgctgacggcgggcaagaccgtccgcacggtcaccctccccgacgcggaccagatccacgtcttcgcgatcagcgtgcagtgacaccggcccggtccggggccggggccgcgcacggtcggcgacgaccgtgcgcggcccgcacgaccgtacgcggaccgggccgcgcccggtcgggacgttcgcagggacgtcggttgctcggccggacatcagcgccggtccgtcggcgcgcggagctgctccctggcccggcgccgggcgtcccgcagccgctctcggctgtcctggccgccgggcccgctggagtcccggggtgccggatcgccgtgacgggcgccgtccggctccgcgcaggggtcggcggtgaggtcgagcgcggcggcgagcgcccgtaggttcgggtgctggaacagcaggagcgggtccagccgccggccgaggacggtgctcagttccgccccgaactgcagcagcgtgatcgaggtgaagccagcgtcgaagaagttggccgtggtggagacggggtggccgagtaccgccgccgcggtgtcctggagccggtcgtcgagtgacgcccaggacccggcggagggcgcggcgaccgctcccgcgcccggggcggcgggcttgaggttcgcggacaggtccagctggtcgacgatcgcgatcgtcgcgggaagcgccggcgcggcgagcacttcggtgagatgcgcgcgcacggccgcctccgccggaggtgactcaggggccaggggctgtacccacagccgcagcgcctggtggtcctcgtcgccgacgagttcggccaccgcctccgccaccccgggacagccgcgtgccgcggcctcgacctcgtcgagcaggacgcggtgggaattgaccaggacctgccgatcgaggcgaccgaccaggtggagcagtccggtcgcgtcacgctgcgcgaggtcgccggtgcgcaccatacggacggagtcggagccggtgacgaaccgctcgggcgcgtcggtgaggtatccggacgcgatccacggctcgccgacccatagttcaccgcgttctccgtcggcgcatcggcgcccgtccgcggtgaggagctcgacctgtctgccgggcagcggacgaccgatgggcacgtgggaggcgtcggggagcgggtcgtcggggtcgaggcggtgggcgaccaccagttgcggggtctcgacgcatccgtagccgttgacgatcacggcttgcggtgcccgcgatctgatcagtgccgccgtcgcggtggtgagcggggcgcccccgcagatgacgaggcgcaggtgcgggaggcgctgggtgttccgggccgcgccgaggacgagcgccagcagggtcggggtcgagctgaggacgctgatccgccgggtgtgcagccagtgggcgagccccgtgaggtccgcctgctcacccggcgtgggcaggcacaggcacgctcccgtccgcaccgcgaggccgatgtcgcgcagggcagggtcgtgggcgggtccgctgagcagggcgatacggtcgtcggcgccgacgccgagccaggccacgaggtcgtcgatcgcggcgtcggtgacgggtgtcggtaccagtaccgggagggggtccgcggtcgtgccggaggtgaagagcacatgtgccgccgcggggaggccgcgcgtctgccggggcggggccgggaggacccgcagggggccgtcgccgtcggggaaggcatgcgaggcgccgctgcccacaaccgctgcgtcgcggcgtgcccgcggccacgcggcatcgatcaggaccggggtgacctcggcgcgcatgcaggcgagcagccgctcgatgaagaggcggtcacgccgggcgggcagggcaacgacgtcaccgggtacggccgttgccagcacctgcgcggcgcgggcggtgacggcacggtcgagtgtgcgccggtcgacgactctgccgccggtgtcgagagcgggggcggagggctgttcggccgccgtacgggagaggaggtcgaccgtcgacggagtgtgggtgtgagtgtgggtgcgggtgtgagtgtgagtgggtgcgggtggtgctgtgaggtgtccggcggtcggcgcgggcggcaggaggtcggcgagccggcgctgcgggtcggtcgcggcggctgagcagacctgtgccacctgcccggcgaaatcggtgagaccggcgacatcgcgggctgctgttcgctcgggggcgacgaggtgcaggcggtagccgtcggtggtgcgtttgacgtacaggctgaggtcgaacagtgcccacccgggtgcgaggtcgtgttcggtactcgcgtggtcgccgaaccgcgctggtggagctgccccggtgaggtcgttgaaccacaggcggatgagcggactgcgggacgtgcgggggagctgaaggcggtcgaggatctcgtcgtaggtgggcgttgcgtggtcgacggcgtcgaggagcgtgagccgtgtcgccgcgcacgcctcgaggacggtgcgcttgtccgcggcgggatggccggggtccagcagcagggtgtcgaggaggaaggcgacggtctgctcgtccgcgggctccccgacccgcacgctcggcacgccgacgacacccgggtgcccgccggagtgtgcggcgagaaccgtcgtggcgatggtcaggaagaagacggccggcgtgatcttggcgctgcgcagcatcgagtccactgcgcggccggctggggccggcaggtcgacggtgacggtggtggcccggtgcgcgtcgggaccggctgcgagg

SEQ ID NO: 1786 - DNA, 678 bp, Unknown
  Kingdom: Bacteria, Phylum: Actinobacteria, Class: Actinobacteria, Order: Streptomycetales, Family: Streptomycetaceae, Genus: Streptomyces
gccccgtcgtacccaccgacagccccgtcgacgcggcctgcaagaacaaccgggcgctcctcaaggaacgtttcggcaaagtgatcacgcagcccatggagcacatcccctacgccctgcgccgctcggcgatggaggaggccgaacgggacttccccgaggcctgggcgcgtacgtcggcgagcaggttccgggccatgaccgacctgtcgccgacctcgtccttcgtcctctactacgcggcgctgaccggccgggcccaaccgggctccatgcccttcacctacctccagctcgccgtccccgacctcgccgaccggctccaacgcctgctggacggacgcgaccaggacaccttctgcctcaacgacgccttctcgacacccgaggacatcgaggcgcagcaggaactgctggacggattcctcaacgcctacttccccacccccagcccctacgaacgatgaagcggagttcttgacgtgcccgacccgacgtcgatgaactcagcggttcacgtctacaagcggctcgtcccccagcccgtgcgctcggccgccgcgaccaccgtcccggccggcgtacgccgcaaggtcaagggacagctcgcccgcaccctgcgccgccgcgaggcccgcctgcaccgccgcgccctgcgccaggtgcgccgggccgggc

SEQ ID NO: 1787 - DNA, 1229 bp, Unknown
  Kingdom: Bacteria, Phylum: Actinobacteria, Class: Actinobacteria, Order: Streptomycetales, Family: Streptomycetaceae, Genus: Streptomyces
atacgcggcctcgtacgcgcccgtcggcgcgtacgaggccgcgtatcgcggggaccgccagcagcgcgaccgggaccacgacgctcaccgccgcggacaccagcagcacatggcccgcgccgagcagggaggcggacggtccggcgagggcctggcccaccggcatcatggcgagggagcccgccacgtcgtaggcgtggatgcggttgaggacgtcggcagggacctgcgtctggacgctggtcgcccacatcacaccccagaacgcctgcccggcgcctgcgaccgcggctcccgcggccatggcccccacaccgagccccgctccgacggccgccgggaaccagacgaaggcgaacagcgcgaccgctccggcgcgcagcatccggcgcgggcgcagccgcagtgcgaggaacccgccgacgacggtgcccgcgccgagggcggagttgatcaggccgtaggcccggggaccgtgctgctggaccacctcggtggccaccagcgggacggtcgggccccatacggcgatcatgtagaggcaccagatcgcgatgacaccccacagccacgtacgcgatctgaactcacgccagccttccaccaggtcggccttgaagctgcccggtccatgaccggcggccgggtcgctgatgggcctcagcagcggcagcggcggcagcctgagcagcagcaggcacagggcgctgatcgcgtaggtggcggcgtgcgcggcgaagactccgccgggcgaggcgaagccgacgaggaggccggcgacggcggggcccgcgagctgggcgccggactcggcgatccgtatcgcgccgttggctccctggatgtcggtggcgaggcggggcaccgtactggccacgccgggctggaagacggcgcccgccacgccgttgaccaacccgatcgcgcagatctcccagagcaccacgtgcccggagtagaagagaaccgctgccgcggactgcgtgcccagccgcaccaggtcggccccgatcatcagtctgcgagtgctgaagcggtcggcgatgacgccgccgaagaccacgagcccggcgaaggcggcggcggtggacgccatggcgaggcccaccgcgcccgcgccgtacccgtgctgcagcaggcccgcggccagcgcgacgggcagcatggtgtcgccgagccgggcgacggcacgggcgacgaagaacagcgcgaagtcccgcgaccagacc

SEQ ID NO: 1788 - DNA, 590 bp, Unknown
  Kingdom: Bacteria, Phylum: Actinobacteria, Class: Actinobacteria, Order: Streptomycetales, Family: Streptomycetaceae, Genus: Streptomyces
cggctcccgcagtgggtgactctgctcatggccgggtccgcggcggcttcgaacggtgaggcgtagaagctccggaagcagtggagagtacagcccgtcgtcgtgggccgggtgagatccacatgccggcaccgtggctcggcggcgcggggttgctgatcgccgcagtgccaggcgtctgacgttctcgccgtagcccgccgccgtcggcggatgcaggaggggcgagtgcctcgccgctgcgatctacgtcggctcgacggacccggaagatcaccgccagaagccgctctgcccgcgccctgaccggcggttcggggcgggtggtcaagttatatgggacagccccgacaggcttgctgttcaggcatgttgaggtggcgggagctcccgcgtgggcgcgaagaaggcttcatagtgactgtgccagacctcactcgcggagcggggttcttgttcgtgtttgagggcgggctggcaacgaggtggcctgcctcggctgcagcgatgacccggaaccgagccgggcccgcaacccgttgtcagacccctgtggtgaggtggagtcagacggcgaagagcgagcggcg

SEQ ID NO: 1789 - DNA, 873 bp, Unknown
  Kingdom: Bacteria, Phylum: Actinobacteria, Class: Actinobacteria, Order: Streptomycetales, Family: Streptomycetaceae, Genus: Streptomyces
cctggctcgcccagtgcgtccccggcgcccggatcctgctgccgatcgccaccggcctggccgcgctgaccgtgcgggacgccgcgcacgcggaagggcccttcctcgacacgcccgcctacttcgtaccgctgcgcggcggcggcagcgaaccggaggcaccgctgccgaggctggacggggtgcccgccagggcccgtgaggacgaactgttccggttcctgctcgccctggtccgcggccggaccgacgcacgcgaagcgtacgacctgtgggagcgggcgggacggccggagcgggagcgctacggggtcaccgtcagcggcgggcgcgcctgggcgtggctggaccacccgcaggggccgcacacctggcccctgccgggttgatccgtacgccctccggtcagccgcgccggacggtgatcgtcgtccacgcgccgacgtgcacccggtcgccgtcctgcagcggcaccggcacgaagggctggatcggctcctcggagccgttgaccgtggtgccgttggtcgagttctggtcgaccaccgcccagttgccgtcgggctgctggacgagcaccgcgtgctggtgcgagacgcccgggtcctccggcggcaccgacaggtcgatgtccggggtgtcaccggtggagtgcctgcggcggccgatggtgatctggttgccgctgagcgtgcgctgctgctccggggagtacgcgggcaggttcagacccgcggcctcggggccggagcggtgcatcatcgccatgaagtactcgcggtccggaccgatcgtcgccgtccaggtcgcgggctgctgcggctgctgcgggaacgcgggaccgggcggcggcggggcctgcgtggcgccggg

SEQ ID NO: 1790 - DNA, 2133 bp, Unknown
  Kingdom: Bacteria, Phylum: Actinobacteria, Class: Actinobacteria, Order: Streptomycetales, Family: Streptomycetaceae, Genus: Streptomyces
ccgtcggtgccggtggaggcggcggcgcccggcgtccaccgcctcaccggcaccgacggcacgcacacctacgcgggcacggtccgggtggacgacccgctcgcttcgctccccgtcaccggcgagtggaccctgaccctggagcgggagggcgccgccccggtcaccggaccgctgggcagctggacggcgtacgatccgctcttctccggcagcggcacctacaccaccaccgtcgacgtcgcccggcagctcctggacgggcggcgtgtcgtgctcgacctcggtgacgtacgtgacgtggcggccgtgaccgtcaacggcaccgcgctggaaccgctgctgtgggcgccgttcatggtcgatgtcaccgaccggatcgtggcgggccgcaaccggctggcggtccgggtcgccaacaccctgtccaacgagcgcaacaagccgctgccgtcgggcctgctcgggccggtcacgctccgcttccgccgccgcgtcaccgccgacctcacccgtctctgacacgcgcccccggcccccgcatcctcccgcacacccgaaaggcaccatgctcacccgaaggagcaccatgctcagacgccgcccccgcggcaggcgccgccgggccctcgccctgcccgccgccgtcaccgcgttcgtgaccgtgctggccggcgcagcgcgggccacggccgaacccggcacggccgtcgcgccggccggcctgcgcacccagcacctcagccaggcgctcggcatcgacgacaccacgcccgacctcagctggcggctcaccgcacgggccgcgaacgcgctgcagggcgcctaccgggtccaggccgccacgtcgaagcagcgcctgaacgccggccggcccgacctgtgggactcgggcaaggtggtctcgtccgtgccggagacgacgtacgacggccgcgccctgggttcccgcacccgcgtctactggcgcgtcatgctctggtcgcagggcggccggaacgcctccgggtggagtgatccggcggtgttcgagaccggtctgacccgggcgtcggactggggtgcccagtggatcacgcaccccgactggcagctgagccggcgcgaggtcgagcccgtcgtcgtcaaggtgccccgcaccacgtcccgttacgtccgtctggacgtcacgcggctcggcctgccgctcgcggaggacttcccggcccggacctggcggctgcagctcggtgagatcgacgtccgcgactccgtgacctcggcgacgggcctggcccggggcgcggcggtgaccgcgtcggagagcaacacggtccgcaagacctgggaacccgcgctggccgtcgacgggctggcgaacagcgccctgcagaccgcggccggatactccagtgccgcccacgcctccgccgacgtctccgaccgtcccgtcaccgtgaccctcgacctgaagacggcgaagaccttcgaccaggtcgccctctacccgagggccgacgtcctcaccgacgacggccgcgtcccggacttcccctcggagtacgcgctgtccgccgcggacaccgccggcggacccttcaccgccttgacccgggtgagcggccagcagccgccgaagccgtacctgccctccggactgcccctgctcgcccaggacttcacgctgccgcgcgcggtgcgcggcgcccgcctctacatcgccgggctcggtgtctacgacgccacgctcaacgggaagcccgtgggcgacgccgtgctcgaaccggccaacaccgactacacgcggcgcgtccagtacgccacctacgacgtcaccgaccggctgcgcaccggcgccaacaccctcggtgtggcgctcggcaacggcatgtccgatgtggtcagcaccgccgaccgctaccgcaagctgtacggcgacatcagcgaccccaagctcatcgcccggctggaggtgaccctcgccgacggcagtgtccgcaccgtcaccagcggcgacgactggcgcacggcgctgggaccgacgacgtcgtccaactggtacggcggcgaggactacgacgcgcgccgcgagatcgcgcactgggaccggccggacggcgaccgcgcggggtggcagcgggccgtcaccgtggc

SEQ ID NO: 1791 - DNA, 951 bp, Unknown
  Kingdom: Bacteria, Phylum: Actinobacteria, Class: Actinobacteria, Order: Streptomycetales, Family: Streptomycetaceae, Genus: Streptomyces
atgggcgcgggcaccaaccactggttccactccgacaccatctaccgctccttcctcaccctgctgctgctcaccggctgccagggcgtcaacggcggcggctgggcgcactacgtcggccaggagaaggtgcggccctacgccggctggcagcagctccagtccgccgccgactgggtccgcccctcccggcaggtcgcgggcaccccgtactggtacctgcacaccgaccagtggcgctacgacggccacggcgccgacgcgctcgccgcgtccaccggcaagggcctgttcgcggggcggcacaccgccgacctggtggcgcagtcggtgcgcctgggctggatgccgtccgcgcccgccttccgtgccaacccgctcgacctgggccgcgcggtgcgcgagagcgggcacgaacccggcgagtgggtggcgtcccaactggacgccgggaagctgtcgttcgcctgcgaggacccggacgccccggagaactggccgcgcgtgctcaccgtgtggcgggccaacctgatcggctcctccgccaagggcaacgagttcttcctgcgccacctgctcggcgcgagcgacaacgcgcacgccgccgaggccccgcccgcatccaggccacgggacctgacctggcacgaggaggcaccgcgcggcaaactcgacctgctgctcgccctcgacttccggatgacctcgaccacgctgatggccgacctggtcctgccggccgccacctggtacgagaagcacgacctgtccagcacggacatgcacccctacgtgcacgccttctcgcccgcgatcagcccgccctggcaggcccgcaccgacttcgagatcttccacgcgctggcccggaagttcagcgaactggcggccggccggctcgacgtggcccacgacctggtcgccaccccgcagcagcacgacaccccgggc

SEQ ID NO: 1792 - DNA, 1859 bp, Unknown
  Kingdom: Bacteria, Phylum: Actinobacteria, Class: Actinobacteria, Order: Streptomycetales, Family: Streptomycetaceae, Genus: Streptomyces
ggacggcctgttcgtcggcgtcggggccggtgccgcgcacgtgcgccacgaagtcctccgcgatctgctcgtcgctgcggccggcgagacggcgggcgtaggagacgtccgggtcgtcgggggcgcgctcgggtgcgaagacgaggctgagggtgtgcgggaaccgctcggtgaggcgggccatcgggtcggccgggcggaccgcgtcggtcagggtggcctcgacccaggcgtcctcgtggcgggcgaggccggggtcggccagcaggtcctccagggtgccgctgatccgggccagcgggcgcggcaccgggcagtcgacgcgctcggcggtgacggctccggcggcgtccaggtcgacgagccacatgctcttgcggtgcgcggcctcggagaaggagtacggcagcggcgagccggagtagcgcacgcgctcggtgatgacctggctgccgtgcaggtggcccagcgccgcgtagtcgacgccgtcgaagacgcccgcggccacggaggcgaccccgcccacggtgatgtcccgttcgctgtcgctggcctcgccgccggtgacgaaggcatgcgcgaggacgacggagcgggtgccgggcgcgcgcgtggcgaggtcggcgcggacccggcccatggcggcggccaggaccgcttcatggctcgccctgtcgacgccgaactctcccttgaccagggcgggttccaggtacggcagcccgtagaaggccacctcaccgtgggcgtccgggagcagcaccggggtgccgcacgcggccggctcggtgcgcaggtggatccccgcgcggccgatcagtccggccccgacgccgagcctgcgggccgagtcgtggttgccggagatcatcaccgtgggcacgccgagagcggcgagccggtgcaggacgtcgtcgaacagttcgacggcggccagcggaggcacggcgcggtcgtacacgtctcccgacaccaccaccgcgtcgacagcgcgctcccgcacggtcgccacgaggtgtccgacgaacgcggcctgggcgtcgagcatgttcacgcggtggaacgcccggcccagatgccagtcggaagtgtgcaggaacctcatgatggtcgaagagtagccgccgggtccgacagcacgggcggttactctcgcatcagccggtcaccaacagcaccgaatgagacggttgatggcacaatgcccgttctgtcgcgtgaggtttcacgcgtcgccgcgggctcgccctacgcgtcgccgtacgcctcgccgcccagttcgaacccggcctctccggccgtgacgtccgccagccacgcccggaaggcgtccacgtcggcgtccggcaggccgatctcgatggtgaccgcctcgccgtagcgcacgtcgcgcacctcgcgtccggtcgccctcaggtcgttctgcaccttgccggcccgctggtggtcgacggtcaccgtggccagccggaagcggcggcgcgtcagcgtgccgagggcgtcgagcgcctcgccgaccgctccgccgtacgcccggatgagaccgccggcgccgagcttgacaccgccgtagtagcgggtgacgacggcgacgacgtaccgcatgtcgcggcgcagcagcatctggagcatgggcacgccggcggtgccgccgggttcgccgtcgtcgctggccttctggatgccggcgtcggcgccgatgacgtaggcccagcagttgtgcgtggcgtccgcgtgctccctgcggacggcggcgacgaactcctgggcctcccgctcggtggcggccggggcgagggcgcacaggaagcgggagcggttgatctcggtctcgtgcacgcccgcgcgggcgactgtgc

SEQ ID NO: 1793 - DNA, 1331 bp, Unknown
  Kingdom: Bacteria, Phylum: Actinobacteria, Class: Actinobacteria, Order: Streptomycetales, Family: Streptomycetaceae, Genus: Streptomyces
cgctcggccgagcagccgccgtccgccacccgatcccggggccgcggtgtggcgggactggccctgctcgtcctcggcgccggactgctggtgtcgctcacgggggccgacgacgcctccgaggagaacctgcgaagcgcgatgttcggctgcgccgtcctcgtcatcgccatgatcgtactggcgccgctgctcgccacccccgtgatccggctgagcggacggctgaccggacgcttcggtatcaccggccagctcgcacgcgagaacgccctgcgtgacccgcggcgcaccgcggccaccgcctccgcactgatggtcagcaccgcactggtcgccgggctcgccgtcatcggcaactccaccgggcaggccctcgaccgtcaggccgcggccggcctcaccgccgactacgtgatcagtacccgcaccatcacgaccggcatcgacccggccgccgtacagcgggtcgccgacacctccggggtgcggacggcgaccgccgtcaccgactccgtcctgaccgtcggcggctccgctcggcagatctccggcatcgaccccggcaccgtgaactccgtcatgaagctcgacttcgtcagcggctccctgaagggtctcggaccgggccggatcgccgtctccagcaccatcgcccgggaacagggcgtgagcgcgggcagccggctcaacgcccgcatgggctacggccagcacttcaagcactacaccgtcgtcggcgtctacaaggacaaccccatcgcccacgacgcgctgggggcccgtaccgaggtgcagcagaacagtttccagcccggctccgtccagcggatcctcgtccgtaccgacagcggcgcggcctcgaagaccaccgagaaccgactgcgcaccgccacgggcaacagcccgctgctgcaggtgaaggaccgggaggaactcgtcgacgaggccgccggggccatgagcgacctgctgaccctgatgtacgggctgctcgtcatcggcgccgtgatctccgccctcggcatcgtgaacaccctggccatgtcggtggcggaacgcactcgcgagatcggcgtactgcgcgccctcggcatggaccgcaccggcatccggcggatgatccgcctggagtcggtgaccgtcgccgcgttcggcacacttctcggcctggcgagcgggctgttcggcgcctgggcggtcggctcgctggccaacggcgcgatggcgcggtactccctggcgctgccctgggggacgctgctcctcgtgtgcctggtgtccctcgcgatcggcgcggtcgcggcagccgtcccggcccgccgggcagc

SEQ ID NO: 1794 - DNA, 855 bp, Unknown
  Kingdom: Bacteria, Phylum: Actinobacteria, Class: Actinobacteria, Order: Streptomycetales, Family: Streptomycetaceae, Genus: Streptomyces
cgcgggcctcggtgagcggcagccccgtgacgcgggcgatctcctcgatgacggcggcggagaagccgggcggggtgttgatgccggtgccgacggcggtgccgcccagcggcagctcggccagccggggcagggaggcccgcagccgctcgacgccgtagcgcacctgggccgcgtacccgccgaactcctggcccagggtcacgggcgtggcgtccatcaggtgggtccggcccgacttcacgacgtccgcgaactcctcggacttgcgggcgagcgcgtccgccaggtggtcgagggccgggatcaggtcccgggtgacggcggcggtcgcggcgatgtggatcgaggaggggaagacgtcgttggaggactgggaggcgttgacgtggtcgttggggtgcacgtcgcggcccagccgctcgctcgcgagggtcgcgatgacctcgttggtgttcatgttggacgaggtaccggacccggtctggaacacgtccacggggaagtgctcgtcccatgtgcccgcggccacctcctcggccgccgcctggatcgcctcggcgacgtccttgtcgagcacccccagctccgcgttgaccttggccgcggcccccttgatccgcgcgagcgcctcgatgtgcgcgcgctcgatccgctgcccggagacggggaagttctccacggcccgctgcgtctgcgcccgccacttggcgtgcgcgggaacctggacctcgcccatggagtcgtgctcgatgcggtattcactcataccgggtacagcgtgtcagacggtgcggttgttccggccgttgggccggatggggggggtgacgggcagcacgtgacgggcggaac

SEQ ID NO: 1795 - DNA, 908 bp, Unknown
  Kingdom: Bacteria, Phylum: Actinobacteria, Class: Actinobacteria, Order: Streptomycetales, Family: Streptomycetaceae, Genus: Streptomyces
ggcgtcgggggccggggttcgcgggcgggcggtcgccgcgtgtgccggtcccgtgagcagggtcagtaccagcgatccgagcaccgcacccgtgcacgtcgtgcgtgaggccatacgtttccgctcccgtcttcgtcttgcgtggtccgttgcgagattgatcacatgggggcaacgcaaccatctcctaccgcgtcacatctcccgagacgacacacagttggtcactcgccgatcactcgttgatcaccgagtgggactgatttggcaaaggattgctctcaagggcacggaatggatcattcgtgctttacatgtgcatgtcctgaccacaagggtttctctccggggcccgaccagccctcatggcgcaaccgcgccatgcgtcggggcggttggcgatcccggccgcttcaccaacgaaggaaccctcaagagtgcacagaccccacatacgcaacgtggcggtcgtcgtcgccgcgacgacggccgtcacgggcctggccggcccggcactggccgcccccgccaaggggccggagcgcacggtgcgggccgccaccccctccaccgcctcggtggtgggtgccgcccgcgccgccgccttcgcccacgcctcggcgaccggcgtcatccaaggggacgaactgcgcgcccaggacgtgatggtcgaccccgagggcgcccgtcacgtccggttcatccgcacccaccagggcatgccggtgctcggtggcgacctcgtcgtccacctgaaccggaacctggcgtacaccggcgtcacccgggccgccgaccggacggtcgagcccgccaccacccgggccaaggtgacgcccgcgcaggccgccgccaaggccgcctccatagccgagggcgacgcgggcaccgcgcagctggtggtggac

SEQ ID NO: 1796 - DNA, 1807 bp, Unknown
  Kingdom: Bacteria, Phylum: Actinobacteria, Class: Actinobacteria, Order: Streptomycetales, Family: Streptomycetaceae, Genus: Streptomyces
cgcgctgggcgcgccgtccgcgttcggccagtcgcagttcgccctcacccggggcaacgcgttcgaggcccgggtcaaggcggacggcggcgccgagcgcgcccgccagcgccgtcttgtccacgcccgcgccgtccaggatcgcgcgccgcttgcagccggggttggcggcgagggccgccagtgcgcgggcgtccagcgcacgggccggtacgccgctgccgcgcagctcagcgagctggtgccggagcgccgtcctccgcgtcctgggaggaggcacccggctcggctccggaatcgagccgtgtttcgcgctgccgtggaattcgctcacccgccgaagtctcgcacccgccactgacaatcggggagatctcaccggccgagcggcccgcgagggccgggacacgagcggccaggaccgtgcgggcgcggtccacggcacgcgtcacgaacgggccgagcagcagtccgacgcccatcacggcgacgcccgcgaccgcgtcgaggaagtagtggttcgccgtgcccatgaccacgagggtggtgagcagcgggtaggcgacaccggccgccttcgtccagcgggtgccgccgtgccgccagagcatcactccgcaccacagtgcccagcccacgtgcagactcggcatggccgcgtactggttggtcatgccgcccatgccgcgcggcgcgctggcgtcgccgccccaccagccgtacgagctgtagtgggccatggtgtccacgaagccgtggtccggcgagagcaggcggggcgggcaggtcggcagcagggtgaagccgatcaggccgatgaacgtcgacgtcatcagccaggtacgggccgtgcggtacaggtcggagcgcttgcggaagagccacaccaggatggccggcgtcaccacgtagtgcagtgacgcgtaccagaagtcggccgggacgccgagccacggctcgcgggtgaacaaccggttgagcgggtgttcgaagttgagccggaacaccttctccaggcgcaggatcgacagcccgtggtcgacggcgcccgagacgtcgccgcggaccagcagccggccggccgagtagcagccgtagacgagcaggatcagcggaagttcggtccaccagcgcagccgggtccgcgggggcgcctcggtatgcggtgcaggtgccggtgcctcggtctgcggcatccgatgcccctcccccttcaggtcgctctgctactcgtcgctgcggcgcccggcgatcccgggcggttccgggccggtcgtgccactttacggtctgcacgcccgcccgcgcggggtgccccggctctcgaagacgcgaagaccgccccccgggttgctcctgcacaaggtgcgcgatgatgggaaggtcccgcccgaagatctcactttttccccggaaaggctgctcatggcaccgcgcatcctgctggcccggcacggacagacccagtggtcgctgtccggcaagcacaccggcaggaccgacgtgcccctcctggaagagggccgccgcggcgccaagctgctcggcgagcgcctgcaccgggcccccttcgacggcctgccgggcgtcgaggtccgcaccagtccgctggcacgcgcgcgcgagacgtgcgaactcgccggtttcggcgagcgcgcgatgtgctgggacaccctcatggagtgggactacggcgcctacgagggcatgacaccggagcagatccaggccgagaaccccggctggttcatctggcgcgacggcgtcccgcgcggggagacgctcgccgaggtgacggcccgggccg

SEQ ID NO: 1797 - DNA, 1444 bp, Unknown
  Kingdom: Bacteria, Phylum: Actinobacteria, Class: Actinobacteria, Order: Streptomycetales, Family: Streptomycetaceae, Genus: Streptomyces
tcaccgcccgccgtacgtccgccgccggggcgcccgtcgccgcggccagcccctccgtggcgaccgcgtccagcgcgccctggcggacctcaccggtcagcagcccccgcaggaaccgctgctcgtcctgcgtcgccgcgcccatcagctcaccgacgagccgggcgcgctcggcctgtgccccggctccggagaccttgcccagctcgctcagccgggcgtcgacctcccgcacggtgagggagggcccgtcggccggggcgaccgggcggccgagcaccgtccacccgacgccgatccgcccctgcgggagcctgcccgccaggtacgggatgacgatcggcacgtcctgtgccgccgcctcccggaacagctccgcgagcagtgcggtcttgcgggaccgcgcggacgtggccgcgacctcctgcgacacctgtgcgagccgggcgagcaacatgcagtaatggtgcaccgcgagacgccccctcacacccccgcgccggcggcgggggtgtgcgggcgcgtctccgtgatcacaccccgcggcctcggtctacgccgtcgccgcctccgccgccccgatcgccgcgtccaggtcggcgaagagcagttcgccgttgatcgccgcgcccgcgcggtagccccggctggccgcgttgatcacctgctcggcgaagccgctcgcgttccccgccgcccacaggcccgggaccgtcgtcaggccccgctcgtcgatcaccgggtaggcgccgaacggcgtctcgcgcatctcggcgcccagccgcagcagaaggtcgttgcgcggtaccgcgcgcggggcgacgaacaggacctggcgggcgtgcgtcgtcccgtccgcgagccgcaccccggtcaggcggccgtcctcggccaccacttccgccaccttgcccggcacgacggcgacgcccgccgccgcgagcctgcgcaggtcggtgtcggacagttcgtcctcggcgacctggtgcaggaacagggtcacatccttggaccactggctcaccatcagcgcctggtgcacgctcagcggcgtcgtggccagcacgccgaaggcctggtcgcggacctcccagccgtggcagtaggggcagtgcagcacgtcggtgccgaaccgttcggccacgcccgggatcgccggcgcctcgtcccgcagcccggtggcgacgaccaggtgccgggcgtgcacggtgcgtccgcttgtcagcctcacgtcgaactccccgtccgtgtcccgcacggcgtccaccgcacggtcccggacgagggcgaccccgtaccgcgcgatctcctcgcggccggtggccaggaactcggccggtgacatgccgtcccgggtcaggaagccctgcatgtgcgcggcgggcgcgttgcgcggctcgcccgcgtcgacgaccagcgtgcgccgccgggcccggccgagcac

SEQ ID NO: 1798 - DNA, 1944 bp, Unknown
  Kingdom: Bacteria, Phylum: Actinobacteria, Class: Actinobacteria, Order: Streptomycetales, Family: Streptomycetaceae, Genus: Streptomyces
ccctcgcccagctccagcccggccgcacgccggcacagctcgtcggccgccttgaccacctcgtcgacgcccggccccaccgcgagcagacagaactcgtcgccgccgagccgcgccacgagcgcgccgggcaccatcgccccgcacagcgacagcaccgagccgaatcgttccagcagccggtcgccgaccgcgtggccgagggtgtcgttgacccgcttgagcccgttgaggtcgcagaccgcgagactgacgacgaccccgtcctcgcggtgccgctcgatcgcctcctccagccgtacgtccacggcacggcggttggcgagcccggtgagcgcgtcggtgaacgccagcctgcgggcctcctccagccgttccgtctgcgcgaggccggccgccaccacggcggcgaggaccgtggcgaagtcggcgtcggaccggtcgaagacggcccggccggccgggcgggcgacgtacagctcaccccaggcgcggccgtgctgcacgatcggcgcgacaacgcagcagccgcgcccgcgccggcgcagcgccgcgacccgctggtggcagtaaccgggctgccccgcggccggaccttccgcggtctccacccacgcgtccggctcaccgccggaggcccaccgctcgtgcaggaactcggcgatctccgggaactggtgcaccgggtacgcctcgccctcggggaactcctcctcctcgggcgcccggtcccccacgttcaccagcacccgcagccgcccgcgctcacgctcccacaccgacagcgcggcgaagctcccctccagcgcccggcacgccccgagcgccgccgcccgccacgactcccgcggggtgtgcgccgcggccatgccctgcgccaactccacgacggcggtcagccgcctgttctcgcccatcaccccaggctagggaggttttacccgattcgggacattggtgggccggtcggcgccatgatcacgaacccggaggagaacagcgcgagggcctggagcccggcggtcggttcactcccccggccagcgcggggcgcgcttctcgttgaaggccgcgacgccctccgcacggtccgccgagaaggccgtggaacgccacgccgcgtcctccacctccaggccggcccgcaggtcaagaccctgccccagccgcagcgcccgcttggccgcccgcaggcccaccggcgagttcgccgccatccgggtgcccagctccagcgcctccgcgcggtcccggccctcctccaccagcaggtccaccagccccagctcgcgcgcctcggccgcctccaggcgccgcgcggtgaagatcagctccgcggcgcgcgccgcaccgacccgccggggcagcaactgcgtgccgccgccgcccgggatcacgcccaccgacacctccggcagtccgaccacggccgtacggtcggccacgatcacatcgcaggacagcgccagctcgaacccgccgccgagcgcgaacccgtgcaccgcggcgacggtcggcatcggcagctccagtacgccggtgtacgccccgcgcgcgaccggccgctgccgcagcaggtcggcgtcgctgaaggagttgcgctccttcaggtcggcgccgacgcagaacgcccgctcgtgcgaggaggtcaggacgaccacccgcgcgtccgggtcggcggcgagcgccgcgcacgcaccggcgatcgacctggccatgtccgtcgacacggcgttcatggccttgggccggtcgaggacgagttccgcgacatggccgtgccgccgcaccagcacgaactccccgaaccgctcctcgctcatgacaccctcccggttaacgcgtgttaacaacatccgccccgatcatctcagccgcgcccgcacggggaaagggtttccctgtcgaggaccggcaccccgttcgagtgacatcccgcccaac

SEQ ID NO: 1799 - DNA, 3340 bp, Unknown
  Kingdom: Bacteria, Phylum: Actinobacteria, Class: Actinobacteria, Order: Streptomycetales, Family: Streptomycetaceae, Genus: Streptomyces
ggacgaggaacgggtcggcctggagagcacctacgtggcggtggcccgcgtaccgcgcctggacagcgacttcgacccggactcgtccttctacgcctatctccagagcctcgacctggccttcggtgacgccgacgagcgcatcgagaccgtgctcgccaccccgcgcgaggcactgctcatcggcaccccgcccgcgctgcccatgctgctgatccaccgcgtctcgcgggacgcgcagggacggccgctggagcgggtccgcagcctgtaccgaggtgaccgcttctccttcaccacccacctgaacggctgacacgccccgcagcgacagaagccccggccttcctgtataggtaacgaaaagataacgggtctagcccaatcgtgatgcctcgttcaggctctcgttgtcagccggactcttccggttctccctcagagaggaacgttgccgtcgtgaaagtgacagtcgtcggagccggcgtggtgggcaccatgcacgcctggcaggcagtggaacgcggccacgaggtcgtgcagatcgagcgcgaggccgaggcccggggcgcgtccctgcgcaacttcgggcaggtctgggtgagcggtcgcgcgagcggcgaggaactggagaccgccctgcgggcgcgcgagctgtgggaggagatcggcacccgggtgcctgccctcggcttccgcgccaacggctccctcacccccgtgcgcggcgccctcgaacacgccgtcgccgaggccgcagcagccgccccggacgccgccgcccgcggccacaagctgctgacccccgccgaggcccgcgccctcaaccccgccctgcgcggcgacttcgacgcggccctgtactgcgaacgggacgccgccgtcgaaccgcgcaccgcccagcgcgcgctgcgcgccgaactgctcaagcacccgaactacaccttcctgccgggccgcgaggtgcgcgaggtcgtcggcgcgggcgccgtccgcgacgaccacggcgacgtccacaccgccgacgtggtgatcctcgccaccggcgcctggctcggcggactcgtccgggaactggccggacccgacctgcccgtgcgccgcgtccggctgcagatgatgcagaccgacccgctcggcgaggcgctgcccacctcggtcgccgacgccgacagcttccgctactacccggcgtacgcctccggcgccctggacgcgctcaacgcggcccagccgcagcccgagaccgccgccgcgcaccgcatgcagctgctcatggtgcagcgcgccgacggcggactgaccatcggcgacacccacgagtacgagcaccccttcgcgttcgacaccgtcgaggagccctacgagcacctcacggccgtcgtcgagtccctgctcggccgcccgctgccgaggatccgccaccgctgggccggcgtgtacgcgcagtgcaccgacccgacccgggtcgtgcaccggcagcaggtgcgcgacggcgtctggctggtcaccgggccgggcgggcgcggcatgacctgctccccggcgatcgccgaacgcaccgcgaacgaactgggctggtgagacacccgatgaccgaaacccacctgaccactgaggcgccaggcgacgcccagggcggcaccgacatccggctcgtcgtgctcgacatggccggcaccaccgtcgccgacggcggcctggtcgagcgcgccttcgccgccgcctccgccgagctgggcgtcgaacccggctccgccgaccacgccgacaagctcgcctacgtccgcgccaccatgggcgagtcgaagatctccgtcttccggcacctgttcggcacggaggaggccgctcagcgggccaacgccgccttcgagaaggcgtacggcgagctcgtcgacggcgggctcgtcgcccccgtgcccggcgcccgcgaggcgatcgaggagctgagcgccgacggccgcaccgtcgtcctcaccaccggcttcgcccgcgtcacccaggacgccatcctcgacgcgctcggctggcgcggcctggtgccgctcaccctgtgcccggccgacgcgggcgggcgcgggcggccgtacccggacatggtcctggaggcgttcctgcgcaccagggccgccgacgccgtgcgccaggtcgccgtcgtcggcgacacctcctacgacgtgctcagcggcgtccgcgccggagcgggcctggtcgccggcgtgcgcaccggcgcccacggtgacgcggagttccgcgccgccggcgccacgcacgtcctcgactcggtcggcgccctgcccgccctgctccggggagaacggtgagatgagcatccgcttcgactccgtcacggtcgcctacgacggcaacgtcgtcctcgactcgctcgacctcaccgtcgcgcccggcgaggtgatggcgctgctcgggccgtccgggtccggcaagaccaccgcgctgcgggcggtcgccgggttcgtgcggcccgtgtcggggcgggtgctgctcggggagcgggacgtgacggacctgcctccccaccgccgcggcatcggcatggtcgtgcagcagtacgccctcttcccgcacctgcgggtcgaggacaacgtggccttcggtctgagggcccgcaaggcgggccggaccgagatccgcgaacgggtcggcgaggccctggagatgaccggcatggccgcttacgcgcgccgctacccccgggagctgtccggcggccagcagcagcgcgtcgccatcgcccgcgcgctcgccatccgccccgccgtcctgctgctcgacgaaccgctgtccgcgctggacgcccggctgcgctccggcatgctcgccgaactggcgcggctgcaccgcgagttgcccgacgtgtccatcctgtacgtcacccacgaccagatcgaggcgctgaccctggccgaccggatcgcggtcatggacaaggcccggctgcgcgcctgcggaacgccccgggagctgtaccgggccccggccgacgagttcacggcgtccttcgtgggcaacgccaacctgctgccggtcaccgtgacgtcccggggcgccgtcctcggcgacgccgagctgaccctggacacggcgggcgcgacggccggcgcccgggccaccctgtgcgtacgcccgcacctggtcggcctcggcgacgggcccaaccggctcaccggcaccgtccgcgaggtccagtggcgcggctccacccaccggctctacgtcgacgtcgccggccaccccgtgctggcggacctgcccgaactgcgggaaccgccggcgcacggcgacccggtcagcctgcacttcgccgccgaggacg

SEQ ID NO: 1800 - DNA, 1848 bp, Unknown
  Kingdom: Bacteria, Phylum: Actinobacteria, Class: Actinobacteria, Order: Streptomycetales, Family: Streptomycetaceae, Genus: Streptomyces
tgcggcacgccgccggcgccgcgggcgacgaccgcggcgccggcggcgtgccgcatcaactggcgtgtgacggtgggcgagagcacggggtcgccggccgccacccggcgcaccgcctcgacgatctcggccggcggggtgtccttgaggacgaacccggcggcgcccgcgcgcagcgcccgcagcacctgctcgtcggcgtggaaggtggtcaggaccacgacctgcggtgccttcgggcgggcccgcagccgctccgtcgccgtcaggccgtccacgcccggcatgcgtacgtccatgaggacgacgtccggccgggtgcgctcggccagcgtctccgcctcgccgccgtcggccgcctcaccgacgatctcgatgtcggcggcgccccccatcatgaaggacagccccgctctcaccagcgggtcgtcgtcgacgaggagcactcggatcacggtcatgggaccagccaaccaaaccgtccgcgcgggagccacaccggctcgccgccacgcgggccccgtggcgccgtgggcgtccggcggtggcaccatgggcgttcatgcgtgccgcgtacatcgaagagctgggtccgcccgacgtcatccgctggggtgagctgccgccgcccgtgccgggccccggcgaggtactggtcgacgtgctggcgacggcggtcgatccggtggacacgctcgtccggtccggcgtcttccgtacgccgctgccgttcccgttcgtggtcgggcgcgacctggtgggcacggtggcggcggccgggtcgggcttcgcggccggtgagacggtgtggtgcaacagcctcggccacgacggacggcagggagcggcggccgaacaggcagccgtaccggccgaccgcctctaccggttgccgccgggcgtgtgcccccaggaggcggtggccgtgttccacccggccgccaccgcctacctggcgctgttcacgcacggtggactgcacagcggcgagaccgtcctggtcggcggggcgggcggcaacgtgggcagcgcgctggtggagctggcggcgtgcgcgggggcgcgtgtcctggcgacggcctcgccccgcgaccacgaccacgtgcgctccctgggcgcggcggaggtcgtggactaccacgccgacggtctcggggaacggctcgcggccctggctccgggcggggtggacgtccatgtcgacacctcgggccgcaacgacctgcggaccgcggtcgcgctcctcgcccaccggggtcgtatcgtcctcctcgccggcgcccgggacgaggccgccctgccggtcggcccgctctacatgaaggacggctccctgcacggcttcgccatctcccacgcgacggtcgccgagctggccgcggcggcggacgcggtcgacgaacggcttgcgcggggcggtctgcggccccgcgcggtggagtacgccgccctgagcgagacggcccgcacccaccagcgcgtggagcgcggcgaactgcacggacggcgcgtggtgctgcgcccctgaccgggccgggcggggccccgagggcccaagtgggccgggccccgcgtgcgccgtcaggccggccacggcaggtgggcccgcacctcgaagccgccgtccggtgtcggcccgtggcgcagggtgccgccggccaggacggcgcgttccgtgaggccgatgaggccctggcccgagccgggaacgtgcgggacctcgccgtcgggcggcgggttgcggacgtggacggcgaggtcctgcccggcgccgccgttgacggtcacggtgacctccgtgcccggggcgtgcttgcgggcgttggtcagggcctcatcggcctcacg

SEQ ID NO: 1801 - DNA, 1308 bp, Unknown
  Kingdom: Bacteria, Phylum: Actinobacteria, Class: Actinobacteria, Order: Streptomycetales, Family: Streptomycetaceae, Genus: Streptomyces
  misc_feature (246)..(320): n is a, c, g, or t
gtccacggcggccgtggtcacgatcacgcccacgccgagccgccgcgaccggtgtggtgcgcgggcggctcggcgtgggcgtgatcgtgaccacggccgccgtggacgtacccgaggtgctgcagcgctaccgcgcccagcacccggacgtccacgtggtcctgcgctccgggcgcagtgacgaactggtggcggcgatccgcgacggtgacctggacatcgccttcctcggcctgccggagggcnnnnnnnnnnnnnnnnnnnnnnnnnnnnnnnnnnnnnnnnnnnnnnnnnnnnnnnnnnnnnnnnnnnnnnnnnnngtcctcgaccacgacgagcacgtgctggcggtgcccgccggtcaccggctggcgagcgcctcccgggtgacgctggcggagatcgccggggagacgttcgtggacttcgtgtccgggacgcccggccgggcccagtccgaccaggcgttcaccgccgcgggcctggtccgcgaggtcgcgtacgaggccgcgctcgtcgagctgatcatccggctgatcgcgcgcggcctgggcgtggcgctgctgccctcggccttcatccgtccggcagccgccgccgagcccgcgctggcgctggtgccggtggtcgacggtccgcaccgggtcgagtacctggcgtggagcaggttcaaccccagcccggcggcccgcgcgatgctccgcgtcctcggcgtcggccccgcccataggcgcccataggcgcccgtaggctcccatgggccctgaagccccccggtcaggggtccgggctattacgccgtaatagcctccgcccggcacggacgaaccccgtcagcgtccggtcgcgccgtcgatcagttcgcgcaggatgtccgcgtgaccggcgtgccgcccggtctcctcgatcaggtgcgtgagggcccaacggacgctgggagcgggacggttcgggcggcggtgggggaggggtgcgcccaggtcggtgcatgcgtcgagtacgtcgttcgcctgtgcgaccgacttccggtagcgggcgacgacgtcggccacgccgtccgcgggcgcggcatggaaggtcgcctgccagtcggtgacctgttccccgaggaacgtcgcccgctcgacgaaggtgaggtggttgagcaggccgagcaggttcgtacccgacggcaccgaggcggtgcgcacggccggttcgggggcgctctccaccttcgcggagaccgagttccggaggtagtcgaggaagccgcgcagcacctcggtctcgctgcttccggacgggggcggcggggtgtcgcggcgg

SEQ ID NO: 1802 - DNA, 922 bp, Unknown
  Kingdom: Bacteria, Phylum: Actinobacteria, Class: Actinobacteria, Order: Streptomycetales, Family: Streptomycetaceae, Genus: Streptomyces
ccccgtggtgggaccggcccgcgcagatggggctcgggatcgcgctgggcgcgctggcggtgcggcggggccgctgggcggcggtggtggtgctggccgccgacgcgcggatcgtgctggacccgagcgtgtacacgtactacaacgcctccgtgctgctcggcacgctcatctgggactcggtggggcagcggcggctggtgccgtgggtgagctggatagcgctgatctccctgtacggcagcgccctgctggtgccctcggactccgtgcagggcctgatccggctggcgttcgcggccggttccgcgctgtacgtgctgttctggccgcagcgccggccgcgcagggggcacggcgccggaggcagggccctgcacctgccggggcagcggcgcgcgccggacggttctcaggcgcggtcggtcagttcctcggcgtagacctgggagaggggctgcgggcccacgtagcgctggcagttgcactggccgggctcgtagcgcagcggtttcttgttctcgtcccaggcggtgggcacctccacgcgttcgtggcagtggccgctttggtcgtgcttggccaggtggtgcgtgcacccgcagacgggctcgggcggctggtgggcggcctcgacggccagccgctccgccttctgcgcctccatcagctccagcctgcgctggtgccggttgcgcagcgcggtgcgcacggtgtccgcgaaccaggcgaagccgccggtccagaacaggatgagcacccaccagatccagttcatctctcccccgcccctcccccggcgcggccgccgggcacccgctcgccgtggagcgccggtgccgcgtccgcgcactgcagcatgggctcaggatagacaactgcgggccgcgtgacagggggcgcggcgggggcggtggtacgc

SEQ ID NO: 1803 - DNA, 2044 bp, Unknown
  Kingdom: Bacteria, Phylum: Actinobacteria, Class: Actinobacteria, Order: Streptomycetales, Family: Streptomycetaceae, Genus: Streptomyces
cggcccgggccgacgctcgccgcactcggtccgaacggctatcgcgcggcccacgccgaggccggagccgccgcgcagtacctgcatctcgcggccgaggccaccgggctcggctgcggactgctcctgggcatggacccccgggccgtcgacctggccgtggccgggaacgacgacggcgaccccgaactgcgcacgaccctgtgcctgttcctcggtcggcgcatgcccggagccgcagggctcgacgaccgcctcatccacgggatgacgttctgagacgttcgacagcacggctcaccacaccagtgagcgccgagcccggggccgtcggcccggcagtccggcagttcttcctccggatcgatcacgatgcggtcacggcggaggggctttccacggtcggcgtcaaggcgcttttcgcaggctgggcggtgtcccgcgcggcgggatccgctacaacaacctgcgggccgcggtcgagggggtgctgggctggtgcgggcctgggcggactcggaccgctggacggcctgtgtgagtcgttgttcgtgtactcgtgctggtcgtgggcggtcgtcgggcgtgaagatcatttgccctgtgtgtcaccgtccgctgtcattcaatcgggcgtttgacggtgaatcctgtcgtatcggcttccttgccggcgaacctagtcgtacgaggtgacgctgcgggtgctgggcggccctaccggtcggagtgatcttgcggcccgtgtccggtctgggcgtgctgcgcggctgctcttgtcggccaggcgaactgtcgcgggcgacgactcgcccgcgacagttcgggactccgcgtggcggggtcagaactggttctcgccgccgttgacgtgcagggtggtgccgagcacgaagctgctgtccgctgaggcgaggaaggccaccgcggcggcgacctcctccgggcgccccctgcggccgatcggcactcccgccgcgagttccgccttgacggcggccgcgttctcctcgccgatggcgatgtcgattccgggggtgtcgatcgcgccaggcgcgaccgtgttgacccggatgcccctgcccttcagctcgttggcccaggtccgcgcgagggaccggatcgcggccttcgacgccgcgtacaggccgaaggcctcccggccgtcgtcggcgcgaatggagtcgttgaagatcaccgaggcgccgtcgttgagcagcggcagcgccttctgcacggtgagcagtgtgccccggacgttgacgccgaagatctggtcgaactgttccccggtggcctgtgccaacggtgcgagcgtggccatgcccgcgttggcgaagagcacgtccaggccccggccgcggtgacggatcgcgtcgtacagccggtccaggtcggtcggctccgatatgtcgcccggcaccgcggtgaccgcggaaccgatcgactcaacggccctgtcgagcgcatccttgcgccggccggtgatgaacacatgggcgccctcggacgccagccgcgcggccgtggccaggccgattcctgtgctcccgccggtcacgacggcggtcttgccttccagctgtcccattgctttaactcccgaaacttagataccgatcggtgcagaatgagaccgtagcacttctgcaccgatcggtatcaaggccgtaggatggagtcatggagatcatccggaaagcgccggtcggccgaccgagaggcttcgacgccgacgaggccctggagcgggcgatgacggtcttctgggagcagggctacgaaggtgccagcctgaccgacctgacccgcgccatgggcatcacccgcaagagcatgtacgcggccttcggcaacaaggaggagctgttccgcaaggccctggagcgctacaccgaaggtcccgccgcctacgcggcccgcgcactggagaagccgagcgcccgggaggtggccagggcgttcctcgccggctcggtcagcacgaccaccctccccggctgccccgccgggtgcctgggcgtgcagggcccgctggccgccg

SEQ ID NO: 1804 - DNA, 665 bp, Unknown
  Kingdom: Bacteria, Phylum: Actinobacteria, Class: Actinobacteria, Order: Streptomycetales, Family: Streptomycetaceae, Genus: Streptomyces
ctcgaccaggccgtcggtgtacagcgcgaggagggcgccttccgggagttcgaccgtcacctcctcgaacggctcgccgcccacgccgagcggcaacccgggcgggacgtccagcatcagcgcctgttcacccggctcgaccaggacggggggcaggtggcccgcgttggcgaaggtgcagcggcgggtgacggagtcgtagacggcgtacacgcaggtggcgaggtagacctccgagaggtccgcctcgcggggcctgcgggcggcgcgcgtggcctgctggacgcctccgggtgcgccgaggccgcgggcgatctcgtcgagttgggagaggacctcggccggttccaggtcgagcagggccagcgtgcgtacggccgtgcggagttcgcccatcgcgacggcggcgcgcagtccgcggcccatcacgtcgccgacgaccagcgcggtgcgatggcccgggagttcgatgacgtcgaaccagtcgccgccgacctcgctgggccggccggtggccgcgttgccgggcaggtagcggcaggcgatgtccaggccggacgcctccgggtcgccgggcggcagcagggagcgctggagtatcagcgcgcgttcgtgttcgcggcggtagaggcgggcgttgtcgatgcagacggcggcgcgcgcgg

SEQ ID NO: 1805 - DNA, 1458 bp, Unknown
  Kingdom: Bacteria, Phylum: Actinobacteria, Class: Actinobacteria, Order: Streptomycetales, Family: Streptomycetaceae, Genus: Streptomyces
gcgccttgaccatggcggcggtgtcggtcgcgctgccggaatcgatcgcgtgcacgatcatctgggcggcggtgaagccgtcggggctgaacaggtcgggggtgccgccggcccgggtgatgccgtcgagcatggccttctccaccgggttgccgccgccggcgcccgggaagtagtgggcgaggaaggacaccttggcgcccgccgcgccgaagaccgggtaggaggcggtgcccgcgaggcccgtgacgaccttcccggcgtccaggacgccctgctggtccagcgcggtccacagcgcgggggcggtggcaccggcccaggcgacgaagaccaggtccggcgcgcccgccttgacctggcgggcgaagggcgtgaggtcggtcgcgctcggcggggccagcaccgaaccgacgtgcgcgcccttcgcgcccaggacggccttcacggcggccacgttcgcctgtccgaacgccgagttctgggcgagcacggtcaccttcttgcccttcgcgtcgccgagcagcgtcccggcggtgaggatgtcctggtaggactgacgaccggagcggaaggtgtacgtgttgacgccggtgaccgcgtcggtggcggcggggccgctgacgtacagcaccttgttctgtgcggccagcggcgccatctgcagggccacgccggagtcggtggtcccggcgatgatcttgcagcccttgccgacgagggtcttggcggcggcgacggccttggccgggtcacccgcgtcgtcctgctcggtgacctcgaccgggtggccgccggccttgttcgtcccgtgcgtggcgtaggcgaggcccgccttgaagccctcctcgtactgcttgccgtaggcggcgagcagtccgctgcgggagtagaccaggcccaccttgacgggcgcggacccgccgtcggaaccggcggacgcggtgcctgcggtaccggccgaggagcagcccgcgacgagggcgccggcggcgagcagggtgaggacacggacggttctgcttctgacggtgcacgggacgctgggacgcatgatgtgcggctcctgaagggtgtcgcccgcccgccgccggcaccgccgccttccccgaaaggcggcggcccgcatgcgcggcggcggcagcgcggtgagtggttgccggaacgataggagcgccacacgccgtacggcatgtggtcaaccaccgctcctgaagccgcactcatggcaccggcgcacatggccggaagcgaacccctgccgggaaggtgaggaccggtccggcagacggccagagccgaccaggcggacagccgaccggacggacagcagccgatcaggcccgggggccagacggacagcggccagacggacagcggccaggcggccaggcgcccaggcggccaggcggccaggcggccaggcggccaggcggccaggcggtcaggcggtcaggc

SEQ ID NO: 1806 - DNA, 598 bp, Unknown
  Kingdom: Bacteria, Phylum: Actinobacteria, Class: Actinobacteria, Order: Streptomycetales, Family: Streptomycetaceae, Genus: Streptomyces
cgcctggtggatcgtcggcggtgttgccgtagtcgggctgggcggtggcgccggggagcgcggaggtgaggtggccgtccttggcgacggcgtgcgcgaggtaggcggcaccgttggcggcgacccgcgccggggtggcggcaccggagccggtgcagcgggccttgtcacccgtcttcccctgcggcgtggcggccagaccctggccgagcgcggcgaccacaccggcggcggtcgcgtccgcgttggccgcgagcttgccgtgcttgtccggctggtaggcgaacgcgcccgcgccctcacccgtgcacggcagggccagcttcagcagggcgtcgtagggggacttgccgtccttgacgacggaggcgggcttctcgcccacgacggcgagggcgccgacgacgaccgaggtcgagttggcgtcgctgggcccgccgggcgtgtaaccccagccgccgtccttgttctgcacggacttcagccaggtgacggccttgccggtcaccgcgtcgcgggcgccgagcaccgcgagcgcctggacggcggcggccgtgctgttggagtcgacggcggtcttggcgtcgcacgccttgga

SEQ ID NO: 1807 - DNA, 989 bp, Unknown
  Kingdom: Bacteria, Phylum: Actinobacteria, Class: Actinobacteria, Order: Streptomycetales, Family: Streptomycetaceae, Genus: Streptomyces
cccctcgagcgtcagtcccccgcctgctggaaggccgtcaccgaggcgtccggctcgcccgcgccctgcttgccctgcaccgggccgtaggaccacttgaaggtctggtcctcgctcgccccgggcaggctgatcttcagcgaggtggccgccagggtcttcccctcgcccgccttgccccgcacgtaggtgagcgtgaaggacgcggtgtcgcccttggccagggtgagtttctgcggctggccggccttgtcctccggcacgcgcgcggaggtgctcccggcggacagggtgacgcccgggaagccgttcagggtgcaccgggcgccccggttggtgagggtgaccgggacgtcgccggtgtcaccggcggcgggtgcggcgttggcggggcccacctggagcccgacctcgccgatccggcaggccgctttgtcggtgttcttgctgccggtgtcggcgtcggtgccactgctgccgccaccgctgtcgcaggcggcgaggaggagggccgcggcgacggcggtgacggtgatcggaaaggcgcgcatgtgctggttcctcgggtcgtgacgatgctcgacgatcatcacgtacgagcgtgcggcgcggttgcccgccccaccaccggttggggcggacgtcgcggacggttcaggagccggggctcgccgtgggcagccctgacggtagcgtcccgccctcggcccgggtgtacgtctccttgccgagtccaccctcccaggtcacctggagggtggtcttgttgacggagtcgaccgtgcccgccgagcgctgcctgcaggagtccagccggatcgtgccgccgcccgcctgcgcggtcgcggtgccggtgcacgtggtccggtccgtcgagaacagtgccgcctgccggccggtgatgatgagcacgaccgccttgccgccgctggtggtgagccaactgccgttcagcgccgtgttcgtgccgcccgcgccgcccgccccac

SEQ ID NO: 1808 - DNA, 1273 bp, Unknown
  Kingdom: Bacteria, Phylum: Actinobacteria, Class: Actinobacteria, Order: Streptomycetales, Family: Streptomycetaceae, Genus: Streptomyces
gacgcgctcagctcgccgagcacgtcctccacggcccgcatgacggtgtcgccgtcctcctgcgcgggcgtggcgcgctgggcgcgcaccaggatgctgccgtggccgtccaccagcgcgccggcgatcttggtgccgccgatgtcgagcgcggccacgaggtcggtgtgcatcagagtcagatctccccgtcaaccagaaaagccaagaggtgggcgcagaccggccgccgcgctacggtcgtgcgagccgggaatgcggtggacagtctctcgtgcgtatgacaacgttgtccaggctctatgctcgacgccacatcctcatacgcacccagggacgccacaccacccctgcggacgacaaggaacaggacgccgcatcgtgccagagaccgcccgccgagaagaccgccccgccgaccgtgccacggaccgcgcgtccgggacacggtacggcaaccgtccgaccatgaaggacgtggcggcgcgggccggtgtgggcctcaagaccgtctcacgcgtggtcaacggcgagcccggcgtcacccctgacaccgaacggcgtgtccaggaggccatcgacgcgctcggcttccgccggaacgacagcgcgcgggtgctgcgcaaggggcgcacggcgagcatcgggctcgtcctggaggacctcgccgacccgttctacggtccgctcagccgcgcggtggaggaggtcgcgcgggcgcacggggccctgctgatcaacggctccagcgcggaggacccggaccgcgagcaggagctggcgctggcgctgtgcgcgcggcgggtggacgggctggtcatcatcccggccggggacgaccaccggtacctcgaaccggagatcagggcgggcgtcgcgaccgtgttcgtggaccgcccggccgggcggatcgacgcggacgtcgtcctctcggacaacttcggcggtgcccgcgacggcgtggcccatctgctcgcccacggccaccgccggatcgggttcatcggcgacatgccccgcatccacaccgcggccgaacgtctgcgcggttaccgggcggcgatggaggacgcggggataaccgtccaggactcctggatgtcgctgggcgtcaccgacccggagcgggtgcgccgggcggccgaggagatgctgtccgggccggacccggtcaccgcggtcttcacgggcaacaaccgggtgacggtcaccgtgatccgcgtcctggcagagctgccccggccggtcgcgctcgtcggcttcgacgacatcg

SEQ ID NO: 1809 - DNA, 1787 bp, Unknown
  Kingdom: Bacteria, Phylum: Actinobacteria, Class: Actinobacteria, Order: Streptomycetales, Family: Streptomycetaceae, Genus: Streptomyces
cggcccatcaggcggatgagctggccgacctcgtcgtcggtccagtcgctcagccggtccgcgagcaggtgcgtggtccgccgcgacagatcgtcgagccggtccaggccgacgggcgtcaggcgcaggatgcgcgagcgcttgtccgcggggtccggcagccggtcgatccagcctcgggcggcgacgtgcgcgacatggcggctggtcaccgacatgtccacggcgagcagctcggcgagcttgctcatgcgcatgtctccgtggcggcccagcagcgtcagcacggcggccgagccggccgggcagtcgggcggcaggatccgccccatgtcccgtttcacggcgccgacggcgctgagctgacgcgcaagctcctcgtactgcgcctgctcggccatggcacctcccgtaatcgttgcttgtaacaaccatagaggtggttaattgcctcaggctcccaaatcggccgagcggccaacaaaaacttggcaaaggcaagcattgcaaaggtaaacatcggtgggcgcggtcacatcccggtcttctatgaccgaggcgctgtgggaggcgtgctgtgggaggccgtcgcgccgagcggtcggggcagggcgctggtgtccggccccgtcctccgcgtgattcaggccgtgcggacgggcatcgcgggcgtcccgccggcgctgcggccggcccggcgggaatgcgctcgccgcttccggtccgcaggccggactcggcgcggacggtgatccactgaacaccggtgaccccgtcggcccccggccttcagtggaagaatggctttccgttcatatgaccaggtatccatgaacagcggcatcgaggactagggggagcagggagtgctcgaactgcgtgagatcgaatgcctcatcaccctgagcgagcagcttcacttcggccggacggcccacgaactccacatctcgcagtccagggtcagccgcctgttacgggacgccgagcagaaggtgggcgggcagctcttcgaccggtccagccggcatgtgcgggtgaccgctctgggacaggtgctgatcgaccggctgcggccgctgtacgagcagttgaacgacgcgtacagcgacgccgtcgcccagtcgcgcggcacggcgggcaccacccggctgggcttcaccggtgccgccggcggcgggtacgcggccaagctgatccgggccgcgcgcacctacgcccccgagtgccggatcgtcctgcgcgaggtgccctgcgtcgacctgctcgggccgctgcggcgcggcgaggtggacatgctggtggcccggctgccgatccatgagccggacctgacggtgggtccggtcctcggccaggagccccgggtgctggccgtggcgctggaccacccgctggccggccgcgtctccgtgcggatcgaggacatcgcgggagagaccgtcttccgcctcgccaacacggcgcccggctactggcgtgaccaccaggtgccgctggtgaccccggccggccgtacgctgcggctcgggcaggaggtgcggacctgccaggagatcctgtccttgacggccgcgggccagggcgtcgcaccgctcgccgagtccgtggcgcgctactacgcccagcccgacgtcgccttcgtcccgatcagggacctgccgacgacgtcggtggccctcgtctggcgcaccaccgaggagaacgtccttctccgcgccgagctgccggccgcagtaggcgagggcgcggatgcgcgcgttctcctcggtggtgcgccagacgag

SEQ ID NO: 1810 - DNA, 541 bp, Unknown
  Kingdom: Bacteria, Phylum: Actinobacteria, Class: Actinobacteria, Order: Streptomycetales, Family: Streptomycetaceae, Genus: Streptomyces
cgaggcgccgaaccctacaggtcccatcgtcgtcaccctgtacgcggacggcggcccgcggccggaccccgacccgctgaccgatccctccgagctccgcgcggcccgtacggacctgtgcgacgaagtctggcccgaactgcgtgcggcgctgcgcctgtggcaccccgtgtgcgaggaccatatcgccccgatatccctgttcgccgatcccgtcctggcccagctgatcaccccgggtcgcggccgcgagatcctggccacgccccgaggtgcgggccacggcctccagtaggctgggtgctccagcagccaggggcagcgacacgcgccaggtcagtacaccagcaggtgcggcgcgtactcgcgcactgctgtcgaagccgtgcgctccaccgtctcgaccgggctgaacacgttcatctcgccgtactggatcgggcacctggaggcgagcggcgtgctcggcggcgccgccgtgaccctcgaactcggcggtggcgtgctcggtggccggctcggtggtcggctcctgaacccg

SEQ ID NO: 1811 - DNA, 1807 bp, Unknown
  Kingdom: Bacteria, Phylum: Actinobacteria, Class: Actinobacteria, Order: Streptomycetales, Family: Streptomycetaceae, Genus: Streptomyces
  misc_feature (1298)..(1396): n is a, c, g, or t
cgcccgcaccggcagccccggccgtatccccgccctcggacgccaagctcgccgagcaggccgcccgcccggcaccgagcagggagcagttctacctcctgctgcccgaccggttcgcgaacggctccccggccgacgaccgcggcggcctcaccggcgaccgcctgaccaccggctacgaccccaccgacaaggacttcttccagggtggtgacctgcgcggcgtcatcgaccacctcgactacatcaagggcctgggcaccaccgccatctggctggcaccggtcttccgcaacaaacccgtcaccgtacgcgacggccgggccaccgcgaactaccacggttacgccatcaccgacttcaccagcgtcgacccgcacttcggcaccgaggccgacctcaccgaactcatcgacaaggcccaccgcaagggtatgaaggtcttcttcgacgtcatcaccaaccacaccgccgacaccatcgactacgccgaacagcaatacggctaccgcagcaagggcgcctacccctccctcgacaccaccggccgccccttcgacgacacccaggggatgcggccgacggacgcggacggcgcctcctacaccccccgcacctccaccgacccacgcgaccgcaaggtccccgactggctcaacgaccccgcgatgtaccacaaccgcggcaactccaccttcgccggggagagcgccctctacggcgacttccagggcatggacgacctgtggaccgaacgccccgaggtcgtccggggcatggagaagatctacgagaagtgggtcggggacttccaggtggacggcttccgcgtcgacaccgccaagaacgtcggcatggacttctggacccagtgggccaccgccctcgaccactacgccgcccagcacggacgccggcacttcttcctcttcgccgaggccttctccgccgaccccgccgtcaccgcgccctacgtcgcccagggccgcctcgactccaccctcgacttccccttccaggccgccgcccgcgacttcgcctcacgcggcggccccgccgacgacctcgcccacgtcttcgcccaggactaccgctacggcaccgacaagaccaacgcctacagcgaggtcaccttcctcggcagccacgacatgggccgcatcggcaccttcctcgcccaggacaaccccggcgccgacgacaccgaactgctgcgccgcgaccgcctcgcccacgagctgatgttcctctcccgcggcaacccggtggtctattccggcgacgaacagggcttcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagatcggcaccgaccgcaccgccgcctccgacgcctacgacaccacccaccccctctaccgcgccatcgcggccctgtcccgactgaccgagcgacacccggcgttgcgcgacggcgtccagagcgagcgctacgcccagggctccgtctacgccgtcacccgcaccgacgcccgcgaacagcgcccctacctcgtcgtgttcaacaacgcggcccgggcgaagaccgtcggcatcccgaccggcaccgcgaacacggcgttcagggcgctgtacggcacgaggggcaccgtgcgcgccggcgccgacggcaaggtcaccgtgaccgtaccggcctggtccaccgtcgtgtacgaggcggccaagccgctgcccgcgccggcggcccggcccaccgtcgccctgcacgcc

SEQ ID NO: 1812 - DNA, 852 bp, Unknown
  Kingdom: Bacteria, Phylum: Actinobacteria, Class: Actinobacteria, Order: Streptomycetales, Family: Streptomycetaceae, Genus: Streptomyces
gggtgcggcgagcgggctgcgcgcgtgcgggtcggaggtctccgagggcaggatccggtcgatgcgccaggtgccgtcctcgtgccgggagatgtccgcaccgagcaggccctggcgggcgccgtcgccgaaggcgccgaacggggtgatgtaggcgtgcgaggtgccgagttcgccgtgcacctcccacagcaggtccacgaggtcgtcgtgggtggcgaggcggtccaggacgggccggtagcggtcgaggacgccgtcccagtcgacgccgttcatgtcggcccgccagaagtggtcccgcatgaggcggccggtctcctcgtacatctgccgccactcggcggccgggtcgaccgtctggcgcacccggccgaggtcgacggtgatgttggagtcgctgtcctcgtcgccggaggcgcgccggtcgctggggacgaccctgagtttgccgtcggaccacagcaggacgcgcttgccgtcgccgctgacctcgaagtggtcggcgtcggcggcgaggtgctcgatgcgctgctgggcgaggtcgtagcgttccagctcggtcttcgggtcggggtcctcgggggtggcgcgggaggcgccgaggacgccggtgacggggtggcgcagccagagcacgccgtcgcgggcggcgcgcaggttggagtagcgggcggcctcgaccgggaagggcacgatgcggtcggcgagcccttcgaggtcgatccgggtggccggggtgccctcgctgtccggggtctcgtccttgtcggcgggctcgaacgggcgcccgtggcgctgcgggccgaacggggagggggtggtcgcggccagcgtgatcaggtgggggcg

SEQ ID NO: 1813 - DNA, 1849 bp, Unknown
  Kingdom: Bacteria, Phylum: Actinobacteria, Class: Actinobacteria, Order: Streptomycetales, Family: Streptomycetaceae, Genus: Streptomyces
gggccggtggtgccggcgcgggggctcatcggcgtacgaccgttccgtcgcgtaggcgtgcgcgtgaggggcggggactggacggcgggctcggtctcacaccgcgaccggctcgcccgccgccgcggcgatctccgcctcggccacgacaccggtgacgcggcgcagcttcttcatcgggccccgctcggagtcgtagaccttcttcacgccgtcgccgagtgaggcctcgatggtgcggatgtcacggacgaggcgcgtcaggccctgcggctcgacggaggcggcctggtcggagccccacatcgcgcggtccagggtgatgtggcgctcgacgaaggcggcgccgagcgcgaccgcggcgagcgtggtctgcaggccggtctcatggccggagtagccgatcgggacgttcgggaactccttctccagcgtgttgatcacgcgcaggttcagctcctccgccttggccgggtaggtggaggtggcgtggcacatgaggatgttgtcggagccgaggacctcgaccgcgtgccggatctgcttcggcgtggacatgccggtggagaggatgaccgagcggccggtcgcgcgcagcgcgcgcagcagttcgtcgtcggtcagggaggcggaggccaccttgtgggcgggcacgtcgaacttctccaggaaggcgacggcctcggtgtcccacggcgaggcgaaccacgcgatgcccttctccttgcagtacgcgtcgatccggcggtactcgtcctcgccgaactccacgcggtgccggtagtcgatgtacgtcatccggccccagggggtgtcgcgttcgatgtcccactggtcgcgcggggtgcagatctccggggtgcgcttctggaacttgaccgcgtcgcagccggcttcggcggccacgtcgatcagcttgaaggcgttctccagctcaccgttgtggttgatgccgatctcgccgcagatgtagacgggcctgccggggccgacctcgcgcgaaccgaacgtgcgcagacgggagttggtgctcatcagagggtttccttacttggggagggtttggagggaggggccgaggatccagccggcgatctcgcggatggcgccgtcgccgccggggagggtggtgaccgcgcgggcggcgccgcggacggcgtcgtgggcgctcgcgaccgccacgggccagccgacgagcgagaagcacgggaggtcgttgacgtcgttgccgacgtagaggacacgctcgggggcgatgccctgctcctcgcaccattccttgagggcgaggtccttgcggtcgatgccgtgcagcaccgggagcttcagcttgcgggcgcgggcggcgacgaccgggttctgttccgtggacaggatcagcatgcgcagaccgctcctgcgcagcgccgcgatgccgaggccgtccccgcggtgcacggagacgaactcccgtccgtcggagtcgatcagcacccggtcgtcggtctgggtgccgtcgaagtccagtacgaccgcgtcgacgtcctcggcggtcggcagggcgccgcgcccgtcggcgtcgaacaggggcgcgagagcgcgggcgcgggcgaggtcgtgcgggtcgtcgatctccagcacgcgcgccgggtcggtgcggaccggttcggtgcggccgaagaagcggtgccggtgggcgcggaagcccgcggcgtccatcgcgtacgcggcgccggtctccagcaggtcctgcggacggtcctggcggcgcgggcggaaggacttgtcgtggttgacgccgtagccgccggccatggctctcccgtccgcgcccaccggtgcggcgacggccacggccgcgacacaaggc

SEQ ID NO: 1814 - DNA, 1979 bp, Unknown
  Kingdom: Bacteria, Phylum: Actinobacteria, Class: Actinobacteria, Order: Streptomycetales, Family: Streptomycetaceae, Genus: Streptomyces
cggctgggccgccggggtggccggcccgtccgccgctccgtcccggccgccgtcctgggcggcctcctccgtctcgtccaccgagatgccgtagtccgtcgcgaggcccatcagcccgttcgagtagccctcgcccagcgcgcggaacttccacgactcgccccggcggtacagctcgccgcagatcagcgcggtctcctggccggtctcgggcttgatgtcgaaggacgccagcggctccgcgtcgccggccgccgcgtcgtacagcaggatgctcagcgcccgcacccgctcgaaggccacgccgtccgccgaggcgaccagcaggatccggccgacctcgggctccagagagagcaggtcggtctggatcgtgtcggtcagcgcctgcgcgatccgccgcttccccagccgccagaccttccccgacgggtgccgcggctggttgtagaagacgaagtcctcgtcggaacgggcacggccgtcggggccgaggagcagtgccgacgcgtcgacgtccggcaccccctggccgggcgtccagcgcaccacggcccgtaccgtggccgcctccagcgggacgttcgaccccttcagcatcgcgcgcgtcatgcggtcatcctgccttctcggtcctgctcacgacaacgcggcccgggacacggcacgcccgcccccgcccgttaccagaagttcatgccccccgggaaccaccgacactgactcgtacgtactattaccggccaccttttccacgccgcgcgccgtcacgggggagctacatgcgtcatttcgggcacctcgctcctgaggtgcgggagcgcctcttccacctggaaccgcaggagttcaccgccgactccccggcccggctgctctccaccgccctgggcgccaccctctacagccccgccacccgcccgcgcctcgccgacgacatcgtcaagcaggccggccgcggcgtggtctcgatggtgctgtgcctggaggactcgatcgacgacgcggacgtggaagcgggcgaggcgaacctcgtacggcagttcgccgccctcgccgcgctcccctccgcaggcgccgcgctcccgctgctgttcatccgggtccgcgccgccgcacagatacccgacctggtgcgccgcctgggcccggcggtccggctgctgtccggattcgtactgccgaagttcaccggcgaacgcggactggcgttcctggaggcggtgcaggccgccgagacggccagcggacgccggctgttcgccatgccggtcctggagtcgcccgaactgctctaccgcgagagccgggtggagaccctggagggcatcttccgcgccgtcgacaagtaccgcgaccgggtcctcgcactgcgtctgggcgtgaccgacttctgctcctcctacgggctgcgccgcgcccccgacatgacggcctacgacgtccaggtcgtcgcctccgtcatcgccgacgtggtcaacatgctgggccgcgccgacggcaccgggttcaccgtgaccggcccggtctgggagtacttccgggcacaggagcgcatgttcaagccccagttgcggcagagccccttccttgaggtgcaggcggccggcctgcgcgagacactgatcgaacacgcgatggacgggctgctgcgggagatctccctggaccaggccaacgggctgctcggcaagacctgcattcacccctcgcacgtactgcccgtgcacgcgctgtcggtcgtcagtcacgaggagtacagcgacgcggcggacatcatgcggcccgagcgcggcggcggaggcgtgctcaggtcggcgtacaccaacaagatgaacgaggtgaagccgcaccgcgcctgggccgagcggaccctgctgcgcgccgaggccttcggcgtcgccagggaggacgtcggcttcgtggaactcctcgccgccggcatccccgccacaccgcccgccacctgacagccggcc

SEQ ID NO: 1815 - DNA, 4461 bp, Unknown
  Kingdom: Bacteria, Phylum: Actinobacteria, Class: Actinobacteria, Order: Streptomycetales, Family: Streptomycetaceae, Genus: Streptomyces
gggccgcgcgcggcccggggacacggtcctggtggcgggcaagggccacgagcagggccaggacatcgcgggcgtcatccgtcccttcgacgatcgcgaggtcctgcgcgaagccatccggagcacacaggggtgaacgaccgcacgagccagggatgaacgtccgtgagacccgggacacgcatctgcgccggacccggggacgaccgtgaagacccagggacgaccgtccgaacgacccagggattgaaaatccagaagacccaggggatgaacttgtgatcgccctctccctcgccgagatcgcagcagtcgtcggcgggcagacgcacgacataccggatccgtccgtccaggtgaccggacccgtcgtccgggactcccgggaggcggtgcccggcagcctcttcgtcgccttcgcaggcgagcgcgtggacggccacgacttcgccgccgccgtcgtcgaggccggcgcggtcgccgtgctggccacccgtcctatcggcgtgcccgcgatcgtggtcgaggacgtccaggccgccctcgccgccctcgcccgccacgtcgtgaaccggctcggcgccaccctcgtcgccctgaccggttccgcgggcaagaccagcaccaaggacctgatcgcccaggtgctgcggcgcaaggccccgaccgtgttcacgcccggctcgctcaacaacgagatcgggctgccgctgaccgccctgagcgccaccgaggagacgaagttcctcgtgctggagatgggcgcccgcggcatcggccacatccgctacctcaccgagctgaccccgccgaaggtggggctcgtgctcaacgtcggcagcgcccacatcggcgagttcggcggccgggagcagatcgcccaggccaagggcgaactggtcgagagcctgccgccggccgcggagggcggggtggcgatcctcaacgccgacgacccgttggtccgggccatggcctcccgtacgacggcgaaggtgctccttttcggagagtccgacgaagcggacgtacgcgccgagaacgtgagactcacggacagcggacagccttccttcagccttcacacaccctccggtgcatctgatgtgaccatgcgcctgtacggtgagcaccacgtgtcgaacgcgctcgccgcggccgccgtcgcccatgagctgggcatgtccgcaaccgagatcgccaccgcgctctccgaggcgggctccctctcccgctggcggatggaggtcaccgagcgcccggacggcgtgaccgtcgtcaacgacgcctacaacgccaacccggagtccatgcgggccgccctgcgcgcgctcgcggccatgggccgggggcggcggacctgggcggtgctcggcaagatggccgagctcggggacgaggcgctcgccgagcacgacgcggtcggacggctcgccgtccggctcaacgtcagcaagctcgtcgcggtcgggggcagggaagcgtcctggctgcaactgggcgcatacaacgagggttcgtggggtgaggagtcggtgcacgtgtccgacgcacaggcggcggtcgacctgttgcgcagcgagttgcgcccgggggacgtcgtgctcgtgaaggcgtcccgttcggtcggtctggagagcgttgcccaggcgctcgtcgagaccggtgccgagggtgaggtcgccgcccgatgatgaaccagatcctgttcgcgggagtcatcggcctcttcctgacgctggtcggcactccgctgctgatcaagctgctggcccgcaagggctacggccagtacatccgcgacgacggcccgcgcgagcacgccagcaagcgcgggacgccgaccatgggcggcatcgccttcatcctggcgacggtcgccgcctacttcctgtccaaggtgatcacgggcaagccgccgacctactcgggtctgctggtcctgggcctcatggtcggcatgggcatggtcggcttcctcgacgactacatcaagatcgtcaagcgccgttcgctgggtctgcgcgccaaggcgaagatggccggccagctgatcgtcggcatcggcttcgcggtcctgtcgctgatgttctccgacaaccgcggcaacacccccgcctccaccaagctgtcgttcatcaccgacttcggctggacgatcggcccggtgctgttcgtgatctgggcgctgttcatgatcctcgcgatgtcgaacggcgtgaacctcaccgacggcctggacggcctggccaccggagcctccgtcctggtcttcggcgcctacaccttcatcggcgtgtggcagttccaggagtcctgcgccaacgcgatgacgctgaccaaccccaacgcctgttacgaggtgcgcgatccgctcgacctcgcggtcgtcgcctccgcgctgatgggtgcctgcctcggcttcctgtggtggaacacctcaccggccaagatcttcatgggcgacaccggttcgctcgcgctcggcggtgtgctcgcgggcctggccatctgctcccgcaccgagctgctgctcgcgctgctcggcggcctgttcgtgctcatcaccatgtcggtggtcatccaggtcggctccttccggctcaccggaaagcgcgtcttccggatggcgccactccagcaccacttcgaactcaagggctggtccgaagtgctcgtcgtggtccgtttctggatcatccagggcatctgcgtgatcgtcggactgggcctcttctacgcgggatgggcagcggacaagtgaccgactggcagggaaagaacgtcaccgtcgccggactcggcgtctccgggatcccggcggccaaggtcctgcacggcctcggcgcgcacgtcaccgtcgtcaacgacggcgacgacgagcgggcccgcgcccaggcggccgaactggagtccctgggcgtcaccgtgcgcctcggcgacggcgattccctgcccgacggcaccgagctgatcgtcaccacccccggctggaagccggacaagccgctgttccaggcggccgagaaggccggcgtcccggtctggggcgacgtggagctggcctggcggctgcgcggcccggacgccgctccctggctggccgtcacgggcaccaacggcaagaccaccaccgtgcagatgctcgccgccatcctcaaggcggcgggcctgcgcacggcggccgtcggcaacatcggcgtctccctgctggacgtcgtcctcggcgaggagcgctacgacgtgctcgccgtcgagctgtccagctaccagctgcactgggcgccctcgctgcgcgcccactgcgccgccgtcctcaacctcgccccggaccacctcgactggcacggctccatggaggcctacgccgccgacaagggccgtatctacgagggcaaccgcgtcgcctgcgtctacaacgtcgccgacccggccaccgaggaactggtgcgcgcggccgacgtcgaagagggctgccgcgccgtcgggttcacgctcggcacgcccgcaccctcccaactcggcgtcgtggagggcatcctggtcgaccgtgccttcgtcgagaaccggcagaagaacgcccaggagctggccgaggtcagcgacatcaacccgcccgccccgcacaacatcgccaacgcccttgccgcagccgccctcgcgcgcgcctacggcgtgccggcgacggccgtgcgggacggcctgcgtgccttcaccccggacgcccaccgcatcgcgcacgtggccgacgtggacggcgtcgcctacatcgacgactccaaggccaccaacacccatgccgcgcaagcctcgttggcggcatatgaaccgatcgtatggattgcgggcggtctggcgaagggcgcggtcttcgacgaactggtcgcgggcgcggcgcagcggctgcgcgctgtcgtcctcatgggggccgaccgcgcgctgatccacgacgccctgacgcgacacgcgccgcaggtccccgtcgtcgacctcgaccggaccgacactggggcgatgctccaggccgtccaggaggcacggcggctcgcccggcccggcgacacggtgctgctggccccggcctgcgcctccatggacatgttcgccaactacaaccggcgtggtgacgcgttcgcggatgccgttcgcgaactcggcgcccgctgaccccggccgcccccgctgccgggcgaccttgggagggacgcgtgggacccgcgaaccgagccggacgtagggtctgtccggtggatcatgctgcaggtcagcgacggtgcggatcagtccgggtgagcggggcttggtgcgggcagccgcaaggcgccgcggatgtgcgtgccgagccccgcgtccgcggcgtgatccgccggacaggccctgggcggccgacgtacagcggaggcggagatgcccggtagccccggcagccgcgcgggcgggccgcccgcgcggctgccgggg

SEQ ID NO: 1816 - DNA, 1528 bp, Unknown
  Kingdom: Bacteria, Phylum: Actinobacteria, Class: Actinobacteria, Order: Streptomycetales, Family: Streptomycetaceae, Genus: Streptomyces
gaccgcatcaccgccggcgtacgccccgccgagccgcccccgggcctgcacgccaccctgcgcgactaccagctgcgcggcctcgcctggctcgacctcatgacctccctcggcctcggcggctgcctcgccgacgacatgggcctcggcaagaccgtcaccctcatcgccctccacctgaagcgggaccaccgcgcacccaccctggtggtctgcccggcctccttgctgggcaactggcagcgggagatcacccggttcgcgcccggtgtccccgtccgccgcttccacggccccgaccgcaccctggacggcctccgaggaggcttcgtcctcaccacgtacggcaccatgcgctcggccgcgcccctgctcgccgaacagccgtggggcatggtcgtcgccgacgaggcacagcacgtcaagaatccccactcggcgaccgcgaaagccctgcgcaccatcccctcgcccgcccgcgtcgccctgaccggcacccccgtggagaacaacctctccgaactctgggccctcctcgactggaccacgcccggtctcctgggccccctcaaatccttccgcgcccgccacgcccgcgccgtggagaacggcgaggacgacgaggccgtggcgcggctggcccgcctggtgcgccccttcctgctgcgccgcaggaagtccgaccccggtatcgtccccgagctgccgcccaagaccgagacggaccacccggtcccgctcacccgcgagcaggccgcgctgtacgaggcggtggtccgtgagtccctgctcgccatcgagaccgccgacggcatcgcccgccgcggtctggtcctcaagctgctgaccgcgctgaaacagatctgcgaccacccggccctctacctgaaggacggcaccctgcctggccgcggggaccgcctggcggcccgctcgggcaaactcgccctgctcgacgagctgctggacaccgtgctcgccgaggacggctcggcactggtcttcacccagtacgtcggcatggcccgcctcatcacctcccacctcaccgcccgcgcggtccccgtcgacctcctgcacggcggcacaccggtccccgagcgcgaacgcatggtggaccgcttccaggacggcgcgatcccggtcctcgtcctctccctcaaggcggccggcaccggcctgaacctcacccgcgcgggccatgtcgtccacttcgaccgctggtggaacccggcggtcgaggaacaggccaccgaccgcgcctaccgcatcggccagacccagcccgtgcaggtccaccgcctcatcaccgagggcaccgtcgaggaccgtatcgccgagatgctcgccaccaagcgcgccctggccgaggccgtcctcggctccggcgagtccgccctcaccgaactgtccgaccgtgaactgtccgacctggtgtcgttgcggagggaggcctgatggacgcgacggagcagacggacgcggcccgcgcggcagagtccgcgcacgcggactctgccgcgcgggc

SEQ ID NO: 1817 - DNA, 2544 bp, Unknown
  Kingdom: Bacteria, Phylum: Actinobacteria, Class: Actinobacteria, Order: Streptomycetales, Family: Streptomycetaceae, Genus: Streptomyces
ccgagggcaagggcggcggcggcatcgagcagcagctggacaagcagctggccggcaagcccggcaagatccgctacacccagtccggcggccgcgaggtgcccacggcgggctccagcgggacaccggccgtgccgggcaccgacgtcgagctgaccatcgaccgcgacatccagtgggccgcgcagaacgccatcaccgagcaggtgcgcaagtccgaggcggaccgcggctacgtcatcgtgcaggacacccggaccggcgagatcctcgccatggcgaactccccgggcttcgacccgggcgacctggcccacgccgacccggccgcgctcggcaacgcggcggtccaggacgcctttgaacccggctccaccgccaaggtcatgtccatggccgccgtgctggagaagcacgcggccaccccgctcacgcacgtcgtcgtgcccaaccggctgcaccgcggcgaccggctcttccaggacgacgtcgaccacgacacctggtacctcacgctcaacggcgtgctcgccaagtccagcaacatcggcaccatcatggccaccggccggctcggccagacgcagcaggaggccaaccaggtcctctactcctacctgcgcaagttcggcatcggcagctacaccggtaccggcttccccggtgagacgaagggcatcctggcaccgcccgcgaagtggtccacttcgcagcagtacacgatcccgttcggccagggcttctccatcaacgcgttgcaggcggcgtccatctactccacgatcgccaacggaggggtccggatccagccgaccctggtgcgcggcaccaagggccccgacggccggttcagccccgcggccgagcccgagaagcgccgggtcgtgagtgcgcagacggcgaaggaactggcccagatgctggagtccgtcgtcgacgacgagcagggcaccggcctgaaggcgcgcatccccggctaccgcgtcgccggcaagaccggtacggccaaccgtgtggatccggccaccggcaggtaccgcggctacacgtcgtccttcgccggcttcgcgcccgccgacaacccccgcatcaccgtctactgcgcgatccagaacgccacgaagggcagctactacggcggccagatctgcggcccgatctacaagcaggtcatggagttcgcgctgaagacactccaggtgccgccgaccggggcgcaggccgcgaacctccccgtcgacttcaagccctgaccccgatcggcctcacggccccgaccggcaccgcagcacccgccggagcccgtaccaccggaacagaaccaccaggaaccagcccgtgacaacgatcacccccggccccgggaaccgtccgcagcccgcgccctcgcttcgcccgcaggcgggtacgcccggtacgctcaccgccgtgccacaccctgatcagtcccaaaccacccagaagggcgcttccgtgacatacccgggaccgccgcgaccggctcaggtctccgccacccccctcgcggagctggccggtcagctgggtaccgcgcagccggacagcaccgccgaggtcacgggcatcacccacgactcgcgcgccgtgcgccccggcgacctgtacgcagccctgcccggagcccgcgcgcacggcgccgacttcgtcacccaggcggcgagcctcggcgcggtcgccgtgctcaccgacccggccggcgccgagcgcgccgtcttgccggaggtgccggtgctggccgtcgaggacccgcgcgcgcggatgggcgagctggcggccacgatctacggccggcccggccgcgacctgctccagatcggcatcaccggcacctccggcaagaccaccacggcctacctcgtcgagggcggcctgaagaccgcgaagtccaccggactgatcggcacggtggagatgcggatcggcgaggagcgcatcaagtccgagcgcaccacgcccgaggccaccgacctgcaggccctgttcgccgtgatgcgcgagcgcggtgtcgaggcggtcgccatggaggtctccagccacgccctggtcctcggccgggtcgacggctgcgtcttcgacatcgccgtcttcaccaacctcagcccggagcacatggagttccactccggcatggaggactacttccaggccaaggcgcagctgttcacgcccgcgcgcagcaggctcggtgtcgtcaaccacgacgacgagtacggccgcaggctcgtcaaggaggccaccgtcccggtcgtcaccttctccgccgagggccaccccgacgccgactggcgcgccgaggacgtccgggtcggcccgatggactcgacgttcaccgtggtcggccccgaggggcagcggatcgcggccaggtccccgatcgcgggcccgttcaacgtggccaacacgctcgccgcgatcgtcgcgctggccgccgcgggactcgtacggctgcccggcgccgacggcatcgccgccgtcccgggcgtgccgggccggctcgagcgcgtcgacgccgggcagccgtac

SEQ ID NO: 1818 - DNA, 2181 bp, Unknown
  Kingdom: Bacteria, Phylum: Actinobacteria, Class: Actinobacteria, Order: Streptomycetales, Family: Streptomycetaceae, Genus: Streptomyces
ggtcccggacgtcgtccacggaaccgccggggccgggctgacccaggcgcacttccttgcgcgcaccggcgacgaccgcttccgggagcggctggcgcgctgcgccgacgggatcctcgccgccgccggggcggacgaccggacgggtccgcgctggacggtgccctcggaggacggccccgcggcccggccggtggtccaccacggtttcgcgcacggcgcggcgggcatcgggacgttcctcctcgaagcgttccgggccgtcggcgacgtccggtacctgtccaccgcgatgcgggccgctgacgcgctgaccgaggccgccgtcgaggaccggggcgcgctgcgctggaccgccgggccggacgacaccgtggccctgaccaactggtgcagcgggtcctccggcatcggcaccttcctgctccggctgtggcgggtcaccggcgagccccggtacctgcgggcggcgcgcggcgcggccgaggccgtgcacgccgaccgctggatgctgccgcccgccgcctgtcacggcgtctcgggcaacgcggaactgctgctggacctcgcggacgccacgggcgagagccgccaccgccggcgcgcgcaccacgcggtgcaggcggttctgagccgtacggcgctgcgcgacgggctgctcctgcccgccgacgactccctgcgcgccgtgagcaccggccaccacaccgggctgggcggagtcctcggcttcctgctgcggctgctgcgcggcggcccgcgctcctggctgccggacacccttccggcggccccttcgaccgcggtgcccgcaccagggcgcgcaccgtgtgacgtcccgctcccgaccggggagtccgggaccctcacgaaaggagatcggacatgaccgacaacctcgacgagctgcagcgcatgccgcaggagaccgccgccgaggaggacaccccgtgcatcccccgggcggcggcccaggtccccaccttcacgacggtgtgctgagcgtcctcaccggacgacgctgaccgggcggcccgctatctgctacggcggatacgggccgctgccacgcccgcatggggcggacggcggagtcataccccgggggcggaccgcacggtgatgccgttgcgttccagcagtgccgccgtcacgccgtcccccggcaccggctccccggtgaacgagccgtcgtacaccgtgccgcgaccgcacgacgggctgcgcggcatcaggagtgcctccgtgcagccggcgcggcgggctgccgcgagggcgcgccgggcgcctgccacgaactgctccgtgacgtcccgtccggtgtcctccatcaccctggccgtgccgtcgagcacgtcgtgtccgtcgccgcccaccagctccgccggccggcggggtgtcgcgagtccgcccgcgacctccgggcagaaggagacgacgtcccggcccctcaccgcctcctccgccgccgacgacgccttgtgccgcccgtcgaaccggcagggcaccccgcgcagacacgcgctgaccaggatcgcttccatgccgtcagcgtagccgcggcgtctccgggcgtgttcgggcggctcggtgccctcagcgggccggggagggacgtttgcgtggaatagtggaggagtgggagccgggccccggtccggcgaccggccacggtcgggtatccggccccgcggcggccgcagggtggtgcctatgtgcgatggcgatgactccgctgcagacggtgttccggacgggacgggctcccccgccgctgacggccgacggtggctccaggagctgggtgtgtgcctgtccggagcggtgacgggactcggcgcgtacggcggcggcgtgtacctgctcgatccggccggggacgctctggtcctggccgtgtacaccgggctgccaccgcagttcgccgggccctggcgccggatccgcctggacgcgccggtcggtgcggccgaggcggcgcgcgagcggaagctggtgtgggtggccgacgcgcaggagatggcccgccgctatccgcgtacggcgctgatcctgccgtaccgcctcgcgttcgccgccttcgaggtgctgcgggcgggtgccggcccagttcacgaagagcgtgccgtgcaccgtcccggcggccaggaggggcacgcaggcgaacgcgaggcggtacgg

SEQ ID NO: 1819 - DNA, 2445 bp, Unknown
  Kingdom: Bacteria, Phylum: Actinobacteria, Class: Actinobacteria, Order: Streptomycetales, Family: Streptomycetaceae, Genus: Streptomyces
gcccggctggacgaactcgccccggagcggctcaccgtgcccagcgggtcggcggtccgggtcgactacgccgatcccggacagccggtcctcgcggtcaaactgcaggagatgttcgggctggacgcctcgcccgtcgtggccggagtgcccgtcctcgtgcacctgctctcccccgccgggcgtcccgtcgccgtcaccgccgacctcgcctccttctggcgggccggctacaagggcgtacgggcggagctgcgcgggcgctatccgaaacacccgtggcccgaggacccggcgaccgcggagccgacccggcacaccaacgcccggctccggcgctgaagctacgaagagccggagagccgggtgccgggtgccgggtgccgggtgccggggaggctacgagggcgaggcggacgcggacgcgctcggtgacggctcggcggaggtgtcggccggggcgaccttcagttccacggtcagcgtcgcaccaccggtggtggtgatgcggagcaggaaagtaccggtggtgtcgtccgcgtacagcttcggcagcttcagcagtcccttggcgtccgtctgaaggcccttcagggtgcgtacgggtttgccgtcgtcgtccttgaagtaggggcccttgtcgttctccgtggggtcgtcggccgacttgatgagcgtggcggtggcggcgaccttgtccgcgacggcgtccttgtaggtggccttgacctcgacctggtcggcgaactcgccgcccggagtgcacatcagcggggtgtcgctggtgcggacgagcgtgtcggcggcgcgcgcggtgaccgtggccttgtactggagcgcggagacggtgcggccgacgaccatggcccggacggtgaagtcgcccgtcttctcgccggcttggagggccggtgcgagggccacgccggaggcgtcggtggtcaccgtggcgaccttctcgccgccggtgaaggtggtgtcggtgtcaccggtgatcacgaaacggaccctgaccttggcgaccgccttgccggccttggtctcggcgcgggtgctgatcttctccgcgaaggcgtcgcccgccatcgcggtgagcgtggccgtaccggcgtcctccaggtggtccaccgtgtcggtgggcgtgggagggatgtcgggaggcgtcacgggcggcctggtcggctcgccagtgctgccgccgggcgtgcccggggtgctcggcgtacccggcttgctgggcgtgcccggcttgtccggggtgctcggcctgccggtgttgcccggcttgtggctgggtgtcggggaggacggctgcgtgggcgtggtggacggccccgggttcgttcccgcggggtcgtcgctgtggtggaccggcagctgtccggtgccgtcgggaacggagtgggtgcccttgcggtagtactccagccacgtcaggacggtgttcaggtactcctgcgagtggttgtagctgaggatcgcgctgctcaggtcggcgtggtcggacaggtcccagtcgttgcggcacaggtagtggccggtggcgagggcggcgtcgtagatgttgttcgggtccttcttgccgtcgccgttaccgtcgcggcccgcccactgccaggtggaggggatgaactgcatggggccgaccgcacggtcgtaggtgctgtcgccgtcgtagaggccgtggtcggtgtcgctgatgttcgcgaatccgctgccgttgaggacggggccgaggatcggggtgagcgtcgtgccgtccgcgtcgacctggccgccgcgggcctggcccgactcgacccggccgatcgcggcgagcagctgccagggcaggttgcagcccggcttggaggagcgcagttcggcctcggccttcttgtaggcgtcgagcacggtggcgggtatgcccgcctcggcgccggccccggccggggtcttggaggccggagtgccggtggtgggtaccggatccgggctgtgcagcggcgggaggtccgtgtagtactgcgtgtcaccggtcgcgctgtcgcctacgggagtgtcgggggcggacgtcgcaccggcagcgggctgtcttccctcatcgctgaccgtcgcgccgggagcctcggaagcggacagcgccgcgaccgccaccgcggccacggccgtcgtcgccgcccctttgtacagcctcctgccgaaatgcgccgccatggagtgaatccctccccgtgaacgcccgagcgtccctctgtacttgcctgttcgccctgttgtgacggttgacccgcggtactggttgccctcgtggagccttccggatgcacgacccaggtgaccctacgacaacttcctttgcgcggggagccgttcgtgcccggtttctactggttggccaccttcggcggcacgggtccggcggacctggaagagcgcgggcaggggcagcgggccgggggcgac

SEQ ID NO: 1820 - DNA, 4839 bp, Unknown
  Kingdom: Bacteria, Phylum: Actinobacteria, Class: Actinobacteria, Order: Streptomycetales, Family: Streptomycetaceae, Genus: Streptomyces
acgtccttcgcggtgcgcgcgggccgctccgcctccggcgcgggcgcaagcggctcctgttcggtgccgcgctgtccggggatcacacccagcagaccggcagcgccggtcgacggctgcaccgtctgcacggccgtctcccgtgccgcgtgcgggcgtacgccgccgctctcgtcgctcgcgcagtcctcgaccacaggccccgacccgggcgccgcctcctgcccgccgtccgcgaactcgtacccaccgcgcgcgcaccgctcggtgcggcacttcttcagcgtcgtgcggcagccgtcgatcacatggaagccgtagcccgagctgcccgtgacccggcaccccaggaagctgccgcggccaccggcggagacgtagaaaccggcctcggccggggagacgaccgtgcagcgctcgatcgtcgggtcggcgcccttggtgacgatcacgccggtctgggtggcgtccaccgtgcagttggcgagcgtgccgccgctgccgtggtcacggaaccacgccccggtggccgcctccttgatccggcagtcgtcgagctgggccgtggcgccgtcgctcaccgacacggcggtgttgcgcacctggaacaggtcgctgtcgacgacgtccgcgcgggagccccggtccaggacgaacagcgcgtcgggtacgtcgtgcaccctgcaggagtcgaggacggcggtcgcgccgtcactgacccatacggccgggtagtcgcccgtactgtcggagatctcgcactggttggcgtccacgcgggtgcccgggtcccacaccgacaggccgttgcgcccgaagtggcgcaccgtggtccgcgtcagcgtcagcacggaacgcgaacgcaggtccaccgcgttctccgggatgtcgtggagccggcagtcggcgagggtgagcacggcgtccgtgtcgagggtgacaccgtccgcggtggtgcggtgcacctcgcagtcggtgaggtgcgcggtggcccgcccggtcacctgcacaccgctgccgcgcacctcgtagacctcgcagcccacggcctccagcgcggagttgtccccggtcacggcgatgcccggacccgaggtgtggtggatccggcagcgctccagacgtggatgggcgccgtcgcggaccgacacgcccgactgcccggcggccacgacctcgcactcctcgaacaccccgccgccggagtcgagtacggcgatgccggcaccggccggattgtccaccgtgcagcgccgcaccgtgggacgggcgccgccgcgcacctcgatgccggacgccgagcgcgtcacgatccgcacgtccctcagctccggtgcgccctcctccaccagcagcgcgggcgccgtggtgtcctggccctccacgtgcaggtcctgcaccaccgccgaggcgcgcacggtcagcggcacgccgtccacgggtgcgatgcgcaccgagccgggggagccctcggggccgcgcagggtcaccgcgcgctggaggacgaggttctcgcggtaggtgcccgcggcgacggtgaggacgtcgccgtccgccgcggcctccagggcggcggccagcgatgcgtactcacccgtgcggcgccgccaccgcgatgtgccggtgtgcgtcacctggaccgtgccctgtgccatggcgttgccgtgcccccacctcgtcgtactgatggctcgttcaccttcggggcgccgcaccggtgccgggaccggggccgtgctcagcccttcgggccgccgcgcgcacgcgcgcggagggttgccgaacgcgtcggccggtccaccgtagcgcgtgtgtggacggtcggttgaccggagcggggaaggccggtggccgccggggacggaaggccgtcagctgccggtgccggtgcggccccagtccgggccggcgcggtcccaggcctggtcccagcgcgcgtacctgcgccggaccaggcgccacaggaccagtctgcgtatcccctccgtgagaccggcagcgacgagggacgtgccgatgccggccagcacggcgtgcgtggtggcggtggtggagtccagagggcggggcacggtcctgccgtgtgtgtcggtccacagggcgaagtggtcgcccgcgtgcgggctcttgaggtccgtggtgaccgggccgtgccgcgagacaccgtccgggccggtccagtcggcgaggacgcggctgcggacctcccggcccgtcgcgatctccgggtccggagccggcacggtcgcggtcagtttccgtacgacggtggccgtgaccaggtgccgggactggcgctggtcgcgcgccgactgctggagggcgtcctgggtgacggtgccgacgagggaaccgagcacgggggcgacgaccaggatcaggagcagcgacaccaacgccacccaggattcgaccagatcggtcgtgcgtcgcagtggattgtgccgccagcgccagagtccgctgattgctcgcactctcccgcacccccttcccgctccgtgataaccccccgcggagccgttcatccgtgaactcggtcgaagagagagggaaatcacctccgaccggccactctcatgaatctctcacgacgctccaacgagcgggccgcggccacgggttcccgggaagcgggcgggtatcactcgaggatcgtgagcgggtcgccgacgcggagtgtgccccgcatctcgggcaccaggttctgcccgaagaccagggagccgccgaagcggcggtggcggccgagggtgcgcaggggttccttgccgcgttcaccggtcgtctggtcggtggtggtgaccacgcaccggccgcacggcttggcgacccggaaggtgacctcgccgatcgcgatgcgctgccagtcgtcctcggcccaggcggcggtgccgcccaccacgacactcggccggaaacggttcatcggcagcgggccctcctcggcgtgatcgccctcggcgatcagggagttgagggagtcgagcgaggagagcgaggtgatcagcagcgggaagccgtcggcgaagctcacggtctccccgggccgcgcgaagtccgggtcgacgggccgtcgggtcgctgggtcgtccatgtgcaccaggcgcacctcggctccgacgaggccgctgcaccaggcgtgggcggcggcaccggccgggacggcctccaccttgtcgccgaagaggtccaccgtcaccgtggcgcccggctgcggcacgggcaccgtgaccgggtcctgcccgggcgcggacagccgaaggccgccgccgggcaacagctcggcgacggccgacgcgagatgcggctgctggcgctgggtgacgacctttcccccgtcgtcgatcagaacccagcgccggtccccggccagcccccagggctccaccacggcctccccgagccccacgggccggagcgccttgaccgggtggatgtgtatcgagtgcagctccgcattccccatgacctcatcctgccaggcggcacggacaggcggggaaagcgatcagtaaccgcggtactgctggttgttgtacggatcctggtacggcgccgcaccgggccgcggggccgcggggcgcatcgcctcgtagccggtgccgttcgtcatgggacgcggcaactgctgctgcgggccggggtaaccgcgcggggcggaggcctgctgcgggatgtaggccgcgggcgcctgctgcagcggcgcgggctgcgcctgcgggtagccgtagccgggctgggacggggctgccgggagtgcgggcagcgccgaggggagcgcgggcaggtggcttcccgcgtggcttcccgtgtcgtacggcgcggggacccggatcggggcgatctgcggtgtgccgcgctcggcgacgagcgagtcgtagatcggggtgtccgggaaggaggcggagtagtagccgccaccataagtggagcggggggaggtcatggcacataagttaagcccacgatgtgctggttggggagaccgataagagggttgttttccgtgtcggcggtgacgcgggatccccaatccgagcgaacttgacaaaaaggggcgccatggggggtttggaccgtgtaaggagcagggttctggggggttgccaggggtcggccgagccggttgtgccgctccccgtgagagttcggccccgccgggcataggttgggcggggagcgagtcgacggagcgccgggagccgggaatcggcccggccgaggtgagggggcgcacatgtccatgccgaagggatcgaacacgccggtgccgaccacggccctgcgcgtcgaggtgggccggcgctccggccccggcgtccccgacgtggacgcctcggccctgctgctcgcggtgggcggaaaggtgcgctccgacggggacttcgtcttctacaaccagccggcccacacgtccggcgcggtgcgccacgagggcaagcgggactccgccgggcaggcgaccgacacgctcgtcgccgacctcacgcgcgtggaggcgtcgatcgaccgggtggtgctcgccgcgtcggcggacggcggcacgttcggccaggtgcccggcctgtacatcgaggtgcgggacgccacggcgggcacggtggtcgcccgcttcgacagcaccggcgcgagtgtcgagaccgccttcgtactgggcgagttctaccgccgccagggcgcctggaagttccgcgccgtgggccaggggtacagcagcggactggagggcctggcaaccgacttcggtatcaccgtggacgagccgcagcacgccgcgccaccgcccgcaccggcgcccggcccgaccccgcccgtgcagccgtcggagggatggcc

SEQ ID NO: 1821 - DNA, 928 bp, Unknown
  Kingdom: Bacteria, Phylum: Actinobacteria, Class: Actinobacteria, Order: Streptomycetales, Family: Streptomycetaceae, Genus: Streptomyces
gggtgcggccgacgagcagcgcggtgagggcgccgacggccagggcgcacagggcgtaggccacggtggcagggccgcgggccacgaagacgtcggcgtaggaccagttgtcgcgcatcaggtcgcggtgggccgcccagccccagcggtaggccaggacgagggcggtgccgccggcggtgagggcggcggcgggcacggcgagcttggccgtcagccagcgggcggggctcacgccctgggtccaggcgaggcgggcggtgcccgactccagttcgcggccgacgagggaggcaccggcgaacgcggccaccgcgaggaagctgtagcagacgaacgtggcgatccagccggtcgggtcgctgtagtcgagggcggcgaacggcgaggctgaggcgcgcacccgctcggcggtgacctcgttgagccacaccagccagccgatcgtgccggccacgaacgcggcccagaccagcagggccgcgcggtgcacggtgaggaccgcgcggggcaggccctggacgagtgcgctcatgcggcggcctcctcgcgggcgggcgccgccgggcgggtggtgcgccgcaggacggtgaacgccgcccaggcgagcaggcaggcgaggaccaggacgagggcgctggtggtcagttgcagcggccagaagtgggagaacggctggctctcggtgtagaagccggtggcgtgcagcttcgcgtacgtccggacgcacgcggccgggtcaggggacccgcagccggggtcggcgatgtgcgcgccggtggcggtgaccaggccctggccgagcgggagtccgccgccggcgtagccctgctccagggtggtgacgcgggtgacggcgggccacatgtggggcagagccagcccggccaggccgcgtatgccggcggccacgcacagaccggtggcc

SEQ ID NO: 1822 - DNA, 1451 bp, Unknown
  Kingdom: Bacteria, Phylum: Actinobacteria, Class: Actinobacteria, Order: Streptomycetales, Family: Streptomycetaceae, Genus: Streptomyces
cagcacgcggacaggtcgccgagatcgcggtcgatccagtcgccgaccagcttcacccatccgtcgccgcgccgggcctcctgggcgacgtaggcgaccaggtcctcgggttcgacctcgtgggcgtagttgcggatgtagcggcgggtgcgggcgatgtggcggccggcccggatgatcttcggcaggtcgtcgcggtcgtcggtccagcgggtgtcggagggcgagcccgcgtcccgcagcagcagcgcaccggcctcccggtcggtgagggcctgcttctcggagacgtcctcgggcaccgggccgtgcgcgtcgaggccgacgtggcagtgcgcgtcgacgaggcccggcagcgcccagccctcgacggtccggacgtcccgggcgccggacgggcggtcgtaggagatccggccgcccaccacccacagttcgtcacggacctggtcgtcaccggggccgacgaggacccgccccttcacgtgcagcaccgcgccatcgctcatgcaccgcaccctaggcgttgtccgcccgtcggggcaggggcggccgggtcgcgggcgccggttactctcgactccgtccactgcgtccattccgccggctcagccgagtcggccggcctcgtgaccgagaagagagcactgccgtgacccaccccttcctggacctcgccccgctgagcgccgcccgcttcgcctcgatcgaggaccgggtggcacggctgctcgccaccgagcaggacgtcgtgatcacccagggcgaggcactgctgccgcttgagggcgcgatccgcgcgacggcgggtccgggcacgacggcgctgaacgtgatcaccgggccgtacgggcagacgttcggcgactggctgcgtgactgcggtgcgacggtgtacgacctgtcggtgccgttccacacggcggtgaccgccgatcaggtccgcgcggcgttcgccgagcacccggagatcgacttcgtgtcgctggtgcacgcggaggcggcgaccggcaacaccaacccggtcgcggagatcggcgcggccgtacgggagcagggtgccctcttctacctggacgcggtggcctccatcggcgccgagccggtgctgccggacgcgtggggcgtggacctgtgcgtgatcggggcgcagaaggcgatgggcggtcctgccggtgtgtcggcggtgtccgtcagcgagcgggcctgggcgcggatggcggcgaacccgcgggcgccgcggcgctcctacctgtccctgctggactggaaggagcgctggatcgacggcggacgcaccgcactgctgcacgcccctgcccagctggagatgctcgccctcgaggcgtgcgtcgagcggatcgaggaggccggcctggacgcggtgatggcccgtcaccggtccgcggcggcggccacccgcgccggtgtccaggccctcggcgcgggcc

SEQ ID NO: 1823 - DNA, 2498 bp, Unknown
  Kingdom: Bacteria, Phylum: Actinobacteria, Class: Actinobacteria, Order: Streptomycetales, Family: Streptomycetaceae, Genus: Streptomyces
cgcgcgatcagcgccacgccgagaccggcggcgaccagcgcgaccagcgtcgggttctcgtcggcctggtggacgacgtccggctcgtgcccggcggcgcgcagcgtgcgcagcagccagtcgtggcacacccgccccggtggctggcagatccaccgctcgccgcccagctccgagcgccgcaccgcggcccgtccggcgaacggatgcccggccggcaccagcagatcgcacaggtcctcaccgatggccgcctgctccaccccggccggcgcgggcagcggcgcgatgtcccagtcgtgcgccaccgcgaggtcgacggcgcccttggcgaccaggtccaccgacaggtgcgggtcgacctcgctgagccgggcgtccagcgcgggatgccgcagggccaggtcggccagcacgcccggcagcagcccgcgcgccgccgaggcgaacgccgcgatggtcagccgcccggccggcaccccgcgccgctcctccagctcggtctccgcccgctccacgatcgccagcaactcctgggctgcggcgaccagttgacgcgcctggtcggtgagccgcaccccgcgtccctcccgctccaggagtacggtcctggtctcccgttccagcttggcgatctgctgcgacaccgccgacgaggtgtagccgagcgcggtggccgccgcgccgacggtcccgtgcacggacacggcgtgcagggcgcgcagtcgctggagatcgagcacggttcctccgcgggtgagggagcgaatgattagcgttgctgcatccaacagtgcagcaatcatcgctggtgctacacggtcggggcgggtgatcctcgacgcatgcgaccaccccacgtcctcctcgccgtcctcgtcgccgccgtctggggcgtcaacttcaccgtcatcgaggtcggcctcggccacttcccgccgctgctcttctcggccctgcgcttcctggccgccgcactgcccgccgtgctcctcgtgggccggcccaaggtggcctggaagtggatcgtggcggtgggactggtcctcggggtcgccaagttcggcctgctgttcgtcggcatggcccacgggatgccggccgggctgtcctcgctggtgctccagatccaggcggtgttcacggccctgttcgccttcgcggccctcggcgagcgccccacccggctgcggctggcgggcatggcggtggcgctcgccgggatcgtggtcgccgccgtcgacgagggcaccacgggcccgctcggtgccttcgcgctggtcatcgtcgcggcggcctgctggggcgcctccaacgtcctcacccgcaaggcggccccgccggacgccctgaacttcatggtgtgggtgagcaccgtcccggtgctgccgctcctcgccctctccctcctgaccgagggcccctcccgcgatctggccgccctgcgcggcctggactggcagggcgcgggcacggtcctctacgtcgcctgggtcaccacggtgttcggcttcggcgcctggggctggctgctgcgccgccaccccgcctccgccgtcgcgcccttctccctgctggtcccggtcttcggcatgtcggcggcggcgctcttcctgcacgagccggtgaccccgctgcgctggtgcgcgggggcgctgctggtgggcggtgtggccctgacgtcgccggcccccgcgaagatccgtgcgaagacccacgccgaggcccccgcgccggagccggccccgatccccgtacccgaccgcgtcccggtccccgcccggcagcgggactgaacccggcgtacagccccaccggcggcccggccgaaatgcggtcgacgcggccgggcccgtgcgtcagactccccgcgtgacgatcaccatggaaggcccggtcctggagggcggcctcgtccgcctggagccgctggcgcaccggcacgccgccgacctcgcggtggccgccgaggaggaccgggactcgtacgccttcacgtgggtgccccgggcccacgagaccgaagcctacgtcgacgcccagctcgcccgcgcggccaccggccgcctcgccccctacgcccagatctgcctcgccaccggacgggcggtcggcgccacctcgtactgggagccgcgctcctggcgcgcggaggaccggctggacgccgtcgaggtgggcttcacctggctcgcccgctccgcccagggcaccgggatcaacgccgaggccaagtacctgctcttccggcacgccttcgaggtgtggcaggtctcccgcgtcgacctgaagaccgacgcccgcaacagccgctcccgcgcggcgatcgagagcgtcggcgcccgcttcgagggcgtcctgcgcaactggtcccgctcctgggcaccgggcgaggacgaccgcctgcgcgactccgcgatctactcgatcacggccgccgaatggcccggacgccgcgcggcgctggaggcccgggtgcgcggcgtccgggccattcg

SEQ ID NO: 1824 - DNA, 878 bp, Unknown
  Kingdom: Bacteria, Phylum: Actinobacteria, Class: Actinobacteria, Order: Streptomycetales, Family: Streptomycetaceae, Genus: Streptomyces
cgccatcgaggccgacggcgagaccggcccgtcggccgatgccgcgactggctcgttggtcgatgccgcgaccggctcgtcggccgacggcgggaccggtgcctcggccgacggccagaccggtgcctcggccggtgtcgcgcccggagcgtcagccggtgtcgcaaccgatgcggcaaccggcgcgggaacggcatgcgccccgcccggcctcgccgcaccggagaaactccagatcagcgccctgcaggcgatgtgccgccacgtcttcgccttccgcctggcgatgatcgccctgtccgcccccgccgcactcgtccacgccgcccccggcctggccgtccgtctggtcggtgccgcggtggtcctcaccttcatgggctcctacgtcctcttccgggactgggaacgcttcggcccgctgctcctgcgccaccccaccctgctggccctggacaccctcttcggcgcgctcctgctcgtcgcggccggcccggacagcaccctggcctacgtcagcgtctgcacccccctgctcgccggcctcgtctacagctggcgcggcgccgcgatcttcgcctcgctccagtccctcatcctgttcctcgcctacgcggcgaccagggaactgcacgccaacctggcccagtccgccctcttccccggcctgtgcatcgtcgcgggcgcggccggcgccacccagcgcacgctgctcctccgcttcggcgaggccagccgggcctggacctcgttcagggtccggctggcctcgccgaagcggaggagcagcgtgcgctgggtggcgccggccgcgcccgcgacgatgcacaggccggggaagagggcggactgggccaggttggcgtgcagttccctgg

SEQ ID NO: 1825 - DNA, 554 bp, Unknown
  Kingdom: Bacteria, Phylum: Actinobacteria, Class: Actinobacteria, Order: Streptomycetales, Family: Streptomycetaceae, Genus: Streptomyces
  misc_feature (266)..(364): n is a, c, g, or t
gtcaggtagggcacgggcgcgaccgcgcggcccagttcctccaccaccacggcggcctcgcggtgggaggcgccctggccgcccagttcctcgggcaccagcaggcccgcgaggcccatgccgtcggcgagcgtcttccacaggggcacgtcgtggggggcgtccgactccacccgcgcgatcacgtccgccggccggcagtgatcggtgagcaggccgcggacggcggcgcgcagcgcctcttcctcctcggagtgcaggagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtccaccagttcgggacggcgcatggtccagtcgtcgtacaacagcccttcctcgccgcgcagttcgacttccaggccgctgatctcctggttgaggcgggcgaaggcgagcttcatgccggagccctcggggccgggctgtcccgcggcgagctgctggcgcagccgctcgccggtgaggcgggcca

SEQ ID NO: 1826 - DNA, 2765 bp, Unknown
  Kingdom: Bacteria, Phylum: Actinobacteria, Class: Actinobacteria, Order: Streptomycetales, Family: Streptomycetaceae, Genus: Streptomyces
caggaccgcctcgccgaactcgagttcccggcgctgctgagcgagttccaccgggacatcgacgcgtacctcgccacccgcaagggaccgcggaacctggccgaactggtcgagttcaaccgtacgcacccggccgagcgcacctgcttcgccggccaggagctgttcgagcaggcgctggccgcaccggcgaccaccgacccgcgctacctggccatgcgtgccgagctgaaggacctctcccggcggtccatcgacgagaccctggccgcccaccacctggacgccatcgcctcgccgacgaacccgccggcctggacgaccgactgcgcgcgcggcgacaacgacgtgatcccgtcctccaccccggccgccgtcgccggctacccgtccctgtccgtgcccgccggcttcgtgggcgaactgcccatcggcctgctcctgatgaccggcgaccaccgggacgcggaactcctgtccctgggagcggccgtggaacaccgcctggatgcccggcgcccgccccgctacctccccacgacaccgcccggctcctcccagcggcaggcgcctcagcagtagtcgatcagtagccgtcgatcagtagtagtcgatcagtagtagtcgtaacggtcgtcgcgggcgtcgtccctgtcgcggctcctgctggggcggaccgggcccgacgccgaggtgccgggcccggaccggaggaggaatggcgcgcggagcccgagcagaggcttcccgcaccgctgtaggcgggcggcgcggcctgggtctgctgggcctgccgcgcgcgttccacctcctgcctgtggctcgcgttgatccggcgcagcgggacgagcgagatctggtggctgatgtactcggcgaggtcccgtcgctgcccggaatctcctccagcgtcgccggtcggccccaactcgccgtgggtgtcggccggtgcggctcgtgacgagacgggaacgggcggatgcgggcgtctgtgaccgagcctctggaaaacctcaagcggcttgccgcggggcgtgtgcgaccggcacggtgaggtgcatggcagcactcacgggactgaacaagaagcacaacttcgtgctggtcgtccgggacgccgacgtggtcgcggcggccctgcggcaggcgttggccgacgcgtcgcccgaggaacgcccgggcctggaacgcgccgccgcgctcgtacggtccaccgccgccgccaccgagagcgggctgcgcgccggctgggtgcgggcccggctggccgaggcgggcttcaccggggacctcggctcgatcgccgcgctgaaggcgctgcgccaggcggagccggggctgagcctggtggcggcggtgcagttgcagaaggaggccgtcggacatccggagtgatccgcgaccggccccggacccgggcggtcgggaaggcgacggcacggcctacagcagggccgcctgcggggcctcggtgaccagccgggtcagtgcccgctcgtccgcctcggtggcgggcatgaacaccaccagatgctggcccggcgcctccgccacgtccagtttggtgtagttgaggtccagccgcccggccgccgggtggctgaagcgcttcatggtcggcctgaacgcccgcaccggatgctcggaccacagggcgcggaactggctgctggaggcggtcaggctgtcgatgagcgcggcggtgcgcggatcgccgggctgccggccgacggagatgcggaactggcccaggatgtcgcggacttcctgctgccagtcgaccagcagcgactgcatctgcgggcgggtgaacagcagccagatgctgttgcgttcctcctgcggcagttggtcgaggccgccgaccagactggcgtaggcgcggttggcggccagcacgtcccagcagtcgttgatgacgtgcgccgggttcgggtcgagggtctccaccagcttgcgcagtgtcgggctcaccgccgccggccgcggtggctcggcgggcagcgccgtctcggccagcgtgaacaggtgccgccgctcggccggggtcaactggagggtctgggcgagggcttcgaggacctgccggctcacccggatgtcccggccctgctccagccacgtgtaccaggtcaggctgacgccggagagctgggcgacctcctcgcggcgcagtcccggagtgcggcgtcgcgggcccgggttcagaccgaggcgctcgggggagagcgactcccgccgggatctcaggaacgccgccagaagctctcgctgcatgccggccatgaaagcacccccctctgggccgtgtcctggtgctcattacaccagcatgattgcccctctgtacccccttcgcgtgaggcgccaccctcttggtgtgaccacagaatcgaccaccacgggaacgaacatccccgccgcggcaccgacgtccgcaccggcctggggcaagcccgtcgccgtcctcgccctcggttccttcgccatgggcacggactccttcgtcctggccggcatcctgccccagatcgcgggcggcctgcacgtctccaccggtgaggccgggcagaccatcaccgcgttcgccctggcctacggcctggcggcgcccttcctggccgtgctgaccagccggctgccccgcaagcccctgctggcggtcgcgctcgcgttgttcgtcctcgccaacctcgcctccgccgccgcaccgaacctgccgctgctgctggtggcgcgggtcgtcgcgggcctgggcgcggcgc

SEQ ID NO: 1827 - DNA, 1136 bp, Unknown
  Kingdom: Bacteria, Phylum: Actinobacteria, Class: Actinobacteria, Order: Streptomycetales, Family: Streptomycetaceae, Genus: Streptomyces
gtggtggcgctcggggtcgtgggcggtgtcggggccggggcggccgggtcggtgcggccgaagaggaccgagcggtagacgcgtgaggaggcggggttggcaccgcactgccagacaccgtgcgggcagtagtcggtcagcgtgttgtagagcggccggtgccggtcgatccaggcgagcatgcggcgcatgtactcggcgtcgtcgccgttgcggaacagcccccactccgggtacgagacgggtttgccgtgcgccctggcgaagtccacgtgcgcctggagtccgtagggctcgccgacctgctgatcgaacgtcaggccggtcggctggtcgtaggagtccatgccgacgatgtcgaccacgtcgtccccgggatagcactccgtccagggaacggcgtcccggccgcggttgggcgcgaagtcgaaccggaacctctggcccggcacggcgcgcatcgcgctcacgatgcgccgccagtagctcttccacgcctgtggatcgggtccgcagcggtgggtgtaggtggtgccgttcatctcccagccgagcacgatcaccgtgtccggcacccgcagctcgaccagccgccgggcgagggcgctgaagtggtggtcgaactgcccggcggcgccctgccgcagcagcccgcggacctcgtcgtcggagaggtgttcctcgttgcgttcctgcatggggacgttgaggacgagcatccggtccggccgctggtcccgccagtgcgcccaggcgtcgaggaagcccggggcgccctcgatgtcctgccagcggtcaccgggcagataggtgtgccccacgcgcagttcggcaccgcccagccagttgctgagctgcgccatccgggccacaccccgcgcgtccgactccaggaaggccccgaaggcgggactcacgggcacggtcacggcagacggactcacgggcgccgtcggcgaagtcgccgggggtgggctcacgggccccaccggcggactcacgggcgcggccggcggactcgtcggcaccgcggacggactcgccgccaccgcggactgactcgtcggcaccatcggcggggtcgcaggcacccctggcggactcggtggcgcggccgacgggctcgcgggcaccac

SEQ ID NO: 1828 - DNA, 702 bp, Unknown
  Kingdom: Bacteria, Phylum: Actinobacteria, Class: Actinobacteria, Order: Streptomycetales, Family: Streptomycetaceae, Genus: Streptomyces
gtgtgagggggagcggcggggcgggtgtgcgggccaggcacaccgacaccgtcagcaggaccgcgcccagtacgcccagcaggagccggtggccgacggtcccgacgagccacgcgccggccgcgagccccacgacgttcggtacgaggacgagggtgtgggccgtcgccgtcacccggccgaccagctcacccggtgtctcgtgctgcacggcggtgaacgcggcgatcagcacgcacggcagccccgcgccgatcgccgcacagcaggccaggaccaccgggccggacggcacggcccgcagggccaccgcgaccgccgtcagggcgatcccgtacgcggcgaaccggcgcccgcccagacggcgcagcccggctcccgcggcgagcccggtcacgaccgaaccggcgccctgggccgcgtacagcaccccggcgtacgcgggcgcgtggccgagcgagtccacgatcgcgtagaccagcgcgccgttcacgcccgcgcacagcatcgtcgccgcgccggccagcaccagcgggcgcagcccggggtggcaccacagtcggcgcacgccctcggcggtgtgctcccgccaggagccggacagccgtcccggcggctgctcgcggacgcgcagcagcgcgtacaggcccgccgccaggacgaaggtggccgcgtccagcagctggacgcggccaccttcgt

SEQ ID NO: 1829 - DNA, 737 bp, Unknown
  Kingdom: Bacteria, Phylum: Actinobacteria, Class: Actinobacteria, Order: Streptomycetales, Family: Streptomycetaceae, Genus: Streptomyces
  misc_feature (256)..(292): n is a, c, g, or t
gccttggcgcggcggggtccggcgcccgcggaggtggcgggcggctgcgcgggcggcgtcgcggggagctgttccccggccgcctcgggagcgcgccggtggtcggtccaggacgagccgtcccaccagcgctccaggtgcggggccgagggatcgcggtaccagccgggcgggggcgtcatgctcaccacggcactgtaggacggatcgccggacggccacaggtgcccgcggcggggcgtctacagcggggtgnnnnnnnnnnnnnnnnnnnnnnnnnnnnnnnnnnnnnggcgaggaaggcgacggcggcggcgatctcctcggcctcggcgaaccggccgagggggatgtggacgagccggcgcgcggcgcgctcggggtccttggcgaacagctcctggagcagcggggtgttgaccggtccggggcacagggcgttgacgcggatgccctcgcgggcgaactgcacgcccagttcgcgggacatggcgaggacgccgcccttggacgcggtgtaggagatctgcgaggtggccgcgcccatgcgggccacgaaggaggccgtgttgatgatggagccccggccctggcgccgcatgtagggcagtgcggccttgcagcacaggtagacggaggtgaggttgacgtcctggacgcgcttccaggcctccaggccggtctccaggatggagtcgtcgtcgggcggtgagatgccggcgttgttgaaggcgacg

SEQ ID NO: 1830 - DNA, 491 bp, Unknown
  Kingdom: Bacteria, Phylum: Actinobacteria, Class: Actinobacteria, Order: Streptomycetales, Family: Streptomycetaceae, Genus: Streptomyces
ccgaccctctccgccgcctccagcacggtcacgcgcgcgccgcgctccagcaggcggtgcgcggcggccagccccgcgatcccgcctccgatgacgacgacctgccccgtgcccgtacccgttgcgctcatgtcccccactctctcagaccccgctgacactccctccgggccccggtgtcccggacgagtccggaccgtgaccccatcggtaccggtttccggcaacgggccgcgcggtccgcgagtcgaagaggcgtcagaggtcaccacgctccccgggggtacgcgacatgcgcacagggtgttctgttcgacgttccgttcgacctgttgtccgggctgcttctcggtccgcttcgcgcaccacttctcgatccgcttcccggtccgctccggcgctggccgggctgctgctcgcggcggcgctcgtgctcaccgggtgcagcagcgcgggcgactccggtggcgccgcctccgacaaggccgccg

SEQ ID NO: 1831 - DNA, 1094 bp, Unknown
  Kingdom: Bacteria, Phylum: Actinobacteria, Class: Actinobacteria, Order: Streptomycetales, Family: Streptomycetaceae, Genus: Streptomyces
gtgaagtcgtccagggcggcgaaggcggcgccgccggtcaccgtggcgacgacggcgcgggcctcctccggcgcgaggcgcagcgtccagcggcgcccggaccggtcggcccgctcctggagcacggcgacctccgggacgtccaggggcgcgtgctcgcgccacaccagctcgacccggacctcgccggagacccgctccttgagtccggccggggtgtcgcaggcgatgacccgtccacggtcgaggacggcgacgcggtcgaggacggtctcggcctcgatgacgttgtgggtgaccagcaggaccgtggtgccgtgctcggcgcggcgccggtccacggcggaccacacggcgcgccgtgccaccgggtccatgccggtggtgggctcgtcgagcacgagcagcgggcgctcgccgaccagggcggcggcgaagcaggcgagccggcgctggccgccggagagcttcttcagggggcgtccggcgatcggtgtgaggcccagttcgtcgaggacggcgtcccgctcggcccgggcccggcgcacgtccagtccgcgcagccggccggtggtctcggcggcgagcgagacggtcagctcgtccagggcgctggactcctgcccgaggtaggcgaggaggcgggcggcccgctcggggtgggccacgatgtcgtggccgaggatgtcgacggtgccgcgatcggggcgcatcagcccggtgagctggcgcaccagggtggacttcccggccccgttcggtccgagcagcccgaagatctcaccgcgccggacgtccagctccacctcgtcggtggcccgtacctcggggacgcccggagtgccgcgtcggccgcgggctgcgggataggtcttggtcagtccgcgcaccgcgcacacgacgtcgtcggtgtgccgaagtcccggtgccgcgcgcttactcacaaaggacgagagtacggggtccgcgggctttactcgcccttggggcgacctctcccggtttctccggcagcctctcccggctcctcctgcacccgccgaccggccccttgccccggggaaccgaaggaaccggtcggcgggtgcaggagg

SEQ ID NO: 1832 - DNA, 749 bp, Unknown
  Kingdom: Bacteria, Phylum: Actinobacteria, Class: Actinobacteria, Order: Streptomycetales, Family: Streptomycetaceae, Genus: Streptomyces
  misc_feature (267)..(268): n is a, c, g, or t
tcatacccgcccggctcatacgtgcccgcctcatacagacccgccagacccgcctcacacgtactcgccgcatacgtacccgccgtacggccgccttcgtctccgtcaccgcgctgacccttgccgtcagcaccgcgggggccgcgcacctcacggtcggtgccacggcgcccggagccggagcggcctccctgttccggtccccggctctcgctccttgcctgatcagcggcgccagagccgtacagatgacggagggcgtacccnngctcgaccgctaccacgagttcttcccgcagacccaggagtggttccgcgccgcctcctacgggcgcctcgactaccgtcccgagaccccgatcacccactggctgcgcatgccgaagccgttcaaggagtacgggatcgagcgcggcgctcccttcgacccgggctaccgcaagctcgtccaggacatcgtggcggcggccgacccgacggtggacttccgcaagtacgacctgctgaacgtgctgatgaccccgaacgccgggccctccgccctggacaccgtcctgtccgtcaccttcgcgggcaacccggacgccccggtggccgacggcgtccccatcgcgaacgcgtccttcgtctactcccgccaggacgacggctccggttcctacgaccgcaccggctaccgggtcctcccccacgagaacggccacgtcttcggcctgcccgacctctacacccaggacggcggcggcgcg

SEQ ID NO: 1833 - DNA, 598 bp, Unknown
  Kingdom: Bacteria, Phylum: Actinobacteria, Class: Actinobacteria, Order: Streptomycetales, Family: Streptomycetaceae, Genus: Streptomyces
  misc_feature (274)..(275): n is a, c, g, or t
tcggcgagcagatctccacccacgaggtcggcaaggccctcgtcatcaaggtcccgctggccggctccggcaccgacaaggtctccaccgacgccctcaagaccctccgcgacgacgccctgcccaaggccttcgagaagaccgacggactgcactacgcggtcaccggccagatcgccgggcagcacgacttcgcctcggtgctcagcggccgtgccccctgggtgttcgccttcgtcctgatcctcgccctggtcgtgctcaccctcgcctnntgctcggcttcgactcctacggcgggatcgtctcctggctcccgctcttcatgttcgtgatcctcttcggcctgagcatggactaccacgtcttcatcctcagccgggtccgcgaactgtggcagcgcggcgacagcgccaaggacgcggtggcgggcggggtcggctccagcgccggcgtcgtcaccagcgccgccgtcgtgatgatctccgtcttcgcgctcttcgccacgatgtccggcatcgagtacaagatgctcggcgtcggcatggccgccgcgatcgccatcgacgcgacgatcgtccgcggtctgctgctgccg

SEQ ID NO: 1834 - DNA, 1754 bp, Unknown
  Kingdom: Bacteria, Phylum: Actinobacteria, Class: Actinobacteria, Order: Streptomycetales, Family: Streptomycetaceae, Genus: Streptomyces
gctcggcaccgcgggtgcgctcgcgctcggcggatgcgccgcggccggccggaccgcgaccgccgtcacgttcctggggttcggcgtcgtcctgacgctggtggcgaccgtgatcgccgggccgctgctggtgcgtccgctgatccgggtcctgggcggggcgttcccggcgctgttcggcgccgtcggccggatgagccagcgcaacgccctgcgcaacccgcgccggaccggtgccacggccgccgccctgatggtggggctggccctggtcggcggcatgtccgtggccagcgcgtccatgacccgctccatcgaccaccagatcgaacagacgctcggcgccgactacatcgtgcagaaccgcacgttcatgcccttcccgcagcaggtcacggacaccgtgcgcgcgacgcccggggcgggtgtcgtggtccggcagcggctggcggcgatcgcggtgcggctgccggacggcaagcgggtccagacggtcgtctccggctacgaccggcggctggacgacgtcgcccacatgacctacacggccggcgacagcgcgacggcgctgaccggcgggcacctggccatggacgtgggcttcgcgcgcaagcacggcgtccggctcggcaccgtactgccggccgagttccagagcggacgccacggcgacctgaccgtcggcgccctgaccgaccaggacacggcagaggggttcggcctgcagggcggcctgtacatgggcctcggcaccctcgaccggtacgcccccggcacgcaggacgccgcgctgtacgtgaacgcggcgccgggcacgagccccgctctgctgcgcgcccggctggagaaggccctcaccccgtatccgaacgtgcaggtgcgtgaccaggccgactacaagaagctggtgcacgaccagatcgcggtgctgctgtacctggtctacgcgctgctcggccttgccatcgtcatcgccgtgctcggcgtggtgaacacgctggcgctgtcggtggtggagcggacgcgcgagatcgggctgctgcgggccatcgggctgtcccggcggcagctgcggcgcatgatccggctggagtcggtggtgatcgcggtgttcggcgcggtcctcggactggcgctgggtctggtgtggggggtgtgcacccagcgggtgctggccctgcaggggatgaagtcgctggcggtcccgtggagcacgatcgtggcggtcgtggtcggctcggccgtggtggggatcgtcgcggccctgctgccggccctgcgcgcgtcccggatgaacgtgctggcggcgatcgcgcacgagtgatggaatcaccgggctgatcaagtcacgtactgcggaggagagttcatgccgcgtccgttccgcttcggagtcaacctgctcgacccggcaccggccggcgagtggcgggccaagtgccgccgggccgaggaactcggctacgacgtgatcctcgtccccgaccacctgggctgggtcgcgccgttcccggcgctggtggcggcggccgaggcgaccgaacggccccggctcggcacgttcgtgctcaacgcgggcttctcgaaccccacgctgctcgcccgcgaggtggccacgacggacgcgctgaccgacggcaggctcgaactggggctcggcaccggctatgtgcgggaggagcacgagcgggccgggctgccgtggggctcccccggcgagcgcgtcgagcgcctgcggcgcacggtcgaggaac

SEQ ID NO: 1835 - DNA, 1428 bp, Unknown
  Kingdom: Bacteria, Phylum: Actinobacteria, Class: Actinobacteria, Order: Streptomycetales, Family: Streptomycetaceae, Genus: Streptomyces
ccgccacggcggtgaggccgggcggacgggtccagggacggtccgcgtgccggaacgtgtcaggtgccgcagtctggatacgcggtctgcacggcaccagcgccgtcggcaccacacccgtcggcccgcgccgtgcccgcccgtccgtccgcgccaggcgcgtccgcgccgccgcgcgcccgccccgccccgtccgtccgtccgggaggtcatccacgtcatgggaagcgaccaccacacggcgcaccgttccggaacgacgctccgggtcaacggcaagccccacaccctcgaactggaccaccgccgggtcctgctggacgtcctgcgcgaggatctcgacctcaccggggcgaagaagggctgcgaccacggccagtgcggcgcctgcacggtcctggtcgacgggcgccgcgccaacagctgcctgctgctcgccgtcaccctggacggctgcgaggtgacgaccgtcgaagggctggcgggcgacggcgaggaactgcacccgctgcagcgggccttcctggaccgggacgccttccagtgcgggtactgcacgccggggcagctgtgctccgcggtcggcgcgatggccgaggcagcggccggccatccgtcccacgtcaccgatcccgccgcgccctccgggcgtcccgtcgcgctggactcggacgagatccgggagcggatgagcggcaacctgtgccgttgcggcgcctatccgcgcatcgtcgaggccgtggaggacatcgtcccgtgaaacccttcggctacgtacgggcgggcagtgcgcaggaggcggcggaggcgttcgccgcgcaccccggtgcccgctatctcggcggcggcaccaacctggtcgacctgatgaagctgggcgtggaacggccggacttcctcgtcgacgtctcgcggctgccgctggagaccgtggaggagctgcccgacggctcgctgcgggtgggcgccaccgtccgcaacagcgacctggcggcgcatcccctggtccgcgaccggtatccggcgctgtcccaggcgctgctcgcgggcgcctccggccagctccgcaacacggccacgaccggcggcaacctgctgcagcgcacccgctgcccgtacttccaggacctgtccaaaccctgcaacaagcgggaacccggcagcggctgcggcgccctggagagcgaacaccgcgaccacgcggtgctcggctactccgaccggtgcatcgccaccaacccgtcggacatggccgtggcactggccgccctggacgcgcgggttgagctgtacgggcgggagggcacccgcagtgtcccggcgtccgagttccaccggctgcccggggaccatccggagcgggacaccgagatccggcccggcgaactgatcacctccgtggtgcttccggcggcgaccgcggggctg

SEQ ID NO: 1836 - DNA, 893 bp, Unknown
  Kingdom: Bacteria, Phylum: Actinobacteria, Class: Actinobacteria, Order: Streptomycetales, Family: Streptomycetaceae, Genus: Streptomyces
cacaccgtgcccatgccgccgtgtccgagcttggccagcagccggtaccgcccggcgatcagccgcccggcgccgggatcggcgggcggcaaccgaacctccgtgggagcagcgggcgttgccgggacagcgggcgttgcggggacggctggagctgccgggacggcggacattgccggggtggcaggcgctgtcgtgaccgctggcgctgccggggcggcgtaaggattctgcggatggggcacgtacggctgcgggtccggcggtcgcaggacgaaactcgtcggctcgtcggcctggttgtgggctcccccgttgtcgctcatggtccatccataccgcgagcgcgttcacgtctccaccgtgggagccgggcggtcacagacccgtgacctacgggtgcgggcccggggccggccgctcaggcgatcctgaaggtgtcgacggcgacatcgaagtactcgcgggcctcccgcaccttgccgaccggcgccgacagccacacgtcgtacatccgcccgtcctgctcccagcacaggtcgtaggtgtgccgggggccctccgccgtactgaaaccgctccaggtgaactcccagagggcggcggggtgtccgtcgtgcgtggtggcggtgacctgcccgtcgtggtagccggggttggtgtccggtccggcggtgtccgcacggcgcatcaccgcgagcgggccgcccgcttccgggtcggccgccttgatgccgaggcggaaggtctgcccaggtgacaggtagaaggtccgcacgccctgcggcgagcgcgcgaagccgtccggtacggccaccgagaagccggccgggtcctgcgccaggtggtagccggagggcgcggtgggagcgtcggcgccgcccgccgccggc

SEQ ID NO: 1837 - DNA, 2167 bp, Unknown
  Kingdom: Bacteria, Phylum: Actinobacteria, Class: Actinobacteria, Order: Streptomycetales, Family: Streptomycetaceae, Genus: Streptomyces
cccgctccccgaacggcgagcgggaacgaccgccgtcatgcgcacggggtccggcgcaccggctctggacgcacggggtccggcgcaccgggtccggacgcacagggtccggcgcaccgggtccggaaagcggcgcagcgctccggctcgctcaggtagcggccccggggcggcgtgaacgcgtacaggtcgaggatgtcgggccggggagccactccgggtccgccggcgcgcacccaggagacgatgtcctccgtcgcgtgcgcgtcgttgaccagccccagccagaccggccgcccgccggccgcccggccctcggcggacggctgcacgacgatgacgttggcctggtcgcacacgtcgaggcactcggagatccgcaccggtaccgccgcccgcagccgcgcggtctgggccgcgtggtccacgccggtgaccttcgggctgccgcagcagcagtcgcggcacaccacgacacggcacggcgctgtcccggctctcgtcccgcctcccgtcacggcgccgcgcgacaggtccgccgtcggctttccgggcatgtcacaccactcccctcccggggagatccgccccggtgttccgcgagggggcgaccgcgtgagtctcctggctcccgggtcgccgctcgtcccgccttcccaccccgcacggagcagtggcacgccggaactcgccgctgacccacgtacgggacaggacgcatccgggcccccgatggccctggcggcctcgcgccgaggctcacgtcgcgggcgcgtgggccaggcggtggccagcccgtggaggcgtccgtccggatcgggcagtggcagctcggcggcgtccgggacgcagacgtgcccggcctgatggtccgtacgaatgacgatgctgcggggggagagccgtgacgacgacacccacggtggacgtgcgcgcccacctgctgctgcccgaggccgatgccctggggtgagggggagccgcggtcctcccgcctacgcggcgtgccgtgcccggccgtggccctggggctggcgggccgtcgtcgcgtccagctcaccggtcaaggcctcgatcgcggtgaccagtccccagcaggagctgagggcccgcgcccgtacgtgcgagacgccgtcggcggcctccgggtcgccgggccaggccagcccgctggacacggagagcaggtcgaaggcctcgcgcagcgctcccgggcgcacgggctctgcgccgtcggccgccccggacagtgcggcgaggtggtcgcccacgggtgcggcgagttcggtcagctcgggcaccacctcgtcctcgcggtccggcaggtgctcggcgagcagcgtcgcggcccggttgaggccgtccacatcggccatgatgcgccgcagttgggcctctgaccagcgtccgcggttgctgcggggctcgtggggcagcttgccgatggcctcgttcagctcttcgtggacccgccgtacggaggtgcgcaggttctccagggcgtcccggtccacggcggcgacgtccgagtagccggtcagtacgacgggcagcaggcgcgcctgcagtcgcagccagcgggcgagcaggaccgggacgtgccggtggtgccacgtgggcagcaacaggaagatcaccatggcgatgagggcgccgagcacggtgtcggcgggccgcccgaaggccaccgggccctccggcgtaccgatgttgtggatgaggaagacgagccatgcggtgaggacgacgttgagtacgtgctggccggtgcgcagcagggtgaacgacagcacggcgaacaccacgacggcgacggcgagcgcgccgtgggaccagtggtactggagcagcccccaggcgacgagtccgccggcgatcgtgccgatcggccggctgatgccgcgggcgaaggtgtgctcgtagtcggggaagagcaccagcatggtggtgagcgcggcccagaagccgtgcgcagggaggccgtggccccagaagtcgccgaccgcacggcccgcggcctccgccacggtggcgcccacgccgacgcgaagggcgtgccggaacagggggtcgccgggttcgagcgcgacggtcagccggcgcacgcccccggacagcgggcccgcgccggagtagagcgcggagacctccatgtgcggggcggccc

SEQ ID NO: 1838 - DNA, 1031 bp, Unknown
  Kingdom: Bacteria, Phylum: Actinobacteria, Class: Actinobacteria, Order: Streptomycetales, Family: Streptomycetaceae, Genus: Streptomyces
gggttcctggggcgggcgggcctgtgtcctgggcttgccgggtgcccggggctcagaccgcctctgcggtctcggggagttccacggcgagctgctcggtcaggtcgatgacctcgcccagatcgccgtagtcgcgtaccgcgttgtcgacggtcttgcggatacgggtgttcacacgctcggagcggaccttcttggccacctccatcgcgtgcgcggcatagcgcgtgctctgctcgggctcgcgctgcagcaggtggacggtggccatgccgatcaggttcagcgcgtaggagcgctggtgttccgcgtcctcggcgaacagttgtacggccttctccatcagcggctcggcgagcgaggcgtacgtggggctgcggcccgcgacgtaggcgaggtcgcggaaggagtgggagttctcgccgtacagctcggcctcggagaagaagcggatccagtcggggtcgggctcgtcccagtcgtcgacgtcggtgaaggcgtcctcggccatccgcaccgcccgcttgcacttgccgggctggcccatgttggcgtacgcgcgggcctccatcgcgtacagcatggactgggtccgcgggctcgcgcagtcgcggctgccgtactgcgcgaggtggatcagctccagggcgtcgtcgggacggccgaggtggatcatctggcggctcatgctggacagcacgtaggagccgagcggcttgtcaccggcctccttcgcggcgtgcagggcgagcacgaagtacttctgggcggtgggctgcagtccgacgtcgtagctcatccagccggccagctcggcgagttccgcggcgaccttgaacaggcgccgggtggtgccttccgactggggctcctggaggaggtccgtcacctcgtgcagctggccgacgacggccttgcggcgcagtccgccgccgcactgggcgtcccacttgcggaacatcgcggtggtgctctccagcagctccagttcggggcgggagaggcggccggggcggcgggtcgcggcggcc

SEQ ID NO: 1839 - DNA, 680 bp, Unknown
  Kingdom: Bacteria, Phylum: Actinobacteria, Class: Actinobacteria, Order: Streptomycetales, Family: Streptomycetaceae, Genus: Streptomyces
ggctacggctgctcctgcgaccgcgtcggctgtcccacgcccgcgcggcacccggtgtcgttcgcctggcagacgcagtccacgaccgaccgcgcccagatcgagcgctgggccaggcaccagccgcaggcgaacttcatcaccgccaccggcatgacccacgacgtcctcgacgtgccgctgcaggccggccaggaggcgctggagcggctgcgggcaggcggggtggaggtcggcccggtcgcggagagcgacgacgggcgcatgctgttcttcaccctcacccgcggcacccccgaggacgaggacgagtggtggccgtgcgagctggactgccaccccgagaccatggacgagcacccggggctgcgctggcactgccggggctcctacgtccttgtacccccggcccggctgcccggtgacgacggccgggccgtgcgctggctgccgggccagggcccggaacacgcgctcccggacccgctgaccctcctggaagccctcaccgacgcctgcgcccggcacaccgccgccgacagcgactccggccacgcggacgcggcctggcccctgcgccactgaaccagcgcgcccccgcgccctgagcgcgccccgcggggaacccggcgcgcgtcagccgccctgcgccgacgtcaggccctgcacacggcccacga

SEQ ID NO: 1840 - DNA, 827 bp, Unknown
  Kingdom: Bacteria, Phylum: Actinobacteria, Class: Actinobacteria, Order: Streptomycetales, Family: Streptomycetaceae, Genus: Streptomyces
gtagccggtgtacgcggcggctccgcccgctgggctggtgcctgctgccggccgtgcccgccgccgcgtacaccggctacctgcgggtgcggaccggtgactggatggcctggaagcacgcggaggaacgcggctggtaccgcgacttccacagccccgccgaggccttccgcaacacctggcacaacgccttcggccacctccagagcaccgggtacgccgtcgagttccagctggagctggccgccatggcggtcggagtggggctgctggccgtgctgctggtccgccgccgctggccggaggccgtgttcatcgcgctcaacctgtgggcgctgggcacgtcctactggtacctctccgtgccgcgcgccaccctgatctggtggccgctgtggacgggcctggcccactggagcctgcggcgccgctgggtcaaggaggcctacatcggcgtggtggcgccgctgaccgccgtccttgcgctgacgttcacatcgggacactggacggggtgagtacgcggtgagcgggcacgcggtcctgcctgactggtagaaacccgaggcgcccccgcgcccccgcgccccgagcaaccgccaccgccgagagagagtgcgccgatgcccctcccgtacgtcctgctgtccgccgccgtgtccctggacggctgcctggacgacaccggcccgagccgtctcctgctgtccggccccgccgacttcgaccgggtcgacgaggtgcgggcctccgtggacgcgatcctggtcggggccgggacgctgcgcgccgacaacccccgcctgctggtcgactcgcccgaccgg

SEQ ID NO: 1841 - DNA, 765 bp, Unknown
  Kingdom: Bacteria, Phylum: Actinobacteria, Class: Actinobacteria, Order: Streptomycetales, Family: Streptomycetaceae, Genus: Streptomyces
cgccgacgcgccgggcctgccggcgaggccgggcggcatgttcgcctgcgcccggtaggccaggaagccgaccgtgacgacggcggtcgcggtgagcccggccacgattcccgagctgctccttgccacggtcgcccacctttgtctcggttgctccagcatgagtctgacttgcgacggtagcagccgtaatgttcgccaccggcgcgggcatgccgaggcgcggccgtgtcggagcgcgcccgccggcgccggagggagtgcgccggagggcggcggtgcgtaccggaccggcggccgggacgggagcggggcccgcccgcggcgcccggcgggggccttcggcgccgtaggctgttcgcgtgctcttgctcgctctggataccgccacccccgccgtcaccgtcgccctgcacgacggcacggccgtcatcgcctcctccagtcaggtcgacgcgcgccggcacggagagctgctgctgccggccgtcgaccgggtcctcgccgaggccggactgaagctggacgccgtcacgggcatcgtggccggcatcggccccggcccctacaccggactgagagtcggcctgatgaccgccgacaccttcgggctcgccctcggcgtccccgtgcacggcgtgtgcacgctcgacggactcgcctacgccgccgacgtccccggccccttcgtcgtggccaccgacgcccggcgcaaggaggtctactgggcgcggtacgccgactcccgcacccgcctgaccgacc

SEQ ID NO: 1842 - DNA, 1799 bp, Unknown
  Kingdom: Bacteria, Phylum: Actinobacteria, Class: Actinobacteria, Order: Streptomycetales, Family: Streptomycetaceae, Genus: Streptomyces
ggcccgcgacggcctggcgggcgtcctcggcgagccccggcatcggctgtggactcggcgcgtagagcacctgctccagagcgtcggccagccggtgcaccgaggcggcggcgaccggatcgaggcgcccgagccggacgatccgctccgccgtcttgcggggagtctgggactcgtccgggaaaatcccgaagtcccaggcggtgtcggtcagttcctgccagacggcgagccggtgcgcgggcgcgtccgccgcgccgcgtccgtgcgcaccgagccggaccgctctcctccgcttccgccacagcagcggtgacaggaggagcaccacgacggccagtccgcccagcgcccaccccgtgaccgcgtaccacttcggaccgtcgccgcccaccggcagcgcggcctgcgcggacgggctcgggcattcctgcagcttcttcatctgcggcgtgcacccggtgctcgccgacggcgcggcggaggcgcgcgagctggcctgcggggagggcaccgccgggttcggcagcgtcgtgttcgaggggtccgactcggtgtactgcgggaccgtgccacgcgtcggtgtcggctcgaagcgggtccagccgacgccctcgaagtacagctcgggccaggcgtgcgcgtccttcagacccacctcgacggagccgtcgccccccggcgtgccgggcgcgaagcccaccgccacgcgggcgggtatcccgagcgtgcgggccatcgcggccatcgcgaaggagaagtggacgcagaagccccgcttgtccttgaggaaccgcgagatcgcctcggagccggtgcccgcctcgacctgggtgtcgtaacggaagcccccgtcgaaggcgaaccagtcctggagcttcaccgcctgctcgtagtggttcgccgcaccgtcggtgaccgcgcgggcggtgttcgccaccagccccggcagcgacttgggcaccttggtgtactcccgtagcaccgccgccggaggctctcccgcggtggcgagctgctccgcggtgggctgcacttccaggctcttgacctggtacgtcagaccgcgcgtgttctgcccgtggtcgccgaccagggtcatgcccacgggttcgtagcgccagctgccgtcgatccgcacaccgctcggcgggtacggcatcggcagccagtcctgggcgtaccagtcggcggccgcgatcgacgtcgtgatctccgtacgccggacggcgccgtccagcccggccggggccgggaagcggtcgggcacgctgacgatgtgccgctgggacggcttccaggtggtgccgtcgaagtcgtcgagggacacgatgcgcagatacaggtcggaggcgtccgccgagttggtgcgcagggtcaggaccgtgcggtcctcgtcgacgttcaggctgtcgcgcagtgagacgagcgggttgaccgcggagatcgttccgccgccgccgatgcccgaggcggccccggccccggcggcgtccagcagcccgccccgcatgccgggcagggcgagcggcaccacgagggcgacgccggggccggggccgcctcgggcatcggcggcggcggaacgatctccgcggtcaacccgctcgtctcactgcgcgacagcctgaacgtcgacgaggaccgcacggtcctgaccctgcgcaccaactcggcggacgcctccgacctgtatctgcgcatcgtgtccctcgacgacttcgacggcaccacctggaagccgtcccagcggcacatcgtcagcgtgcccgaccgcttcccggccccggccgggctgg

SEQ ID NO: 1843 - DNA, 1489 bp, Unknown
  Kingdom: Bacteria, Phylum: Actinobacteria, Class: Actinobacteria, Order: Streptomycetales, Family: Streptomycetaceae, Genus: Streptomyces
gggtgagcgcctcggcctccatgggccggctgcgcaccgcggtgcgcaccctcgcggacatccgcgcgaccacgtcgtcgaggtgggtgagcagctcgtcgggggccaggtcgatgtccgcgagggtgcgcaccgcggtgcgcagccggcccatggaggccgaggcgctcaccccgtgcccgatgacgtccccgacgaccagggcgacccgcatcccggacagcgggatcacgtcgaaccagtcgccgcccacgccggcccgggccgccgggaggtagcgggaggccgccgtcacgccggccgtgcgcgccagcgtgcgcggcagcaggctgcgctggagggcgagggccgtctcgcgctcacgcgagtagcggcgggcgttgtcgatgcagacggcggcgcgcgcggtgacctcctcggccagcagcacgtcgtcgggcaggaaccgggcggtctgcgtgaaccgggtgaagacggcgacccccagggtgatgccgcgggcccggatcggcaccgacatcgtggagtggacgccgagccggccgacgagccggctgcgcaccgggttccaggccagccacttgtccaggtcgcccgagctttcggacaccacgatcgcgtgccccgacagcagggaggcgccctgaggcgaggccgccggatagacctcgctctgcccgacgggcgtcaccgcctcgggatcgcccggtgtgacggagcggtgggcgacgcggcgcagcgcggccggcacgctcagcgtgccgatgggcagttcaccgccgtgcccgggcgggtccaccaggtcgacgctgacgaagtcggcgagggccgggacgcacacgtcggcgagttcctgcgccgtccgggtgacatccagggtggcgccgatgcgcacgctggcctcgttcaccagttgcagccgctcgcgcgcccggtactgctcggtgaagtcgtgggcggcgacgcacacgccgcgcacccggccggtggagtcggtgatcggcgacatccgggccatccaggcgttcacccgcccgtcgccgccgatcggcacgtacgtccgcacgtcgtgcccgcggccggtgtcgagcacccggagcatgtgccgctcgatgtcctcgctctgcggcccggcgccgatctcggacagccgcagcccccgcagccgctccccgcgcacgccgagcacctcggccatggggtcgttgatcgcacgcagccgcaaccggtcgtcgtagatcgcgacggcacacggggactggacgagttccgcccgggccagcgggtcgtccggggcttcggagccgccgccctccagcggggtcaccacgagccagtcgccgccgtcccgcccgtgccggtggtgtgccagcacccagacggacacggcctgcccgtcgcggtggcgcagggtgagcgtgccgctccagcggtgctccgcggggagggcggccggcgcgccgtccgcgagcaggttcacggcaggccg

SEQ ID NO: 1844 - DNA, 1950 bp, Unknown
  Kingdom: Bacteria, Phylum: Actinobacteria, Class: Actinobacteria, Order: Streptomycetales, Family: Streptomycetaceae, Genus: Streptomyces
gcggcgaaggcgcgggcgatctttacggcgtcctcggctcccgtcccgccctcggcccagtcggtggcggagatgcggacggtcatgggccgttcctcgggccacaccgcgcgtacggcgtcgaagacctccagcgggaagcgcagccgtttctccggtgagccgccgtaggcgtcggtgcggtggttggtcagcggggagaggaagccggagagcaggtagccgtgggcgcagtgcagttcgagcaggtcgaacccggcgcgggcggcccgccagacggcggaggtgaactgctcgcggatgtcggtgagttgtgcgcggctgagctggcgcgggacctggctcgcgggcttgtacggcagcggggaggcggccaccagcggccagttgccctcgggcagcggttcgtccatcccctcccacatcagcttcgtcgagcccttgcgcccgctgtggccgagctgcacgccgatcgcggtgcccggcgcctgccggtgcacgaactcggtgatccgccgccaggactcggtctgccgtccggtccacaggccggtgcagcccggggtgatccggccctcggggctcacgcacaccatctcggtcatcaccaggcccgcgccgcccagcgcccgcgcgccgaggtgcacgaggtggaagtcgccggggacgccgtcgacggcggagtacatgtccatgggcgagacgacgacccggttgcgcagggtcaggccgcgcagccggaacggggtgaacatgggcggtgtgccgggcgggcagccgtactcgcgttccacggcgtcggtgaagcgggcgtcgcgcaggcgcaggttgccgtgggtgacgcggcggctgcgggtgagcaggttgaaggcgaactggcggggcggctggtcgaggtagaggccgaggttctcgaaccactcaaggctggcgcgggcggcgcgctgggtggaggcgacgaccggtttgcgctcctcctcgtacgccgtcaacgcctgcaccacggtgggctgttcgtccaggcaggcggcgagcgcgagggcgtcctcgacggcgagcttggtgccggagccgatggagaagtgggcggtgtgcgcggcgtcgccgaggagtaccaggttgccgtgcgaccagtgcgcgtcgaccaccgtgcggaaggtggtccaggcggacttgttggagcgcagcggccggccgccgagcgcgtcggcgaagatcttggcgcagcgttccacggactcccgctcgtccagttcgtcgaatccggccgcgcgccacacctcctcgcgcatctcgacgatcacggtcgaggcgcatcggtcctgcggcccggagtgcctcgttgagggatggtggtcgggcgacgggcgggagtacgggtagccgtgcagctgcatcacgccgtgctcggtctcggcgatctcgaagcggaaggcgtcgaaggcgaagtcggccgcgagccagatgtagcggcagcggtgctcggtgatccggggccggaagacgtcggcgtacgcctcgcgggtggcgctgtgcacgccgtcggcggcgatcaccaggtcgtacgtctcgcgcagccggtccgggtgcggtgcctcggtgcgaaagcgcaggtcgacgccgagggagcggcagcgttcgtgcaggatctgcaggagccggcgcctgccgagggcggcgaagccgtggccgccggaggtctgccgggtgccccggtgcacgatgtcgatgtcgtcccagcgcacgaagtcccgctggagggcctggtagaccaccgggtcggcgtgttcgatcccgccgagggtctcgtcggacaggacgacgccgaagccgaaggtgtcgtcgggggcgttgcgctcccagacggtgacctcgcgggcggggtcgagccgtttcagcagggccgccgcgtacaggccgccggggccgccgccgatgaccgcgacccgc

SEQ ID NO: 1845 - DNA, 2088 bp, Unknown
  Kingdom: Bacteria, Phylum: Actinobacteria, Class: Actinobacteria, Order: Streptomycetales, Family: Streptomycetaceae, Genus: Streptomyces
agcggatccccctccgcggcgggtcgccgcggagggggatccgctgcacggagcggtgcgcatcgccaccggcctggcccggggcacgctcgcgctgccggtcgacgagaagatgctgtacgtgccccccgagtgacatctacaggtgtcccccaagtgacacttaccggatatttccctctcttgccggacaactgagcacatgttcggggcgagttgtcgcatccgatccgattgcccgcaccgatcatttccgatcggtgcgtaactcacgcgacaaaaccggacggaaaccgctcacccgccccctccccgaacaggggaaccccgaaagccagtaacatgcggcgccatgagctcccccactgggcccgcgtccggcctgcctgtacgaatgccgcgcccccgccagcccggacggcaccgccgacccgaaccgctggcggctcccgagggcgcgcccgcgctcgtcctcgcggtgccgggcacgcccggtgccgcatcgcgctccctcgccgaggaggtcgtgagcatcgcccgctccgagcttcccgggctcgacgcgctgatcgggtacctcgacggggacgaggcggagttcccgaccctgcagtccgtgctcgcgcgcgcggccgacgagcgcacggcccgctacgagcaggcgctcgccgccggtgcggaggccaaggagcccgagggcccggtcgcggtcgtcgtaccgttgctggccggcccggacaacgcgctgctgcgccggctccgccaggccgtcatggacagccgggtcgccgccgagctgaccgatgtgctcggcccgcacccgctgctcgcggaggcgctgcacgtgcggctgtcggaggcgggcctggcccgggccgaccgggcccggctgttcaccgtggcgaccgccgcggacggcatcatcctcgccgcggtcggcggcgaggaggccgtgcaggcggcggggatcaccggcatgctgctcgccgcccgcctcgccgtgccggtgatggccgccgcgctcgaccaggagggttccgtcgcgggcgtcgccgagcagctgcgttcgtcgggttcgcagcagctggccctggcgccgtacctgatcggtccggagatcgacgccgagctggtcgagggggcggccaaggaggcggactgctccgccgccgaagcgctcggcgcctacccggcgatcggcaagctcgctctggccaaatacacgaccgccctgggcatcgccccgcagcagccgcagggcacgccggtgcgatgacgccgcaccggcgcccgtagggtcaccggtcaccacgaagggtccgctctgcacaggccggagcggacccttcgccgtgcagccgtgccgcaacgaacgccacggtgacggatccggccggagtgatcagccgaagacgacgcaggacgcggcggccaccttgacggcgccggcccgctgcgggaggcccgtctccggatgcacggcgaaccaggtgacgtcaccggagcgttcattggcgacgtagaggaatccgtcggacagggtgagcgccctgggccagtggccgccgcacgagacggtcgccagcagttccagccgctctccgcccgcctcgacggcgaagaccgagagcacgtcctcaccgcgcgtggcggtccacacgaagcggccgtccggcgcgacggcgatgcccgacgggtaggcgtcgcccgccggggcgacctgcagcacctgcgtctcggccagcggccggagcgagccggtctccggttcccagtggcaggcggtcacggtcggcgtgagttcgttgacgacgtaggcgtgccggccgtcggggtggaaggcgaggtggcgggggccggagccggggcggagcgcgatctcgcggtgcagggcgaggctgccgtccgtcagcgtgcacacgcgtacggagtccgttccgaggtcgacgctgacggcccagcggccactcgggtcgggctgcacctggtgggcgtgcggggcgcgctgtcggcgttcgtgcgggccggaaccggtgtgccgcagcacgtgggacgggctctggccgagacgtccgtccgcgcggacgg

SEQ ID NO: 1846 - DNA, 2434 bp, Unknown
  Kingdom: Bacteria, Phylum: Actinobacteria, Class: Actinobacteria, Order: Streptomycetales, Family: Streptomycetaceae, Genus: Streptomyces
cccacacccgtcgagcacatcctgcactggtcgacctggcgccgaagacgacaacaccaggcccgcaccagccactacaaacgacgcggacacagcccctgacctggccacccgtcacggcaagcaccgttgcagtactaggtcccggggcccagcccgcggagcggccgggccggtgggctcggccgctccgcaggggccggacggttcagggagccacgccgagtcacaccccgtgcgggctcgtccggtccatccggtccgccgcctcccggcggtccaccccgccggtgtcgtccgtgccgtccgccgggcggtccccgtcggccgcgtcggcgccggtgccggtctccggtgcgtcctccgtggccgggatgacgcccttcggcggggacgcggcgaacacggaggcgtcctcgcggttccagtgggtctcgttgaagaggatgttgaggaggacggcgaccacgctcgcggcgctgatgccggaggacatgatcagcgcgaaccagtgcgggaactcgtcccagaagtgcggcgcggcgaccgggatcaggccgaagccgacggcggtggcgacgatgacgaggttgaggttgttgtcgaaccgcacggtggacagggtccgtacgccactggccgccacggacccgaagagcaccagcccggccccgccgagcaccggcagcggcacggcggcgacgatgcgcccgaggatcgggaacaggccgagcaccaccatgatcccgccgccggcggcgacggcgtagcggctcttgatcctggtcagggcgacgagtccgacgttctgcgcgaaggccgtgcaggcgaagccgccgaagagcggggagacgctggtggagatcatgtcggcgcgcaggccgtcgccgatccggcgggcgtcgaccttggtgccgacgatctcgccgacggcgatgatgtcggcggtggtctcggtcaggacgacgaccacgacgacgaccatggagatgacggcggcggcgtcgaaccgcggcgctccgaaggcgaggggctcggggagggcgaacgtcgctcccttggtcacgccggagaagtcggtcttgccgagtacggcggcgagcacggtgcccaggacgatgccgaggaggatcgacaggcgcgagacggcgggctttccgacccgggacagcaccaggatgatcagcagggtggcgccggccaggccgacgttcgccatgctgccgcccttggcggagccctcgccgcccccggaggcccagccgaaggcgaccggcagcagggtcaggccgatgacggcgatcaccgtgccggtgacgacgggcgggaagaaccgtacgacccggccgaagaacatgctgaccacgaggccgacgaggcctgcggcgatggtcgcgccgaagacggcgggcaggccgtggctgcgggtcgcgatggccgtcatcgtggacacggcggcgaacgtggcgccctgcacgagcgggagctgggcgccgatcatcggcacgccgagggtctgcagcagggtggcgaggccgctcacgaagatggtggccgtcaccagcaggcccagttccgtgccgctgagtccggcggccccgcccacgatgagcggcggggcgatgatgccgccgtacatcgtgaggatgtgctggaaaccgtaggcgaccagttggcgggcggggagccgctcgtcctccgggcggggagccgtctccgcgtcccgtgtctccgcgtccggtgatgtcacggcggaggaagttgatcttgacctgaacacgaccccaaccttccgtatcatggaatcaacatttcgttgaggggtggtggtgacgttagctacgtcacagaagcacgtcaacacttcctacgatgcactcacttccgtccggaagagttcgtgtgtatccacaaggtgatcgccgcagcggccggtacggcggtgcggcgaggaggccgctttcggtcacccgcaggcgcggggactgcttccgaccaccggcgcggatgacggtcagggcacggccggaccactgaggtagttccccttggagtcgtacggccaggcgttggcgacgcagccgcgcagcccgtcgatctgctgcatcatcgcgggagcggggcgtccgggaccggggcacgtctcgtggccgtggccgatgcggtggccgacctcgtggttgatgatcagggcgcggtagtcgtggatggacccggggaactggggcgagccctccttccagcgcttgaggttgacgatcacctggctgccgacgtcgcagttgacctcgccgcgggtgtgcagtccggccgcgccgcagatgcggtccacggtgtcgggcgtggcgatcttcaccacgaagtcgacggcgccctgcgagacgagctggaaggcgtcgtgcccgtcggcggtccagctccgccggtcggcgag

SEQ ID NO: 1847 - DNA, 1752 bp, Unknown
  Kingdom: Bacteria, Phylum: Actinobacteria, Class: Actinobacteria, Order: Streptomycetales, Family: Streptomycetaceae, Genus: Streptomyces
gtgccgtccggtgccgccgccggcgggggcggtgggctgggggagcagcgactggagcggggcgacctcttcgtctatggcgtcgaacaccgacgagacctggtcgctgacgtcgccgagctgcacgggcagcttctggcgcagcgcgccccacgcgtcgcggtgggacttggagaaggcggagagggcctggatggggcccagggagtccgggtcgcgctcgtacgcctcgtggagcaggcggtggccctcggtggcgtcgtgctgcatcccggacagggtgcggcggatctcgccgagtgactcgtggtccaggtgtccgcctcggccgcgctccagcagccgtctggcctcgctcagccgggtcgaggcgaggtccaggtaggcctggccctggctgtcgtccccgtcggtcaggtagttgagcttgaagtcctcgatgccccgcttgagtccgtacagcgagtcaccggggagggcgtcggagctggcggcggccactccgccgaacgcgccggcggccaccccgacgctgagcccgcccgcggccagccccttggtcagccgtgtgcgcggccgcagtttccccaggccgctcgcccggtgtgcgcccttgccccggtggccccgctggccgggcaccgacagctcattcgcctcgcccgccgcggtgccctcctgcagcatggcctccatggcggccaccagttgggcccgctggacggccttgacctcggggtccagctccggccggggcagcgcgccgagaccggtggcgagggccagcagccggccctgctcggtctgctccgccgccggggccggttccggtccttcggtctgctcggccgccgtgccctggtcggactgctcctccagggcctgggcgaaggcgttcgcccgccggtgcgccgatacgttcgcgatcactggcggcacctcctctcgtcatgacggtcggctccccagcggtcctgaggattgcacgctcgcgaccgcaccacacgatcgggcgatcagcgtgggccaaggcgtgaccatagggagcctgtatcccgcacaacgagcggctcggcacttcggttacggacgtcccgggatcgggtcgagaagtcaacgcggctcgacggagggtgagttggctgtcgcccggcgtggccggtctcagcgggcgtcgtcggggagcagccgggccagggtgcggaccgcgcggtactggagggtcttgatcgcgccctcgttcttgcccatcacgcgggcggtctcggcgacggagaggccctggaggaagcggagcgtgacgcactcctgctgctgggggttgagccgtcgtacggcgtccagcagggcggcgttggacagcgactccaggacggagtcctccggtgagcgctcgacctcgttggcgtcgagcatctcgccggtggtgacctcgaggcggaagcggctggacttgaagtggtcggcgacgaggttgcgggcgatggtgaccagccacgcgccgaagtcgcggccctgccaggtgaaggtgccgatgcggcgcagggcccgcaggaaggtctcgctggtgaggtcctcggcggtcgccttgccgcccacgcggtagtagatgtaccggtacacggtgtcgctgtactggtcgtagaggcggccgaacgcgtcggcctcgccggcctgggcgcgctcgacgaggtccatcatccgggcgctgtcgctgtccgcggcggggcggcggacagcgacagcgcccgg

SEQ ID NO: 1848 - DNA, 1216 bp, Unknown
  Kingdom: Bacteria, Phylum: Actinobacteria, Class: Actinobacteria, Order: Streptomycetales, Family: Streptomycetaceae, Genus: Streptomyces
atcgcccaggaactggcggcggccttcggacccggggtgttccgcttcgagcaggcggcggtgtcccgtcagggcgtgccgccggtcgtggcgcacacgctggtggcggcgggcctgccgatggacatgggtccgttcttctgggcgcaggcccagccggggcgcccggtgccgacgctggcggagctggcggccgagcgcggggtgcagccggcgccggacgcgggctcgtacctcgtcgtgggcagcgacttcggcaaggcgctctgtgtgcagtacggcacggcgaacatcgtggccgtgccggtggaggcgggacctggcggtacgtccgtgccgccgcagttcgtgaacaccggcctgccggagttcgcgcgctgcctggcgctgctgggccggatgtggcggctgcgctacggcctgaaccaggagcaggcgggccgctggaccgtcgacttccaggcccagctcgcctccctggacccggcggcgctcggctcgccggagagctggtggtcggtgctgctggagcagatgtgggacggactgctgtgagcgcgtgaacacgtgagcatctgcgcgcttgacggcgtgtggggccgggcccggtcatgtgaccgggcccggcccttctgcgtgcgtcctcgtttctgttcaccctcgcccggatgcgcgcccggagtgtcgcgttatgaacatttcgtccctatagctgaggatgtgcccgcagtcatcgtgtcgcatccattcggcggtgtccggcggtgcacgacggagaggggttcaggatgggcagcacggcgtcatcggtctcgctccacggcttcgcggtcgtagcacgggggcgcggctaccgtcccgaacaggtgaacgcctacgtgaaccagctctccggcgaccgggacgccgcctgggagcgcgccgcgcggctgaccgtgctggccaagaacatggaggcggagctggcggccctgcgggaggccgtcgccgggctcgacgagcagacctacgactcgctggggcagagcgcccggcggctgcacgagcacgggcagcacgaggcgcgtgcggtgcgcgagcgtgcccggcgcgaggcgcacgagacggtgcaggcggcgcgcgcgcacggggacggagtgctccggcgggcgcgggcgtacgccgaggccgtccgcggtgaggcggacgaatgggcccggcagcggctgctcgccgc

SEQ ID NO: 1849 - DNA, 1326 bp, Unknown
  Kingdom: Bacteria, Phylum: Actinobacteria, Class: Actinobacteria, Order: Streptomycetales, Family: Streptomycetaceae, Genus: Streptomyces
gtgctgttcctggacgagccgaccaccggcctcgacccggccagccgcaaccgcatctgggacgccgtgcgcgaactgaagcagcagggcacgacggtggtgctgaccacccagtacctggaggaggccgaccggctggccgacgacatcgccctggtggaccggggccgcatcgcgcacaccggatcgccggcccagctcaagtccctgatcggtgcgcacgccgaggtcgtcgtcgcacacccggacgagatgaaccgggcggcggccgtcctggaccggctcaccggcgccgagccggtcttcgaccacgagcggggcgccgtcggcgcggtcgccaccgacccgaccctcaccctgccccggctggtgcgcgaacttgacgcggcgggcgtgccgttgctcgacgcgagcctgcggccgcccaccctggacgacgtcttcctccggctgaccggaaccgcccacgacggcgaggagatcgcggcatgaacgccctcacgtacgacggcacggcgatggtgggccggcagttgcgccgggtccgcaacaacccgggcctggcgatcctcacccagatcatgcccatcaacatgctgctgttcttcggctacgtcttcggcagcgcactggcgacgcccggccgggagtaccgcgccttcctcgtgccgggactgctggcggcgacggcggccggcgggatcatgaccgggatgttccaggcggcgcaggacacgcaccggggagtgatggaccggttccgtgccatgccggtcagccgggcggccgtgccgctcgggcaggcggtggccgacctcgtcgtcaccgcggtcgggacggtgccgctgctgctggtcgggctggccgtgggctggcggatcgagggcggcgcggcgcgggcggcgggcgccgtgggactgctgctgctcttccggttcgcgtgcacctgggtcgggatcctgctggggctgctcacgcgcagcgaggacgcggccggtcagctcggcgcctcgacgttcgtcctgccgctgctgtccaacgcgtacatcccgaccggcaacctgaccccctggctgcgcaccctggccgagtggaacccgatcagcgcggtgaccacggcgctgcgcgacctcttcggcaacgctccggtgcctgagcacgccgcctggccggtggcccacccggtcgccgggacgctggcctggtgtgcggtgctgctcgccgtctgcgcgcccgcggcagtacggcggtacgcgcgcgccgagggctgaaggagagggtggggaggaggaagaggagggcggggtggagcggaccccactgggc

SEQ ID NO: 1850 - DNA, 1076 bp, Unknown
  Kingdom: Bacteria, Phylum: Actinobacteria, Class: Actinobacteria, Order: Streptomycetales, Family: Streptomycetaceae, Genus: Streptomyces
  misc_feature (472)..(473): n is a, c, g, or t
tcgccgcgcacgtccgtgaccacgacctcggcgccctcgtccagcaggtgccgcaccaggtggtgcccgaccttgcccacgcccgcgacgccgaccttccggccgcgcagcgtcgggtcgccccacaggtgctgggccgaggcccgcatgccctggtagacaccgaacgcggtcagcaccgaggagtcgcccgcgccgccgttctcgggggagcggccggtggtccagcggcactcgcgcgccaccacgtccatgtcggtcacgtacgtgccgacgtcgcacgcggtgacgtagcgcccgccgagcgaggccacgcaccgcccgtaggcgagcagcagctcctcggtcttgatcagctccgggtcgccgatgatcacggccttgccgccgccgaggtcgagaccggccatggcgttcttgtacgacatcccgcgcgagaggttcagcgcgtcggccacggcctcgcgctcgnncgagcgcgggccccagggcggtggagtggatggcgatgacggccttgaggccgctggcgcggtcctgacagagcacgacctgttcatggccgccctgctccgagtggaacagggtgtgcagtacgtcagcgtgcgcgccggttacgtcggtcacggtggtgactcccaggtaagtagcggcgagtggagtgtcgtccccgtgcgggtggcggggccgtggcaggagattagaccctgaccaggcccgcccgaggtgcagtggtccggatcaccctccctaggagtaccttcccacccgggcgtgcgacgatttgcagtggttttccgtccgtccgggcgcgggccgggcgggtttcgggcccggtccggtggggagggagcaggcgtgcccaaggtgtcctccgtggtcgtcccgtacgcgacctatctgcgcgtctacgagccgctggccgccttcccggagccggagcgcagccactgggcgcgctacgcccgccgccccgaccgcccctcctaccaggacgaactgcgccgctcgctggtggacctgctgccgaccccgccggtggcggtgccggtgcacgagagcagggacgcgttcgt

SEQ ID NO: 1851 - DNA, 2240 bp, Unknown
  Kingdom: Bacteria, Phylum: Actinobacteria, Class: Actinobacteria, Order: Streptomycetales, Family: Streptomycetaceae, Genus: Streptomyces
  misc_feature (2028)..(2074): n is a, c, g, or t
gcctcgtcgagcgcgccctcgtgccgcagggcccacaccagttcggcacgggtgacggggtgcccctccagcacgggttcgcgcagcccgggatcggcggcgcccagggcgtgcacggccggcgcctcgccgactggtccgccgctacggcaccgacgagggggagcgcggccgtcggtgagggtcccgcggccaggcggcgcgtacgcacggcggtgtcgacggcgtcctcggccatccggcggtaggtggtgagcttgccgccgaccaccgtgatcactccctgcgacgaggtgagcaccgcgtgcctgcgcgagacgtcggcggtgcgcgaagccccgccggacgagccgtccggaccggtgccgaggagcggtcgcaggcccgcgaaggcccccaccacgtcgtcacggtggaccggcgtctccagagcggagcccaggacgtccagcaggaagccgatgtccgcctcggggacctcgggaacgtccggggtcgcgccgtcgacgggttcgtcggtgagcccgacgtagacccggccgtcgccctggggcaggacgaggacgaaacggttggtctcacccggcacggggatgtgcagcccggcgggcagcggacccagacgctcggcgcgcagcacgaggtgggtgccgcgggagggccggatccggacgccgtcgaccagtccgcccgcccacacgccggatgcgttgatcacggcgcgggcccgtatctccccctcctcgccggtgagttcgtcccgtacccgggcgccggacgccgtcagttccagggcccggacgcgggtcaggatccgcgcgccgcgcgccgccgccgtacgggcgacggcggtgaccaggcgggcgtcgtcgctgagccgtccgtcccaggacagcaggccgccgcgcagcccgctccggcgcagcgccggtgccagatgacgggtctccacggcggacatccggcgcggcgcgggcaaggtggcgcgggccgtgcgcgcggccaggcgcagcccgtcgcccgcccggaagcccgcccaggccagagccgcctgaccccgggagaccatggaggtcagcggcaggacgaacggctgcgcaccgaccagatgaggtgcggtgcgctccatcaggatcccgcgttccaccgcgctctcgtgggcgacgtcgagctgggcggaggccaggtagcgcagtccgccgtggatgagtttggaactccagcgcgaggtcccgaaagccaggtcatgcgcgtcgatcgcggcgacggacagcccgcgggcggcggcgtccagcgcggcaccggcgccggtggcgcccagcccgaccaccaggacgtccacggccggaccgcccacggtcagcgccagttcgcccgcgcggcgtgcggcgctcagggaggaagaagcggcaggaggaccggcggggccggcagggtccgcggggccgggatgggagcgggcggggctcatggcgtgagggtcctctccagaagggtccgcagttctccgaggaacgcctgcgcggtcagctcgggatcgtcctcgtcggtcatcgtgcgcagcgacagcgtgaaggactggacgaccagcagcagcgctcgcgcctgccgcacgggatggccggggcgcaccgatccgtcggcgtggccctcgcgcagggcgtcggcgaccagttcgagcagggcgtcctggctggccccgcgccggtcgagcacgtaggggagcagcagctcggggtccacgtcgacgatcttgcggaacaggggatgcgcgcggaacgccgccacccccgccaccaggccgtcgacgatcagggtgcggctggccgtaccgggccgccgctcgggcatggcgccggtggccacgccgatccactcccgggtcatcaggtcgcccaccagggagcgcacgtccggccagcgccggtagagcgtcatccgggagacgcccgcacgccgggccacgtccgtcagggtcgtacgacggaccccgacggccaggacgcagtcgcgcacggcgtcgagcannnnnnnnnnnnnnnnnnnnnnnnnnnnnnnnnnnnnnnnnnnnnnngtgtaacagtgtaacgcccttggatccgaccggtgaggaacaacccatggacatgctgtggagcggctggggcgacccggccaaggccgcgccgctgcccgccccggtgaccgggctgctgcgcgacctgctcggcgtcaggcccggcggcgccgcaccggccggc

SEQ ID NO: 1852 - DNA, 1562 bp, Unknown
  Kingdom: Bacteria, Phylum: Actinobacteria, Class: Actinobacteria, Order: Streptomycetales, Family: Streptomycetaceae, Genus: Streptomyces
ggcccggaacacccccgccggcgcaccggccgctcctgcccccggcaggcactcccgccgcttcggacttcccgtcgccaccgccctggtgatgggcaacatcatcggcggcggcatcttcctgctcccggcgtcggtcgcaccgtacggcacggtcagcctggtcgccttcggcgtcctgaccgtcggcgccatcgcgctcgcgctcgtcttcggacggctcgcccagcgtgatccgcgcaccggcgggccctacgtctacgcccgcgaggccttcggcgacttcgccggcttcctggccgcctgggcgtactggatcaccacctgggtgtcgaacgcggcgctggccgtggccgccgtcggctacctcgacgtgctggtcccggtgaacgatcaccgctggacggcgtgcctggccgcgctcaccctgcagtggctgcccgcactctccaacttcgcgggcacccggtacgtgggtgccgtgcagatcgtctccacggtgctgaagttcgtgccgctgctgctggtcgcggtcggcggcctgttcttcttcgacccgcacaacctcggcccgttcaacgcgagcggccacagcgcggtcggcgcggtctccgcctccgcggcgatcctgctcttctcctacctcggcgtggagtccgccgccgtgagcgcgggcgaggtcaaggacccgcggcgcaacgtcggacgggccaccgtcatcggcaccgcgggcgcggcgctcgtctatctgctgggcacgctgtccgtcttcggcaccgtcgcgcacagccgcctggtcggatcctccgcgcccttctcggacgccgtgaacgccatgttcggcggcgcctggggcggctgggccgtggcgctcgccgcgctggtgtcgatgaccggctgcctgaacggctggaccctgctgagcgcccagacgccgtacgccgccgcccaggacggcctgttcccggcagccttcgcgcgccggcggcggggtgtgccgacggtcggcgtcgccgtcaccgtcgtcctggcctcgctgctcaccgtttacaactacacctcgggctcggccaaggtgttccaggtcctggtcctcgtcaccacgttcaccgcgaccgtgccctacctgctggccaccgccgcgcagatcttccatctggtcgccgggcgccgccatctggtggaccgggcgcgcctggtgcgggactccgtgatcgcggcggtcgcggcggccttctcgatgtggctggtggcgggcgcgggctacgcggcggtgtaccagggcgtgctgttcctgttcgcgggcgtcctcgtctacgccgtgatggcggcccggcggccaaggactccgtagcgccccgcaccaccgacggggcgaagacgacggaaccaggcgtggtgacgtcggcatctccacgtgagcatcgtgcccggtgacgcacccggtcagctgggccgcgccgggctgtgggagttcgagggcggtgcgcccggctcggcacgccgaccgggcgcggccagcgccggggcacgtacacggcggccgcctaccggcccgtcgc

SEQ ID NO: 1853 - DNA, 1466 bp, Unknown
  Kingdom: Bacteria, Phylum: Actinobacteria, Class: Actinobacteria, Order: Streptomycetales, Family: Streptomycetaceae, Genus: Streptomyces
gcgcaccgcgctcccccggcccgaggaagcgctcctccaccggaacccgccgtggcggacgtccggtccgtcggccggtgagatcaccgcgcgcccgctgccggacggcgtgtggcggctcgactggctgctgccgcccggcaaggacctggtcacccccgaactgctgctcgcccgtatccgcgagaccctcaccggctggaccggcgagccgtcaccggcgtacgacctgctggacaccggagtccacacggtccaccaccgtgtggcccgccgctggcgcgcgggacgcgtcttcctcgccggggacgcggcgcacctgctgggcgcgttcggcacgcagggactggacgagggcctgcgggacgccggcaacctcgcctggaagctgggcctggcctggcaccacggcccgcacgaggcactgctcgacagctaccagacggagcggcgggcggtcgtcgcctcccggctgcgcgccgccgaccagttgctgccggtgctgcgcgggggcggcggcctgcggtcctacgtccccgggacggcgcgcgggcacgacgcgtcgctcatggacggccacctggggcgcgggacactgggcgcaccgggggcgtacgccgactcgccgctcgcaccaccgtgcttcgacgcggaggcgcccgtggacacggcccccggagcagcggtcgcgaacgtggtggtgacggcggaggacggctcgttcgtgccgctgcgcgaccggctcggccgcggagccctgctggtggtgctggtggcgccgggcacggtggtgtgggagcgccggcactgggtgagcgccgggatcatgccccggctggccgccgcggtggccgcgctgccgcacccggccgaactgctggtcgccgagagctatccgggcgcggccccgcacaccgtgctcctggtacgccccgacggacacctggtcaccgcgctgagcggggtccgcccggccgacctgtacaccgcggccgaggccaccctgggcggcgcggcgcccgtcgatgcccgggcggaggcgggcgcccggtgaagtgccggccaggacgctcaccgtcgtcgcggtccgcatggtgacggtgagttgaccggttcggggcgccgtggtctactccggaccatgaccgacaccgatgtgcgcctgtggcggagggtccacatggacctcgtccgctatgcgggctgcgtgtgtcgcccgtcccgctgaatccgcgctctcttctcctcctccttctcttttcgcgcgcgtcggcaacgcctgcacagcgtggtgttcgctgtgttcacctgccgtgtcccccctgctgctttcagtgcgctcttttcactgcgcctttctgcaccggggtgccgccgcgtgcgttccgcgaatcctcttcaggacggtgtgcatgtctgtctcctcctccgcgtcggccccctcccccgccccctccgcttccctt

SEQ ID NO: 1854 - DNA, 1555 bp, Unknown
  Kingdom: Bacteria, Phylum: Actinobacteria, Class: Actinobacteria, Order: Streptomycetales, Family: Streptomycetaceae, Genus: Streptomyces
gaccactcggccacgaccgtgggggcgttcgcggtggccacggtgtgcctgctgccgctcgccgcgatcgaggggctggtgccgcacacggtcgaaccggtccggctgctgtggctgctcgcctacatcggcacggtgccgacggccctcgcctacgccctctacttcgcgggcgcggccgtcgtccgctcggccactgtgtcggtgatcatgctcctggagccggtcagcgcggccgtcctcgcggtcgccctgctgggcgagcggctgacgacggcgacgctcgccggtaccgcgctgatgctgggctccgtcggctgcctcgccgccgcggaggcccgcggggcgcgacccgcggtggaggaacccgccctggtgtgagaagtggcggaccgggacgggggctctgcggcctgacggccggggcgggtcctacggcagcggccccaggacccgccccggcccgcgtccgtcaccggtcggagtgggtgtcacagggccgctacgtagccggggacctcggtgccgggggtcaggtcggcgtcggggagcggggcgccgtacgtcctgcggaccgggaccacgccggcccagtgggggagggccaggtcctcgggttcgtcgttgacgccgcccgtgcgcagcttggccgagacctcggtgaggtcgaggcggagcacggcggtcgcggccagctccttcgcgttgccggggcgggagtcggccgcgcggccggggaccacgtggtcgaccagcgcgtccagggccatccgcttctcgtcggggtcggtcacctggtgggcggtgccgtgcaccacgacactgcggtagttgatcgagtggtggaaggcggagcgggccagcaccaggccgtcgacatgagtgaccgtcaggcagaccggcagccccgggtcggcctggcccgccatgcgcagcggacgcgagccggtcgagccgtgcacgtacaggcgctcgccgacccggccgtagagcgtcggcagcaccacgggcgccccgtcgcggacgaagcccaggtggcagacgtacccctcgtcgagtatcgcgtgcaccagttccttgtcgtacgacgcccgctgcgcggaccgggtggggacggtgcggtcggtcggcgggtaggtgtcggccgtcggggtcggctgctgtgtcccctgcgatgtcccctgcattgcgctctccattgcactagtgcataatctgctttgtgctaggagaatatcggatcgaggggcggcgcgcagcagaaatcgcggcgagcgtcgagcgtgcggtgggctcgggacatctcgagccggggcaactgctgccgccgatgcgggagttggcggtcgacctcggtgtcaatcccaataccgtggcggccgcgtaccggatcctgcgcgagcgcggggtcatcgagaccgccgggcgccggggcagccgggtgcggcccgcgcccgccaccaccggccgcgaccacatccgcgtcgacgtgcccgacggcgtgcgggacgtgtccgccgggaaccccgacccggccctgctgccaccgctcgcg

SEQ ID NO: 1855 - DNA, 1616 bp, Unknown
  Kingdom: Bacteria, Phylum: Actinobacteria, Class: Actinobacteria, Order: Streptomycetales, Family: Streptomycetaceae, Genus: Streptomyces
gaccggcacacggcggaggagaacgagcgcaaggcgatggccgacgcgaacacgcaggaggcccgcaagcgtgaggccgaaaccgagtacgccgctgccgaaaggcggctggccgccgccgaagtcgagcggcgcgcggtcgaaatcgaggacgccgcgaagctgacgccgcgcgagcgggcggtccgcaaggtcgcgcgcatggcgttcgcgggcggcgcggtgttcgtcggcctggacaccgacgggatccaccgggagctgtgccgggtcgtcacgatcgccgacgtccagcgcgagttcgacgtgtcgtccaccgacaccgcctccaagtaccgccaggaggccgtcgcgctcatcgccggcggataccgaccggagcagtgacctgcacaaacgagccgttcgacggttccaccggcccccgagacgaagtcagcgcctcgggagcgcggtgaaggcgccgaaacgccacgacaagcctcccagatcgcccccgccctgagaaggagaaccccacctcatggatatcaacgcactgttcacggacgagggccttcgggccttcaccgccaccgtccgcgaccagcacgttcgcgacgcccagcagtacgggcagatcgccgacatcgtgcgccggcgcctggagcagacgccgatcgacggcgaccgctggatgtccaagaagctccgcgcctggaaggtgtcgcggcagctcaaggccatgcagaaggcgtccggcgaggccgcgagcaaggcggaggccctgtacgcgacctacaagaacgaggtcctggagctcccccagcgcagggccgcggcggaggcccggaaactggagcgcaagtccggccgccaggccgccctgggcgccgccgtcgccaagtccctggacaagacggtgacctcgctgaacaccccggccgaccaggcgccgggcgcgtccgggcaggcgaggccggcggagttcgtggccccggacaacccctggcagcagtggccgatggcggccggcggtgagcggccgaccgcctcgatcaacgactacttcccgaagggagagcaggggtgagcacgcctcggcagacgcaaaaccgcgcgaagcactggaacgcgcggatcgcggaagccacgaccgagaaggagcgggccggggtctggtacgacgcgtgccggaccctggccatcaaggccgaacgcgagggtcatcccgaggtgtggcgcaagctcaccgaggagctgcacgacttcttcaagcgcaacggagggtgacgaagttcttcttcatcaccgcctcttcctcgccgcctggagcactccaaggcgcgcgcgtgtcgtgcgcgcgcgagggtgccccaggcggtgaccgtctgtcaactccgagaaggagacgtcatggccgacgacgacggcccgaatcccccgaacaacttgatccactttccccgcgtgggctacacggctcctgccgaaccccccgcttcggccccggtcgacgtgccgttcgccgcccccccagacccctcccccgccaccccccaagcgtttgcacccgcgacgcgaaccgacccgatggatgtcatcgcggccctgcccgagcccggtctcggcacccc

SEQ ID NO: 1856 - DNA, 2854 bp, Unknown
  Kingdom: Bacteria, Phylum: Actinobacteria, Class: Actinobacteria, Order: Streptomycetales, Family: Streptomycetaceae, Genus: Streptomyces
ctgcacacgccgctcgtgcccgtggcggccggtgaggcggtagacgatctcggggcgcagggcgccgccgcccgccagcagcgcgccccggtccagggcgtcggcggtgagcgacgtacggtcctggcgctccatcgcgctcaccatgacggccaccgcctcgctgatctccgccggtgcgacggtgtccaggtcaccggtaccgagcgcggtgcggcgcgcgtcgacgaccgcgccgtccgccagcagcaccacctcggtgagctgcgcgccgatgtcgacgacgagcagcggccgggacaggtcggcgcccgcgccgagggcgaccgcgcgggccccgggcacggtcaggatcccgcgcggtcgcagcacctggacggccgtacgggcctcggcgcggaaggcgacgccgtccagcacgggcgcggtgagcacgaccagcgggcggccgaagcggggcatccggtggacgagcaggcgggccagcatccgcgcggtgcccggtgtgtcgacgatcgtgccgcgctggatcgggtacgcggcaccggccccggggaacgtcaccgtcggcacgtcgaggaccagcccccgtccggccacccacgcgcgggtgcgcgcgctgcccaggtcgagggcgacgccgaaggacgggccgcgccccggccacgggcggcgcgccggccacggcctgcggatcgccgtcaccggtccgcctccctgacctgctggcagcgggcgcagtaacgcgcctgcggcactatctccaggcgttcgcgcgcgatgggcccccggcacaggtggcaggcgccgtaggtgccgtcggccatgcgcgcgagggccgcctccacgtcggccaggaccatccgggcggacgcggcgagctggacgcggacctcgatctgggcggcggcccgctgctccagcagcgcgtcctcgcgggaggtcgcggaggccgcgatctgctgcagctgctcctgccggaacaggcgctgctcgtgcaggttctcgcggagcgcggcgaggtcgtcggcggtcagcgcgccggaggccggggccgccgtgccggagggcggggccgggatctcgcgcgccggtcgtgtgccgtggtcggcgatggtctgtgggttcaccggttcacccctcgggcagggcgggagacgagtggcggcggacagtcggagagggcggtccgacggtcaggacgatccgcggcggcaggcgacgcagtggctcgtgtacgggaggatctccaggcgctccgccgggaccggggcggcgcaggccacgcaggtgccgtacgtgccgtcctcgacgcgggcgaaggcctcgtcgatctccttgagcacccgctcgatggcgtcccgctgcgcggacatcaggtggtcgtccgcgctctgtccggtctcggtgagcgcgcgcagctggaccagccgcgtgccccgggcgtgttcgagccgctgccgcgcctcctcggcggtcaggcgttcgagacggggagcggtccgggcggcgtcggagggcatggcgggtcctctctccgaaggagtgcgggggacgggggcgtgcactcatcagcctggcccgttccccgccccgggcccatcggtcccagaacccatttgcggcgggtagcgggatgcacaccgaacgggtgaccgagcggacgtggtgcggagcgggcgcggtgccgagcggcgtggtgccgggcggacgtgttcgccggccggacatgggtggggcgcccaccgcgaaatgggcgccaggacccatcgacgcgcccgcccgcgagaggagaggctcgacggcgtacgccagaccgagggcgtacggcaggacaggacgacgaccgggacggggcccgcggcccgtccgcgacgtgcgatggccgacagtggaggcatacgggccacgtcggccacgtcatgcggacggaccgcgtcatgcgaggaggaacgaccccggtgtccctgttctggcggatcttcgggctcaacgccgtggtgctcggttcggccaccgcgctgctgctgtgggccccggtgaccgtctccgtgccggtcgtgctgaccgaggccgtcatcctggtcggcgggctggtcgtcatgctcgtcgccaacgcggcgctgctgcgctggggcctggccccgctggaccggctgacgaagctgatgaccaccgtcgacctgctgcggcccggccagcggctgccggccgccggcggtggcgaggtggtcgagctgatccgcacgttcaacgccatgctggaccggctggaacaggagcgcgccaccagcagcgcccgggtgctgctcgcccaggaggccgaacggcgacgtatcgcgcaggaactgcacgacgaggtgggacagagcatgaccgcgaccctgctggccctcaagcgggcggccgacgaggccgagccgccgctgcgcgacgaactgcaccaggcgcgggagatcacccgcgagagcctggacgaggtacggcggctggtacgccggctgcgccccggcgtcctggacgacctcggcctggtcagcgccctgacctcgctcacctccgacttcgccacccacaccggcgtgaaggtcgtgcgccgcttcgacagcgacctgcccgccctggagcccgagacggagctggtcctctaccgggtcgcccaggagagcctgaccaacgccgcccgccacgcggaggccgagcggatcgaggtggccctcacccgcgccgagggcgccgtggtgctggccatcaccgacgacggccgcggcatcagggcggcctgcgagggcgccgggatccgcgggatgcgcgagcgggccctgctcatcggggccgcgctggacatcggcga

SEQ ID NO: 1857 - DNA, 2360 bp, Unknown
  Kingdom: Bacteria, Phylum: Actinobacteria, Class: Actinobacteria, Order: Streptomycetales, Family: Streptomycetaceae, Genus: Streptomyces
ctccaccgaccccgcccgcatcgacgccggacgcgtgcaccactggctgtccaccgacgcgtactgggcgctgggccggtcgcgcgagaagcaggaccgggccatcgccggatcactgaacttcggcgtgttcgacaccgcgggcggcgaacaggtcgcgtacgcccgggtgatcaccgacctgacgacgttcgcctggctctgcgacgtgtacgtcgacccggccgtccgcggcaagggcatcggcaccgcactcgccgccgccgtccgcgaacacctgcggccccacgggctgcgccggatcctgctggccacgcacaacgcgcacggcgtctacgagaagctgggcttccggccgctggagcgcccggaccagtggatggcgctcgtcttcgagtgaggcgccggctcagctctcgcgcggggcgcgcgtgtagtcggtggtgagcaccaggtccttcgccgggccgcccacccgccacaccgtccgccagtggtccgcgtcccggacggtgaactcgccgcggtagaggtcggccgagcaggggtggtcggcgacgtgccggccggaggtgaggtccaggtcgtggaagggccgtccgtccgcgaaccgcacgtccgccccgcccggtgacgtgcccggcaggaaccgcagggtccgctcggcggggcgggccacgccgcgccagaggaacgtgcccgactcgtggtgcagcagcccgcccccgtccagcggagcgaagtcggtcacgccggtgaaggcgccctcgtcgccggtcgccaggtcccgcaccgtccgctcggtccgccaccgcccggccagatagaccagcgcgtccggcaccggccagtactcgcccatcgtgctccgccctccgctcacgttccgccgcttcccgcccctgccgcgaaggtggccacgccggccgccgcgcccgacgccgtgaacaccgggaccgccgcggccgtcgcgccccgcacgtccacctccaccgcggtcgccgaccggttcacgtacaccttcccggcgaaccctgtcacgttcctcaggatcaagcagaagcaggcacccgggccgggacctacgccggccctacgccgtgggctgctctccgagcggcaggagcccacgctcgccgaagaccttcttggccacgaaggtggcgttcagggccttcgggaaaccgcagtacccggccgagtgcagcatcgcctcgacgatctgctccggcgtgagaccgacgttgagggccgcgttcacgtgcacctccaactggggctcgcagccgccgagcgcggtcagcatccccagggtcaccaactggcggtcgcgcggggcgagttccgggcgcgcgtagatctcgccgaagccccaggagacgacctggtggcccagctccgggctgatgtcggcgagcgagtcgatgacccgctgccccgcctcgccgtccacgctccgcaggacctccaggccgcgggcgaagcgctcttcacgggtggtgctctcgctcatgtcaggtcgtccgtccccgcccgccgctcgtgcagcagtcgttcgtagtgatcgatcttgtcgtccagcgcgcccgcgctgcgccgcaacgcccgcatccgcgccgccagttcggcccggtgctcacggagcatcgccagccggtcgccgacgctcgcctcgccctgggcccgcagccgcgcgaagcgctgcatgtcggcgatcgacatgcccgtctcgcgcagccgcagcaggaactccagccaggccaggtccgccgcctcgtaccgccgctggttgccggtggtgcggccgacccgttcgatcaggccggcccgctcgtagtagcgcagggtgtcgtgcgtgagtcccgtgcgctcggcgacctgggcgatggtcagagtcgtcgcgcggccctgcgggagtggctgtccgctggtcatgggaaaaccgtagaacctggagcgcgctccaggtcaagccgcggcgccggatgccgtgccgcggggcccgcgcgagccgtcccgcgcgccaccggccaccgtccgcgaacccgacggcaattcaattaacccccgcatcatttacgcgacggttcgagttttcctggcggaaacagggtgccggagaatactgctgcgcattcgaattcgcggcaccaattctgggcgacggcacggccatcgggaagtccggccgtccaggccggcgaatcaccaacgcgcggggagtgacctcccctccccccgacgagacgccgtacgtcccgaattccctgggagcctgccgagaatggaccgcccaagcctgccgaggaccgttttcgcagccgcgcggcgacgaacggacgtgggcgccggcgcccacg

SEQ ID NO: 1858 - DNA, 2102 bp, Unknown
  Kingdom: Bacteria, Phylum: Actinobacteria, Class: Actinobacteria, Order: Streptomycetales, Family: Streptomycetaceae, Genus: Streptomyces
gcaccggcaccggcacgcggggtgccccggcccagccggccgtgcccggcatcggcgggaccggcatcggcgggaccgtcataggcgggaccggtctgaagggcctgaccgaacgcctcgcggcggccggcggctccctcaaggcaggcccttcgccgcgtggcttcacggtcaccgcgcagctcccgacgagcaccgaggaactgacggccgcggcgctggccgccgccacggcgggcagcggcccgcgagtcaatacccttggtccgtgaacgagatgccccggggccaccggcccgccaagtccgtccgcgtcctgctcgccgaggaccagggaatgatgcggggtgcgctcgccctgctgctcggcatggaggaggacatggaggtcgtcgcccaggtggcggccggggacgccatcgtggacgccgtgctgacccaccggcccgacgtggccctgctggacatcgaactgccgggcaggagcggtctggacgccgccgccgagctgcgcgagcaggcgcccgactgccgggtgctcatcctgaccaccttcggcaggcccggctatctgcgccgggcgatggaggcgggcgcggcgggcttcctggtcaaggacgggccggtggaggagctggccgccacgatccgccgggtgctggcgggcgagacggtggtcgatccggcgctcgccgccgccgcgctgagcgccggtccgaacccgctcacggcccgcgagtgcgatgtgctgaaggcgtccgtggacggcgcgacggtcgcggacatcgccgcgaggctgcacctgtcggagtccacggtccgcaactacctgtcctcggccatcggcaagaccggcacccgcaaccgcatggaggcgatgcgcgaggcccggcagcaggggtggctgtagggcgtggctggtagggcttgtccagcagaccgcgccgacgagcgccgggctcgccgtcccggccaccaccggcctcgccctcctcaccggcctgccatcagccccctgggccggcctcggcgtgaccgccgggcgggccggggcggcgccgtcggccggcggcgtgctgctgctgctgctgctgcgcaggcgtgacgcgtgaacgcccctgcagttcccgcgagttcgtgcggattcgttcctcaagccgtccggggttccgcgatcccctccgcggacccgcgcgttccgaacagcgccgtccacaagaaggcctccccgaactgcggcgagtcgtcgggttggtcccgcatccggcgcagctcgacctcctcgaagccggagaagatccggcgcagcgactcgggggtgtaggcgagcccgccgtgcagccgggaggtgcggtacagctcggcgtcgggcagttcggagcccatggcgccggcggcgaagcaggtgagggcgaaccgtccgccgggtgcgaggacccgctccagcagggcgaggtagctgatcctgcggtgcggcggcagatggtggaagcagccggagtcgtagacgaggtcgtacggcccggtgagctgagccccggccgctccgaaggcgtccccgctcaggaaccgcacccgcgcgccggcctcccgcgcccgctcctcaccccaggccacggcggcgggcgagaggtccacggcgtcgacctcgaagccgcgcgccgcgaggtgcagggcgttgcggcccggtccgcaccccaggtccagggcgcggcgcccgccgatcaagccccggtccagccactccaccaggttctcgtccggccgggcggcgaagaacggcaccgggcgggtccggtcggcgtagaagccgtcccaccagtcggccgcgccgtccgtccaccggtcggcctccggtgcgaacaggccgtccagcaaccgcagtacgtcgtccacggtgcggatgtcccggtcgacgttccggtccatgccccggtccatgcgagccccctctcagcgggccctgcgccgggcccgttccggtaccgcgacagtagcggcggagggccggaaagcccaggtcagagcgggttcaccggcatgctccgcatgtcctgtacgggcctgtgcggggcgagtacgggcgcggcgaggccggcgcg

SEQ ID NO: 1859 - DNA, 2044 bp, Unknown
  Kingdom: Bacteria, Phylum: Actinobacteria, Class: Actinobacteria, Order: Streptomycetales, Family: Streptomycetaceae, Genus: Streptomyces
catggacgttcgtgccgccgatgccgaaggagctgacgccggcccgcggcgggtgcggcgcggccggccacggttcgccggtggcgttcacccggaacgggctgccgtcgagcccggtcgccgggttggccgtgcggtggtgcagcgtcggcgggacgtaccggtgctcgatggcgagggccgtcttgatcaggccgaccacgcccgccgcggtgtccaggtgccccacgttgcccttcaccgagcccagcaggcagctgcccggggcggccgcgggatggaacacctcggtcagggcgcgcacctcgatcgggtcgcccagcggtgtcgccgtgccgtgggcctcgacgtactgcacggtcgcggggtccactccggccaccgcgagcgcctccgcgacgaccgcggcctggccctggggcgagggtgcggtgaaaccggccttgtcggcgccgtcgttgttgaccgcggagccgcggatcacggcgtacacgtggtcgccgtcgcgcacggcgtcgtcgaaccgtttgaggacgaccatcgcgacgccgtcgctcacgacggtgcccgcggcgtccgcgtcgaagggccggcaccgcccgtccggggacaggatgccgccctcgtcgtagtggtagcccaccggttcgagcagccgtacggcggcgccgccggccagggcgacgtcgcactcgcccagcagcaggctctgggtggccaggtgtacggcgaccagcgacgaggagcaggcggtctgcacggtgatgccgggcccgcgcaggcccagcttgtacgcgacgcgcagggccagcatgtcggggtcggtgctgacggcggcctgcaccggcatcgtgccgcggcggcgctcggggtcggcgtcgatgcgctgcgagcggtagcccgtcgtgctgccgccggcgaagacgccgacccggccgcggacgctctcggcggtgtggcccgcgtcctccagggcgtgccaggtggtctcgaggagcaaccgctgctgcgggtcggtgagttcggcctcggccggggtgtagccgaagaactcggcgtcgaagcgggcgggacggtcgagggcacccaccaccgggacgtacgccgggtcgtcacgcacctcgggcgggacgcccgcgtcctcgaggctgcgcgcggaccaccgggtgaggccctcctcgccggacaccagggcggaccagaaagcgtcgaggtcggccgctcccggcaggcgaccggccatgccgacgatcgcgatcctgagcccgtcctcaccgtactcagccatgcagtcctctttcgggtctttttccgagcgctttgccgagatcgcacgagaagcaaagaagggaatcggccgggatcagctcgtcgcggcggagcacaggaatcacggaatcacaaaggaatcggcccggaacggctgccgttcagaaaacagtccgcaacatgatctcccccgtttacatctgcgagccggacggtcgtcgcgtgtgaggacactacccaaggcagtgaacccacttcaatacctgaacttgatgtgtgcacgtttcaatcgctcaaaagactcacgccgcggagcggtcacggtaataatcgggagggcacgccgaatcggttcggcacgtgccgtggaaatgtcccgcctccgcaatctcggtgaggaaaagaatggctgacgtgatcttccaggtggtccggaacgacgaggagcagtattcgatctggccggccgaccgcgatctgccgcccggctgggcggccaccggcttctcgggcccgaaggacgactgcctggcccatgtcgatcaggtgtggaccgacatgcggccggcgagcctgcgccgtgcggcgacctgaaccgtccggacacggtcagctcctgacccggcgacagcgggcccggtcgacgaggtccccgacgagccggccgacggtgtcgagctcctggcggtagtagaagtggccgccgggcagcacggccgtctccagcgggccgtcgacgacctcggcccaggcgtcgagtccggccgccgggcac

SEQ ID NO: 1860 - DNA, 646 bp, Unknown
  Kingdom: Bacteria, Phylum: Actinobacteria, Class: Actinobacteria, Order: Streptomycetales, Family: Streptomycetaceae, Genus: Streptomyces
cggccggggacaccgcgccgcaggtgtcggctcagcgcacccgcgcctgccggtacggcaccaggagcaccggtccgacgagcccgtacgcctgccgggcggccgtgccgaacacggccggctcggcgaccctgaggcggttcaggaggggcgtggcgacctcgatctccagggtgttggggccgcgccgcagccacgggccgatgtcgagcaccgggtgcagccggtccaccgggtcgagcggcctgccgttgacgctgacccggcaggtgtcgctcacctgccccagctccagcagcgcgcccacgtcctcgctccaagcggcgggcagtgacaccgtggtgcggtagcggccgacgccggcgacgtcggcgagctccggtatccgcgaccagggcaggagttcgtccagggtgagccggtgcgtggcgtgggcggtggccgtcgcgcgggcgcccggccgccagtcgtcgacctccaggtcccaccggtcgggcgtgacgggtcgggcacctcggcgaaccgggtgacgaccgtacggcccgtgcgtccctcggagagccgggtggtgcgggtgcccgcggtgcccgagcggacgacgaggccgtcctcggtgaacagcgcctcgtcggcgtcggtggccacc

SEQ ID NO: 1861 - DNA, 1583 bp, Unknown
  Kingdom: Bacteria, Phylum: Actinobacteria, Class: Actinobacteria, Order: Streptomycetales, Family: Streptomycetaceae, Genus: Streptomyces
gggtcggtgtgcgggatgtcgagggggaggcgggtgcgcagggtgaggcgtccctcgtcggtgaggtcctggtcgtagaggccggcggtgatgtggtgggggcggctgccgtggtggtcgacggtgagggcgcaggtgccgtcggcggtgggggtgatgtggggggtgagggtgtcgacgccggtggtgcgcagccaggcctgggcccaggcgtggacgtcgcggtcggtggcggaggcgagggagtcgatgaagtcggcgagggtggcgttggcgaagcggtggcggcggaagtgggtgttgatgccggcgaggaagtccttctcgccgagccaggcgacgagttgacgcagggcggaggcgcccttggcgtaggagatgccgtcgaagttgaggagggcggaggcggtgtcgtggacggcttcgggggcgacggggtgggtggtggggcgctggtcggcgtcgtagccccaggatttgcgggagaggccgaactcggtccaggtgtcggtgaagcgggtggcttcggcggtggtctggtagcccatgtattcggcgaaggactcgttgagccagatgtcgtcccaccacttgagagtgacgaggtcaccgaaccacatgtgggccatttcgtgggcgatgaccatggcgcgggtctggcgttcggtgtcggtgacggcggagcggtagacgaactcgtcgcggaaggtgacgagtccggggttctccatggcgccggcgttgaattcggggacgaaggcctggtcgtaggagtcgaaggggtagggctcgtcgaacttctcgtggtagcggtcgtagcaggcgcgggtgatgtcgaggatctcgtcggcgtcggcgtcgaggtggggggcgagcgagcggcggcagtggatgccgaagggcaggccgcggtgttcggtgcgtaccgagtgccaggggccggcggcgacggcgacgaggtaggtggagatcggcggggtggtggcggctttccaggtgccgtcgccggtgtgttcggtgatgccgttggcgaggacggtccagccgtcgggggccttcacggtgaggtcgaagacggctttgaggtcgggctggtcgaaggcggcgaagacgcgttggacgtcttccatgaacagctgggtgtaggcgtaggtctcgccgtcggaggggtcggtgaagcggtgcatgccttcgccggtgcgggagtagcgcatgagggcgtcgatgcgcagttcgtgttcgccgggggcgaggtccgtcagcggcaggcggttgccgtcgaggcgggtcgtgtcgagggggtgtccgtcgagggtggcggaacgcagttcggcgggcttgacctcgacgaaggtgtccgtgctgggtgtgccgtcccggccggtgcgtacggtgaaccggatctcggtgcgggagtcgaaggtgtcctcgccgcgggtcaggtcgaggtcgacggtgtagcggtggacgtcgaggagctgggcacgggtctgcgcttcgtcgcgcgtgagtacggacatgcaggccatgctgcctgatggcggtggcggggcacgagggggttcgggggacgggcttcgggc

SEQ ID NO: 1862 - DNA, 714 bp, Unknown
  Kingdom: Bacteria, Phylum: Actinobacteria, Class: Actinobacteria, Order: Streptomycetales, Family: Streptomycetaceae, Genus: Streptomyces
cggacccgtcggcgaccagggctccgacatcgcccgcatcgccgccatcgccgcgggactgccggacaccgtggccggcgtacaggagaaccgcttctgcgcctcgggcctggaagccgtcaacctggccgccgccaaggtgcgctccggctgggaggacctggtcctcgcgggcggcgtcgagtcgatgtcccgggtgccgatggcctccgacggcggcgcctggttcaacgacccgatgaccaacctggccaccaacttcgtgccccagggcatcggcgccgacctgatcgccaccatcgagggcttctcccggcgcgacgtcgacgagtacgcggcgctgtcccaggagcgtgcggccaccgcctggaaggaaggccgcttcgaacggtccgtcgtgccggtgaaggaccgcagcggcctcaccgtcctcgaccacgacgagcacccgcgccccggcaccaccgccgactcgctcgccaagctcaagccgtccttcgccgacatcggcgaactcggcggcttcgacgccgtggcgctgcagaagtaccactgggtggagaagatcgaccacgtccaccacgcgggcaactcctccggcatcgtcgacggcgcctccctggtcgccatcggctcgaaggaggtcggcgagcgctacggcctcaccccgcgcgcgcggatcgtctcggccgccgtctccggctccgagcccac

SEQ ID NO: 1863 - DNA, 935 bp, Unknown
  Kingdom: Bacteria, Phylum: Actinobacteria, Class: Actinobacteria, Order: Streptomycetales, Family: Streptomycetaceae, Genus: Streptomyces
gccgtgcgcacaactccaccacgtcgccggccgcggagcgttccgcccgcgtgcgcgcggcgccgaccaggtcctccagcagccggtgggcgccgggccggtcgagtgcgcctatccggatgctcaactgacctggcaaagcgggcagttcgcgccgggcggcgacgatgaccgcgctgcgcacgtcgtcgacgagcagcgggcgtacttgcgcctcggtggcggcgttgtcgaggacgacgaggacgcgtcgcctgctgaggacgtcgcgcagtcgtgcgcctgcttcctccgggccgtccgtgtcgggcgcagtgcccagggatcgcaggatgcggcggacgagccggtcgggggtgagcggctcggtggccgccgggtgcaggtccacgaagatctggccgtcggggaaccgggcgcgcgcggtgtgggcggcgcgcaggatcagtgaggtctttccggcgccgggtggtcccaccacgacggcgagctgctggtggtcggggggttgctgcgtgacgaggtgggcgcgcagttcgtccaggtgcggctgtctgccggccaggcggggacgcggggccgcggggagttccgcggagagggccgtgggctgtggtgcgggtcggggctgcggccgggaggtacgcagcaggcggccgacgtccgccggtggcaggccgagtgcctgggcgagcaggcgcagggactgcttgcggggccgggcggtgtgtccggtctccaggttgcggatggcccgtacgctcagtccggaccgacgggccaggtcctcctgggtgaggcaggccgtctcccgcgcgtggaccagcgtcgcggcgagggcctccagtggggtggtgtcggtcacgtcatgcccatctcgtcgtgcttgtcatgacatccctggattggtggggtggggctgtgggggcgagggt

SEQ ID NO: 1864 - DNA, 607 bp, Unknown
  Kingdom: Bacteria, Phylum: Actinobacteria, Class: Actinobacteria, Order: Streptomycetales, Family: Streptomycetaceae, Genus: Streptomyces
acgacgaagccgcggcgccccacgccgcgcgtcccgccgtcctcgcgggccgctcccggccgcacgccctgccccccgtcgtcccgtccgccggtgccgtgcctgtcgtcctcgcccaccgcctcgtctctcggctgcgacgacccgtcctgcgacgcctgttgcaccaccgcacgctccttcgtgttcgcacaggggagacccggtcgcgcggggcgaccgagccggaggcgccgaccctaagcgagcccgccagacggaacaagagtttcgacagacggaacaggagggcggtctctggaccgggaggccgaccggttcctcatggcggtgccgtcgcggcgactgggtggcgcaacgggtcatcccctcctgccgcgccgcacgtcacgggcgtcagcgcaggtcaggatgggtggcgtaacgtgccggaaacatcggcgccctagtttgggcgggcccccacagggcacggtcggccgaacacggtccgccccggccggactggtggacggcgtcagagcgcggtccctcaccgccggaccggtggacggcgcacgggcacggtccgtggtgccctgtcggcacgatcgggccgatcggcggg

SEQ ID NO: 1865 - DNA, 537 bp, Unknown
  Kingdom: Bacteria, Phylum: Actinobacteria, Class: Actinobacteria, Order: Streptomycetales, Family: Streptomycetaceae, Genus: Streptomyces
gtcccgctcgatccgctccaggtcgagcagatcgagcagggactcgagtgccgtgctcacgggtcctacaggcccatgttcttggcgatgatcgacttcatgatctcgctggttccgccgtagatgcggttcacgcggttgtcggcgtacagacgggcgatcgggtactcgttcatgtagccgtagccgccgtgcagctggaggcagcggtcgatgacgcggtgggcgacctcggtgcagaacagcttggcggaggcggcctcggcggcggtcagctcgcccgcgtccagtgcctccagggcgcggtcggcgacggcctcggcggcgtccacctcggcctggcaggcggccagctcgaacttggtgttctggaagtgcgcgaccggcttgccgaagacggtgcggtcctgcacgtactgctgggcgaaccggacggcggccttggcctgcgcgtaggcgccgaaggcgatgccccagcgctcggagggcagattggcgccgaggtaggagaagcccttgttctcctcgccgagcagg

SEQ ID NO: 1866 - DNA, 1406 bp, Unknown
  Kingdom: Bacteria, Phylum: Actinobacteria, Class: Actinobacteria, Order: Streptomycetales, Family: Streptomycetaceae, Genus: Streptomyces
cgggtggcacgctcagccgcagcggaccgcggtagcgcaccgcggctccggggccggactgggcccactcgtggacggcgccgcgcccggcggcgaagacatggatacgaccggtgccgtcgacggcggcggcgagcccctcctgcacctggcctccggccaggtcctgccacggcgaccagtgccccgccgcgtcccggacccgcgtactgaggcccttggaggcgttccgcacgaagacgtgcacgcggccgtcgcggcccaggaccgccgtcggcggcccgacccggcggccacggaccggattgcgctcgggattgccgaggctgctccacgtgccagggaacggccccccggcggaccgctgctcgacgtagacgacttcccgcgtgttgtcggccgacgcggcgcccagcccggagaagcgaagcccgaacaacacgtcccgcctgtcggagagcgtgacgacgctcagtgccggggccagcgggccgcccccgatgtcttccggggcgctccatgccgtcctgcccgccgtgctgcgcgtccagcgggcggcccgcatgccgagcacgccgtagacggtcagctcgcctcccggtccggcgacgccctgcggtccggaggtgggataccggtagtgggtgctgcgcacccacttgcgtttgtcgcgcagtgaggcgcccgatccgacgccgtagtcgccgcaaccgctgggattgccgcagtgccagtcgggtctgccgccgtagtcgtcgagatagcgggccttccgctggacgatggcgccgggcaggttgatcggccaccgctggttgtagtagccgcggtacacctcggtcaggaacaccggggccttgccgccggaggatgtgctgtgtcccacccaccgggtcatggcagcccaggtgaacagggcgaccgcggtgtggtccgggtggtccgagtaaccgcgctgatcgctgcccctggggttgtgcgcgtcgtgcacctgcacgtcggggtccgggtccagcgtacgtatgaccgtgggccggaaccggtcgaagagatgggcgagggtgtcgatcaactggtcccggctgtagtggcgcagcctggtgaccggagaacccgggacgaccacggtggcggcctggacgccggagtccgcccagagctgggccataccgacctgggtgtggggccccacccgggtgtgcatgtcgatgctgaggaacacgagatcgacacgcctgccctggtgggtgaggctctgcacctcgacctcaccgccgtccggcacggtcagggtggaccgggtccagggcgcgaagaggccgagcccgagcatcgccgcgtacgcctggcgcagaccctgctggcgggccgagacgtaggcggggacattgggcgggggcttgggg

SEQ ID NO: 1867 - DNA, 1229 bp, Unknown
  Kingdom: Bacteria, Phylum: Actinobacteria, Class: Actinobacteria, Order: Streptomycetales, Family: Streptomycetaceae, Genus: Streptomyces
gctgctgctcgcgccacggcagcagcagcggtgtcgcgagcagcagcaggcccgccaggccgatcgcggtgcgcgagccggtgaggccggccagcaggccccacagggcggtcatcgccgccgtggtcagcttgcccgtgaccgaccaggccgacagggtccgggcgacccggtcctgcggggtctgctccaggcggtacgcggagtacaccgggttgaacacaccgcagagggtgatcagcaccagctcgaccgccatcaccaccacaagaccggccacgcccggccggacgaacgccagcccgaccgaccagcacacgcgcagcgcacccgtcgccagcagcacccggcgctgcccgtacgcgtccaccagccaccccgccagccgggaacccaccagcccgccgagacagggcacagcgaaggcgagaccgtactgccacggtgtgaacccgagccgtccgagcatcagtacggcgagcagcggcgccaccgccatgatcagcgagttgaccagcaccgtgttgaagaagagcgggcgcagcgccggatgcgccagcacgaaccgccagccgtcgagcagctcccccgcccgcagccccggcacgcgcgccttgccctcagaatccccggaccctccggaacccccagcgcgcccggctccccccggcggggccggctccgtaccgccgatcgctcggatcccgagggcggacagcagatagctgaccgcgtcggccaccaccgtcaccaccggcccgaacgccccgaccaggacgccgcccaccggcggccccagcaccgacgccgtccacgtcgtcgactcgaaacggctgctcgccaccagcaggtccgccgacggcaccagcgccttgaggtgcgccccgctcgccgcgcggaacgccaggtccgccgccgcgaccaccaccgacaccaccagcagctgggcgaacccgagcccgccgagggcgtacgcggccggcacgctcatcagggccgcgcaccggaccaggtccatcgcgaccatcaccggccgcttgcgccggaactcgatccacggcccgagcggcaccgccacgaccgcgcccaccgccagccccgccgccgacagcaccgacacctcggccggcccggcgtgcagcaccagctccgcgatcagcgcgaaggcgtcgaacgccagccacgtaccgaacgtgctggccgcgtaggcggcccacagccacccgaac

SEQ ID NO: 1868 - DNA, 548 bp, Unknown
  Kingdom: Bacteria, Phylum: Actinobacteria, Class: Actinobacteria, Order: Streptomycetales, Family: Streptomycetaceae, Genus: Streptomyces
tcggcgtgggcctcgtcgtcgtcgccgtggcgctgcggctgctgcgcatgggcgtgtgggtcagcgcgcgcgggctgcgtcacgtcagtttcctgatcacccgtacgacgccatgggcacaggtcgtgagcgtccgcacggtgcagcagccggtgcgctggctcggactgccgcggacggtgcagggccaggcgctgctgctcggccgcaggggccggccccaggagtccgcgccgccgctgctgaccacgcacaacgccgacttcctgggccgcgtgacggcgttcgaccgcgcggcggacatggtggaggcgtgggccgaggagtacgggccccgctgagccgggatcctcgcggccgggcgcgccggtcccacgggcgtgcgcgtcccggagcgcgtggtgcgggcaggacccgggggcgccggcaccgcgtggtgccggcgcccccggatgtgtgaccgtacggtggcgtgcgccgcgctcaggccacgggcacgggcttgccgtcgtgcagggcgatcgcccgctgcatcgccttgcgggcgc

SEQ ID NO: 1869 - DNA, 1898 bp, Unknown
  Kingdom: Bacteria, Phylum: Actinobacteria, Class: Actinobacteria, Order: Streptomycetales, Family: Streptomycetaceae, Genus: Streptomyces
gtggtgggccgcagcgatggccgcgtccgtgccgtggccgcgcgcctccggcgccagccacagggcgaacacggtggcgaccagagcaccgccggccgccaccagcggcaccagccacggccggtcggagcccgccagcttgaggaatccgccctccgccgtcgttcggtagggccggtaaccggccaccgactccagcagccagccggtgcacaggtggagcagtccgaacagcgccgcggcgcccagacccgccacggcgccgatgaggatcgcgggcagcacccagcgcgcctgcgagtcgtccgcgccgtccgccggcaggagccgtgcggtcaaggaccgtaacgaccagcgccgtgaacgctcttccgtaccacgcgcccccgttgtcacccgcatactcccgccgcccgacatcgtccccctcggcaagggtgacggccgacccggcgcaaggtcaacctcagtgtctccaacgggtgatgacggttgatcagcttgctgacaagcttactgacactccatcgcacaaccgtccaatacaccccagcggaaccggtcacccgcgcccgaatcacgggctgacctgcccacgttcctctggttatcctcgaagtcggatcaacagacagtcagcaggcggtggcgacagggggctgaggccgatgccgagcggggccggtgagcgcacggcggacatgccggatctgacagggctgcccctggaggagatactggagggcaccgactcggcgctgtccgcggccctgcgccgcgtcctgcgccacctggcgggcgaggaagcaccggtggccgcctacgactccggaggcgacacctccgggggcccacgccggctcaccacccccgctccgtgaccccggccgaccacgccccgcacggccggtggcccgacgacctcctcgacgtcgccgccctgcgcgccgccgggacacaccccctgcccttccgggagttcgtcgtcaaggtgcacagccgctgcaacctcgcctgcacctactgctacgtctacgaggccgcggaccagcactggcggacccagccgcacaccatgtcaccggacacggccgcgcaggtgtgccaccgcatcgccgaacacgcggcccgccaccgcccgcgatccctgcgcgtcatcctgcacggcggcgagccgctgctcgccggacccgccctgctgcgcaccctcacccgcaccctgcgcgcccggctccccgccggcaccaccgcagaagtcgtcgtccagaccaacggccttctcctcgacgacgccgtactgcgcatgtgccacgaggacgacatcaaggtcgccgtcagcctcgacggcaccgcagccacccacgaccgcgcccgccgcgaccacgccggacgcggcagccacgcccgggtcgccgccgccctgcaccgcctcgccgcccccgagcaccgcgccatatgggccggcctcctgtgcaccgtcgacgtcaccgccgacccgctcgccacctacgagcacctgctgtcgtacgacccgcccgcactccgcctcctgctgccgctgggcaactggacgacccgcccgcccggacgcaccgccgaccccgcccacaccccctacggcgactggctcgccaccgtgttcgaccgctggtacggcacccccggagcaccggtgcgcatcgcgttcttcgagtcggtcctcgacctcctcctcggcggcgtcacccgcaccgagaccatcggcggcgccccctgccagctcgccgtggtcgacacggacggcgccctcaccctctccgaccagctcaaatccgcctacgagggagccgaccgcagcggcctcgacgtccaccgccactccttcgacacgctcctggaccaccccggggccgcggccc

SEQ ID NO: 1870 - DNA, 2123 bp, Unknown
  Kingdom: Bacteria, Phylum: Actinobacteria, Class: Actinobacteria, Order: Streptomycetales, Family: Streptomycetaceae, Genus: Streptomyces
gaactggccgtgccgcttgcagccaccggcgaactggtcggcagcgcagccgccgcgcgctccgccgtcgccgccttcaacatcatcaccctggaacacatcgaggccgtcgtcgcgggcgcggaggcggccggcacaccggtgctcctccagatcagcgagaacgcggtcaagtaccgctacggacggctgctgccgctcgcccgcgccgccgcgtccgcagccgaacagtccaccgtccccgtcgcgttgcacctcgaccacgtgcagagcgacgacctgctgcggcaggccgccgacgcgggcttcagctcggtgatgtacgacgccgcccggctgccctacgcggagaacctcgccgcgacccgggccgccgccgagtgggcgcactcccaggggctgtggatcgaggccgagctgggggaggtcggcggcaaggacggccggccgccgctggacgcccacgcgccgggcgcccgtaccgaccccaccgaggcgcacgcgttcgtcaccgactccggcgtggacgccctggccgtggccatcggcaacacgcacgccatgaccgagcgcaccgccgccctcgaccacgacctcatcaagcgcctggccggcgcgctggacgtcccgctcgtcctgcacggctcctccggcgtgtccgacggcgaactgacgtcggccgtcaccggcggcatcgccaaggtcaacatcggcaccgccctcaacatcgccatgaccggcgcgatccgcgagtacctcgccgcccaccccgaggcggtcgactcccgcaagtacctcggcgtgggccgcgaggcgatggcgcgcgaggtggaacgcctcatccgcgtgatcggcacgcccggtgccaccgaggcggccggtgccgcggctcctgccgctacctcttgacggccgtcagcaccacgaacttcgggttgccggccaccagccggcagttgccgaacagccggcgcagcttcacgtgatagcccaggtgccggttgccgaccacccacagcgcaccaccggggcgcagcgcccgccgcgccccggtgaacatccgccacgccgtcgcgtccgtcgtcgcctggtgcgagtggaacggcgggttgttcagcaccaggtccacactgccggccggcaccccgtccaggccgtccccgacccggaactcggcgtgccccggtaccccgttcgccttgtacgtcgcctccgccgacgccaccgcctggaacgactcgtccgtgaagagcacctcggcctcggggtgcgccagcgccatcgccgtacccaccacaccgtttccgcagcccaggtccaccacccgccgcgcaccgggcgcgtccggcaggtgctccaggaggaaacgggtgccgatgtcgagccggtcggcgcagaagacccccgcgtggttgacgaccggccggccggagaccgcgccgatcccgccgggcagcgtgtgctcgtacggccacgggttcccgggccgctccagcgccgggtccggcgtgcacaggatcagccgcgccttgcgctcggccagtgaggtccgggtggggccgaggatccgctcgaacagcgccagcgtcgaggtgtggatctccttcaccatgccggtgccgacgacgaccgtgcccgcgtgcaccccgggcgccagccgcagcaactggtcctccagcagcgcgagactcttgggcacccgcaccagcaggacgtcgatccgctcgggcggcgggtcctgcgtggtgagcaggcgcaccgccccggtctccaccccgttgcgggcgaggttggcgcgggccgcctcctgcccgaggtacgagtcggtgatgtgcaccagccgcacctgtcgcacctgccggtgcgtcgccagcgccgtcgccagtgcgccccagcggtcccccaggaccacgaccgtcccggacaggtcgatggcctggtcggcgaggtgccgcaacaggtactcgtcggaggcgtcccaggcgcgcagccggtcgcggggatcctcgggaaaacgggccagcgccggctcgccccaggcagtcgtcatacggtcgctcatcgtgcgtccaggctagccgagccgcagctcacgaccgctcgggcaggatgggacgtatgga

SEQ ID NO: 1871 - DNA, 764 bp, Unknown
  Kingdom: Bacteria, Phylum: Actinobacteria, Class: Actinobacteria, Order: Streptomycetales, Family: Streptomycetaceae, Genus: Streptomyces
gccccggcccgctgctggtcggcacggccggcaaacccgtcgagctgacgatctcgcccgccggcggtggagaggtgcggcacgccgtcgtggtgcccctggccgacgaggaaccgctgcgctaccacgcctgggtcaccgaccgccgcgcctacgtccacgagaagtccggcggccggctcggctacctgcacgtgcctgacatgcaggcgcccggctgggcccagatccaccgcgacctgcgcgtcgaggtggcccgcgagggcctggtcgtggacgtgcgcgagaaccgcggcggccacacctcccagctcgtcgtggagaagctggcccgccggatcgtcggctgggacctgccgcgcggcatgcgaccggagagctacccgcgggacgcgccgcgcggccccgtcgtcgccgtcgccaacgagttctccggctccgacggcgacatcgtcaacgcggcgatcaaggcactgggcatcggaccggtcgtcggcacccgcacctggggcggtgtcatcggcatcgacagccgctaccgcctggtcgacggcaccctgatcacccagcccaagtacgcgttctggctggagggttacggctgggacgtggagaaccacggcgtggatccggacgtcgaggtcgtccagcgcccgcaggaccacgcggcgggccgcgacccgcagctcgacgaggcgatccgcatcgcactcgaggcgctggagacgaccccggcgaagaccccgccgagcctgccgtagccc

SEQ ID NO: 1872 - DNA, 1170 bp, Unknown
  Kingdom: Bacteria, Phylum: Actinobacteria, Class: Actinobacteria, Order: Streptomycetales, Family: Streptomycetaceae, Genus: Streptomyces
tggcccggtaccgggccagcgccagatcgagggtgcccgcacccgggcgggcgtagtccagggggacggtgaccttgccgcactgcaggtccttcggcgcgccggtctcgcacgccgtccacgtcaccttctgccggtagaagcgctccaggcccgacgggcccgcgcccgcggcggccacggggggtcccgcgccgcacagtgccagagcgacggcaccgacgcaggcacagcgccggaccgcggaccgcgtcgacagcttggccagcatggatgcctccaggggcgctccgccgcggaccgggacaacgccctcgctcaccataagcggccgccggaccccgcgcctccccggtggaaccgcaccggacttccggtgcatgccccgtgaaattccggtgcgattccggtgcgggaccctgccgtcaggcgtacgacactcccgcggccgttcgaaaacaggccatcgggaggtgaccggcgcaccgctcgaaggggtgaaacacgggcagaccgtataacccggatggcggacccgcgttctgtccggtgcgggcaagcgtccgtgaccatgtctggaaggcacaggacctatgaaacgggttacccgaaatggtgtgatcgccctcgccgcctccggcgcggtggcgatggccgtgccggtgtccgccgcgttcgcggccgactcaggcgccgccgcggacggctccgcggccggctcgccggggctgctgtccggcaacagccttcaactcccggtgcacgtcccggtgaacgtgtgcggcaacacggtggacgtcgtcggtctcctcaaccccgcggcgggcaaccggtgcgccaacaccggccggcacggcacctcgtccggggcgtcgtccaccgggggagcgactgcacgggagagcggaaaggattcgccgggcgtgctctccggcaacggcatccagctgccggtgcacgtcccggtcaacgtcagcggcaacacggtcaatgtggtgggcatcggcaaccccgccaccggcaacacctccaccaacacctccgtcgaccggcccgcgccgcacccggtcacgccgcccgcgcggtccacgccgcgccccgcgcccaagcccgtgccgcacccggtcgccgtaccgcgcaccgagacgtccctcgcccacaccggcgcgg

SEQ ID NO: 1873 - DNA, 841 bp, Unknown
  Kingdom: Bacteria, Phylum: Actinobacteria, Class: Actinobacteria, Order: Streptomycetales, Family: Streptomycetaceae, Genus: Streptomyces
tccgccgccttccccccgccgagcacctcggcggggggaaggcggcggaggtggaggcgggagtgttcgacggcgtcgacgccgcgctgatgttccaccccggggtgcacgactggtcgcgggcgccgctgaccgcgcaggtgcagtaccgggtggccttccacgggcgcgccgcgcaccccaccgggaacccgaccgagggcgtcgacgcgctcgcggcgctgatcgagctgttcaacgtcctggcgggactgggccggcgtctgccggccgcctcccacatccagggcatcatcaccgacgggggcacggccaccaacatcgtgccggagttcgcgcagggcctgttcggtctgcgcgcggccacgacgggggcgctggacgacctgaccggccggttgcgcacctgcgccgagggcgtggccctggccacgggcaccagggcggagatcgagcgtgccacgccccgctacgaacacttccgtgacaacggcgtcctgtccgaccgcttcgccggacacctgtcccgggccgggatcaccctgaccccgcccgtgccgggtgtccagctgggctcgtcggacatcggcaacgtgagcacacgtgtgcccgccatccacccgttcgtcgcgatcatggacgaggggtccgaccacacccccgagttcgccgtggccgccgcctccccgcgcgcccgtgacgtactcgacgccgtgtccggcgcgctggcctgcacggccgcggacgtgctgctgagcgcggacctgcgcgcgcaggcatgggcgcgacacgggggcggcggcgcgggcgggaagggctgacgcggcacggctcgccgttc

SEQ ID NO: 1874 - DNA, 1605 bp, Unknown
  Kingdom: Bacteria, Phylum: Actinobacteria, Class: Actinobacteria, Order: Streptomycetales, Family: Streptomycetaceae, Genus: Streptomyces
tggcggtcaagacacaggacaccgaggcggcgctcgcggcctgggggcccgcgccggtcgagggcggcggcacggcggccgacaccttgccgctgctgtgcgcgcagaacggggtggaggggcagcggctcgcgctgcgccgcttccgccgggtctacggcgtctgcgtgtggctgcccgccacgcacgtcgaaccgggcgccgtctccgccgcgggcaccccgctcaccggcatactgcacctgggccgctgtccgcacggcaccgacgacaccctgcggcggatctccgccgacctggagtcggcgcacttcgaggcgccggtcgtgcccgacgtgagccgctggcagtacgccaaactgctcggcaacctggccaacgcgatggaggccgtcagcggcccgctggtcggcgaagcggccggagccctgtacgccagggtgcgcgcggagggcgaggccgtgctggcggcggccgggatcgcatacgcgagcgcggaggagcaacgcaccacacgcggcgacaagatcacgctcgttccgctgcccggcgccccgcgcggcggcggttcctcctggcagtccctcacccgcggcaccggcaccatcgaggccgaccacctcaacggtgagatcgtgctcctgggacggctgcacggcgtccccacgccgctgaacgagctgctgcaacgcctcgccaactccttcgcccgcgaaggccgggccgccgggtcgctgccggtggcggaactggtccgcctggccgatcaagccgaacaggacgagcgcaacaggacgagctgaggggacgagcgggcgggacgagcgaagtggaccaggaacacggccgctgattgggccgtgatcctgcgccaatggaccactagcctccagtgcatgaccagtacccgtacgcctaccgatcgggacgccacggcccccgcccgggtggacttctacttcgaccccgcctgccccttcgcctggatcacctcacgctggctgctggaggtcgagcgcgaacgcccgctcgacctccgcttccacgtgatgagcctgttcctgcacaacatgggcaacgaactgcccggctggtaccgcgaactggtcgacaagtcgatcggcccggtgcgggtcgccgtggccgccgccgagcggtacggtgacgagaaggtgctgcgcgacctgtacaccgcgttcggcacccgcatccacgagcgcgaggagaccgacttcgacgccgtcgtcaccggcgccctcgccgaactcgccctgcccgccgacctcgccgaggcggcccacgacccggcgtacgacgcggccgtgcgccgcagccatgaggccggggccgaaccggagtcgggcggttacgtggggacgccgacgatccacgtcgacgggacggtgtggttcgggccggtcctgcgggccgttccgcgcggcgccgaggcggcccggctcttcgacagcttccgggtgcttgccgcgcaccccgacttcttcgagctcaagcgcacccgcaccggaaccctgcgcttcgactgagcgcccgccgcgtcaggcgccgagcgccgtggccgtccgcggcagccgcgcggcgtcgtac

SEQ ID NO: 1875 - DNA, 695 bp, Unknown
  Kingdom: Bacteria, Phylum: Actinobacteria, Class: Actinobacteria, Order: Streptomycetales, Family: Streptomycetaceae, Genus: Streptomyces
gcggcacatcactgctcggctcgggctgttcagccgtggaacgtgatgtacccgttgccgtcgcggtcgttgcgcgccttggtgtaggagtgcacgtcggcgcgggcgccggagggcttgtacaggtagatggtgtccttgtcgttgttccagaggaagttgcagttctggcggtaggcgacgttcttggcgtcggactccttgcccttgccgccgcgcagcttcacgtagtcgccgggctccaggtagtggtcggcggagaacctgaagcggttgccggcggcgtctttgacgacgtagcccttgagattgacccgcgaggtgcgcgagtagttcttgacggtcaggtactcgtccttggtgttgcccttgctgcagctgttggagtcccgcccgggagcgtcgtactggacgcccgcgatcttcagggcggaggagtactcggcggcctgtgccggagccgcggcgatgacggcgaccgttcccgcggtggcggcggcggtcagcacggagcgtatgcgcatgaggatcccccctcggtgatgcggatggagcgtcaggagcatacacaggcgtgacggaacggcggcgaggtaggaggctccggtcacgcgcctcacgctagccgaggacgggcaccggccacctcccagccttcacggctcctccaccctctcgccgccgttccgtcacgc

SEQ ID NO: 1876 - DNA, 669 bp, Unknown
  Kingdom: Bacteria, Phylum: Actinobacteria, Class: Actinobacteria, Order: Streptomycetales, Family: Streptomycetaceae, Genus: Streptomyces
ccatgagtgcggatgccacaaaccctgcgcccccgggcccgcctccggggcgccgacggcgccaccgggcccggggccgcagggtttgtggcatccgcactcatgggcacctccggctgcgtggaccggcggacggggtgccccagggcgtacgcggctcaggggttggcgtcggatcccccgtccgggccggtgcttgatgctaccgagcccagcacactgagccgaccgcctctcggagagcgtgaaacggatcacccattcgagcgacggcctgggaggtttacggttttcggtcaggtgacaagcgggcatccgtggatttccaccgccacctgggccgtcggcctggatcctgtccggccatgccgcccgcggccctgcgatgtccgggcaggtcccagctcagacagccgctgattccagccactccgcctcgatctcgccttcggcgacgatcacagcgggaccggtcatctcgatctcgccgtccggccgctcggtgatgaccagggtgccgccgagcacgtcgacgcggtacgtcaccggagtaccggttgcggcggggtcggcaccgtcgcggcgggcggccgccacggcgacggcacacgcgccggtgccgcacgagcgggtctcgccggagccgcgttcgtgcacccgcatcgcgac

SEQ ID NO: 1877 - DNA, 1036 bp, Unknown
  Kingdom: Bacteria, Phylum: Actinobacteria, Class: Actinobacteria, Order: Streptomycetales, Family: Streptomycetaceae, Genus: Streptomyces
gctcccgcccggaccagcccgacgccgcccagggccactgagaccacgcagtcccccgtcaccctgcgccggggcgaccgcggccccgaggtgagcgatctcgaggagcgcctgtcacggctgtacctctacaccggccggatcgacggcttctacggccggcaggtggaggacgcggtacggacctaccagtgggcccgcggcatctcctcggacggtctcggcgtgtacggcccggcgacgcgggcgagcctggaggcggagacgtcccactggtgacgtaccggtggtgacgtaccgccggtgacgtcccgccggtgacgtagacccagccttgtcagccgacgtgcaggcggatcgtcccgtcctcgaccggctcgacccggatccgcgtgaggtcgcgcaccaccgcgtcagggccgtggacgacggcgcgcgggccgacgccgatcacccgcatcccggcggcccgcccggccgcgatgcccgcgccggagtcctcgaagaccacgcagtcggcgggggcgatgccgagttcggcggcgcccttgaggaagccctcggggtcgggcttgctcgcgccgacggactcggcggtgacccgcacgtccggcaggggcaggcccgcggcggccatccgggccgtggacagggccacgtccgcggaggtcacgagcgcgtgcggcagtccgtgcagcgctgccaggaactccggcgcgcccgggaccggcaccacaccttccatgtccgaggtctcctcggcgagcatgcgggcgttctcggcgatgttctgctcagcgggccggtcgggcagcagcagcgccatcgaggcgtgcccctggcggccgtgtaccaccttcatcacctcgtcgcggtccagtccgtgccggtcggcccagcgccgccagatgcggtcgacgacggcgtcggaattgacgagggtgccgtccatgtccagcaggaaggctcgggcggtgagtacggcggtggccgtcatcggcagctccaaggcgcgcggaggggcgtgggggtgggc

SEQ ID NO: 1878 - DNA, 2317 bp, Unknown
  Kingdom: Bacteria, Phylum: Actinobacteria, Class: Actinobacteria, Order: Streptomycetales, Family: Streptomycetaceae, Genus: Streptomyces
accgggccggtgaggaaggggccgagcgcctccaggacgtcctcccgctcgtccccggccagcaggtggacgcgggcggcctcgcggtcgaaccacgcgacggtgcgcccgtcgggggcgcggacgtacagccgctcctgcccctgctgtccgcccggtacgacgcgcaggccgcccgcaccgggcgggccgggcggtcgacgtggtccgctcatgcgccatcacccctacgaccatgggaacaggcagggtgctcccggggcaagaacacggctacctttgaggtgccctggggtggggagttggggaggcgcgccgttgcggacccgtggacatcagcccgacgtaccggctccacagagcccgtggagcgagatcgtgcccggcctgtggatgggcggacacgagttcaggagcggctccggacggctggagtccgtcgtcgtgcacgacgagttcgacctggtgcagtcgctgctccggctgccggggtacggccccggccccggcgtcacgcaccaagtgtggccgatccccgacggaccgctggacggcacccagctggccggtgtgatacgcctcgcacaggcagcgtgcgtcgcgctggacgccggcgaccgggtcctcgtgcgctgttactccgggtacaaccgttcgggcctcgtcgtcggccacgccctggccctgcgcgggtgccgggccgacgaggcgatccggctgatccgcggccgccgttcgccgtgggccctgcacaacgagttgttcgccgactatctgcgggcgggcctggcaacggcccggctgctggaggagctgggggagccggccgagtagccgatcgttttctcaccttcgccgcctacgctgcggacgcccgccgcctacgatccgcggacgcagccgggccccgccccgttcgccctcgccccggggggggccggagcccgtacgcaaaaaggacttccatacgaataaggtgtacgggcccccaactcatccacctaccccacccccggagagcagtgttccgcagacgtcccgccctcgtcaccgccgccgtggccctgctgctggccacggcggcgggctgcggcgacgcgggcggcctgcgcgccgcgggcaccacaccgaccgcgatcagcccggcccggctgtggccctcactgcggccggccgcgagccccgcgtggccgtacgacgaggtgcagatcgagacggtgaaggggatcaccgcccccggcgacgacatccgcaccgtcgatccggtggccgtcgtacgggcggaggccgccgcgcatccggacgactacaagggcgccaaggcgccctaccgggacacgaccgcccgcctggcggactgcggagcggggccgggccggggcggctgtcccgtcctgcggccgtactaccgtgacctcaccggtgacgggcgcgacgacctgacgctgggcttccggctgtaccccaccaaccagacggccgtccgtgtctacaccttcgagaagcaccggctcgtgcaggtcttcgccaacgacgacgcggtgatcggcgtcgagctggccgggcgcgccgtgatcatccgctcgccggccgggatcgccgggtacgagtaccgcacgacgtggtcctgggacccggaccagcgggcgatggtgttctcccgcgacgagttcctgcgcacgggcccgcacaagccgacgcgggcgcacaccccggcggccaccgccgcgccgtcgcccgtgccccggccgacaccgacccccggcctcaccccgtcggccacctcgtcggccgccccgtccggaccggacccggccgcaggggcggaagcagcggccatgccgtccacgagcggccgatgaggaggcaggtggcgctcccccggtggaccgggacgctcgccgtgaaagccgcggccttcatcacggtgatgtgctgcgcgctggccgcgctgctcggcatcctcgtgcacgtctcggtgaccgaccagaccgtcggccaggcgcgggagctggcgctggcccggcttaaggacgccacgagcgcgttcgagtccggggacacactgctgccgggcgcgggcgtcgacccggagggtctgccgccgtcgctgcggcggctggcggcggacgggcggcgcggcacggtggtcgggcggcaccacgggcggcccacgatgtgggccgccggccccgccgaccacggacggacgctggccgtcgaggtcgactactcgcagcaggcgcacaccatcgccggtctggacaacgccatcctgtggtcgtccgggctggcgatcggggcgacgctgctggtg

SEQ ID NO: 1879 - DNA, 942 bp, Unknown
  Kingdom: Bacteria, Phylum: Actinobacteria, Class: Actinobacteria, Order: Streptomycetales, Family: Streptomycetaceae, Genus: Streptomyces
gcgcgcaccgcgaaggacgtgctcggcgaactcgacgcgctggtcggcctggagagcgtcaagcgggaggtgcgcgccctcatcgacatgatcgaggtggggcggcgccggcagcaggcgggcctgaaggccgcttccgtcaagcgccatctcgtcttcaccggctcccccggcaccggcaagacgaccgtcgcccgtctgtacggcgagatcctcgcctccctcggtgtcctggagaagggccatctcgtcgaggtgtcccgcgtcgacctggtcggcgagcacatcggttccaccgcgatccgcacccaggaggcgttccagcgggcgcgcggcggtgtgctgttcatcgacgaggcgtacgcgctctcgcccgaggacgccgggcgcgacttcggcaaggaggccatcgacacgctggtgaagctgatggaggaccaccgggacgcggtcgtggtgatcgtcgcgggctacacggcggagatggagcgcttcctgtccgtcaacccgggtgtggcctcgcgtttctcgcgcaccatcaccttcggcgactacggtcccgaggagctgctgcggatcgtggagcagcaggccgaggagcacgagtaccggctggcggcgggcgccgcggaggggctgctgaagtacttcacggcacttcccaggggcgccgcgttcggcaacggccgcacggcgcgtcagacgttcgaggcgatggtggagcggcacgcgagccgggtggcccagctcgacgacccggacaccgacgatctgacgctgctctacgccgaggatctgcccgagctgccctgaagcccggggcgcccggtggccctgaagcccggggcgcccggtggcccggtggctctccggggcccagcaggagtggtggggcggaggtgaccccgacgacgaggggaccgtcgtcggggtcacctccgc

SEQ ID NO: 1880 - DNA, 829 bp, Unknown
  Kingdom: Bacteria, Phylum: Actinobacteria, Class: Actinobacteria, Order: Streptomycetales, Family: Streptomycetaceae, Genus: Streptomyces
gcgcagcagcggggccgcctcggcgttgaggaagccgacgacacggccgcgcgtcgccaccccgccggccttgcggtacatctgctcgtagtgcgtacgggccgcgcgcagcatcccgatgtcggccggggtgacccggtgccggccgccccgcgagacgtccacgtcctcgggcgggttctcccactcccacaccggcatcacggcgggggtgccggtgacggcgggcgcgcccaggacgtgcgggcgctgctgctcgtcggagcgccacagcgcggtggcccgttcgacgaagccggacagggaggtggcgtgcggggcggacggctcgccgggcacgcccaggccgatgtcgtcgagggtgacggaccggcgcaggcggccggccagcacctcgcagatcagatcgggcacctggccgcgtggccgctggcccttcaaccaccgtgccacggcggtgtgttcgtagcgcagggcgaggccgcgtgcccggcccgcctggttgacgtgcgcggccagaccggcgtgcgagatgcccgcctcgtccaggatcgcgtcgagcagtgtgttgggctgcatgtcgggccccccgggtggctcggtggggacagcgtagtgcggggcggttcacacggggtgtgaacgaagtgcccgcgtccgcacggtgcgctcgctgtcgcgcggggtgggcgcccggttcactgagatgcctcgtcaagaggccggccgggccgcctgctccccctcttacagtgcggcggcccgctcccgcgccgcccgctccgccgcctgcccgacactccgtggcggggcgggcggcgaccagggg

SEQ ID NO: 1881 - DNA, 836 bp, Unknown
  Kingdom: Bacteria, Phylum: Actinobacteria, Class: Actinobacteria, Order: Streptomycetales, Family: Streptomycetaceae, Genus: Streptomyces
cccgccgcgtccagcgccatcgccgcctcggtgtggtcccacgggtcgaggtggtggccgcggaaccaggggatggcgccgtcctcccgctgggcggcgaggatgccgtccacggtcgcggcggcctgctcggcggtgaggaccccgggcaggacgaggtgttctgtccggggcgtggtcacttggcgtccgcccggggcaggtggggcttggtcgcgtacgccacgaagctcttgccgatcagcgggttcagcgcctgctcggcgacccgggtggccagcggcttcttcatgatgtcccagaccagcagcttgtggtacgccttgacgggcagcgcctggtcgttgtcgacgccgaaggcgcacttgagccaccagtacggggagtgcagggcgtgcgcgtggtgggtgccgtacggcttcaggcccgcctcgcggatcttggcgaggagttcgtcggccttgtagatgcggatgtggccgccctcgacctcgtggtaggcgtcggacagggtccagcagaccttctcggggccgtagcgcggcacggtgatcgcgatccggccgcccggcttgagcacccggaccatctcggcgaggacgcccttgtcgtcggggatgtgctccatcacctcggagatgatgacgacgtcgaaggactcgtcggggaagggcaggttgagggcgtcgccttccatggcggtcgcggtggcgccggcgggcgcctcaccggcctccttcatcgccgcgaaccacttggcgacctcgcggatctcctcgccgttctggtcgagggcgacgacctgcgcgccgcgccggtagcactcgaacgcgtgc

SEQ ID NO: 1882 - DNA, 536 bp, Unknown
  Kingdom: Bacteria, Phylum: Actinobacteria, Class: Actinobacteria, Order: Streptomycetales, Family: Streptomycetaceae, Genus: Streptomyces
tctcggtcgcccagcgggcccggcgggcgaccgagacgccctcgggcagctcctcgtcggcctcgtccgtcgggctgcccggctcgacgcggtcagccaagggcgtctcgtcctccagcgacatccgcgcgggcgtctcggatatccgtaccggcgtctcggaatcggcgcgtccactcatggcgggcgagcgtagcgcctgcgcgctgcagctctgacgtggggtcgcaggcggtgacgccgacgacgtgacgcccgtgcggcaagaccggcggagccacccgcgagaccaccggcacggccggcacgacaggcagcgcgagcgcccccggtaccgctcatgagaccgtccacgcccccgtgagaccccgcgagtctctcgcctcctgcggtcttgccgccgacggatgacgaggcgagacgcaccctgggggatgcatcgcacccgacgcatcccccagggtcactgctcgctgtcgtcggcgcctcagccctcgctgacgcccagcttctggaggatcagctccttgacgcgg

SEQ ID NO: 1883 - DNA, 1621 bp, Unknown
  Kingdom: Bacteria, Phylum: Actinobacteria, Class: Actinobacteria, Order: Streptomycetales, Family: Streptomycetaceae, Genus: Streptomyces
gtcgagatcgagtgggccgtcccccggccgacggcccactcgatctcgacggccgccttgaaggtgatcccgtgccgccgccgcgcgtccgccgtgatccggcgcaggaacgtacgaccgcacccgggatgccgcgcgccctcctgcgtgatccggtcgaccggcgcccaggcccagccgggctgcccggccagggccaccaggcggtcgaggtctggatagaggcgcaggtcgccgtccggggaacccagcacgtccgtggtgacgatcgagtcgtcggcgaggaaggtgtcgaacaccggcgacatgcccacgccccacgccgccgcggcggccagccgcgccaccggcaccgtcttgacccgggtgatcccggcggtgtccacgtaggcgaggacgacgccgtgcacgccccgcgcggccagttcaccggcgagcgcaccggcccgctccacatctccggggcgaccgccggggacggggtcggcgagggtggtcatacgtactcctcggagcgttcctcggggcgtgcggcggtgcgccgcgccgcccgcgtcagggcttcaccggtgtaccgcgccgcccgcgtcagggtttcaccgccaccgcgccgaactgcggcaccacgggggcggaacctgccccgggccgccaccgcgagcacggcaccagacccggctcgaccaggtccaggccctcgaagaaggcggcgacctcggcgcgcggccgggcggtgatcgggggagtggcgttctcgttccagaacgccatggcgcccacgttgccctcgccgccgaggtcggcgtcgacggtggggtgggtgaggaccaggcaactgcccgacgggaccgccgacatgacccggcggacgatgtcgcgcgccttgccggtgtccagcacgaagttcaggacgccgagcatcatcaccgcgacgggccgggcgaggtccagcgtggccgcggcccgctcgacgacggcgtccgggtcgtgcacgtccgcgtcgatgtaggcggtggcgcccgccggggtgctgctcagcagggtgcgtgcgtgggcgaggacgagcgggtcgttgtcgacgtacacgatccgcgcctcgggggcgagctgctgcgctgtttcatgggtgttgtcgaccgtcggcaggccgctgcccaggtcgaggaactggcgcatgccgcgctcggcggtcaggaagcgcaccgcccggccgaggaagtcgcggtccgcgcgcgcgacctcacggatcaccgggaacatcccggccacgtgctcgccgacctgccggtcgacctcgaagtggtccgtgccgccgatccagtagttccagacccgcgcgttgtgcgccaccgccgtgtccagcctcggcgacccacccgacggggcgttgctctcgctcacgtcgcactcccggttcgtgtccgcccacggcacggcgcaggccgcgcgccgcccccgccattgtgccgcgcggtgatcaccgtgtcccgggaatcggcggacccggacggtcccggcgtcggcaccgccgccggcggcgtttgcccctggacggtgcggcgtgtttgtctcgggggtcggcgccgagcccgtccccgtaccgctcccgccgccgcaccac

SEQ ID NO: 1884 - DNA, 748 bp, Unknown
  Kingdom: Bacteria, Phylum: Actinobacteria, Class: Actinobacteria, Order: Streptomycetales, Family: Streptomycetaceae, Genus: Streptomyces
gcacgatccgctggccgccggtctggacggcgatgggccgctgacccccggcgtcagcgcggccgtgcactcggcggagggcctgcgcggggccctggaggaggcacggcacgcgcggcgcgtcgccgcggcccgccccggccgggtctgcgcggccggccaccaggaactggcctcgcacgtcctgctgctccccttcgtccccgacgacgtgcgccgcgccttcaccgcccggctgctggacccgctgcgcgactacgaccgccggcaccgcgccgagctgatcccgaccctggaggcgttcctcgactgcgacggctcctggacccgctgcgcgacccgcctccacctgcacgtcaacacgctgcgctaccgggtcggacgaatcgagcagttgacgggacgtgacctgtcgcgcctggaggacaagctggacttcttcctggccctgcgcatgagctgaggccggcgcgggcagggtcggtgaggcgggggccggccgtccgcccacgactttgtgaaatccttcacccacccccttggccgggccgctggattcgtgctgagatgcggccaccactcaaggctcgaaggcgtgctcggggagggcaacgtggcgcataccgccatgtctggttacggaacgaccgccggtgacgatccactccagaccgcggtatggcggctgcgctcacgcgcgtgctgggccgacgcggcggcactgctgccggcggccaccgccgccgcc

SEQ ID NO: 1885 - DNA, 622 bp, Unknown
  Kingdom: Bacteria, Phylum: Actinobacteria, Class: Actinobacteria, Order: Streptomycetales, Family: Streptomycetaceae, Genus: Streptomyces
cctcgttgcacgcgaggccggccgcctctcgtcgcgccgtccgtcctcgccgaggcggaagcggcgctgtcccgcgccggcctcgcgggcaacgaggaggcgttcttccggatgctgcacggctggtgcccgccggtgacctgacggcgcggcccgacccgcctcagcagaccggtacggtcaccgccgtcgccagcaggccctcccgtacgatccagcggccgtcgaagcgggtgatgcgccgctcgcccagctgcggtccggggacgaggagttgggcgcggaaggtgccggtgcgcggagtgccggtctgcgaggcgtcggcgtgcggggcccctggggctgggcggaggtccacgtcggcctgagtgaagtccagccactggccggtcagcgggaaccacgccttgtagacggactccttcgcgctgaacagcagcctgggccagtggatgtcgggccgttgctccgccagctggtccagcctgcgccgctcgccgggcagcgagacggcgggcaggaccccttccgggaggggtgcgtggggttcggcgtcgatgccgagggaggccacgtcggcggcccggcccagcgcggcggcgcagtagccgtcgcagtgggt

SEQ ID NO: 1886 - DNA, 845 bp, Unknown
  Kingdom: Bacteria, Phylum: Actinobacteria, Class: Actinobacteria, Order: Streptomycetales, Family: Streptomycetaceae, Genus: Streptomyces
ggggccggtggttcctccggcggcggcaagaaacgcggaccgggctccgggacgggcaccggcaagacgaccggccccggcaccaagagccccggcaagggcacgggttcgggcgggaagaccacgcccggcaccaccagctcgaagggccccggcaccggcaagggcacggggaccggcccgaagagtgggacgaagaagtcgccgcgcggtacgaccggcccgtccgggatcctgcgcaagaagcccggcaccaccacctccggcaccggtccgaagaccaagccgaaggggaagggcggcagcggcgcgggtaccacggcgcccggcagcaagcgcggcgggaagaagggcaaggcccgctccggcaagggtgggacggtcccggccccggtgcccacggcgccgggcgggaagtcccgcaagggcaagaaggtcaagctcacgccggggatcgcgcacggcaccatggcggcgtcggacacgtacggctgccggtgccgcaagtgccgccgcttcgaccgcgagtacggcaagaagatggacgcggcccgcaaggccgcggctcggggccggaccaccttcggtgaggcggtgcacgagaccgctgagaagcggctcaagcgccgccgcaagaagatggggccgcccatcgtcaccaaggtcaaggtcaagaagccgaagaagaaggccggcccgaagaccaagaccaccaagcccggcagcaccacgcccgccgggcccgccgcgaagactccggccgggccggcggcgaaagcgccggcccgtcgcacgccctggtccacggccaaggcgagggcccgcaagcgcgcccggatgcgcac

SEQ ID NO: 1887 - DNA, 1878 bp, Unknown
  Kingdom: Bacteria, Phylum: Actinobacteria, Class: Actinobacteria, Order: Streptomycetales, Family: Streptomycetaceae, Genus: Streptomyces
ccgccgagatggcgctcggccagtacgtgcgccgcggcgacggacaggccgagcgccatctcggcggtcaggtccgcgttggcgacgccacgcacgccgtccgtgccgaagagtcgtcccacttgtcctcctgaggaagcgtcagttcgtgaagccgtgccgaggatttcagcgcgcgttcaccgttcactgggttcgatgttctcgatgcgcccgcggatcccggagccgggcatcccatcacacgagccgttgagcggctgagcactaaagcacctgagcactagagcaccttgtgccgttatacgcccacggccggtgataaacgaacgccccggcggcacagtggcgtgccgccggggcgttcggagtaggcctgtccgcaggcagccgcagattagcgcttgctgtactgcggagccttgcgggccttcttgagaccggccttcttgcgctcgaccgcacggtcgtcgcgcttgaggaagccggccttcttgagcgggccgcggttgttgtcgacgtcggcctcgttcagggcgcgggcgacaccgagacggagggcaccggcctggccggagacaccgccaccggcgatgcgggcgacgacgtcgtaacggccctcgagctccagcaccttgaagggctcgttgacttcctgctggtgcaccttgttcgggaagtagtcctcgagggtgcgaccgttgatcttccacttgccggtgcccgggacgatccggacgcgggcgatggcgttcttccggcggcccaggccggcggccggctgcggctcgccgaagcgggaggccatggactccgaggtgtactcgccctcgacgggcacctcggactcggtggtgtagctctcgatgtcgatctcttcgatcggctgctcggcagtggtctcggccacgattctcctcagattctgttcagtcttagggggtggccggacttactgcgcgacctgggtgatctcgaacggcaccggctgctgggcgccgtgcgggtgctggtcacccttgtagaccttcagcttcgagagcatctgacggcccagggagttcttcgggagcatgcccttgacggccttctcgacggccttctccgggttgttcgcgaggaggtcgtcgtagcggacggagcgcagaccgcccgggtagccggagtggcggtacgccatcttctgggtccgcttgttgccggagaggtgcaccttgtcggcgttgatgatgatgacgaagtcaccagcgtcgacgtgcggcgcgtagatcggcttgtgcttgccccgcagaagggtggcggcagtggtcgccaggcgacccaggacgacgtcctgggcgtcgatgacgtgccactggcgcgtgatgtcgccgggcttggggctgtacgtacgcacggttcgtagccttcgcttcttcagtgaatggtcctgacaaggtcaccgaagacgatcacgacagccctgaccgcacagcggtgacgcaaaccgcgtgctggtcgctggtcatcggcccggtggaccggtgtaagggccgggtccgtgagaagagccaagccaatacacaacgaacaagcagagtacccgcgcggcgcaccagcggtcaaaacggggtcaccgggcaggtctcccgcatgttccgccccagtgtacgaccgctgtccgaccgccccgctccgccgccgccgacgccgttaggatgcgggccatgagttatgggcaggggggcggctcacagtcccagtgggacccctggaaaccgaattcccagcagtcctggaacagcggcggcgacgaccagaccccggactgggcggcactcgccgaggcctccgcgacccgcgccaagcggcgccggctgctgttcgtcggcgggggcg

SEQ ID NO: 1888 - DNA, 2427 bp, Unknown
  Kingdom: Bacteria, Phylum: Actinobacteria, Class: Actinobacteria, Order: Streptomycetales, Family: Streptomycetaceae, Genus: Streptomyces
tacgaggcccggcaccgccccgactggctgcccgtgccgctggcggcggtgccgggcctcgtagaggacctcgtagaccgccttgtcggtctcgtaggcccgcagcagcaccgggtcggtacgcgggtcgcgcccgccggcctcggcgtacccggtgcagtacgcggcccggcaggccgccgcccactggggcgcgggcgggccgccggccgagtgcgccgcgtagtcgaaggaccgcagcatcccggcgacgtcccgcaccaccggctgggccatccgccgctcggcgagcggcttggccggttcgccctcgaagtcgatcagcgaccactgaccggacggggagcgcaggcactgcccgaggtgcaggtcgccgtggatgcgctgggcggtccaggtgtggccctcggcggccagatcggccagcgccgcgaaggcggagtgcagcccgggggcgtacggcctgagcgcgggcaccgcctgggccgccgcctccagccgctcggccatcgccgtccaccagcgactggacctgcaggtgcgccaggctgaccgtgggcagcgcgcgggccagcgccgtgtgcacctcggccgtggcacggcccagcgctcgcgcctcggcggtgaagtcctcacccttggccagctcgcgcagggccagctcccagccgtccgaggcgccctgcacgaacggctggagcaccccgaggacgtacgcgtcgtcccccgcctccccgacgtcggcggtcatccaggcggccggcgccggaacccgggggcagccctcgcgggccagcgccagcggcagctccagatcggggttgacgccgggcaggacccggcgcagcagtttcaggatgaacgtatctccgtagacgaccgacgagttggactgctcggcggtgaccatgcgcggcaccaggtcgggccgtatctcctcgcgccgctcgaaacgcagcccgccgatgcgggcccgggtgcgcagggcctccaggatcacctcggcgggccgcgtgtcgtacagggcgtcgtacacggtgcgcccggcgagccggccctcgtggacgtggccgatcagcgcgggcgccagcctggggggcagcgcctcgcgcacgcctatgagcagctggtagcagtcgccggggtgcgggacgacggcgccctgcgcgggcgagagcggctggtgggcgcggacgagcaggtggtgcaggcccagcttgccgtcggacgggagcagctcggtggccgcgaccagggagaaccccgtgaccgggcggcctttgcccgcgaaccagcgctgccggggcagccactcgtgcagcagcgggtccagggacgcgagcaggccggcgccgccggcggtgacagagcgtgtgacggcttgcgacatggcttccgacatggcgtcgcgtccaatcgctggtcgggtgtgactcacgcgtgcccacgagcggggcggcggaaaccgccccgcccgtgggcctcggccctgaggacctaggcggcgtccctgcggagccggaaccagtagaagccgtgccccgccagggtcagcaggtacggcagctccccgatggccgggaagcgcaccccgccgaacagctcgaccggatgccgaccgatgaacgaactgaggtccagctcggtgggctgggcgaagcgggagaagttgtgcacgcacagcaccaggtcgtcgtcgtactcgcgcaggaaggcgaggacggccgcgttcgaggactgcagttcggtgtaggtgccgaggccgaaggcggtgttctgtttgcggatctcgatcatgcggcgggtccagtgcagcagcgacgagggggaggacatggaggcctcgacgttggtgacctggtagccgtagacggggtccatgatcgtggggaggtagaggcggccggggtcgctggaggagaagccggcgttgcggtcgggggtccactgcatgggggtgcggacggcgtcgcggtcgccgagccagatgttgtcgcccatgccgatctcgtcgccgtagtagaggatcgggctgccgggcagggacaggagcagggcggtgaagagctcgatctggttgcggtcgttgtcgagcaggggggcgaggcggcggcggatgccgatgttggcgcgcatgcgcgggtctttggcgtattccgcgtacatgtagtcgcgctcttcgtcggtgaccatctccagggtcagctcgtcgtggttgcgcaggaagatgccccactggcagttggcggggatggcgggggtcttggcgaggatctccgagaccgggtagcgcgattcacggcgtacggccatgaagatgcgcggcatgacggggaagtggaaggccatgtggcattcgtcgccgccgccggtgaagtcgccgaagtagtcgacgacgtcctccggccactggttcgcctcggcgag

SEQ ID NO: 1889 - DNA, 583 bp, Unknown
  Kingdom: Bacteria, Phylum: Actinobacteria, Class: Actinobacteria, Order: Streptomycetales, Family: Streptomycetaceae, Genus: Streptomyces
cccggcccggcctgccgcgtagccgacgaggaaggtggtcaggggggccgcgggccgggccacaccgtgggccgcgtcgcgcgcgaggtcgagcagtacgccggtgtcgacgtccaggtcgatgcccagttcgtccttgactgcggaaatccattcatccagcacgtgcccatgctccctgatgcgtgccctggcggtggcgatgtcgtcccaggtgtcgcagtcgaaagaggcgacgtcgtcggggacgcgggtgaggtcgagcgctccggtcagccggcgcagcggaaggccggtgagggtgccgtgttcctgggcgaacaccgccagtccgcggcgcagcgcgtgcgcgcggtaggccgccacgagcggctggtcgcggccgtcggcgtcggtgagcagcgcaccgtcggcgcggttcgcgcgcagcgtggcgagcagccgccgtaccgtatccgtccggaggaagggcaggtccgcggagaggacgacgaccaggtccgccgtggtgtggcgcagtcccgcggcgagcgcggcgagcgggccgccgccgggcggatcctcgcgcgcccatcgcacgggc

SEQ ID NO: 1890 - DNA, 1726 bp, Unknown
  Kingdom: Bacteria, Phylum: Actinobacteria, Class: Actinobacteria, Order: Streptomycetales, Family: Streptomycetaceae, Genus: Streptomyces
gcgccaggtccgcgagcgcctcctgacccgccggcgaggtgtcgggcagcttgcccgaactctccttcacccccagataggtgccggtgatcgggtcgagggcgatgagttcgtcgacgtaggcgtcggcgacctgacggggcagcgggctgttggtgtctgacatgtggacatcctcgtacgggaagagggtccgcgtcagcccggtttgccgggcgaaggaccgaatccggtcgcggccggcccgatttcgctcagggcgtcgcggttccggtcagggcgtcgcggtttcggtcagctggcgccgttttccctacggggcaccggcccggtccgcccagggggctcgccgttcccgtcagggggccgatgtctccgtgcccggtggcagcaggggaccgcagtcccactgctggaagatcagccgggtctccacccgggccacctcgcgccgtgccgtgaactcgtccagcacgagccgctggaggtccgccatgtccgccaccgccacgtggacgaggtagtcgtccggcccggtcagatggaacacggtccgcgactccggcagcgcccggatccgttcgacgaacggccccaccagttcccgccggtgcggtctgacctgcaccgacagcaacgcctgcaggccacgccccagcctggccgggtccagccgcagttgatggccgaggatcacgcccgagcggcgcagccgcgtcacccggtccaggcaggtcgagggcgcgacgccgatctgcgcggcgaggtcgcggtaggtcgtccgggcgtcgttctgcagcagccgcagcagatggagatccaccggatccagtacgactgattccgccatgtgccgaacgtagcacggccgacccgccggtagccccgtccggtgttcacccttccgtcatggacacgcccttggactcagcgagcacgtccgcccacggcaacccgcgccccgcgccccgagcactggccaccgaggccgtgcacgccggccgggaggacctcgcccggcagggcctgcacgccccgccgatcgacctgtccaccacctacccctcctacgacagccgggccgaggccgcccgcatcgacgccttcgccaccgacggcgccgagttcgaagggccgcccgtctacggacggctcggcaacccgaccgtctcccgtttcgagaccgcgctcgcccggctggagggcaccgagaccgccgtcgccttcgccagcggcatggccgcgctcagcgcggtcctcctcacccgctccgccctgggcctgcggcacgtcgtcgccgtccgtccgctgtacggctgcagcgaccacctgctgaccgccggactgctcggctccgaggtgacctggaccgaccccgcgggcatcgccgacgcgctgcgcccggacaccgggctggtgatggtcgagtccccggccaacccgacgctggccgaggtggacctgagggccgtcgcccacgcctgcggatcggtgccgctgctggcggacaacaccttcgccacgccggtgctgcagcgcccggccgcgctaggggcccggctggtgctgcacagcgccaccaagtacctgggcgggcacggtgacgtgatggccggcgtggtcgcgtgcgacgaggaactcgccgggcggctgcggcaggtgcggttcgccaccggcggcgtcctgcatccgctcgccggctacctgctgctgcgcggcctgtcca

SEQ ID NO: 1891 - DNA, 2136 bp, Unknown
  Kingdom: Bacteria, Phylum: Actinobacteria, Class: Actinobacteria, Order: Streptomycetales, Family: Streptomycetaceae, Genus: Streptomyces
gcccggcgcgcgtagcggcggtcgacccgcgccgccgcgtaacccagccccaggaaccccaccgccatgccggccgggccgaagtcgatccacagctccgcccacaccggcgacgagaggttcgtgttcgtcgcccccatccactggccgaccaccacgccggtgtccatcggcttgcccggccacaccgaccggggcaccgcgaacagcaccgagcccgccagctggcggccgtaggtgtggccgcgccccgaccgcacgtacgtgacggtgttggcgaacatgacgacctggtcgtagtccttcatggccagcggttccaggggcgacgtggtctgcagcggacggtagttggcgtcgtcgtagcggaaccggtccgcgaacgggaagacgatcagcgccaccaccacgcccaggctcagcgcgatccggtacagcgcggcgctcaccgggaagacggtgaacagcatcgagaacaggacggtgaggaaccagaaacgcgggttggagaccgggttgttgaccaccgcgttcaccgcggccagcgccagccacacggcgatgaccgccgcggagcggcgggcccgccgcgaggtcaccagccaccgcgtgtacgccagccaggcgatcaggacgggcacggtgcccagaccgcgcacgatggcctggcccgcctgcgagtcctcctgggagagcccggcctcctggacgctgctgatgatctcctggcggctggtgaagaagaccgcgggcccgcccagcttgaccacgaggagcgccgaaccggcgaaggcgaggagggtcagcaggtacagccgacggcggtgcaccagcgccggccgaggttcctggtcccgttcccggcccggccgctggcgggccagcagcgaaccgatgtcgaaggcgacgcagccgatcaggaccagagagacggcctcggtcagatcggtgcgcgcccccaccaccggcgtcggcgtgcgtccgagcaccgcctgcgcgagcggcgccacccccatcgccatgtagacgaacagccagaacgaaccggcgagcagtttgcggcggctggtgaggatcatcgccgagagccggacgcccgcgtacatcgtcagcgccagctgcatccacagcgcggagtcacgcagaccggtgcccggctgcaccagcaccagcagcggcaggaacaccgagaagccgagcacgagcgggaccgacagcgcgcgggacaggagcgtgcgcggtgagaacgccggcagcgctcccgggccccgcgcacccgtgtccggtttccgggccgccggtgcccccgccgccggtgtccctgccaccggcgcccccggcgtcgtcgtcacgcttcggtccctctggtgctgcgtcatggcgcccccgcccccggaaaagatccccgccgcagtctactgacgagagggccgcggggaacggccagcgactagagtgggcgaagcggcgtcaggggaggcgccgtcggggggttggatcgatgcgtgatctcacggccttcacactggccgggtacgacaagggccgcggcctgctcgtccaggcgctctggttcgccgtgctgaacaccgtcttcatggcgtggttcaccccggcccgcgtcaggacggccctgctgcgcgcgttcggcgccgacatcgggaccggagtgctcgtccggcaccgggtgcgagtgctgtggccgtggaagctgacggtcggcgaccacacctggatcggcgaaggcgcgtggatcctcaacctggagccggtcaccctcggcgcacacgtgtgcgtgtcgcaggaggcactgctgtgcaccggcagccacgaccaccgcgccgcagacttccgctaccgcaacgcgcccatcaccgtggacgacggcgcctggatcgccacccgcgccaccgtcctggccggagtgaaggtcggccgctgcgccgtcgtgggtgccggagccgtcctccacaaggacctgcccgaacggaccctgcacaccgccgacaaccggcgccgtcccgtggaggagccggcgtgagagtgctgcacgcggtcaccctgcacagcacgacccacgccttcggcggcccggtccgggtcgccctcaacctctgccagggcctgcgggcacgc

SEQ ID NO: 1892 - DNA, 958 bp, Unknown
  Kingdom: Bacteria, Phylum: Actinobacteria, Class: Actinobacteria, Order: Streptomycetales, Family: Streptomycetaceae, Genus: Streptomyces
gagaagcagaaggcggccgagcgggcgagcgagctggtccgcttcgccggccggcgcggatccctcgccgtcctcatcggtctcgccgtgctcctgctcacccgctgggcggtggccggcatcgccgccggcgtcctcgtcttcttctgggaccgcctcttcggcggcgccgcggcggagcgctccgccatgcgccgcgtggaggccctggcctcctggacggagtcgctgcgcgacacgatcgcgggcgcggtcggcctggaacaggccatccccgcctccgcccgggccgccgccccggtgctccgtccccacctggacgccctggtcgaccggctgcgcgcccgcaccccgctgcccgacgcgctgcaggtgctcgccgacgagatcgacgacgcgtccgccgacatcatcgtcgcggccctcatcctcaacgcccggctgcgcggccccggactgcgccaggtgctgggcgcgctggccaagtcgtcgcgcgaggaggtcgacatgcgtcagcgcgtgatggcccagcgggcctcgacacgccgctcggtgcagatcgtcgtcgcggtctccatcgcgttcgtcctcggcctcgccgtcttcaaccgcgacttcgtcgcgccgtacggcaccccggtcgggcaactggtcctcgcgctcgtctgcgccctgttcgcgctcggcttctggtggctgcgcaagctgtccaccatcgagacgcccgaacgcttcctggtgcacgacgagtcggcggtgcggttcgtacggccccgcacgcccgcccagcaggaggaaggggtacgccggtgaacctgacgatgcccgtgctggtcggcgcggtggccggcctcgggatctacgccctcgtacgcgcactgatgcccaccaagcgcagctccgtcgcgcaggtcgcgcggatcgacgccatgcgggcgcgcggcgcggcgtacgagac

SEQ ID NO: 1893 - DNA, 927 bp, Unknown
  Kingdom: Bacteria, Phylum: Actinobacteria, Class: Actinobacteria, Order: Streptomycetales, Family: Streptomycetaceae, Genus: Streptomyces
ccccgggagccaccccggccgcccccctgtgggaccgcccggagcgccgcgcctcctaccgcctgccggcgagctggcggcgctaggcagggtgcgggcaggaggacgacaggcacgggccgacacgagagggagcacatggacatgaacggcacggagcgccgccactacccggtacggagccgccacgaccccgtacgcagcggaccacgggccgagcccaccgagcggccctggccgcgggcgctgctggcaggggaggaggagcgtggcgatgagccgcacatccaacggggcatcgactgaccggcctgaccggcccggcgcggcccgcaccggcctcctccgccgcccggaacccacgggacgtgacgccggcatcggactgatggcctccctgctgccgccgccggtggtggccgtggagtcgttcggcgacgggcaggagggctggcggggggcgctgctgcccgccgaggcgcggcacatggcgaccgcgggagagaaacggcggcgggacttcaccggcgtacgggtgtgcgcccggggtgcgttgcgggtcctcggctacgcgcccgtgccgctgctgccgggaccgcggggagaaccgcgctggccgccgggcgtgatgggctcgatgacccactgccggggctaccgcgcggcggtggtcgcccgcccgcgaccgggcctggcgggcctcggcatcgacgccgagccgcacgcctggctctccccggacgtgctggagggcgtggcgagccccggcgagcaggcgcagttggcgatgctggccgacggctggccgcacgtgcactggggacgcctcctgttctgtgtgaaggaggcggtgttcaaggcgtggtatccgctggcccgtaccgaactgggcttcctggaggcggagatcgccttccggccggccgg

SEQ ID NO: 1894 - DNA, 873 bp, Unknown
  Kingdom: Bacteria, Phylum: Actinobacteria, Class: Actinobacteria, Order: Streptomycetales, Family: Streptomycetaceae, Genus: Streptomyces
gccgggggacggggcatgggcgggtcctccacaggtacgggcacggcgcgaaccggacggtcctcccaccgcaccaccgagtcacggctgccaccaccgcgccggtccgtccgggtgaggcggctcccgcggcaaggcatagggtcggtgcgaaggagcgcacgcacgtttcccagggagcccgccgtgaccgagctgtccacctccgacgccacccccgtgatcatcgactgcgacacgggcgtcgacgacgcgctcgccctgctgttcgccgtccgccacccgggcctcgacctgcgcgcggtgacctgcgtggccgggaacacggacgtggaccaggtcgtacggaacacgctgaccgtgctggagcaggcgggcgcccccggcatccccgtggcgcggggcgccgagcgcccgctgatcgagccggtgcgcaccgcgctgcacgtgcacggccaggacggcatgggcgacctcgggctgcccgccccggcgcgcagggccgccgacgtggacgcggtggcgctgctgcgccgcgagatcctcgcctcgccccgcccggtcaccctgatccccaccgcgcccctgaccaacatcgccctgctgctgcgcacccaccccgaggtgacgcgcaacatcgagcggatcgtgttcatgggcggcgcggtggccaccgggaacgccacggcggtcgccgagttcaacgtctggcacgacccggaggccgccgcgatcctgctcaccgccggggtgccgatcacgatgtacgggctcgacgtgttcgagcgggtgatcgtcccggccggtgacgtgcggcggctgagcgggagcaccgaggcgggggcgcggctggccggccggctgctgtcccac

SEQ ID NO: 1895 - DNA, 991 bp, Unknown
  Kingdom: Bacteria, Phylum: Actinobacteria, Class: Actinobacteria, Order: Streptomycetales, Family: Streptomycetaceae, Genus: Streptomyces
ctggccgtcctgctgtccgaccatggacttggtggccggcgcgtcgagcgcggtgaccccgaagacgacggagtcggacagcaggacggccagtggcagggcctgttctacccggcctccggcaacgcgtcctcgtccttctcgatcccggccaaggcgaagttcacctggaaggtcaccgtcggcctcggcgcccactaccccaccaacgacagcgacttcacgctgaccgccgacggcatgcgcaacaacgtcgaggccgacccgtccggcagcacggtcgtcttcaagacgaagccggagacgaagccgggccagttgaacacgtcgtggaagtgggacggtgtcgtcgcgcggcccggcaagcgcacgagcctcgtgctgaccacgaaggccacgggaccgggcgagttcccggcgcaggtgaaccgcacggtctacgtcgacggccccaccccgtcgggcaccctgcgcaagcgcctgatcctggaggcggaggtcggcggcaagatcgtcacgatgaaccagaccgacgcgggtgtctgggagcttcccccgctgccgaagggcttcggcgccgcatcgggcccccagaacctcaagctgtacttctcgctgagcttcaacacctacatcgacaaggagatctccttcccgctgcgggccgcctactccatgggcgactcctacgagttcaacggctccgcggtccaggtgaaggccggtccagagaaccccggcacgagcacccccgccccctccggctcctcgaccaaggccccctccggttccggctccggctccgcctccgccgagcccaccgccgccgcctccaccacggcaccggccggtgccaccggcggtagcacgggcggcggcaccggcaccaccctcacgaccgctgccggcggcggctcgctcgcccacaccggcgcctcctccacggggctctacagcgccctcgccggcgtcctcgtcgcgctcggcggcg

SEQ ID NO: 1896 - DNA, 2279 bp, Unknown
  Kingdom: Bacteria, Phylum: Actinobacteria, Class: Actinobacteria, Order: Streptomycetales, Family: Streptomycetaceae, Genus: Streptomyces
gacggggccgtcggcgagcgcggcgaccggcggcaggaagcgcatcaccgtgcccgcgttgcccacgtcgaccgtggccgggccgtgcagccccgccgggatcacccgccacgcctcgcccgagccgcccgcgccggaggagctggaggacaccgtctcctcgatgccgacgcccatcgcccgcagcgcgccggccatcagcagcgtgtcccgggagcgcagcggacggcgcagccagcccggctcggaggccagggcggccagcaccagggcacggttggtgaccgacttggacccgggcacgtggaccgtcgcgtcgacggctccgctcgcgtgcggggcgggccagagggcggtgtgggcggggttcggggccatgggcccactctataaggagggcgtcacaccggccttcctgcggtggacggggtgatcggcacggcggcggtgccggtgaggcgggacgtgcggcgggccgctcacgtcccgagcagccagcgcccgccgcccatcagcgagcacagcgacaccgcgtggaagaggaagagccacagggccgccggtacgtgcgtcagccgcgccagctggtccgcgtccgagtccccggcgcccccgcgcgagcgcttcatctggagttcgaaggcggggcgcaccccgccgagcagcaggaaccacaccaccgcgtacgcgaacgccgcctgcacctgcgtgcccgccagccaggacaccagcaggaacgtgccaccggtgaggaccacggtcagcacgccgtacgcgttgcggatcatcaccagcatcgcgaccagcagcgccgtggccacccacagcagcagcgtgacgcgtccggcggccagcagggcggcgccgcccagacccagcagcgggggagcggtgtagccggaggcggcggtgaggatcatcccgaggccgtacggcttgccgcggctgacggtgaggccgctggtgtcggagtgcaggcgtatcccggtcagcgtgcggccggtgagcagcgcgaccaggccgtgaccgccctcgtgggcgatggtgatggcgttgcgtgacaggcgccacagggtgtgggggaccaccacggccagcgcggcggccgcggtgacgagcaccacccacaggtcgggtcccggctggctgccgacgagccggtcccacaggccgggcagcgccatggaggcgaggctgtccatgtttacgagcggctccctcttgtcgtacggagtctggcagtgtggcacgcatgtgcggacggtatgcagccagtcgcggggccgaggatctcgcgggagtcttcggcatcgagaagtgggagccggaggagaccctggagcccgactacaacgtggcccccaccaaggaggtccacgtcgtcctcgaccgccccttgaaagacgcgcaggacacccgcccggttcggcagctgcgcaagctgcgctggggcctggtcccgtcctgggcgaagagccccgagggcgccgcccggatgatcaacgcgcgcgcggagacggtgcacgagaagccgtcctaccgccgcgccttcgccacccggcgctgcatcgtgcccgccgacggctactacgagtgggtcaccggcaccgaggagcgcgacctggaggtcgagggcaggcgcaaacgcccgcgcaagcagccgtacttcgtgacacccgcggacggatcggtgttcgcgatggcggggctgtacgagttctggcgggaccgcacgctgcccgacgaccacccgagggcgtggtgggtgacgtgctcggtgatcaccacggaggcggagacggccccgctggcggtggccccggccgaggggccgcgttcgctggccggcatccacccccggatgccgctgatgctcactcccgaccgctgggacgcctggctggatccggcccgcacggaccccgaggacctgcggtccctgctggcgccgccgcccgagggcctgatgcgcgcctaccccgtccccacggcggtgagcaacgtccgcaacaacggccccgagttgctgaaggaactggcggcaccggaagagggcacgctcttctgaccacctgctgaccacgctcttctggcatcctctcccaggtgacccctgtgacccctgacacacgcgagaccgtcgagacggaagcgggaccggcccgcgtcacctggcaccgggccgcgcacgcacgtctcgtcctcgccgtcggtcacggcgcgggcggcggcatcgaggcccgcgacctgcaggccctggcgcgcacgctgcccgggca

SEQ ID NO: 1897 - DNA, 2101 bp, Unknown
  Kingdom: Bacteria, Phylum: Actinobacteria, Class: Actinobacteria, Order: Streptomycetales, Family: Streptomycetaceae, Genus: Streptomyces
gctcatggaccaccacagcgtcggccaccgcgccggcgcccacctgcacagccgcggccgacgccgcatcggcgtggtcgtgcccgaggaaccgggcctccacgcgttctcccggccccgcctggagggcgtacggcgcgccctgtgcggcacgggcgcgaccgtcaccgaactgccactcggctacgacgaggagtccgcggcccgcctcgccgcccgctggcgcccgctcggcctggacgcggtcttcgcctacaacgacgagtacgccatgctcctgatgcgcgcactgcaggacgcgggcctgcgcatccccgaggacacggccgtcgtcggcgccgacgacctgctgctgggcaggctgctgcggccgcggctgagcaccgtccacatcgacctgcccgccggccgcgacctggccgccctggtcgaccgcgccgtacgcgatccgggcggcgaacccgaacggcacccggtcctgggcgccacggtggtccaccgcgagtccagctgacctgcggcggccccgggcagcagggccaccggcggctactcgccggactgctcagcctgcgcctgctgctcggcgaccgccttgcggacctcgtccatgtcgagcttgcgggcctggccgatcacatccgccagagccgcctcgggcagcgcgccgggctgcgcgaacacggccacctggtcacgcacgatcatcagcgtcgggatggactggatcccgaaggccgccgccagctccggctgcgcctccgtgtccaccttgccgaacaccaggtcagggttgtccgtggccgccttctcgtagaccggggcgaacgaacggcacggcccgcaccaggacgcccagaagtcgatgagaacgaactcgttctccgtgaccgtctggtcgaagttctccttggtcagctccacggtgctgctcatggcgtgatccctcttcctggtgtcgggttgagccgtccgcacaacacggccgaccctacgggctattccgtgcgcgcaaggcactgccccgcgcgcgtacccatgtggcctgcgggcacaccacccaccagactgaccccatgacggaaacggaaaacctcgcgtacgacgtcgtcgtgctcggagccgggccggtcggcgagaacgtggccgaccgcacccgcgccgccggcctgtccaccgcgatcgtggagagcgaactggtcggcggcgaatgctcgtactgggcctgcatgcccagcaaggccctgctgcgcccggtcattgcccgcgccgacgcccgccgcctgcccggactgagccaggccgtccaggggccgctggacaccgccgcggtcctcgcccgccgggacgagtacacctcgcactggcacgacgacggccaggtcggatggctggagggcgtcggagcggacctgtaccgcggccacggccgcctcgcgggcccgcgcaccgtgacggtcaccggtccggacggcacactcacgacgctgaccgcccggcacgccgtcgccgtctgcaccggcacccgcgcccagctgcccgacctgcccggtctcgacgaggtcgggccgtggaccagccgcgaggccaccagcgccgagcaggtgccgaggcggctcatcgtggtcggcggcggtgtggtcgccaccgagatggccaccgtcttccaggccctcggctcccaggtcaccgtgctggtgcgcggcaagggactgctgtcccgcatggagcccttcgccggtgaactcgtcgccgacgcgctcaaggaggcgggcgccgacctgcgcaccggcacctccgtggagtccgtgacccgcgagaacggcaccgtcgtggccgtcaccggcaccggcgagcgcatcgaggccgacgagatcctcttcgccaccggacgcgccccgcgcaccgacgacctcggcctggagaccgtcggcctggagccgggctcctggctcacggtcgacgacaccctgcgggtcgacggcaccgactggctgtacgcctgcggcgatgtcaaccaccgcgccctgctcacccaccagggcaagtaccaggcccggatcgcgggcgacaccatcggcgcccgcgatccgggcctggt

SEQ ID NO: 1898 - DNA, 1903 bp, Unknown
  Kingdom: Bacteria, Phylum: Actinobacteria, Class: Actinobacteria, Order: Streptomycetales, Family: Streptomycetaceae, Genus: Streptomyces
gccccggccgacccccacggcaaggagtcctgatgcgcatcctcgacccccacatccacatgacgtccaggaccaccgacgactacgaggccatgcgcgccgcaggcatccgcgccgtcgtcgaacccgccttctggctcggccagccccgcacctcacccgcctccttctacgactacttcgactccctcctcggctgggaacccttccgcgccgcccagtacggcatcgcccaccactgcacgatcgccctgaaccccaaggaggccaacgacccccgctgcctcccggtcctcgatgaactgccccgctacctggtcaaggaccgcgtcgtcgccgtcggcgagatcggctacgactccatgacacccgccgaggacaccgcgctcaccgcccagctccagctcgccgccgaccacggcctgcccgcgctcgtccacaccccgcaccgcgacaagctcgccggactgcgccgcaccctcgacgccgtcgccgagtccgcgctgcccgccgaccatgtcctggtcgaccacctcaacgagaccaccgtcaaggaggccaaggacagcggctgctggctcggcttctccgtctaccccgacaccaagatggacgagacgcgcatggtggccctgctgcgggagtacggccccgagaaggtcctggtcaactcggccgccgactggggccgcagcgacccgctcaaaacgcgcaaggtcgccggggcgatgctcgccgagggcttcaccgaggacgacgtcgaccgggtgctgtggcgcaacccggtcgccttctacggcatcagcggacgcctcgacctcgacgtcaccgagcccggcaccacccacgagggcaactccgtgctgcgcggcggggagtgagcgatgcggttccggcaccccgacggctccaccgtccacctcgcctactgcaccaacgtccaccccgccgaaacgctcgacggcgtcctcgcccagctccgcgaccactgcgagcccgtccgccgccgcctcggccgcgaccggctcggcatcggcctctggctcgcccgcgacgccgcccgcaccctcgtcaccgacccgtccgccctgcgtggcctgcgcaccgaactcgaccggcgcggcctggaggtcgtcaccctcaacggcttcccctacgaggggttcggcgccgagcaggtcaagtaccgcgtgtaccggccggactgggccgacccggaacgcctcgaacacaccaccgccctcgcccgcgtcctcgccggtctcctgcccgacgacgtcaccgagggcacgatctccaccctgccgctcgcctggcgcaccgcccacgacgggacacgcgccgcccgcgcccgtaccgcactgcgcaccctcgccgaacgcctcgacgccctccaggacctcaccggccgctccctgcgcatcggcctggaacccgaacccggctgcgtcgtcgagaccacgcacgacgccatcgccccgctcaccgagatcggccacgaccgcatcggcatctgcgtcgacacgtgccacctcgccacctcgttcgaggacccgcacaccgccctggacgccctgaccgaggccggtgtccccgtcgtcaagtcccagctgtccgccgccctgcacgccgagcagccgcaccaccccgaggtccgcgccgccctcgccgccttcgacgagccccgcttcctgcaccagacccgcgccctcaccgcgcacggcccgctcggcaccgacgacctcggcgaagccctgcacaccgacgccctcccggacggcggcccctggcgctcccacttccacgtccccctgcacgccgcccccgccgcacccctcacctccaccctgcctgtcctgaagaccgccctgacccggctggccggcggcccgcacccgctcac

SEQ ID NO: 1899 - DNA, 1969 bp, Unknown
  Kingdom: Bacteria, Phylum: Actinobacteria, Class: Actinobacteria, Order: Streptomycetales, Family: Streptomycetaceae, Genus: Streptomyces
gccgggtcctgggcggactccggcacgtggtgcggccggccgatcaggccccgcagctcgcccacggtgacggtgaacggcagttcccgctcgcccagttcgtgctgggccgccaccttgcgcagcagccgcgcgacggaccgctccagggtgcgcacgcccgcctcgcgggtgtactcgcccgcgagcttgcgcagcgcgccctcgtcgatcgtcacctcgtcctggtcgagaccggcccgctccagctggcgcgggagcaggtggtcgcgggcgatgacgatcttctcgtcctcggtgtagccgtccagtcggacgatctccatacggtcggcgagggcctcggggatcgcctccaggacgttggcggtggccaggaagacgacgtccgacaggtccagctcgacctccaggtagtggtcccggaaggtgtggttctgcgccgggtccaggacctccagcagggccgctgccgggtcgccgcggtagtcggagccgaccttgtcgatctcgtcgagcaggaccaccgggttcatcgacccggcctccttgacggcgcgcacgatccggccgggcagcgcgccgacgtaggtgcgccggtggccgcggatctccgcctcgtcgcggacaccgccgagggcgacgcggacgaacttgcggcccatcgcgtgggccacggactcgcccaggctggtcttgccgacaccgggcggccccaccagggcgagcacggcaccgccgcgccggccgccgatcacgccgaggccccggtcgctgcggcgcttgcgcaccgccaggtactcggtgatccgctccttcacgtcctggaggcccgcgtgctcggcgtccaggatcgcccgggcgccctggatgtcgtagacgtcctccgtccgctcgttccacggcagttccaggacggtgtccagccaggtgcggatccaggagccctcgggcgaggcgtcggaggcgcgctccagcttgtcgacctccttgagcgcggcctcacggacgtgcccgggcaggtcggcggactcgacgcgggcccggtagtcgtcgctctcctcgccctcgctctcgccgttcaggtcacgcagttccttgcgtacggcctccagctgacggcgcagcaggaactcgcgctgctgcttgtcgacgccttcctggacgtccttggcgatggtctcggcgacgtcctgctcggcgaggtggtcgcgcagctgccgggtggcgagccggaggcgggccaccgggtcggcggtctccagcagttcgatcttctgttcggtggtcaggaacggcgagtaaccggagttgtcggcgagcgcggagacgtcgtcgatggcctggacgcggtcgacgacctgccaggcgccgcgcttgcgcagccaggcggtggcgagggccttgtactccttcaccagttcggtgacctggccgggcaggggctccggcacgctctcgtcgatccgcgtgccctcgacccacagcgccgcacccggtccggtggtcccggcgccgatgctcacccggtcccggccgcggaccagcgcgcccggatcgccgtcggccagccggccgacctgctcgacggtgcccagcacacccgtcttggcgtaggtcccctcgatgcgcggcaccagcagcaccctgggcttccccggctccgaccgggcggcggcctgggcggcctccaccgcggcccgcacgtcggagtcgctcaggtccagcggaaccaccatcccgggcagcacgacctcgtcatcgagcggcagcacaggcaggacgagcggtgtgaacgccgtggactcagcagccatgatctccccttcggcagtcaagttgagctatgccgactcaatgcacgggcgcggctgattgttccccgacggctgttcgccgtcagcgatcacgggggaaggaaaattccggacctggcggaggggacgtgcggggcgggtcagcgggcgcc

SEQ ID NO: 1900 - DNA, 718 bp, Unknown
  Kingdom: Bacteria, Phylum: Actinobacteria, Class: Actinobacteria, Order: Streptomycetales, Family: Streptomycetaceae, Genus: Streptomyces
gaggagggaggcgaggcggaccgcggcggcctcgcggttgcgccactgggagcggtgctcactggcgcggacggtgacgacgccgtcgacgagccggcccgccagccggtgcagggcgcgctccttccacacctcgggcagcgcctcggtgcgcgcgaggtcgaagcgcagttccacctggctgtcggtggtgttgacgtgctggccgccgggccccgaggaccgcgtgaagcgccaggccagctcggcctcggggagcgcgacggagccgcggatgacatagggaccggacatgtcctccatggtcccgcgcctgtccgggtcacgtcaccgggttttcccggtaccggcttggtaaaaaaggtaaagacatccggaaccatggggacccctctcggcgttcctaggggtggcggtagcttcgtccgcacacgcaacgagggaagggactcccaacaatggctgtaagcctctccaagggcggcaacgtctcgctcaccaaggaagccccgggcctgaccgccgtcaccgtgggcctcggctgggacgtccgcaccaccaccggcacggacttcgacctggacgcctccgccatcgcggtcaacgcgcagggcaaggtgtactccgacgcccacttcgtcttcttcaacaacaagcagaccccggacagcaccatcgtccacacgggcgacaaccgcacgggcgagggcgcgggcga

SEQ ID NO: 1901 - DNA, 1586 bp, Unknown
  Kingdom: Bacteria, Phylum: Actinobacteria, Class: Actinobacteria, Order: Streptomycetales, Family: Streptomycetaceae, Genus: Streptomyces
gcctggccggggccgacccggaccgggtcggccgcgcccgcggcgacgtccccgacgacctcgagggcggccgggaactcctcgctcgctccggcgacgtccgcgacccggaccgcgtagccgtccatggagctgttgtcgaacgggggcagcgagagcggcaccatgacgtcctcgacgaggacgcacccttgtgcgtcgagcagttgcagctcgatgggttcgagcgggcggacggtggtgaggacgtcctccaggtgctcgtcgaccgaccacaggcggtccgggtctgcgatgtggtgcgcgtcgctgctcaacgtcgttacatctcctcggctacgtaccgctgaagccaggtcctgaagtcggggcccaggtcctcacgttcgcatgcgagtctgacaatggcacggaggtagtcgccgcggtcgccggtgtcatagcggcggcccttgaagaccacgccgtgcacggggccgccggcggtctcctcctgggcgaggcgctgcaggccgtcggtgagctggatctcgccgccgcggccgggctccgtcttgcgcagtatctcgaagatgtgcgggtcgaggacgtagcggccgatgatcgcgtagttggacggggcgtcggccggctcgggcttctcgaccaggccggtcacctggacgacgtcgctgtccccggtggcctccacggccgcgcagccgtagaggtggatctgttcgggcgcgacctccatgagggcgacgacgctgccgccgtactggccctggacctcgatcatccgctgcagcagcgggtcgcgggggtcgatcaggtcgtcgccgagcagcaccgcgaagggctcgtcgcccacgtgcggggccgcgcagagcaccgcgtgccccaggcccttcgggtcgccctggcggacgtagtggatcatcgccaggtcgctggactcctgcaccttggcgagccgttcggagtcgcccttcttctccagggccgattccagctcgtagttgcggtcgaagtggtcctccagggggcgcttgttgcggcccgtcaccatgaggacgtcgtcgaggccggcggagacggcctcctcgaccacgtactggatcgccggcttgtccacgaccggcagcatctccttgggagtggccttggtggccggcaggaaccgggtgccgaggcctgccgcgggaatgacagccttgctgatcctggggtgtgcgtgactcatggcggccaccttaacggctgcgttgtgggggatccgcgcctccggttcattagatcgcatatgagcacatttactgttcgaggaagggcacgggagcgaccttgagtcacatcgcagggacggcggggcccggcaagcaggccctgcggcgggagttcctcgccgcacgcgaccggctgaccgtggacgacgtgcgcgaggccgccgacgcgctggcccggcgcgcgctggagctgccggagctggcgggggcgcgcacggtggccgcgtacgtctccgtgggcgccgagccgggcaccctcgcgctgctcgacgcgctgcgcgcgcggggtgtgcgtgtgctgctgcccgcgctgctgcc

SEQ ID NO: 1902 - DNA, 1846 bp, Unknown
  Kingdom: Bacteria, Phylum: Actinobacteria, Class: Actinobacteria, Order: Streptomycetales, Family: Streptomycetaceae, Genus: Streptomyces
cgggcggccgtaggcgatggcgtcgcggacggtgcccgggaagaggtacgcctcctgcggtacgacgccgagccggtgccggtacgccgtgatgtccaggtcgcgcaggtccgcgccgtccacggtgatccggccgccggtcgggtcgtagaaccgggcgaccagcttgaccagggtcgacttgcccgcgccggtctcgccgacgaaggcgacggtctgcccggcggggatgcgcaggtcgatcccggtcagggcctcctcctcgtcgccgtaggcgaagctgacgtcctcgaaggcgatctcgccgcgcagcgcgggcacctcgcggggctcggcggccggctcggtggacgtcggctcctggaggagttcctggatgcggccgagcgagacgctggcctgctggtagccgtcgaagacctgggagagctgctggacgggcgcgaagaacaggtcgatgtagagcaggtacgccaccagcgcgcccgtggtcagcgtcgccgcctccacccggctcgcgcccgcgatcagcacggaggccgccgcgaccgaggacaggagctgtacgaacgggaagtacacggagatcagccactggccgcgtatccgggcccggcggtagctgtcgctgcgctcggcgaaccgccgtccgccgtcctgctcccgccggaacgcctgcacgatgcgcagtccggccaccgactcctggaggtcggcgttgaccaccgagacccgctcgcgggcgagctggtaggccttgacgctggcccggcggaagaagaacgtggcgatgaccagcgggggcagcgtcgcgaagacgaccagcgccagctcgacgtcgatcaccagcagggcgaccatgatgccgaagaaggtgaccacggagacgaacgcggtgaccaggccggtctgcaggaacgtagacagggcgtcgacgtccgtcgtcatcctcgtcatgatccggccggtcagctcgcgctcgtagtagtcgaggccgagccgctggagctgggcgaagatcttcaggcgcagcgtgtacaggacgcgttcgccggtgcggccggtcatgcgggtctcgccggtctgcgccgcccactgcacgagcacggcgagcaggccgagcagggaggcggcccagaccgcgccgagcgccatcttggtgacgccctggtcgatgccgtgccggatcagtacgggcagcagcaggcccatgccggcgtccacggcgacgaggccgaggctggccagcaggggcagcccgaagccgtgcagcaggcggcgcaggccgtaggaggtctcggggcgtacggcgcgggcctcgtcgacgtccggggtgtcggtggccggcggcagggccgccacctgggcgagcagttccggggtggcgggcatgccggcggtggccgcgtcgcgcggttcgcgttcgcccgcccacagcgcgggtgtgatgccgcgttcggcgtcgaactcggcgtccagctcctcgcggaccgaggtgtcctccgggggcgcggcgggcagggcgtggcccggggagacgccgccgagttcgtcggggtcggtgagcaggcgccggtagagcgcggagcgttcctggagttcgtcgtgggtgccgatgtcggcgagccggccgccgtcgaggacggcgatgcggtcggcgaggccgagggtggagcggcggtgcgcgatgaggagtgtcgtacggccccgcatgacctgggccagggcttcgtggatctcgtgttcgacgcgggcgtcgacggcggaggtggcgtcgtccaggacgagcaggcgcgggtcggtgaggatggcacgggccagggcgacgcgctggcgctggccgccg

SEQ ID NO: 1903 - DNA, 509 bp, Unknown
  Kingdom: Bacteria, Phylum: Actinobacteria, Class: Actinobacteria, Order: Streptomycetales, Family: Streptomycetaceae, Genus: Streptomyces
gcccacccccgccttcaccggcgatagcgccgcccagggccccgccgggtaaaaccgcggccaagggcgaacttttgtccagggaatatgggtggattgcccagttgtaggggcgtggaattcgtcaccggcgtcgcccaatgctcaacaggccggatagtgtgagcgatccggtgccaccggccgcgaggtcaccctgaggtcgtgcactgtgaaccagacctgagcgcctcgggggaaggcgccgcgtggccccgacggagggttcggacaaccgtggacgcgcaaggccgtgggcgggcggacaacatcgatcccgcagaccagtgggtactcaatccggccactggcgaatacgaactgcgactgaatccttcccctccgcagtcggcggtccccggcccgcgcagatcctccgcccccggggcgggcggagcggccgccgggcgccgcggtgccccggcgggcaaggcccaggagcaggcgcacgagacggccccggcacccac

SEQ ID NO: 1904 - DNA, 531 bp, Unknown
  Kingdom: Bacteria, Phylum: Actinobacteria, Class: Actinobacteria, Order: Streptomycetales, Family: Streptomycetaceae, Genus: Streptomyces
  misc_feature (264)..(331): n is a, c, g, or t
gaacccctgccgacgccgagcggctaccgcctgcacgccacggaggtgtccgggacgagcggcctggtggaactggcgcaggcactggtccggccgcctgccggaacccccgtaccgggaggaacggtgagaacctcccatggctgagcccgtgatgcaccgtgtcgcacccgtgatgcacccaaggagtcccatgtcccggtccgtgtcccctccgtccccccgttcccgccggcgcagagccgtcgtcgtcggtgccggccnnnnnnnnnnnnnnnnnnnnnnnnnnnnnnnnnnnnnnnnnnnnnnnnnnnnnnnnnnnnnnnnnnnnctggccggcatgctggccgcggctgccctgtccggcgtcgtggacgaggtggtcgtactcgaccgggacgacctgcccggcgggcccgagcaccgcaaggggctgccgcaggggcgccacgcccatctgctgatggccggcggcctggccgccatggaggaggtggtgccgggcggcggcgtacgccagcggctgctggc

SEQ ID NO: 1905 - DNA, 935 bp, Unknown
  Kingdom: Bacteria, Phylum: Actinobacteria, Class: Actinobacteria, Order: Streptomycetales, Family: Streptomycetaceae, Genus: Streptomyces
tcaccgtcaacgccgtcgcccccggcctgaccgaggtcgaggccaccgagaccgtaccggccgaacgccacgccctctacgccacgaaccgggcgatctcccggccgcagcagcccgaggacctcctcggcctggtctccttcctgctcgccgacgagtcccgctacctcaccggacaggtgatcgccgtcaacggcggattcaccatgcactgacccccacccccgaaccgcctgcaaggagtacgtcatggatctcggcctcgccgaccgcacggtactggtcaccggaggcagttccggtgtcggcctggccacggtccgcgccctgctcgcagaaggcgcccgcgtcgccacctgcgggcgtgaccccgaacgcctcgccaaggccgccgcccggctcggcgcggacccggagcggctgttcaccggcgcctgcgacgtccgcgacgccgacgccgtacgccggttcaccgacgccgccgcgacccacttcggcgacggcctcgacggcctcgtcaacaacgcgggccagtcccgcatgaaacgcctggacgagacgacggccgaggactggcgcgacgaactggagctgaagttcgcgggcgtcctcaacccgctggccgccgcccggagtcacctgcgcgcctcggacgccgcctcggtcgtcaacatcaacgcggtgctcgccaagcagcccgagacccgcctgatcaccaccagtgccgcgcgcgccggcatcctcaacctctccacgtccctcgcccgggaactcgccgccgacggcatccgcgtcaactccgtctgcctcggcctgatcgacaccggccagtggacccgccggcacgccgccgccgacagcggcctgacctacgaggagtggcaggccgagcgcgatgccgcggtcggcggccagctcggcctgccactcctcgt

SEQ ID NO: 1906 - DNA, 921 bp, Unknown
  Kingdom: Bacteria, Phylum: Actinobacteria, Class: Actinobacteria, Order: Streptomycetales, Family: Streptomycetaceae, Genus: Streptomyces
tgagccggatctacctggacttcgccctcggcaaccgcggcatgtacgagctgatgttccgtcacgacctgctggagagcgggcacctgggcctgcgggacacgagtctgccgctcttcgccaccctggtggacctggtcggccgggctcgccccggggccgacgcccgcgcggtcgccggctcgctctgggcgggcctgcacggcatcgcccagctgtggggctggggcagcctccagctcgccaccggcgccgacgacgtcgaccgcgtgctgcgcacgacgctcgacgcgcacctcggcgcggagggccgcgggtgaaccgcgcgcacctggtgacgctggtgagcagcgtggccggcgcggtgatcgtcgccctggacggcacggtcctcaccgtcgcgcagcccgcgctgcgccgggacctggacgcgtcgtacgcccaggtccagtggaccagcaccggatacctcgtggcggtggcgagcctgctggtgttcgccgggcggctcggcgaccggtacggtcaccggcggctgttcaccgccgggatgctcggtttcgcggccacgtcggcggggatcggcctggcgcccggcatcggctgggtgatcggcctgcgcgtcgcccagggcgtgtgcggggcgttgctgcagccggccacgctggggatgctgcgggcacagttcccgcccgaccggctcgggatgccgctcgccgtacgttccggcgccatcgggatggcggccgcggccggtccgctgctgggcggggcgctggtggccggtcctggctggcggacggtgttcttcctgaacgtcgccccggccctggcgttcggcctgctcgccctcgcactgccccggcccgagcggacctgcgcccagccgaacggtgaccggccaccgtgcggcgggagcgc

SEQ ID NO: 1907 - DNA, 894 bp, Unknown
  Kingdom: Bacteria, Phylum: Actinobacteria, Class: Actinobacteria, Order: Streptomycetales, Family: Streptomycetaceae, Genus: Streptomyces
  misc_feature (631)..(695): n is a, c, g, or t
ggtcagccgcagcgcgccgcgcgagcccggtgcggcgatggccgtgggaccggacgacgaggtggtgggcagtgtgtccggcggctgcgtggagggcgcggtcttcgacctggcccaggaagtggtggcgagcggcgaggcacgcctggcgacgttcggttacagcgacgaggacgcgttcgcggtcgggctcacctgcgggggcgagatcggcgtgctggtcaggcccgtgacggccgagtcggacccggccttcggtgccgtcgcggcgtcggtcgcctccggcgagccggtgaccatggcgacggtggtcgacgggccggcgccgcgcggggcgacgctcgcggtgtggccgggcacggtggcggggacgctgggcgagcccggcctggacgtggcggtcacggccgacgcccggggcgaactcgccctgggtgccacggggacgcggcactacgggccgcacggcgagcgccgcgaggacgcggtctcggtgttcctgcactccttcgctccgcccccgcggatgctggtgttcggcgcgatcgactacgcggccgcggtcgcccggatcggctccttcctgggctaccgggtcacggtgtgcgacgcccgcccggtcttcgccacnnnnnnnnnnnnnnnnnnnnnnnnnnnnnnnnnnnnnnnnnnnnnnnnnnnnnnnnnnnnnnnnnagcggttccccgacgcggtcgaggtggtcgccgactggccgcaccgctacctgcactcgaccggcaccgacgagcgcacggtgatctgcgtcctgacgcacgacccgaagttcgacgtgccgctgctggaggaggcgctgcgccggccggccgcctacatcggcgccatgggcagccgccgtacccaccacgaccgcgt

SEQ ID NO: 1908 - DNA, 4391 bp, Unknown
  Kingdom: Bacteria, Phylum: Actinobacteria, Class: Actinobacteria, Order: Streptomycetales, Family: Streptomycetaceae, Genus: Streptomyces
gcgggcccgtgcgaggccggcggtgttgcgttcccagtcggtggggcgccgttcgccgggcagggggacggcgatgacgccctggacggcggcggtgtcggggctcgcctcggcgaggtcttcggtgagctggtcgcaccagtgcgggccgacctggacgtcgtcgtcgaggaaggcgacccagggggcggtgaccgcgcgcagtccggtgttgcgggcggcggcggggccgcgtccgccgctggtgagcacggtggtgcgggcccgcaggtcgcccaggacggtcaacgcgtgttccagggcgccgggttccggctcgggccggtcgtcgacgaggacgatctcctccggtcgcggcccgtgtgccgcggcgagcgcggccaggcagtcggccagggtgtcccgggcgagcgtgggcacgaccacggcgtaggagacgcgggcggcggtgttcatgcgtacgccctcgtcctgcgcaccgcgtacgggccgatggccagcaggtcgacgggggccgagccgaagcactccagcgcgtcgcgcgggtcgtcgaccatgggccgccccgcggtgttgaggctggtgttgacgacgacgggcagcccggtacggcgttcgaagccgcgcagcatccgtgcgaccaagggttcttgccgctcgtcgacggtctggaggcgtgcggtgccgtcgacgtgcaccacggcggggatgcgctcgcgccagtcgcggtggacgtcgtgcacgaagagcatgtacgggctgggcagcgggccttcgaagagttcgggggcgcggtcggcgaggaccatcggcgcgaccggccggaactcctcgcggcccttgacccggttgagccgttccaggttctcggcgcggccggggtgggcgagcagggagcggtggccgagggcgcgcgggccgtactcgctgcggccctggaaccaggcgacgacgccgtcgcgggccagttcctccgcgaccgcctcggcgatgtcgtcgggccgctcgtagggtacgccggcctcctccagccagtggctcagttcctcgtcgctccagccgcggccgaggtcggcgccgggcatcggcgcgggggcgccgccctcgctcgcggccaggtacagggcgccgccgagcgcggtgccggcgtcgcctgcggcgggctgcacccatacgtgccggtacgggccgcgcgcggcgatcttggagttggcgacgcagttgagggcgacgccgccggccagggcgagggcgtcgccgcccgcctcgcggtgcagccagtgcacgagttcgagcaggacctcctccaggacggcctggcagcttgccgcgaggtcggcgtggtcctgggtccaggcctcgtccttggcgcgcggcggcgccagcgtgctccagtcgacgccgtgggcgcggaagccgccgtcgccggtggcgtggacgtactggcgcaactggggcaggaagcggggctttccgtaggaggcgagggccatgaccttgtactcgtcgctgctgcgcaggaagccgaggtgggcggtgagttcctcgtagaggagccccagggagtggggcagggcctgggcggcgagcgtgtcgagcttgccgtcgtggaagcggcccgcgaggtgggaggcggcctcgccgcggccgtccaggacgaggacggcgctgtcggggtgcggggaggccgggcccgcggaggcggcgtgcgcgatgtggtgcgggacgaacacgaccttcgccgggtccaggccgggcagtgcctcggcgaggaactcgggggcgcggcgcgcgtactccaggcgcagcgggtcccacgggtcgaacaggcccaggtcggcggcgggccgggcgagggccgggtcgaaggagtaggtgacggcgtccagctcgtcggggcgcagtccggcgtgttcgaggcaccagcgtgcggagagttccggcagttcccacgcggagaacggcaccgggcgcttgccgtgcttgcggcggctgaagcgctcctcctcgccggccgcgaccgtgcggccgtcgacgacgagggcggcggcggggtcgtggaacagggcgttgattccaaggatgcgcatggggtgggctccgtcccgttgcggcggtggcctgcggtgcgggggcgagtcggggctgtcggacattccgggcttctgggtgccgcgcctcagctgtctcaaacacctgaagacaactggggcgcgccgaccaggcaggatcacgctgcgtgagtgctgctgccgggggcggtcctcaggcggcgaccgcccgggtgaaccagccgatggtgcgttccaggccctcgttccagggcacgcggggctgccagcccaggcgttctcgggcgagccgggtgtcgggacggcggcggccggggtcgtcgacggggcggtcgacgaagccgatgcgggagcgggagccggtcagctccacgatccggcgggccagctccagcatggtgatctcgtcgccgccgccgatgttcaccggccccggttcggcggaagcggccagggcgaggatgccgtcgacggtgtcgtcgacgtagcacagcgaccgggtctggctgccgtcgcccgcgaccgtgagcggggcgccgtccagggcctgtgcgatgaacgtgggcacggcgcggccgtcgccggtgcgcatccgggggccgtaggtgttgaagatgcgcacgatggcggcgtcggtgccgtggacggcgcggtgcgcggtgaccagggcctcggcgaagcgcttggactcgtcgtagacgctgcgcgggccgacggggttgacgttgccccagtaggtctcgcgctgcgggtgttcgagcgggtcgccgtagacctcggaggtggaggcgagcaggaagcgggcgccgtcggcgcgggcgcgctccagggcgttgcgggtgccggtgctgccgacgtcgagcgtctccaggggcagccgcaggtagtcggcgggcgaggcggggcaggcgaagtgcaggaccaggtcgaagcggccgggcaggccgcgcagcgcgccggggtcggtggcgtcggcgcggacgaagcggaagccgcgccgccgctccagttccgccacgttggcgtgactgccggtggccaggttgtccaggcagacgacgccggtgccggcgtcgagcagccgtgcgcacagatgggacccgacgaagccggcaccgccggtcaccagggcccggcgccactcgcgtccgctcacgggactctcctccctctcgcctccccccgcgttcactcacgtgacggcttgagtaacccggtgacggaccgccacacatcggcccgtcagggccggtcaggtgcgaaccccgcccgatccggggtgaatcccggccaaccgcaaccgatcacacgtgcgacggacgtctactcgacccccgctatacaccgcgtacatacaccctctgtaaagtcccccgcatgccttccttgaccaagaagaccaggaaaaacgggagaacggggagcaacgggacccggtttcgcgcgatcgccgcactcgccgccgcggccggcctcacggtggcgctgagcggctgcacgaaggtcgacgcgaccagcccgagcaccgcgcggacgcaggccgcggcgggcgcgccgggccggttcggttcggtcgactgccgtcaggccaagtgcatcgccctgaccttcgacgccgggccgagcgagaactccgcgcggctgctggacatcctgaagcagaagaaggtgcccgcgaccttcttcctgctcggcgcgcggcacatcgacacgtacccggaactggtcaagcggatggcggccgagggtcacgaggtggccagccacacctgggaccacaagatcctcacgaagatatccgaggcgcagatacgcgaggagctgcagcgccccaacgacgcgatcgaacggctgatcggacacaagccgacgctcatgcgtccgccgcagggccgcaccaacgacacggtgcagcgcatctccaaggagatgggcatgtcggaggtcctgtggagcgtcacggcgaaggactacacgacgaccgactccgcgctgatcaagaagcgcgtcctcgaccaggcgtcccgcgacgggatcatcctgctgcacgacatctacgccggaacggtgcccgccgtgcccggcatcatcgacgcgctgaaggagcgcggctacgtgttcgtcaccgtgccgcagctgctggcgcccggcaagccggtaccgggcaaggtgtaccggccgtagccgagccgcccgtccggacgcgggccgcggtcgtccgtggccgagccgccaggcgggcgcgggccgaccggccggtcaggtcccgtcgtccggcgtgagcgtgcgccggaagctcaggcccggccggcccttgat

SEQ ID NO: 1909 - DNA, 517 bp, Unknown
  Kingdom: Bacteria, Phylum: Actinobacteria, Class: Actinobacteria, Order: Streptomycetales, Family: Streptomycetaceae, Genus: Streptomyces
  misc_feature (180)..(182): n is a, c, g, or t
ggcacggtggcgatgttgtcgacgatggtgcggtgctggaagagcccggcgttctggatgacgtaacccatcgagcggcgcagggtgttgacgggctgttccttgatgtcggcgccgtcgaggaggacgcggccctcgctcggatccaccatccggttgatcatgcgcagggtggtggtnnngtccgggtaccgcttggtgactgaatctatgcgtatcaaaacgccgcatacccttcaggtctggcaggagctgcccgctctcggccacggtcgcgcgggccgttgcggagagagtctagacgcccgggatcgcggcagggtcgcagcacccgtgcggggcgcggccgttgacggcaccgcgccccggacacgacaccgcacccggcgtgacggccgaagccgccgcgccgggtgcggtgcaggagtcgacgaagcgcgcccgtcgagggtgcggcacgtgcgtcacgtgccgcgcccggggcccgtcaggtgcggccggggccgccgctgccgaa

SEQ ID NO: 1910 - DNA, 3951 bp, Unknown
  Kingdom: Bacteria, Phylum: Actinobacteria, Class: Actinobacteria, Order: Streptomycetales, Family: Streptomycetaceae, Genus: Streptomyces
cggtgggcagcaggtcgtcggcgccgccgggctgcgcgccgcgtggtctgccgcggttacccatgggcgccgtccgcgggagcgggcacgcgcgcgtaggcaccgggccgggtgaggtgggtccagtggcccagcggccaggcgatccagtcggcccggccgatcacgtccccgaccgggaccatgccgccgcccggtgagcccaggtggtcgcgcgagtcgctggagtcgctgcggtggtcgccgaggacgaacagcgtgccgtccggcaccacgacgtcgaagggcaccgcggaggggctgtcacccggatggaggaacgccgactcgtcgaccgaccgcccgttcacctcgatcctgcccttctcgtcgcagcagaccacatggtctccccccacgcccaccacgcgtttgacgtagtcggcgtcgccgaagtagccggtgccgtcgaacacgacgacgtcgccgcgccgcggaccggcaccgaaacggtaggccagcttgttcacgaggacgcggtccccgatcctcagtccctgctccatggatccgctggggatctggaacggctgcaccacgaacgcgttgacgagcagcaggaggaccaggccggacagcgcggacagggtcatccagccgccggggacgtggccggtgagccgcgccgccaacgacgaacgcgaccggtcctccggcccctgcgtgtccggaatccgttcggatccggcttcggaagggcgggaggagcggtcgcgctcggtcggctgtgcttcggtgtccatcggggcggaatgctatcccgccccgatgtgaaccccgaaagcgctcagttgtcgcgcttctccttgatcttcgcggccttgccgcgcagctcacggaggtagtacagcttggcgcggcgcacgtcaccacgggtgaccagctcgatcttctcgacgatcggggtgtgcaccgggaaggtgcgctcgacgccgacggagaacgagaccttgcggaccgtgaaggtctcgcgcacgccggaaccctggcgacggatcaccacgcccttgaactgctgcacacgggagcggttgccctcgatgacgcggacgtgcacgttgacggtgtcgcccggacggaacgcggggatgtcgtcgcggatcgacgcggcgtcgacggtgtcgagcaggtgagacatgtctctgctttcctcgctgatgccacaggtcatcaacggaaactaggattttccagaaggtctgccgggcggtcggggcggtcgtcgtgtccccctgtggcaggggcgcccgccggacggcgcacagcagcggcctattcttccacgtcgccggtcctgcgccaaaatcggccgtacggctcccccgcgggatcgggcgaccagcccaggatggacagcatctcgcggtccttcttgtcgaaggccgcgggagcgcagcgctcgatgaggtcgggccggttggccgtggtgcgccgcagggcctcgtcgcggcgccagcgggcgatcttcccgtggtggccgctgagcagcacgtcggggatgtcgtggccgcgccagacgggcggcttggtgtagacgggcccctccaggaggctcgccatggctccgggcgcgaaggagtcgtcccggtgggactccgcgttgccgaggacgccgggcagcagccgggccacggcctcggtgacgaccaggacggccgcctcgccgccggccaggacgtagtcgccgatggacacctcgtagacgggtatccgggtggcgtactcgtccatgacgcggcggtcgatgccctcgtagcgcgccggtgtgaagatcagccagggccgctcggacagctcgacggcgagttcctgggtgaacgggcggccactgggtgtcgggacgatcagcgcgggcgtgtgggcgcccgtctcgtagccgtcggcgaggacggagtccagggcgtcgccccacggctcggtcttcatgaccatgccgggaccgccgccgtagggcgtgtcgtcgacggtgttgtgccggtcgtacgtccacgcgcgcaggtcgtgcacgtgcacgttcagctgtccacgcgcgcgtgccttgccgacgagtgagacgttcagcggttcgaggtactcggggaagatcgtgacgacgtcgaggcgcatcaggaggcttcccctgagccgtcggagcggccgtgggggccgccgtcgggaccgtcggatccgtcggcggagccctccgcgtcgcgggcggaggcgatctcggcgcggtcgtcgatcaggcccggcggcggggcgatgacggcccgctgctcctccaggtcgatctcggtgacgatctcctccacgaacgggatcatcacctcactgccgtcggcgcgttcgacgatgaacaggtcctgggagggcaggtgcgagatctcggtgatccggccgacctccgtgccgtcctcggtgaccacgtcgaggtcgatcagctggtggtcgtagtactcgtcctcctcctcgggcagcgcgtccgggtcgatctcggcgatgaggagggtgttgcgcagcgcctcggcggcgttgcggtcggcgacgccctcgaaccgcagcaggaggcgtccgctgtggacgcggcccgtctcgatggtgagcggtcccgcggaggcgggatcggtggcgagtacggcgccgggcgcgagcctgagttccggctcgtcggtacgtacctcgacggtgacctcgcccttgatgccgtgggcacggccgatccgtgcgactacgagctgcacgtgtccagatctcctgtcatacgactgcgggccggggacggccctctacggccctccccggcccgagccggttgcgatgcgatgaagcgtcagcggacgtggtccacgtcgacgaggtcgacgcggacgccccggccgccgatggcgcccacgacggtgcgcagggcacgtgcggtgcgaccgttgcggccgatcaccttgccgaggtcgtcggggtggacccgcacctcgagcacgcgtccgcgacgcaggttgcgcgaggcgacctgcacatcgtcagggttgtcgacgatgcccttcacgaggtgctcaagcgcctcttcgagcatgctgctcaggcctcggaggactcggactcggcagcggcctcgtccttcttctcagccttcttcttctgggtgatggcctcacccttgccctcgtcctcgccgccgagcgactcgaacgacggacgggcggccttctcctgcggctgcagcagcggcgccggggcgggctcgcccttgaacttctgccagtcgccggtcttcttcaggatggcgagcacgggctcggtcggctgggcgccgacaccgagccagtacgccgcgcgctcggcgttgacctcgatgcgcgaggggttctgcaccgggtggtacagaccgatctcctcgatggcccggccgtcacggcgggtacgggagtcggcgacgacgatgcggtagtgaggcgaacggatcttgcccagacgcttcagcttgatcttgactgccacgggagtgggttctcctggaattgacgtggtggggcacggcgggacgccgcgtggggttgcggtacccgagtgcccgacggacgcgtcagccggaggagagaggggtcctgtgcggctgtcgagtacagctagccattgtgccacacccggcggcccccttccggcgctgggtggggcacctccggggcacgccacaggggcacccggcggccgggtgccgtcagccctccgagacgccctggaccggatcgccggacggcggccggagcgcggctgccacgagcagccgcgccctcagctcgccgcgcccacgacctccgggatccggaacggcttgccgcacccgccgcacacgatcggggcctgggccaggaccgaggggacgacgcgtacgttgcgcccgcagtcgcagaccgccttgacccggaccccgccgcc

SEQ ID NO: 1911 - DNA, 696 bp, Unknown
  Kingdom: Bacteria, Phylum: Actinobacteria, Class: Actinobacteria, Order: Streptomycetales, Family: Streptomycetaceae, Genus: Streptomyces
ggcggtgggcgacgccaacccggcgtacacggaccccgaggccgcccgcgcgctcggccaccccgacgtgatcgccccgccgaccttcgtgttcgcgatcacctaccgggccgccggtgaggtcgtccaggacccgcagctcggcctcgactacagccgcgtcgtgcacggcgaccagaagttcgcctacaagcggcccgtccgcgccggtgaccgcctgaccgtcacctccaccatcgaggcgatcaagtcgatggccggcaacgacatcatggacatccgcggcgaggtgcacgacgaggcgggcgagcacgtggtgaccgcctggatgaagctggtggcccgtgcggccgaggaggcgtgaggaaccgatgacggcgaagatctcctacgacgacgtcgaggtcggcaccgaactcccgggccgcaccttccccgtgacccgcgccaccctcgtccagtacgcgggcgcctccggggacttcaacccgatccactggaacgagaagttcgccaaggaggtcgggctgccggacgtgatcgcgcacggcatgttcaccatggccgaggcgatccgcgtcgtcaccgactggaccggcgaccccggcgcggtcgcggagtacggcgtccgcttcaccaagcccgtcgtcgtccccaacgacgacaagggcgccctgatcgaggtcgtcggcaagg

SEQ ID NO: 1912 - DNA, 3213 bp, Unknown
  Kingdom: Bacteria, Phylum: Actinobacteria, Class: Actinobacteria, Order: Streptomycetales, Family: Streptomycetaceae, Genus: Streptomyces
accgggaccctgacccatcgggccgggaccgcccatggggttcgggccgcccatcgggcccggacccatctggccctgcatcggaccggggccctggcccatcggaccgggaccctgacccatcgggccggggccctgcgggccctgtccgccggggccggcgggcagctgcggggcaccgctcggcagctggggcgggccacccatggggccgcccatctgctgctgcggcgggcccgatatgccggcgggcaccggagcgccgggacctcgcatgccctgctgaggcatcccaccctgctgaggcatcccgccctgctggggcatcccgccctgctgcggcatgccggggccgccgggaccctgctgcgggtgctgctggtcctgctgctccgggggcttgcgcatgttctgctggttctgcgcggcggcccgggtggccgcggccagcttggcgcgcaggtcctcgttctcgcggagcagacgcgtcagctcggcctcgacctcgtcgaggaaggcatcgacctcgtcctcgtcatagccttctcggaggcggacggtcgtgaactgcttgttccgcacgtcctcgggggtcaacggcatctcttcacctcaacgtagtcatcggcagtcggcaagaccgtatcgtccacagtcacgtcgcgagattccccacgatgtagatcaggatgtagacgatgatcatcaggacgaagaaggacaggtcgagcgccacgcccccgagacgcagcggcgggatgaaccgccgcagaagcttcagcggtggatcggtgacagtgtaggtggcctccagaacgaccaccatcgccttgccgggttgccacgagcgggcgaactggaacacataatccatgaccaaacggaagatcagcacgatgaggaacaccatcagcgcgatgtagagaacctccatggccacgcccatgatcggtgcttccctctcccctgttccgtgcctgttttccggtggtgcgtctcagctctggttgaagaacccgccctctgcgatgcgggccttgtcctccgccgtgacatcgacgttagcaggcgacaacaggaacaccttctgtgtcacccgctcgatgctgccgtggaggccgaacacgagaccggcggcaaagtcgacaagtcgcttcgcgtccgtgtcgtccatctccgtcagattcatgatcaccggggtgccttcacggaagtgttccccgatggtacgggcctcgttgtaggtccgggggtgaagtgtggtgatccggtacggctcacgttcggacacgaccttgggcatgatcaccggtgcgttcttctccaggctggcgcgttcttgtgtgatggatgccacgggcgcgatacgcgccggacgaggggattccgccgggagcgaagcggaatgggacacaggttcgcgtggcgccggaggctgcaccacgcgtaccggttcgtccctttgcggctgatgtgttccgtgcggctggtgcgacggttcgtgccgtcgacggtcccgctcaggctccgggtcgagttcgggttcgaagtcgtcatcggggtcgaaaccccggccgtcgtacccatcgtcctccacgaggccgaggtagaccgccatcttgcgcatcgcgccggccatgctctgagtcctccgctctgtggtggatcgactgacgaccgccaagtccccgcgatccacgaggtcgttgcgccttcttcggcggtattgaccatattttctgctgtggtccgacttcttggcgacgttacccgagcctggggcggactccgagtaccgcagtgccgacgcgcacatgtgtcgctccggcggccacggcctgttcgaggtccgcgctcatccctgccgagaccatggtggcagccggatgggcccggcgcaggtaggtcgacaaatccatgagccgttcgaacgccgcctgttggcgtccggcgtactcaccggtcagcggcgcgacggtcatcagcccgtcgagccgcagtccttcggcggccgcgatccggtcggccaactcctcgacgccgcccggcgccacgccgccccgctcgccccggccgctctcgccggcgtccagggcgacctggatcaggcaccccagttcgcgctccgcacgcacggcctccttggagagcgccgtgacgagccgggagcggtccacggactgcacgacgtccgcgtaaccgacgacggatcgcaccttgttggtctggagttgaccgacaaaatgccaactcaagggcagatccgaacattcggcggccttcggcgccgcgtcctggtcgcggttctcggcgacatggcgcacgccgaggtccgacagcatccgtacgtccgccgccgggtaggtcttggtgaccacgatgagggtcacgtcctcgcgcgggcgtcccgcggcggcgcacgcggcggcgatgcgctcctgaacccgcgccagatttccggcgagttcgtccttacgttccgtcatgcctcatcagtccagccagacatagcccgcgagccgaccggtggtgcggtcgcggcggtacgagaagtggtcgtccgactcgcgcgtgcacaccggcgactgctcccggtcgtgcacgccgagccgttcgagctgcgcgtgcactccggcgctcacgtcgagcgccggcgtgccccaactcgtctcggcgtacgcccccggctcgaccgcgcccacctcggcgcgcatcgcctcgggcacctcgtagcaccggccgcacaccgcgggtccggtgcgggcggtgatccgggcggggtcggcgccgagttccaccatggcccgtacggcggcgggcaccaccccggccaccatgccgggccgtcccgcgtgggccgcggcgacgatcccggcggacgggtcggcgagcagcaccggcgtgcagtcggcggtgaggacggcgagggcgagtccccgccgggtggtgacgagcgcgtcgacggaggggataccggccgcggtgtcccacggtccgtccacgaccgccacgtcggcgccgtgcacctggttcatccagaccacgcgggccgggtccagtccgagggacttggcggccagttcgcggttggtccgtacggcggccgggtcgtcgccgaccgcgccgccgaggttcagctcctcgtacggaacggcgctcaccccgccccaccggtcggtgaaggcgaagtgcgcgccgttcacggtgtcgcgc

SEQ ID NO: 1913 - DNA, 1416 bp, Unknown
  Kingdom: Bacteria, Phylum: Actinobacteria, Class: Actinobacteria, Order: Streptomycetales, Family: Streptomycetaceae, Genus: Streptomyces
gtgtacggactgggctgaccgccgcctccgggagcggcggcgaccactcccgagggcgccgcggtgacccgccggggcgctacgccttcgtcagcgaggcggccgtcccgacggacgccgcaggcagcccgtcgtccgcagacaggggccgctcgcgcagcgacagcagcacccgcagcacgcagatccacatcaggcaggaccccagcatgtggacgccgaccaggacctcgggcaggtgcgtgaagtactgcacgtagccgacgacgccctgggcgaggaggatcaggaacaggtcgcgggtgcggtcgagcggtcccttgggcgcgtcgacggccttcaggacgaaccacagggcgaacgtcagcgtcaccacgatccacgccagcaccgcgtgcgccttggcgaccgtctcccagtcgagcgggatgcggtcgacctccgcggagtcacccgcgtgcgggcccgcgccggtcaccacggtgcccgccgcgatcagcagcacgctcgcgacgaccaggaaccacacgagctgctgcaccgccttgccgaccagcgggcgcggctccgcgtcgccctcccgggtgcgctgccacatcaccgtggcgaccgcgatcagcgccgtggtcagcaggaagtgcgccgcgaccgtgtacgggttcaggccgaccaggaccacgatgccgccgagcaccgcgttgcccatgacgatccagaactgcgcccagcccagccgggtcaggccgcgccgccacggcttttccgagcgggcggcgatgatcgcccagccgaccgcggcgcacagcacgtacgtcagcatgcggttgccgaactcgatgacaccgtggaagcccatcgcacgggtcgtggtcagcgagtcgtcggtgcaggtcggccaggtcgggcagcccaggcccgagccggtcagccgcacggcgccgccggtgacgacgatgaccaccgccatgacgagcgcggccagggccgcccgctggacggtcctgggctgcggggtccagcgttcggcgatgaaggcgagcgggttgcgcacggcggatacggcgtcgtcgcgggtcaggttcggcacgcgtcccatcgtaggccgccgcttgtgcacgctttcacgagggtccgtttcgcgagggtccatgggatgtctccggttcctactcccagcggaagaacttcccggccgcgcccagcgccacgaccgcccacacggcgaggatcccggcgtcgccccacggcatgccggcgccgtgctggagcacgtcccgcagcccgtcggacagcgccgagatcggcagcaggcccagcacgtcctgcgcaccggaggggaacttgtccagcgggacgaccacaccgccgccgacgagcagcagcaggaagaccaggttggcggcggtgtggtcgtcc

SEQ ID NO: 1914 - DNA, 1055 bp, Unknown
  Kingdom: Bacteria, Phylum: Actinobacteria, Class: Actinobacteria, Order: Streptomycetales, Family: Streptomycetaceae, Genus: Streptomyces
gcggttccagtcgatgtggtgctgccgtcggtccgttggtcgtacaagttggtccagaccaattgcgttgtcaagaggtccagaccaaaatcgcgtccgccgatccgcccgccgatccgcccgccggtccgcccgccggtccgtccgcctgctcgtcggttgccgcgtccgccgatccgtccggccggggtcaagggaccggcgggccgccacgctttcgggctcgacaggaatggacaacctgccccgttttgatgtgacttgtgcgacccgagttgccacggagctgacgaatcgctgttctccggtcacagaggcgtggatacagtgctcaagtagtcacgcagtgaagtcaactcggtgcgccggaggaacgacggcggccggacgggcggcagacggggagctggcgtgtcaactgcgatcgctgtgaccggcgcggacatggcactgcccgcgcaggacgaacggaccgtgcccgccgccgtcctgccggacctggaccgcgaaccgctcgaacggacgctcgacggcatacgggcgctgctggagcagcacggccacctgatcgtcgtctgctcacgggcgctgtccgccgccgcggagcaccggctgcacacggtccgctcgctgctggagagcgaccgcatcgcgctcttccgcccggatctgccgccgctcgccgtcgccgtcctggcccgccagttacggcagctcgcctcctgcgacctcagcccaggcgtgctcgcctccgcgggccgtctgctcacccactacgtccactgcggcgcggtcctcaactccgtcacccgcctcgaccgcgtgcccgtcgacctcaaggcccacgccaggtcctgggtgccgggcagccagttcggcgtcgtcgcccaccccgcgccgcacctggtgcggatcggccccggagccaccctgccggggccggacttcggcacctggatgctcgtcgccaaagggcagctccagtccgactgggtcggcgcgcacctcgccccggcctggaaggtgctcggcctgcgcgaggccgcgctgcccgc

SEQ ID NO: 1915 - DNA, 1177 bp, Unknown
  Kingdom: Bacteria, Phylum: Actinobacteria, Class: Actinobacteria, Order: Streptomycetales, Family: Streptomycetaceae, Genus: Streptomyces
ggggtacgggccggcggcccgcgcgtcctggaccggctgctcgccctcgcccgcgacgacgcctgacacccgggcgaagcgagcgcgccggacggacggggcagctgacggggcgtgggacgagaggcggccggccgcggctaccctgcccgcatgaccgagccgacgagcagccccctgaagcccatgcccggcgactggcagcgcgccctcgccgtggtggcgcacccggacgacctcgagtacgggtgcgccgcggcgatcgccgcctggaccgacggcggccgggaggtcgcctacgtcctcgcgacccggggcgaggccggcatcggcacactcgaaccggacaggtgcggcccgctcagggagcgcgagcagcgggcgagcgccgccgtcgtgggcgtcacgacggtggagttcctcggccaccgggacggcgtcgtcgagtacggtcccgccctgcgccgcgacatcgccgccgcgatccgccgccaccgccccgaactggtcatcaccctcaaccaccgtgacacctggggcggcgtcgcctggaacacccccgaccacgtggccgtcggccgggccaccctggacgcggcgggcgacgccggaaaccgctggatcttcccggaactcaccgaacggggcctggaaccctgggacggcgtccgctgggtcgccgtcgccggctccagcacccccacccacgccgtaccggcagccccgggccatgagcgcgccgtgcgctcgctgctgcaacaccgcgcgtacatcgaggcgttgaccgacgaggacccggaacagtacgcgcgcgccttcctcaccgcgaacgccgaggcggccggcgagcggttcggcggcgaaccagcggtcaccttcgaattgttcggccggtgacgcggcgctgcgcctaggatgatccgcacggacgtgacggggtgtcacgccgacggggacggggacgggacacggtggacggcatgaccggcacggccgacgaggaagccctggcgcggcggttcgaggagcaccgggaccggctgcgcgcggtggcctaccggatgctgggctcgctgacggaggccgaggacgccgtccaggagacctggctcaagctcacccgcacggacaccgcaggcatcgcgaacctggccggctggctgaccacggtgaccgg

SEQ ID NO: 1916 - DNA, 603 bp, Unknown
  Kingdom: Bacteria, Phylum: Actinobacteria, Class: Actinobacteria, Order: Streptomycetales, Family: Streptomycetaceae, Genus: Streptomyces
  misc_feature (166)..(222): n is a, c, g, or t
ggccggctcctccgcggtccgtacggcggcccagtcggagacggccaccccgtcgaaaccccactcctccttgaggacgtccccgagcaggcaattcgcggtcatggtggtgccgttgacaccgttgtaaccggccatgacgagccacaccccggccgccacggcnnnnnnnnnnnnnnnnnnnnnnnnnnnnnnnnnnnnnnnnnnnnnnnnnnnnnnnnngacgaagtgcttggccgtggccgcgacgccctgcgactggatgccccggatcagggcggcgccggtgcgcccggccagctccgggtcctccgagaagcactcgaagtgccggccgcccagcgggctgcggtgcaggttgagcgtgggagccaggacgacgtccacgcccttgcggacggcctcggcggcgagcagcccgcccagttccgtcagcaactcctcgtcccagagcgcaccgagggccgaggccgagggcagcagcgcggaggtgcgccgctcgtcccagctctccccgcgcacccccgccggcccgtcggagcagaccatctgccgcagcccgatgtccggctccgcggccgtgcgccacgtcgtggcgccggt

SEQ ID NO: 1917 - DNA, 1112 bp, Unknown
  Kingdom: Bacteria, Phylum: Actinobacteria, Class: Actinobacteria, Order: Streptomycetales, Family: Streptomycetaceae, Genus: Streptomyces
ccgtccgccgggggccgttcaggcccgtcgcggcatcgacgcctcaggcgcggaagtcggccgtgtggtcctgtgcccactgggcgaaggtgcgggcgggggtgccggtgatcttctccacggtgtcggtgatctccggggtggtgccgacggtgtggcggaaggtgttcagcaggccctgcagcatgtgcggcgggacgtgcgggaagagttcgggtccggcttcctcgggcggcagctcggtgaaggtcagctcgcggccgagggcgcggccgatcgcggcgacctggccggcgttgctgatcgcctcgggtccggtgaggcggtggacggcgccctggtggccgtcgtcgaggagggtgcgttcggcgacggcggcgatgtcgtcctcgtggatgggcgcgctcatgccgtccgcgaagactccgcggacggtgttcccggcgcggatctgcccggcccactggaaggcgttggtggcgaaggcgcccgggcgcaggaacgtccattcgaggccgctgtcgcggatcgcccgttccacgccggcgtgcatgacgtggatggggtgggtctcgtcggcgccgtccgcgatgatggcggaggacaggaacacgacctgccggacgcccgcctggcgggccgccgccaggaattcggcggtccgctcgccggcggcctggacgtagaggaagagtttggtggcgccggtgaacagggcggccgggtcgtccggctggaaccggacgacctcggcgcgttcgggcaggccggcgcgttgcgggtcgcgggtcagtgcccgcacgggccggcccgcggcggcgaggcgctcgacgagggcacggccgacgttgccggtggcgccggtgactacgatcacggtttcctccgtggctggggctggtcgtccttcaggtgtccgagcctaggaaggacgatcagcccgcgcatcgtcgtcagggaccaggtgtgtcgtacgtccccggtcgtacgccccgggcccgctctctgcgcctgcgccgcgcccgcgcctatgacgcctgtgccggtgtctcctgcggctgccgcgcctgctgtgtctcgcggacgcgcagggcgcggcagccgcaggagac

SEQ ID NO: 1918 - DNA, 744 bp, Unknown
  Kingdom: Bacteria, Phylum: Actinobacteria, Class: Actinobacteria, Order: Streptomycetales, Family: Streptomycetaceae, Genus: Streptomyces
cccgccgcgcgccccgcccatcacggcggccggtgcggacgcgcgggagccgaagccgccggcgtccgccgcgcaccgcccggcgccgtcgagcagcccgtccgcaccctcgaccgcgacgccccggaccccggccgcgaccgcctcgaacacctcgggcgcttccgggacttccgggacctcgggagcttccggaacctccggctccgcgacgtccacgcagccggcgggcaccggcggttcgtccaccggttcgaccggttccgccggttccgccggtacctccggcgattccggcggctccgggcaggtgaagggctacgacaccgcgggcgggcgggtggtcttcgacctggacacggcctccgcgacgctcgtctcggcgacaccgggcacgggctggtcgatgcaggtgtggaagacggcgacctggatccgggtcgagttcacctcgggcacggaccgggtgtcggtcatctgctcctggcacgacagcccgccgcgggtggaggtcggcaactactaggtaccgcccgctggttcccgggcgtcagcgcaggactgcgggcgtcagcggaagacggagggcggcggggccggtgaggcgacggccgccgcgtccgtcacggggacggcgccgcccgtgaagtcggtgagcgcgcggccgtgttcgacccgggccgggtgcgggtcggaggcggcacggcgggtcagctccgcgaccggcagcggctggtcggaggc

SEQ ID NO: 1919 - DNA, 743 bp, Unknown
  Kingdom: Bacteria, Phylum: Actinobacteria, Class: Actinobacteria, Order: Streptomycetales, Family: Streptomycetaceae, Genus: Streptomyces
gcggaggagggcgcgcgggtcctcgtcaccgacgcggacggcgccgaggcggagaagaccgcggcggagctgtgcgaacgtgggctcgtggcgcgggcgttcgcgtgcgacgtggccgaccgggcttcggccgaggcggccgtggcccacgcggtggacgcgttcggcgcgctcgacgtcctcgtcacctgcgccgcccactgcaccccggacaccccgctcttcgaggacggcacggacgaggcgtgggaccgtgacctcgacatcaccctgaccggcgtccaccgctgctggcgggccgcgctgccgcacctggcggcgtccggccggggcgcgatcgtgggcatcggctcggtcaacggcctccaggacttcggcaaccacgcgtacagcgcggcgaaggcgggcctgatctcgctcacccgcacgctcgccgggcacgccgccgcgcgtggggtgcgcgtgaacctcgtagtgcccggaacgatccgcacctcggcgtgggagggccgggaggccgacctggagcaggtccgcccgctgtacccgctcggccgggtcggtgaaccggaggacatcgccgccgccgtcgccttcctcgcctcccgcgacgccgcctggatcaccggcaccacgctgaacgtcgacgggggcctcaccgcggtcaacaccggcttccacaaggcgatccacgcgacagcccgcgccggcggtgccccgtcctagggtctgtcgtcccggtc

SEQ ID NO: 1920 - DNA, 1157 bp, Unknown
  Kingdom: Bacteria, Phylum: Actinobacteria, Class: Actinobacteria, Order: Streptomycetales, Family: Streptomycetaceae, Genus: Streptomyces
gacaggccgaggccgccctcgtcgagcactacccccggctggtccggctcgcctacctggtgctgccgtcgggccggggccgcagccggcgcgtgctgctcgcgcactccctcgtgcagcgcgcgctgcccaggggccgctccgccgcgtccgcggtcccggcgcagtccaccggccacgacggcagcaccaggtaggcgagccggaccagccgggggtagtgctcgacgagggcggcctcggcctgtccgacgtcgacggtggggcgggaggcggacgaggggcggtgcggggcgacatcctgtgactgcacgttcagcagaacgagcgaatcggcggttggtcaccgccgcccggtggtgccggtcgccgtgccggtcgccgtgtcagccgtgctgccggtcgtccgaatccgccagcaggcgggcgtagttggccatcgaccgctggtagcggggcagatggggcgcgagggcgccgagtaccagggacaggccctcgcggtcgcggccgaggctggacaggcacagtgcgaggcacgcgcgtacggcgtcgtccaactcgtccgagggcgcgtccagttccggggtgagcagcttgacgccctcctccggctgccccaggttcctgagcgagctggacagctggatcttcgcgcgccggccccggtaaccgctcagcccgcgcgccagggcctcccggtacagcggcacggcccggtccggatgcccggtggagtcccaggcgctggcctgttcgaacggtccgatcgggctgtcgtcgggcagttccgcgacgagcgcgtcgagctgcgcgcggaaggcgggcgcctcgctctcggggaggtcgccgatgcgggcccagacggcggccacgcggtcttcccagtcctggttcatcggcccactttcgcacaggtgtgcctgcgggtggcggggatttgagcggggcgtgcggcgcggccgtacggaaggacggtgggcccggccgggcccggcgaccggagggacgaagatgaggccgactctgaccgcacccgggctcgcggtggtcgccgccgtgacgctgctggcgccgacgggctgctccggcggcggtacggcggccacaccgtccacggcggcgacggcgccgccgccgatgaccggcagcctgga

SEQ ID NO: 1921 - DNA, 1978 bp, Unknown
  Kingdom: Bacteria, Phylum: Actinobacteria, Class: Actinobacteria, Order: Streptomycetales, Family: Streptomycetaceae, Genus: Streptomyces
gttcggcgccgggcgccggggtcacggtcgtcgagccctggcgctgagcgcgccagcagggggcggtgggacggcggccggcgtcagcccgtcgtcctgcggccccggttgctgcccggccgggcggcggcccaggcgcggaccgtgtcggcgtaccagtagggcctgccgccctccacgtggtcgggcggcggcagcagtccgtgcttgcggtaggaccgcacggtgtccggctgcacccggatgtgcgccgcgatctccttgtacgaccagagccttcggtcggtcatgacgtgcacctccccgcgcgccgcggaggcggcctggaggccgtcgggggagccgggcgcgcgccggcgatcaagctgagcctgtgccgcgtgaacgaggcgggggcggcgggggcaagggcctgtcggacggatgtgacgcagaggaggcggacccgggacatgtgtgacgaaggcgttgcttttgtggcagagccgggccggagggacgggggagcccgccggagcgggcgtctgcttcttccgcctcccgttccgttccgcttcccccacccgttcccttctcgtccgaatgtccggacaaagcattgacaggcctccgcctccggcattagaaccgggggagccgacgcgaagggagaccgatcgtgtacgacgtgatcaccatggggcggatcggcgtggacctctacccgctgcagacgggcgtgccgctggcccgcgtgtccgcgttcgggaagttcctgggcggctcggcgacgaacgtcgcggtcgccgcggcccgcctcggccggcgtacggcggtgatcacgcggaccggtgacgacccgttcggcgcctacctccacgaggccctgcgcggcttcggcgtcgacgaccgctacgtgacggcggtgcctggactgcccacgccggtcaccttctgcgaggtgttcccgccggacaacttcccgctctacttctaccggctgccgaaggcgcccgacctggagatcgacgcccgcgacctcgacctggccgcgatcggcggggcgcgcgtcttctgggtcaccggcaccgggctgtgcgaggagcccagccgtacggcgacgctcgccgcgctcgcccaccgggcgaggtccggcccgacggtcttcgacctcgactggcgccccatgttctggcgcgacccggccgccgcccgccccttctacgccgaggccctgcggcacgccaccgtcgccgtcggcaacctcgacgaggtggaggtcgccaccggcctgcgcgacccgcacgccgccgcccaggccctgctggacgccggtgtcgaactggcggtcgtgaaacagggccccaagggtgtcctcgctgccagccgcacgggtgagacggccgaggtgccgccgctgccggtcgaggtcctcaacggcctcggcgccggggacgccttcggcggctcgctgtgccacgggctgctctccggctgggacctggagcgcgtcatgcgccacgccaacgccgccggcgccatcgtcgcctcccgcctcgaatgctcctccgcgatgcccaccgccgccgaggtggagtcggccctcgcggccggtgccgtcagggcgggaaggtgagggcggtgcgatgaggacgggaaccggacggacgttcggtgtcgtcgtcggcagcacgtgcggcggacgccgggcgcgccccggttgtacggtgcaggtatccgcccgtcccgtgcgggacgagttccaaatcccgggcggtgcaagcgcgttgggtgaccgcacccaggtgccgcgcgccgcccggccaccgatcgcctccggcgcgggagaccgcttcgccctggcaggagcgaagtgcgagcgacgactccccgcccgctacggccccgcgccggaggtcctccgcacccgcgggtaccgccgctcccgtttcccgggcgagtcccgggcgaccccgtacgtgtcccgcgcgtgtcccgc

SEQ ID NO: 1922 - DNA, 800 bp, Unknown
  Kingdom: Bacteria, Phylum: Actinobacteria, Class: Actinobacteria, Order: Streptomycetales, Family: Streptomycetaceae, Genus: Streptomyces
cgatcgaggaccacatccgcgccgagatcgccgagatgtccgactccgaagtgatggcggactcgatgctgctgaaggagcagaacgcatgagcaccgaggaagcgacccccgccgtgtcggacgtctcgctccgcgaccagctgctgcgcagccgcctggccggccgccgcggcaggcgccgcgacacccccgtccgcgccgaccgcaccgccccgctggcgctcagccacggccagcagcagatgtggttcctgagccgtctggaaccggactccaccgagtacacggtcccgctggtgctgcggctgcgcggcaccctcgacgcggctgccctgggccgtgccgtcgaggcgatcgtggcccgtcacgagatcctgcgcacccgctacgccttcgtggacggcagccccgtacaggtcgtggacgcgcccggcaccctgccgctgacgctgccggccgtccccgtcaccgacggcccggccgcccaccgcgagcagcgcgccctggaactgctgcgcgagcagctcgccaccgggttcgacctggccaccgagtggccggtgcgcgccaccctgctgcggctggccgacgacgaccacatcctggccttcgtcttccaccacatcgcctgcgacgcctggtccacccgtgtcttcggagccgaactcagctccctgtacgcggcgttcaccggccagagcgacgtccggctgccgccgctgcccctccagtacgccgactacgcggcctggcagcgcgccgagctcgcaggtccgggcgctgccaggccgcgtagtc

SEQ ID NO: 1923 - DNA, 2565 bp, Unknown
  Kingdom: Bacteria, Phylum: Actinobacteria, Class: Actinobacteria, Order: Streptomycetales, Family: Streptomycetaceae, Genus: Streptomyces
ggacccctgcctcccgtgcggtcggagccgaccccgaacgggacctcgccgccgcacgggaggcaggggtccggttcgtgtgccccggcggcaccgaatggccggcccagctcgacgacctggcggacgcacggcccaccggcctgtgggtacgcggccggcccagcctgcgcatgtgggcgctccggtcggtggccctggtcggcgcgcgggcctgcaccgagtacggcgcgcacatggccgccaccccggccgccggtctcgccgagcgcggctgggtggtggtgtccggcggcacctacggagtcgacggtgccgcccaccgcggcacgctcgccggcggcggcgccaccgtcgccgtactcgcctgcggcgtcgaccggccctatccgcgcggccacaccgaactgatcaccaggatcgcgcagcagggcctggtgatcggcgagctgccgcccggcgaccacccgacgccgagcagattcatcgtccgcaaccgggtcatcgccgccctcacccgcggcaccgtggtcgtggaggccgcccaccgcagcgggtcactggtgaccgcacgggccgcgcagcgcctgggccgccacaccatgggcgtccccgggccggccaccagcgcccgctcggcaggcgtccacgaactcctgcgcggcggcgccacgctcgtcaccgacgccgcggaggtcgtcgagctggtcggtgacatgggcgaactcgcccccgaccggcgcggccccgtcctcccgcgtgacctgctggaacccgaggcccggcagatcctggccgcgctgcccgcacgcggcgcgccgaccgcggcgcacatcgcccgggacgcccggaccaccccggacgacgcgatcgcgagactgtacgaactgcgcgcgctcggttacgtcgaacgacatggcgacggatggaagttgacacgccaggcggtgatctcgggccggcctgttcccgacgaatgctgaccgagcgtgttcggccgtccgggggaacgccgacggctgcgtaaattcccgcagttgagcgttccccacatcacccagggtgacgcggatgccccgggggagcgccctgcggaacgtatctgcgcacgccccgcgccccgccgttcgcgcaccgcgacactccagtcacgctacgctcacgtggttccgacgaggacacccgataccgaacccagaccgacagctcacccagaaagccgcatcccacggcagaacggcacaaggcgacgaatgccccagcacacctccgggtccgaccgggcggcgatccccccagccgcccgcgacggtggcagcgtgcggccgcccgctccctcgacgctcgacgagctgtggcggtcgtacaaggcgacgggggacgacagactgcgggaacagctgatcctgcactactcgccgctggtgaagtacgtcgcgggccgcgtgagcgtcggtctgccgcccaacgtggaacaggccgacttcgtgtcctcgggcgtgttcgggctcatcgacgcgatcgagaagttcgacatcgaccgggagatcaagttcgagacgtacgcgatcacccggatccggggcgccatgatcgacgaactgcgcgcgctggactggatcccccggtcggtacggcagaaggcgcgcaacgtcgagcgggcgtacgcgacgctggaggcccggctgcggcgcactccgtcggagagcgaggtcgccgccgagatgggcatcgcggtggacgaactccacgccgtgttcagccagttgtcgctggccaacgtcgtggcgctggaggagctgctgcacgtgggcggcgagggcggcgaccggctgagcctgatggacacgctggaggacaccgccgccgacaacccggtggaagtggccgaggaccgggagctgcggcgcttcctggcccgggcgatcaacaccctgcccgagcgggagaagaccgtcgtcacgctgtactactacgagggactcacgctcgccgagatcggcaacgtgctcggggtgaccgagagcagggtcagccagatccacaccaagtccgtgctccagttgcgcgccaaactcgccggcttcgggcggtgatggcgagaccggcgcgcggagcctgagcgggtggcacggccggtgcggctcccgccgcgggcgacgcgtccgtaaagtggtcggcgtgccaaggattcgagcggcctccgtggccgagcaccggtcgatgcagcgcgccgccctgctggacgcggcgcggaccctgctgtcccagggcggtacggaagcgctgaccttcccggctctggccgagcggacggggctcgcgcggtcgtcggtgtacgagtacttccggtcgcgggccgccgtggtcgaggagctgtgcgccgccgacttcccggtgtgggcggcggaggtgtcggcggcgatggccgcggccgacggcccggaggcccggatcgaggcgtacgtccgcagccagctggaactggtcggggaccgccggcaccgggccgtcgtggcgatctccgcgagcgagctggacgcgggggcccgggagaagatccgg

SEQ ID NO: 1924 - DNA, 814 bp, Unknown
  Kingdom: Bacteria, Phylum: Actinobacteria, Class: Actinobacteria, Order: Streptomycetales, Family: Streptomycetaceae, Genus: Streptomyces
tcgaagacggcgagggcgtcgcgggcctgggccaggtaggccgcggcggcgagttccgtctcgcggtcgaccgggtcgaggtgggcggtgagggtcgccgggtcgaggtcggcgacgaccgcctccgggcggatctcggggagccggtggaccagttgccggtcgtaggtgtagccgccgttgacgacgccgagcccggcggccgaggcgatggccgcgacctggcggaactcctccacgctggaggtcacgagcacggtgcggtgcgtgcgcgcgaactcgtcgagggtggtgtgtccgtcggtggtctcgaacggcagccagggcagcagcatccgcaggatctcgtcgtcgtgcacggcgagcgacttgacggccaggtggtggacctggaggaagcgggagagcagttccgggtcgctggcggcggtccgggcgatccattccctgagccgctcggcgagggcgtcgcggaccgcggcgagcgtgtcgtcctcgtacagggactcgcgggacgcggtcgggcgcaggctctcggcgtcgatgacgcagcggacgaagaacgcccactcgggcaggatctcctcggcctgctcggacagcagcatgcccttgacgtgcacccggtggccgtggcggcgtccggcgggcacggcttcggacagcacacaggcgatgcccttcaggccgacggcgggcaggtccagctcgatggtgtccagcggctcgaagccgaggacgtcctcgccgtacgccgccagtgcgcgtgagcgcgtgcccggtgtcgggtaggtacgggcccagggggcgggct

SEQ ID NO: 1925 - DNA, 2327 bp, Unknown
  Kingdom: Bacteria, Phylum: Actinobacteria, Class: Actinobacteria, Order: Streptomycetales, Family: Streptomycetaceae, Genus: Streptomyces
agacctgctgaggcggcaccggcccggctcggcacggcccgcccggtgcgtccggccccggcttctggcgcaccgggcaccactccggtctcccgtcccgcttccgggccggtgccgcctcagcaggtcttgcggacgtagccgctgtcgccgggagccgtgacgtccacgtcgcgcagcacgatgctgagccggtcaccgtaggcggcgcacaccttcgtgaggttcttctgctggtactcgatgacgatgacgtggtcgccgaacccgtcgacgtagtcgccgcactcgtcgtactcgccgcactcctcggcgacggcgaagtcgagcccggtctgagcgcggtcggtggagaactcggaggtgttcttctgggcgatcgccaggcccttgtcgtgcgcgtgggcggacagcagcttgacgaacgccttcgcgtcggcctcactgatcagcttcgtccggtcgaaggtgtccaggttgtccggctcgacggccttgaagcccttgctcgcacacgtgtcgatccaggagttcaccttcgccgcgatccgctgccgcttggcgtcgctgcggatgtccagcatggcctccccccagttcttgtcgtacacgaccttgccctgcgcatcgcgcagcagcaggtcgccccactcgctctccgcgcccggctgggcctggaaggcgttgacgtagcagatgttgtagagcccggccgcaggggcggccgtgtagtcgcgggtgacgaccttcacgccggacggcggcggataggccttgccgatctggtagtcgaaaccggcgtgtgccggaggaagggtcaccgccgccgcaggagtcgccgcggaagcggtcgcggaagcggtcgcgggtgtcgccgcggtggtggccgcgctcgccgaggcgcaggcggacagcgggcagatgaccgcggctgccgcggccaccgccacggcagcgcgcccgtgcggccgggcacgatcgaagagggacatctttgagctccagaagatgcgagggtcacgtccccgcctcggacccccacagctgtgcggacggatcctggcgactttgtccggacttacggtgtgcgcaccgtgctaccggctgggcgtacctctgacgccgggtgctcaactctggcgttggaaggagtaaagcgagcaactttcgccatgtcaacagatcgaagatgcgcatcttgcgcacatgggcaaggcggtggggtcgggccgcatccccgtcgcggacccggcggcgcctctccaccgcacggccctcgcgccggaactgtgcggtctatgctcaactcatgctgaaaactgagcgtcatgcgcgaatacttgagcatgtctccgcgcgtggtgccatcgacgtcaccgagttgtcccggttgctgaacgtctccggagccaccatccggcgcgatctgcagcacctgagccggctgaacctgctgcgccggacgcacggcggggccgtccagggccaggccggccccgaactcccggtccagcaccgcaccgaacgcagccggccgcagaaacaggccatcgcacgggccgcggcccggctcgtgccccgcggcgcggtcgtcgggatgaccggcggaaccaccgtcacggagatcgcacgcgtcctggccgcccggggcgcggtcaccatcgtgaccaacgccgtcaacatcgccgccgagatggtgccgcaccacgacgtcacgctcgtcgtcgtcggcggctacgcccgcaccgagagctacgaactcgtcggccccatcgccgagaagacgctcgccgaccaccacaccgacatcacgttcctgggcgtggacgggatcagcgccgcccacggctgcaccacgcacgaccagttggaggcggcgacggaccgggccttcgcagccagcagcgaccggaccgtcgtcgtggccgaccactcgaagatcggcagggccaccttcgcccggatctgctccctgacggacatcgaccacctcgtcaccgaccaggccgcaccggccgacgcgctcgccgacatcaccggcaccggcgtcgcggtgaccgtggcgtgacgcgaccgggagacgggcgaaccggccccggcggagcttcccggcgtcgtgcgtgactacttggcgggccgcgcacccgctcgagggtcgggcgccgtggcgaggaaccgctgccggtcgacgatcgcgcgatcgatctcgccggacgcgacgacctcccccgcgccgtcgacggcccgcaccaggaaggtgagccggcggcccacggcggcggcaggcgcctccgcgacgacctccacccggccgcccacccgggtgg

SEQ ID NO: 1926 - DNA, 1040 bp, Unknown
  Kingdom: Bacteria, Phylum: Actinobacteria, Class: Actinobacteria, Order: Streptomycetales, Family: Streptomycetaceae, Genus: Streptomyces
cacctgaggggaaggcgccgccgtcatgggagatggcggcgagcggccacccgccgccgtcgtgcaccgcgacgtcccccttcagcagcccggcgacggcggcggccacgtccgggacgtccccgccgcgcagcaccaggtcggtgagccggtcgtgggactcctcggcacgctgcatggcggccgagtgctcgcggatcacggcgttcgcctcggccagttcggccagtgcggcccgcgcgtcggccatggccttggcggtgtcgatggcgatggcggcgtggtcggccagcgagcacagcagggcgacctcgtcgggcgagaaggtccggggtgtgcggtccgccgcgaagagcgcgccgatgacctggccgccgctcccggagcccagcagcagcggcacaccgaggatcgcgaccaggccctcgtccaggacgccggcgtcgatgctgccggtgtggtggaagcgctcgtcggtgcggtagtccggggacgcgtaggggcgggcggtctgcgcgaccaggccgccgaggccctcgccgagctggaggcgcaggttctggaacagttccgacaccgagccgtcggtgacccgcatgtacgtgtcgccggcctcctcgtcgggcagtgtgagataggccgtgtcggtgccgaggagcatcctggcgcggcggacgatggagcgcagtacggcgtcgaggtcgcgcagcgccgcgaggtctcccgcggtgtcgaagagtgcggtcagctcggcctcacggcgccggtgctggcgcagcgtggcacggatgcgcagcgccgtcgcggtggcctgctcgacctccgcgaggtcctgggcaccggcgccaccaccgcgccgcgcctcggtgagaacggcaccgaggtcctcggcgggagcacccgcggcgagcagttcgagcagccggcgcaggggagaggcggcggacgggggcttctgggacatggctgggcaatcgtggtcaggtgggcggactgccgcaccgggggaccggcgcaccggggacgggcacaccggggga

SEQ ID NO: 1927 - DNA, 626 bp, Unknown
  Kingdom: Bacteria, Phylum: Actinobacteria, Class: Actinobacteria, Order: Streptomycetales, Family: Streptomycetaceae, Genus: Streptomyces
  misc_feature (378)..(442): n is a, c, g, or t
ccagggcctgatcgcccgcgcagcagcaggtagacggcgaacagcccgggcgtgagcttgatgccggccgcgaggccgatcgcggcgcccctgccgcgcgcgccgggcgggcgggtgaggtcccacagcaccagacaggtgagggcgaggttgatctgcccgtaccggaaggtctggaagaccggttcgcaccacagggcgagggccgtcgccgtgcacagcgtcgcgagcccggccgggcggcccgccaggcgcgcggacaggtggacgagccaggccagcaggagcgcgttgcccgcgaggaaggccggtttcagcagcggcacgggcagcagcgccgtcggcacgaacagcaccgcggcgaacggcgggtaggtnnnnnnnnnnnnnnnnnnnnnnnnnnnnnnnnnnnnnnnnnnnnnnnnnnnnnnnnnnnnnnnnncggagggccaccgtccgttctgtcacggaccgaccctaaagggtcacttgtggcgtatgcccgcttcctcgccgtactccccgaggatgatcacgtcgaacgcggcccccgcgaacaccttgacggcgtgcagggcgtcccccagacggtggtggtggctgctgccttgaacagccgtggcacc

SEQ ID NO: 1928 - DNA, 2761 bp, Unknown
  Kingdom: Bacteria, Phylum: Actinobacteria, Class: Actinobacteria, Order: Streptomycetales, Family: Streptomycetaceae, Genus: Streptomyces
gccgagcgcggcggcctcgtcgacggcgcggcggttgtcggccagggcccgggcgcgctcgtccgggtcggtcgcggtgaggaagccgccccggcacagggtggtgacggtcaggcccgcgtcgcggacgagcttggcggcggcctccaccccgtaggcctgtaccggctcgcgccacaggccgatgccgccgatgcccagttctgcgcaggcgtcggtcagttcgggcagggcgagctgcttgacggtcatctggttgatggagaagcggctcaggtcgtggtgggtcatcggttcaccccgtgcagggacaggagggtgcgcatccgttcctcggcgagcttggggtcggggaacaggccgagccggtcggcgagttcgtaggcgcgggccaggtgcggcagggagcgggccgactggaggccgccgaccatcgtgaagtgcgactggtggccggccagccaggcgagcaggaccacgccggtcttgtagaagcgggtgggggcctggaagaggtggcgggagagttccacggtggggtcgaggagggcgcggaagccggccgtgtcgccggtgtccaggacgcgtgccgcctcggcggccagcgggcccagcgggtcgaagatgccgagcagggcgtggctgaagccctgctcgtcgcctgcgatcagctccgggtagttgaagtcgtcgccggtgtagcagcgcacgccctgcgggaggcggcggcgcaggtcgatctcgcgctgggcgtccagcaacgacaccttgatgccgtcgatcttgccggggtgggcggcgatgacgtccaggaacacctccgtcgcagcgtccaggtcggacgagccccagtagccctccagggccgggtcgaacatggggccgagccagtgcaggatcaccggttcggcggcctggcgcagcaggtggccgtagacctccaggtagtcctcgggaccgcgtgcggtggcggcgagggcgcgggaggccatgaggatcgcctgggcaccgcagtcctcgacgacggcgagctgttcctcgtaggcggcgcggatgccggcgagcgagccgccgttgatctggtcggtgccgacgccgcaggcgatcttgccgcccaccggcttggcctccgccgccgaacggcggatcagctcggccgcgcccgcccagtccaggcccatgccccgctgcgcggtgtccatggcctccgcgacgcccagcccgtgggaccacaggtggcggcggaaggcgagggtggcgtcccagtcgacggcggcgggcgagtcgggcgagacgtcggcgaacgggtcggcgacgacatgggcggcggagaagacggtgcgggaggtgaagggggtgcccggggtggcggcgaggggttcggtgcggggctcgtaggcccgcagcgtcccgcccgcgtccggcaggtggatggtcacagcgcgatctccggtacgtcgatgcggcggccctcggcggaggacttcaggcccagttcggcgagctggacgccgcgggcgccggcgagcaggtcccagcggtagggggcgtcggcgtagacgtggcgcaggaacagttcccactgggccttgaagccgttgtcgaagccggtgttgtccggcacttcctgccactggtcgcggaacggctcggtggcggggatgtcggggttccagaccggcttgggcgtggcggagcggtgctgggcgcggcagttgcgcagcccggcgaccgcggagccctcggtgccgtcgacctggaactcgaccagctcgtcgcggttgacgcggaccgcccaggaggagttgatctgggcgatcgcgccgccgtcgagttcgaagatgccgtaggcggcgtcgtcggcggtggcgtcgtagggcttgccgttctcgtcccagcgctgggggatgtgggtggcggtgagggcctggacggaggtgacgcggccgaacagctcgtgcagcacgtactcccagtgcgggaacatgtcgacgacgatgccgccgccgtcctcggcgcggtagttccaggacgggcgctgggcctcctgccagtcgccctcgaagacccagtagccgaactcgccgcgcacggacaggatgcggccgaagaagccgccgtcgatcagccgcttcagcttcagcaggcccggcaggaagatcttgtcctggacgacgccgtgcttgatgccggccgcgtcggcgaggcgggccagttcgagggcgccgtcgaggccggtggcggtgggcttctcggtgtagacgtgcttgcccgcggcgatcgccttcttgatcgactcctcgcgggcggaggtgacctgggcgtcgaagtagacgtccacggccgggtcggcgaggacggcgtccaggtcggtggagacgtgctccaggccgtgccgctcggcaagcgccttcagcgcgtgctcccggcggccgacgaggaccggttccggccacagcacggtgccgtcgccgaggtcgagtccgccctgctcgcgcagggcgaggatcgagcggaccaggtgctggcggtagcccatgcgtccggtcacgccgttcatggcgatgcgcaccgtcttgcgtgtcacgtcggtcccagtcccttcgtacggccgtcggccacgacaccgacagcaagcgctttctacggcaggagacgctagcctctgaacagcggtccggacaagagcgggcgcggatcgcttcgttcggcgggaggacatcagggggtccgggcgggcggacgccggaggccgttcggg

SEQ ID NO: 1929 - DNA, 974 bp, Unknown
  Kingdom: Bacteria, Phylum: Actinobacteria, Class: Actinobacteria, Order: Streptomycetales, Family: Streptomycetaceae, Genus: Streptomyces
  misc_feature (302)..(303): n is a, c, g, or t
acctcctcggcggcggccgggccggtctggcaggagaccggcacctcgcacgtcgactcgctgagcggcagtcagggactcgccagccgcgcggacggctcgctggtgtaccggggcctcgcctcggtcccgctggacctgcgcgtcaagggctggaaccacgtcggcgacccggacatcgcgcggggcgacgtcttcgacgcctaccagggcgcggactcggcgacgtccaagatgttcgccgtgaccaccccggacggcaagcgctacgagtacgtgcatccgctcgacgcgggcgaganngcgagtggggcgaccagaaccggctccaggtcttccccgccccgctgctcaacccgtccaccccgcgcaccggcggcaccctgccgcaggccccgcagatcagcctcgacaagcccgtacgggacatccagggctgcgacttcgtcgacgacacccggctgctgtgcgcgtcggacgacgggtcggggactctgttccccgaggaccggccgctgctccaggtcgatctggaacacaggctggacggcggcccggtgaccggtcacgtctccagcctgttcgcgctgccgcaacgcagcgtgtgctccggcacgttcgaggcggagggcgtcgactacgacgccgtcaccggcacgctgcgcgccgaggtcgtcccgccgagcgtgtgcaaggtcgccacgacggtgtacgcgtaccacctccggtagaccgggcgaacggaccacggacggcggcgggcctcgcccgccgccgtccggcgtgtccgggccggcccggaatctccccgttcatcagctgaactcccgcaccgcagccggactttcttcgcttcaactcttgacgatgcgggtcaccgagagcacattggcggcgcacacctcgcgtgagagcgctctcagcaatgtccgtctctccccgctcctctccgaactccccccaccctcccccac

SEQ ID NO: 1930 - DNA, 2626 bp, Unknown
  Kingdom: Bacteria, Phylum: Actinobacteria, Class: Actinobacteria, Order: Streptomycetales, Family: Streptomycetaceae, Genus: Streptomyces
gccggtgccggggtctccggcgggcgggacgcgggcgccggggcggcgccgtccgcgtcgccgacgccggtgtggaacacccacccggactccatcgtcgcggtgggcgactccatcacccgtggcttcgacgcctgcatggtgctgacggactgtccggaggtctcctgggcgacgggcagtgacgcgagcgtggacagcctggccgtgcggctgctcggggtcacgggcgcggcccagcgcagttggaaccaggcggtgaccggttcccggatggccgatctgcgcggccaggtgacgcaggcggtgctgcaccggccggagttggtgacggtgatggccggggcgaacgacgcgtgccgcgactccaccggtcagatgacgtccgtggcggacttccgcaggcagttccagtcggcgatggacgcgttgcgggcggcgctgccgaagacggaggtgtacgtctccagcgtgccgaacctgaagcggctgtggtccgagggccggacgaacgcgctgggcaagcaggtctggaagctgggcatctgcccgtcgatgctgggcgacgcggacgacctggacgtggcggcgacccagcggcgggacaccgtgcaggcccgggtggtggagtacaacaaggtgctggccgaggtgtgcgcgaaggaccgccgctgccgcttcgaccacaacgccgtcttcgactaccagttcgacacgaagcagctcagccactgggactggttccacccgagccgcaacggccaggcgaggctcgcggagatcgcctaccgcactgtcaccgccaaggatccgtgacctacagtttccgccatgaacgaacttttcggcacactttccgacggcacgccggtgcaccgctggacgctggagcgggccggggtgcgggtgcgagtgctgtcgtacggcgggatcctgcagtcggtcgaggtcccggaccgggacgggcgcgcggcggacgtggtgctgggcttcgccggtctggacggctacctcacccatccgcagccgtacctcggcgccctggtgggccggtacgccaaccggatcgccggcggccggttcgagctggacgggcggccgtgcacggtgacgccgaacgagggcgccaacgcgctgcacggcggcgcgcgcggcttcgacaagcgggtgtgggacgtgacgccggtcgagcacggcgtgcggctgtcccgggtcagcccggacggcgaggagggcttcccgggccggctggacgtcacggcgacctgcacgctggacgcgtcgggcgccctgcacctcgtctacgaggcggtcacggacgcgccgaccgtcttcaacccgaccaaccactcctactggaacctgggcggcgcgggctccggtgacgcgaccggacacgaactgcgcctggccgcctcccgctacaccccggtcgacgcccagctgatccccgagggcgctccggcggacgtcacgggaacccgtttcgacttccgccgggcgcgcaaggcgggcgcgggctacgaccacaacttcgtcctggacaagggggtcaccgagcgcgccgaggaggtcgccgagctgcacgacccggcgtccgggcgggtgctgacggtggcgacgaccgagccgggtctccagctctacaccgccgaccacctgtccgccggcccgttcacctccggcgccgggatcgccctggagacccagcacttccccgactcccccaaccgccccgacttcccgagcaccgcactgcgtccgggcgaggtgttccgctcggagacggtgtacggcttctcggtgcgctgagtcctgtcgcccctcgggccggacggggcgtcaccgcgccgtcgtcaggcgctctcgccgcgcatccgtgtgaccgcccggccgagcagggccaccgcgcccgcgcggatcagcagcaccgcgccgccggtcagggtcggctgcggcgcaccgctcttgaggccctccgccggtgaccgtggcggcgaacaccaggacgatggagtacagggcccggccgaccttcgcgccggccgggacgacctggagctagctgcgggatggtcgtcgccgccccgagccccagggcgaacgggatgcaggcgcccgtcatcagcgccccgaagccgaagggattgccgtacgcgccccagccggcgcccttcaccagcagccggccggcagcgccgaaggacagcaggaccaggacgccgttgatgtacgcggcgagcgtggcggccttgcgggcaccgggcaggtgtgcggccggggagcgccgggcgtccggggtgatctccccctagcgtcccccgtagccgcctgaggcgccctttccgggccgtccgccctatccgggcgggacgccacgagccccggtccaggggtcaggtcccgggccggggctgtacgtggggaagcttgccccggatccgaccctaagcgccgggagaccgcgacgaccgggagaggaggcgccgggccggaacctcgtacgaacccttcacaaacggccggggacggctcccgcgaccgcctccccgtccgctcccccgcccggctcgccgcccgtgcggtcctccgcgccgccacccgtctcctcgtgcgccccctcgtc

SEQ ID NO: 1931 - DNA, 554 bp, Unknown
  Kingdom: Bacteria, Phylum: Actinobacteria, Class: Actinobacteria, Order: Streptomycetales, Family: Streptomycetaceae, Genus: Streptomyces
gcggcgaggacgggatcgtacgcctgtgggacgcgcggacgctgcggccggacggggccgcgctggacgccgccgacggccccgtcacggccctcacctgcttccccggccccgccggccgcccccacctggcggccaccggccccggcggcaccgtccacgtgtgggacgtcaccgcccggacccgggtggcgcgcatcgtgaccggcagcccgctcggcgtcctccaggcccgcccggccgacggtacggacccgcacgggcaccccgttctcctggtggccggaaaggccgggctgagcgtgttcgaactgaacctggggccctcctgaccctccccctgcggccccaccggcacggcgcgcgagggcgccctggggtggacgtgcgccctccggatgcctccgcgcctcctccacgcgcccccgtgtgcaggccgaaaaccgctcctgcggaacgccgttgcgggacaatgatcgctcgaatgtcccgtcggcacatgcaccggagcacggatcgcgcatcgatcgtgcgtgcaccggcgccggcgccgg

SEQ ID NO: 1932 - DNA, 670 bp, Unknown
  Kingdom: Bacteria, Phylum: Actinobacteria, Class: Actinobacteria, Order: Streptomycetales, Family: Streptomycetaceae, Genus: Streptomyces
  misc_feature (215)..(351): n is a, c, g, or t
tcgacctggtaccgcggggcacgggtgccctcgccgacctcaagccggcgctcggcggcggccccttcaacacggccgtcgcgctcggccgcctcggctcccccacggccttctgttcccgcacctcggacgacgccttcggcgaagccctgctggacgggctgcgaagggccggggtggacgtctcgggtgtgcagcgcggcagcgaaccgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgctgcccgccggcacccgcgcggtgtcgttcggcacctgttcgctcgtcctggaaccgggcgcgagtgcctacgagaagctgatgcgccacgcggcggccgagggggtgttcacggccctggacccgaacatccgggccgggctgatcccggacgcggacgcctaccgggcgcgttttcgcagctggctgccctcggtgtcgctgctgaagctctccgaggaggacgcgcggtggctgggcggcacaccgcgcgagtggctggccgagggacccgcgggcgtcgtgatcacccacggcggcgacgggctcaccgcc

SEQ ID NO: 1933 - DNA, 2485 bp, Unknown
  Kingdom: Bacteria, Phylum: Actinobacteria, Class: Actinobacteria, Order: Streptomycetales, Family: Streptomycetaceae, Genus: Streptomyces
gtggcgagggcggcggcgcccgcgccggcgaacccccggacgacctgctggcccgcgccgaggccctcgccgaccgcgacgacgtcaaggacgccgtgggcctgaaggacctgcgtcccgccgaggccgaactgctcgcctcgctgctggccgggcacgtgctcggggacgtctcccacgaggacctgctggccgggtgccggagcctggccgccgcccaggcccaggagtggttcgccggagtggaccgcgcgctgacggcacccgccaccgacccggacggaaaggcggcacggccgggcacggcgaccctgttccacccggtggcgttccggatcgcgctggccgtactgggcggcgcgccgcacagtgccgtggcctccgcagcacacctgctgacctgggaactgtccgtgcagagcgacccggacaacaccccggcccgcccgctgttctgcgacgacccggacgccgacctcgccctctcgcgcgccgaactcaccgagggcgaggtcgaggtggccggcgcggaggtcccggcccggctgatctggtaccggggttccgcgctgccgtccgccgtgctcaccgaactgtgggaccggcacttcccggcacgcgccccggtgatgcgctggctgcggctgctggccgacgacccgcgcccccaggtgtggatgcgcgccgcggtcgccgccggcgaactgtgcgtccgcgacttcgaccacggctacacggagctggtccgcccgctggccgaggcgcccacgccgctgcggcggatcttcgcggccaccacgctggaccaggccgcccggcacgactcgcaccggccggccgtgcaccggctggtcggcgagtggagcaggcacggcacgacgcgcttgcgctggacggccgcgatggccctcggctacggcaacgccgccgcgaccacggacgacaccctggacgccctcgccaggatcggcatccacggcgacggggaccagctcgccgtcgcctccttcaacgtcgtacgcctgctggccctgccggacggggcccgggtgctggcgcggatggccgactggacccaccacaagcgcgagcggtaccaggacatgggcctggtcaccaccgtccggctcgccctgaccaccgtcgacgaggtgctgacggacgacccggactcgtcgctcgccgaccgcggcgactggccgctgccgctcgccctcgccaccgagcgacccgaactcgtcggtcccatggccgacttgatgtggacggcgctcaacaccgcccgctccaaggacgtggcgatggacgcgctggagaccctgctgcgctcggcggtacgcaaggacggcacggagtggacccggcggggactggcggtgctgctgcccgcgctcgccaccgacgggtacgaccggcggcggctggactggctgctgcgccgcatgatgaacgacccggaggagccgttgtccgacgcacgggcgcgcgacctgtggtggctcgccgtcgcaccgcgccgggagcgcccggtccgggagggaacgcgcgaggaggtaaggcatggctgaggacgggaaccgggccggtgccgggggcgcggcgcccgcggggccgttcctgcgggagtacgcgccgacgggcggccagccgccggtcagcgcccagcgggcctccgtggtgttctaccgcaacggcgggtacagcgtgatcaccgtcgccgggatccagcacgtcggcaaacgggccctggcccggccctacaccgtgtgcgagatcgcgcagggcaccttcgtcaccaccctcggcatggagctgcccgcggccggcggcaccagcttcttcaaggccgaggtggacatcgagtgggaggtgaccgacccgcacctggtcgccgtcaacgtcgtcaccgacgtcgccgcacggctcacctccccggtgctggaacggctgcgggaggtcaccctcggctatcccgtcaccggggccgaccaggccaaccggctcatcacgcaggagtgcgtcggcggacgctggagcgacctgggcgccgaactcgggctgcgggtacggctctacgtccggctgggcgtggacgacgaggccatcgcgtacgcgcagcacaagcgcgaggtgcacgccgaagccgaggtgacccgggtccgccaggacgagttccggcgcatgctgcgcggcggcgacatggagcagctcacctacatgctggccgccgaccccgacggcgccaaggacttcctggagaagatcaggcaggagggccggcaggacgagaaggaccggctggaccggctgtactccatggcgatggcgggcgagctgcacgccgccgacgtggagacacaggtcctcaacctcctcaaccgggaccaccggcgcccgctccagggccccatcggcgcgctgcccgcccgcagggagccgcgccggctggaaccggcgccggacgaccggccgttcacaccggact

SEQ ID NO: 1934 - DNA, 573 bp, Unknown
  Kingdom: Bacteria, Phylum: Actinobacteria, Class: Actinobacteria, Order: Streptomycetales, Family: Streptomycetaceae, Genus: Streptomyces
tcgcggtcgcctggtcctgcgcggtcaccccgcaggaccaggcgaccgcgagcaccgaccgcgcccgctgcgccgccccgggcaccgccgtccatgtgccacccatcgggaacctcctcgatagcccttcttaaggtaaggcttgcctaacttatcgaaggtcgcggcacacgccaaccaggtcggaccggagagcggggccgagaggggggcgtacggaggcaaagggagctgcaaggggggcgcgaggagacggcgggggcctggccgcccgctgcttcagggcgtcagtacgcccagcagcgcccgcgcgcacaggtcccgcacctgcgcgcgcgtcagctcggagccgcgcagccactccaggcagacggcggtggtgaaggccagccagccccggacggcgagccgcacatcagcacggcggccggcgagcgagccggacgcacgatcggcgtcgagcgcgtcggccccgggttcgccaccgagtccggttccctcggcaccggccgcgagtccggctcgttcgctgccgatccggagcccggctcgctcggtggcgaacccggggcc

SEQ ID NO: 1935 - DNA, 1887 bp, Unknown
  Kingdom: Bacteria, Phylum: Actinobacteria, Class: Actinobacteria, Order: Streptomycetales, Family: Streptomycetaceae, Genus: Streptomyces
ctggtcgagggcgacggcccgctggctctccgagcggcaccgggccgtcgccctcgaccagcggggccacggccagagcgagaaacccccgcgcgccgcccacacccggcaggcctacatcgaggatgccgaggcggccgtggaacagctcggcctcggcccggtcgtcctggtcggccacgccatgggcgcgctgaccgcctggcagctcgccgcacaccggcccgacctggtgcgcggactggtcatcagcgacatgcgggcctccgcgctcggcgcgtcctcccagcgcgagtgggaggactggttcaagacctggccgatgcccttcgccaccctggccgacgtccgcaagtggttcggcgaggacgatccgtgggtggagcggccccatccggcgcgcggcgcgttctacgccgagatcatgcacgagtgcgcggacggctggcgtcccgtgttcgaaccggagcagatgctcgcctcccgcgagacctgggtctacgacgcgcactgggaggagctggcccaggtgcgctgcccggccctcgtcgtgcgcggcctcgacggtgaactcggccgggcggaggcgcaggagatggtccgcgtcctgccgcgtggcgagtacgcggaggtcgccgacgccggccacctcgtccactacgaccagcccgaggcctggcgggctgccgtcacgcccttcctggagtcggttctcacctcatgagcacggcgactcccgcagttccgccggccgtccaggaggagtccctgagggccttccacgccgagcacccggcggtcacctcggccgccctgggtggcggccgggcgccggacgggcgctccagctacgagatcctcgcggaccgggtgaccggccgccgggggatcctggacctcggctgcggcgacggcgtcctgctggacgtgccggcccgtgcgccgggcaggctgctggcgggcgtggacgcgccgagcgcggggacggtgaccgtgggcggggtgccggtcgccgcactggaaccggagcggctgcgccgccaggtcgtcctggtcacgcaggagcaccacgtgttcctgggcacggtccgcgacaatctgcgcatcgccgaaccggcggcgtcggacgggcagttgtggtcggcgctggccgccgtgggcgccgacacgtgggtgcgggagctgccggagggcctggacaccgagctgggcacgggcgcccacccggccgacggggcccgggcccagcagctcgcgctggcccgggtggtgctggccgatccgcacaccctgatcctggacgaggccaccgcgctgctcgacccgtcgaccgcccgccacaccgagcgcgccctggcggccgtgctccggggccgtacggtcatcgccatcgcccaccgcctgcacaccgcgcacgacgccgaccgggtggccgtgatggagggcggcctgctcaccgaactgggcacgcacgacgaactggtggcgtcgggcggggcgtacgcggccctgtggcacacgtggcacggggacggtgacggggacgagggcgccggcgaaggcgaaggcggagaggtggtggccggggagggcgcgggggcctgacgtccgtcccgtcagggcagctcgggcgcggtccagtcggcgtgccggagaacggtccgcatcgtggcgcgggacggggccagccggagagcgccgtcgcgcagggcgacggccagcggatggctgagccgctggcccatccggccggcccggcgggcggcgcgggccacggactggctgcgcgggcggcgcccggcgtcgtaacgggccagcgcccgctccaggaccggttcggcggcgagtgcggcggcgagggtgaccgcgtcctccagtgcctggcag

SEQ ID NO: 1936 - DNA, 700 bp, Unknown
  Kingdom: Bacteria, Phylum: Actinobacteria, Class: Actinobacteria, Order: Streptomycetales, Family: Streptomycetaceae, Genus: Streptomyces
accctcgtcaacaacgccgggggcacccccttccggatgctcggcgagggcggagccgcccggcacgcccgggtcgtcgcactgaacctcctcgcaccgctgacggcctcgctcgccgcgtacgaggtgatgcgcggccaggacggcggggggtccatcgtgatgatcggcagcgtcagcggaacccgcccctcaccgggcaccgcggcctacggcgccgccaaggccggcctggaccacctggcccgctccatggccgtggaatgggcaccgcgggtccgggtcaacacggtcgtccccggcatggtccgcaccgaactgtcgcacctgcactacggcgacgaggacggcatcgccgccgtcggccgcaccgtgcccctcggccgcctcgccgcgcccgccgacatcggcgacgcctgtgtcttcctcgcctccgaccgggccgcctacatcagcggggcgagcctgcacgtccacggcggaggggaacgccccgccttcctcgacgcggccgacgtcaacaagtgacacacccttcgaccatccacgagaggactccttccatgaccggactgtgcaccggacgcgtcgccgtcgtcaccggagccggccgcggcctgggccgcgcccacgccctcgccctcgccgccgagggagccagggtcgtcgtcaacgacctcggcgtcggcctcgacggcac

SEQ ID NO: 1937 - DNA, 808 bp, Unknown
  Kingdom: Bacteria, Phylum: Actinobacteria, Class: Actinobacteria, Order: Streptomycetales, Family: Streptomycetaceae, Genus: Streptomyces
ccacacccagggcggcgcgcgccccggagaccagggcgacggccgcgctcaggtcgaccggcgcgtgccgcagcccgggcagtacggaaaggcgcccgcgtccccttccggactcgccgaccgcgaccagcagtccggacagcgcggcaccggaacgggccagggtctgcgaccggcggccgaccgtgcgcccggcggggatcgccttcagcagccgccacacatcgggcaggccgtgcagcgccaggatgtcggcgccccagaagacggccgtgtcgcggtcggtgagggcaaccgcgatgtcgctgccgttcagcccggccaggacgccgtggtcgtcggccgacccgacgcgggcgaccgtcagcaccgcgcccgcgtcctcctgcgcgcgcagcccgtacaccacgtcgtccagcgggcgccgcgcgtccacgacctggtcggccagggctgtcaggtcctccagggcggggtcgtcgacgaccacgaccctgagtccggcacgccgggccgcgtccagcacgggttcggcccacgcgtccgcctccccgttcgcggtgcgcagcgcgctggggtgcaggacgacggtgcccgccatctccagctgacgcgcccgctccgggtcgcggaccagtaccccggtgcgggccagtgccgcgccgagcaccgcgtggaagacggccgggccgtagcgcgcggccttcggcgatccggcgagcaccgcctcggcggcctcggcgacgtcgtgcttgaccagcagcgtcacggccgcgcccaccaggctgccggcggaggcgtgataggc

SEQ ID NO: 1938 - DNA, 866 bp, Unknown
  Kingdom: Bacteria, Phylum: Actinobacteria, Class: Actinobacteria, Order: Streptomycetales, Family: Streptomycetaceae, Genus: Streptomyces
acgccgcaggtgtagacgcccgagtcggcgccgcggcccgcccgtccggcggcgccgactcgggcgtctacacctgcggcgtggagcagtaccgggaaggcgacttcgccgcggccctgagcagcatgaacggcttcgtccgggaccacccgcacgaccgggaccgcagccgggcgcagaagatcgccatagcggcggagatcgcgcagacggtcccggccgccggcaagcacctgccgacgacggactcgggcggcagcatcgaggtcacgatcaagaacgacagcccggacgacatcgaggtcctgtacacgggcccggtcaccggcagcgtcacgatcaagggctgcggcagctgctccgcgtactccctcggcgccaccctgcccatcggcgggttccacccgtgcagcgacagcggtaagaactacccgcagcggacgatctcgctgccccccgggacgacgtacttcctgcacaagccgcgcggcggcagcgcctcctcgcccggctccgacaccgccaagctgcagtcggggtacatctacacggagtgcgcctacaccaagcgggggttcggcctgggccagtgacccgcgcggcgcggaccccgccggtgtccgtcaccgtcgcgccggagggtccctcgtccgggggagccgggcgggacacgccggcgcgacgatcatcgtgtctgccagcctccttgtgccgggcgcgacggcccggccagtaccaggaggtggcgtttgtccggtcatgtcgggcgcatcggcgggcggcaggtggtggcggtcctggcactgggaggcggcctcctgctcgggccggtcctgccgtcccaggcggtcgaggcgggcggagcg

SEQ ID NO: 1939 - DNA, 623 bp, Unknown
  Kingdom: Bacteria, Phylum: Actinobacteria, Class: Actinobacteria, Order: Streptomycetales, Family: Streptomycetaceae, Genus: Streptomyces
ggacggcggcccggggcggtggcccgcgcggcgggcggtgctcgtgggcggggcggtggccctcgcgggcggtgcggtgctgtggcgggacggactggggcggctgtggtggcggttgccgggcgaccagagaccgcgggtggccggtgcggtggacttcgccggggcccgctgggtggcggcctcaccggcgaactaccggcgcgcggaccggcccgacgactacgcggtcgaccgggtggtcatccatgtcacgcagggcagctacgcgagcgcggtgaaggtgttccaggacccggagcaccaggcggcggcgcactacatcgtccgcgcggacgggcaggtgacgcagatgatccgcgagctggacgtggccttccacgcgggcaaccgggagtacaacgagcggagcgtcggcatagagcacgagggcttcgtggagaaggcctcgtccttcacggacgcgatgtacgccggctcggcgcggctgacggcacgggtctgcgcgcgctacggcatacccgtcgaccgtgagcacatcatcgggcacgtggaggtgccgggcaccgaccacacggaccccgggccgcactgggactgggaccgctacctgcggctggtgc

SEQ ID NO: 1940 - DNA, 2183 bp, Unknown
  Kingdom: Bacteria, Phylum: Actinobacteria, Class: Actinobacteria, Order: Streptomycetales, Family: Streptomycetaceae, Genus: Streptomyces
accgcgcgatggttccgccgccaccagcggcggaaccatcgcgcggtaggcggcgcggctgtcgcccatgccgtgcgcgagaacgaccagcgggccggaacccgccacctcgtaggcgatcgtgccgccctcgacgtccaggaactcggtcatgacacccctccgttgagcactctggctaacctcgttagccaaaagctaatgtcattaaccaaggctgtcaacgcctgccgtgcggccggcccactcccccgggcgggtgggccgaccgcgcggaggccgcccggcactgcggcggccgcccgctactcccccgcccaggcccctttcagggcggcgatgtcgagcttgcccatcgcgagcatcgcccgggtggtgcgggccgccttctccgggtccgggtcgttgatcatgtcgatcagctcctccgggacgacctgccaggacacgccgtacctgtccttgagccagccgcaggggcccggctcgccgccgttgtcggtcagccgggcccagtagtggtcgacctccttctggtccgcgcagaggatctggaaggagatcgactcgttgaacgtgaactgcgggccgccgttcagcgcggtgaaccggtggccgttcgccgtgaactccacggtgaccaccgacccggcggggccgggcccggcctcgttggcgcggccgatccgcccgatgctggagtccttgaagatcgagacgtagtagtgggcggcctcctcggccgtgccgtcgaaccagaggcaggtggtgaatccctgagtggccacggggtcctccttgggggtgggacgcggtcttccctgtcgaccggtccacgcggtcacctgtatcgaccggaccgcgccgcggaactcatcgctcgcccggaaaatatttccggcagcctcgtgaccagcgccctagcatcccgtccatgacgaccccaccgcccgccgacggcatccggcccttccggctcgacgtcccgcgaaatgccctggacgacctgaacgaccgactcgaccgcacccgctggcccgacgaactgcccggcgtgggctgggactacggggtgcccaccggctacctgcgcgacctggcccgccactggcggcacacctacgactggcgggcggccgaggcgcggctgaaccagtggccgcagttcaccaccacatcgacggagcgaacgtccacttcgcgcacgtccgctcccccgagcccgacgccgtcccgctgatcgtcacccacggctggccgggttccgtcgccgagttcctggacgtcgtggggccgctggccgacccggccgcacacggcggcgaccctgcggacgcgttccacgtcgtggtgccgagcatcccgggcttcggactgtccgggcccacgaccgaccgggggtgggaggcgggccgggtcgcggacgcctgggccgagctgatgcggcggctcggctacgagcggttcggcgcgcagggcggcgactggggcgcggcgatctctcgggagctgggccgggcccaccccgaccgggtgatcggcgtccacctcaacctgctgccgggggcgcagcagaccaccgagccgaccgaggcggagctggccgcgctcgacccggccgagcgggagcgcaccctcacctcctggcgccgctgggcggcctgggaacgggacggcgccgcctacgcccacctgaacgcgtcccgcccgcagaccctggcctacgcgctcaccgactcccccgtcggtcaactcgcctggatcgtcgagaagttccgcgagtggacggactccgaggaggtgccggaggaggccgtggaccgggaccggctgctcaccggcgtgatgctgtactggctgaccggcacggccggttcggccgcccggatctactacgagcgggcccacgcgcacaccggccgggccgctgctcccgccgagccgtccacggtgccgaccgccctcgcggtcttccccgcggagatccaggtcccgctgcggcaccgggcggagcgcacggagaacatcgtgcgctggacggagttcgaccggggtggccacttcgcggcgatggaggagccggacctgctggtcggggacgtacgggcgttcttccggcaactgcgcgaccggcactgaggccacgggcccggccaccggccctgatggtttctctgcccgtg

SEQ ID NO: 1941 - DNA, 2237 bp, Unknown
  Kingdom: Bacteria, Phylum: Actinobacteria, Class: Actinobacteria, Order: Streptomycetales, Family: Streptomycetaceae, Genus: Streptomyces
accgagccccggcccgtagcccctgtgcagccgggccggcacgggtgtcgctgtgcgggagagccccgtgcccgccgggccggcgatctgtgcccgccgggcggcattccgacccccggcccggagagccgtgcagccggactggtgccccgtgtcgctgcgcgggagggcgccattcccaccgggcggggagcctgcgaccctgggccggagccccgtgccacggggctggctcaccgtgccgctgggctggggcccgtacccgccgggccgctccataccgctgggtgggagagtcctgtacccgcacggcgggggctccgcgcccgtgagccggcgccctgcgtcgggcggcctggcgccccgtgcccgctggcggggccccgcgcaggcgggcccgggccctgtgccgccgggccggagcctcgcgcccgcctggcccgcaccaggtgcccgccgcccgcaggccagcgtgtcagaggggcggcgtattgtcgcattgacgtagtttgcagaaggggtggggagggggggtggtccctacagcctgtagggtgacgtcacccccaccgcatcccccaccgtacagagacgagaggtggccgtgtcgagcgtcgcgcccgagccggacgtcagcgttgtcgtcatcgtctacaacgacgaagagcgtcttccggcggccgtcggttccgttctcgagcaaactctgcgcaatgtcgaggtcgtcatcgccgacgactgctcgacggacggctcctacggggtcgcgcaggcgctcgccgcggcccaccccggcaaggtccgcgcgatccggctcgaggagaacagcggcggctgcggagagccccgcaaccagggcatcaaggtcgcccgcggccggtacgtgatgttcctggacagcgacgacacgctggagcgcaacgcgtgccgcaacatggtcgaggccgccgaccgcaccggcgccgacctcgtctccgggctgtgcgtgcgcgtgtacacggacaaccggcacggcaagcgcgtcgcctggtacccgtggctgtaccgcagcacccgcaccctcgactccgtcgccgagctgccggacctgttcgtcttcgacaccctgtcgaccaacaagtgctaccggcgcgagttcctcctcgacaacgacctcgtcttcccgcgcggcatccactacgaggacctgctcttctccgcccaggcctatctggccgcgcggcgcatcaccctcatcccgaacacggtctaccactggaacgtcgtggagaagaccgaggccaagtcgatcagcaaccgccgcggcgagatcaggaacttcgccgaccgggtcgagatccaccgccgtatcgacgccctcctggaccgtcagggcctggagcggctgaagctgtggaaggacatcaagttcctcaagcacgacctcgtgctctacctgcgggaactccccttcctcgacgacgactaccggcacggcttcgccgagctggcccgcggctacgtccaggacttccccgaggcggcctacgccgagctggaccgcgtccacgccatctgcgcccagctgctgctgcgcgaggactggaccgacctgatgccggccatcgacaccctgatcaaccggcacaagatctccaccccgctcaccgagcgggacggccggatctactggaccgaccgctacctcgacgacccggagatgcgctccgtcctggacgtcaccaccctcggctaccacgccaagcggctgaaccagatgtccctgcgcaaccgcctcaccgagtacgcggcgcacgacggcgacatccggctcgccggtgagatcgtcaacccgctgcacaccatcgcccccggcgcgaagctcaccgccgagctggagttccgggcacggcggcgcagcctgcagaccttccgcttcccggtcgccgccctcagccacgagggcgacgcgatcacctggcgcgccgaggtgccgctgacccgccgcctgcgcccgctcggcatcatcgacgacgtctgggacgtccgcctgcacctcaccgccgacggcacgctgaccaccagccgcctcaccgtcggcaccgtcgacctggagcacgccgaggcactgcccgtccggccgcgcctgacgcggctgatggccgaccgcatcgaggcccaggtgtccgccaagggccacctcgccttccggctcgcccagcacggccaggccgcccgcaccggccgcgccgccgtcc

SEQ ID NO: 1942 - DNA, 1470 bp, Unknown
  Kingdom: Bacteria, Phylum: Actinobacteria, Class: Actinobacteria, Order: Streptomycetales, Family: Streptomycetaceae, Genus: Streptomyces
gtccggcggcgtggactccgccgtcgccgcggcccgcgccgcggaagccggacacgacgtcaccggcgtccacctcgcgctctccgcgaacccgcagtccttccgcacgggcgcgcggggctgctgcaccatcgaggactcgcgcgacgcccgccgcgccgcggacgtcatcggcatcccgttctacgtgtgggacctcgccgaccgcttccgcgaggacgtcgtcgaggacttcgtcgccgagtacgaggccggccgcaccccgaacccgtgcctgcgctgcaacgagaagatcaagttcgccgcgctgctggacaaggcgctcgccctcggcttcgacgcggtgtgcaccggccactacgcgaaggtgatcgagcacgaggacggcacccgcgagctgcaccgcgcctccgacatggccaaggaccagtcgtacgtcctgggcgtcctcgacgagaagcagctcgcgcacgccctcttcccgctcggcgacaccgtcaccaccaaggacgagatccgcgcggaggccgagcgccggggcctggccgtcgccaagaagcccgactcgcacgacatctgcttcatcgccgacggcgacacccagggcttcctggcccgccgcctgggcaaggccgagggcgacatcgtcgacgagtccggcgcggtcgtcggcactcacgagggcgcctacggcttcaccgtcggccagcgcaagggcctcaggatcggcaccccggcccccgacggcaagccgcgctacgtcctggacatctccccggtgaccaacacggtgacggtcggcccggccgccgccctggacgtcgacgccctcaccgcgatcaagccccgctggtgcggcaccgcccccaccggccccggcacctacaccgcccaactgcgcgcccacggcggcgagaccgaggtgacggccgaactcgtcgacggcaccctggaggtctccttcaccgagcccgtccgcggcgtcgcccccggccaggcgatcgtcctgtacgacggcacccgcgtggtcggctcggcgacgatcgcgacgacccggcgggcgaccgcgggcgccgcgtgaccgccacggggacccgctacgccccgtagaactccgcgagcaccggcgccagcacctccggctccaccgcatgggtctggccctccaggacgcggtacgtgccctggggggccgcctcggccacctggcgggccgcctcgcgcatccacgccgggcccgcgtcgcccgcggcggccaggaccgggaccgtgatcgacgccagcaggtcacgggggaccgtgccgtcgcccatgaccgcgtcgtcgtacgcgagggccggcgcggggacgcggtggaactgttcctgcgggtcaccggactggccgagcagatgatcgtgaacgcccgccagtcccccatgtggccgggcctggaggccatcgcgccgaccctcgcgtacgacgacgcgg

SEQ ID NO: 1943 - DNA, 1447 bp, Unknown
  Kingdom: Bacteria, Phylum: Actinobacteria, Class: Actinobacteria, Order: Streptomycetales, Family: Streptomycetaceae, Genus: Streptomyces
cctccacgtgcttgcgcggcagttctccgagcgggaggggcatctgcgggtgccgcgcaagcacgtggaggtgctgccggacgggaccgaggtcaagctgggcgccgtcgtggacaacacccggcgccgggccgacaagctgcccgatgagcagcgggcggagtggaccgccctcggcatgcgctggtagcgatcaggcgtaggacagacagggggtcggtcaccactaggtggtgaccgaccccctccatctcgtggcccgggccgtcatgcgggggccggtgcgggccaggacgtccgccacatcttcggcggcgccgagcagcagggcggtctgttccgggttggagtccgcggcctcccggccggcgtagaagctgagcaggggagcttggcgtatgtatctccaacacgaaacccaggagggacccgctggacgccgaccagctcgccgcactcgcgaacctgggggtcgaatgggcatgactgcatgtggttgcgggtgcccaggccgctcaatctgagccgtatccgggtgcgcggtgcatgaaaatgactccgggccgttgctgtcccggagccattctgtcacaagatcactacgtgcttgtcttgaatcgatcgtaaatcgcagccatcgcggtaaagaaactaattgcacccataaacacaactcccgcgtaacacacacattcccaccatgtgtgctgggcgagcctcgcgcctagcagcgtgagcgcggaagcggcaatcgaaaaggttacgacggttagacaggtaaggaacgcggcccacctagtatcgtcttgggtacgtacgtgcatgagtactccttctgtaaacattaagggtcattttttgatccacctttgacttctgtttcttgctctactattgaattgcgttcacccgtcgccgtacgaggtgaacgctttccagcgtcgatcactatttcgacgcctctgcatgaccaaatgcgtgcagacccgcatcatctcggaatcagggtcccctcattgcatacctccttacgatcaagaaacgtgatcacagttgccccgccgttggcggggtgtcgagggtaggacttctcccctctgatgtacagaacgcggatcgcgtcggagcagttcccatcatcacccgttcggggcactgagccgcctacctgcataaacggtgaacgctcgtgccgctcgccacagttgagggcgtgtcagcactcggggctggccgttggccgacgacgaccacgacgttacctccgacgttccccagctgcgcccacacctcgtccgacgccgcatacccctggctccggcctccactggtgggcgagtcggcccggcggtgtcgccggcccagttccagcggcccgggtcacctggccgctgctccagtgcgcgaaaggcgtgcgcagcgggcaggggtcggcgcgtggcggggc

SEQ ID NO: 1944 - DNA, 1211 bp, Unknown
  Kingdom: Bacteria, Phylum: Actinobacteria, Class: Actinobacteria, Order: Streptomycetales, Family: Streptomycetaceae, Genus: Streptomyces
ccttgagcaggaagccgctggccccggcgcgcagggccgcgtagacgtactcgtcgaggtcgaaggtggtcaggacgaggacgcgggagcggtcgcccgtggcgacgatccggcgggtggcctcgatgccgtccatgcccggcatgcggacgtccatcaggacgacgtcggggcgcagctcggcggccttgcgcaccgcttcggtcccgtgcgctgcctcgccgaccacctccgtctcgggcacggagtcgaggagcatccggaagccgtaccgctggagcggctggtcgtcgacgatgagcacggtggtcatcgggcaccgtcctgcggggtgaggtcgaggtcggcccgtaccgtccagccggtgcccgcggggctcgcgctgacctgtccgccgtagagcgccgctcgttctcgcatgcccaccagaccgtgtccttcctcgttcgccgtgcgggggcggccgtccggggcgggcggccccgagtcctggacggtgatggtcaggcgtgtgtcccgcacgacgatcgccaggttcgcacgcgcgcccgcgccggcgtgtttcagggtgttcgtcagggcttcctgcacgatgcggtaggcggtgagctgcaccccgctgtcgagggcgtcgatgtccccggccgtacggtagacgacctccaggccggcggcgcgtaccccttcgcacagcgcgtcgacgtcggtgagcgcgggctgcgggctcagctcgggctcggccggcgggccgtccggctcgcgcagtacgccgagcacccggcgcagttcgcccagcgcctggcggccggtgcccgcgatgaggtgcagcgcctccttgccacggtcgggagcggcgtcggcggcataggcgcccgcgtcggcgagggtgatgatgacggacaggttgtggccgacgatgtcgtgcatctcccgggccacgcgcgcccgttccgcggcgacggcgagcctgccgcgctggtcgcgttcgatctccagccgtgccgcgcggtcgcgcagtccggccagctgggcccgccggatgcggatcaccaggccgagcgcgagcgccgcggtcgccgtgctgagcaggaagaacagcgcgtcccagaccggcaccgccgcggagacccgggccgcgaccaggcccagtgcgcccgccatggccgcgcaggcccacggcagctgccgcagccgcccgtgcagggtcaggc

SEQ ID NO: 1945 - DNA, 1808 bp, Unknown
  Kingdom: Bacteria, Phylum: Actinobacteria, Class: Actinobacteria, Order: Streptomycetales, Family: Streptomycetaceae, Genus: Streptomyces
cgggggtcagccactgcggcccggccggaccggtcccgaccacgaccacctcaccccgctcccgcaccgggcgttcggcgtcgacgcggctgggcagcacggccacggagaagtacggcaccgactccgcggccacgtccgccagcgaaccgacccgctccccgggcatcgtggcccgctcgacgtaccgggcctccgccagccggcccgaaccctccagtgcgcgccgcaccttggggaacgtacggcccagcttcatgacgaccgccgaatccgtcgccgccagccgtgcggccagctcctcctcgggcagggtgcccggaaggacggtcagtatctcctcgccctcgacgagcggggcgccgaggcgggccgcggcggccgagaaggacgtgacaccggggatcacctccgtctcgtagcggtcggcgagccgcttgtgcaggtgcatgtaggagccgtagaagagcggatcgccctcggcgagcaccgcgacgctgcggccggcgtcgaggtgcgcggccagccgcgccgacgccttctcgtagaactcctccaaggcgccccggtaaccgcccgggtggtccgtggtctccgtggtgaccggatagaccagcggcacctcgacgtggtcggagcggatgtgccgcgccgcgatcgagcgggcgatggaccgcccgtgccgtgcgctgtggtacgcgatcacgtccgcgccggcgatggcctccaccgcgcgtacggtcatcagggacgggtcgccggggccgagccccaccccgtacagccggccgctcactccgcctcactcgcgatcgcgttgagcgcggcggcggccagcgcgctgccgccccggcgtccgcgcaccaccaggtgctccaggccggacgggtgcgcggcgagcgcgtccttggactcggcggcgcccacgaacccgacgggcacgccgatgacggcggcgggccggcccgcgccctcctcgatcatctccagcagccggaacagggcggtgggcgcgttgccgacggcgaccacggagccctccagccggtcgcgccacagctccagcgcggcggcgctgcgcgtggtgcccagcttcgccgccagctccgggacgctggggtcggagagcgtgcacagcacctcgttgtcggcgggcagccgcttgcgggtgacgccgctggccaccatctgcacgtcgcagaggatgggtgccccggcccgcagcgcctcgcgcgcacgggccaccacggcgggcgtgtacgcgaggtcgcggacgaggtcgaccatcccgcaggcgtggatcatccggaccgtcacctggctgacgtcggcgggcaggcccgcgaggtccgcctccgcgcggatggtggcgaaggactggcggtagatggccgcgccgtccttctcgtagtcgtagggcgtcacggtgttcttctcgctgctctcggtggtcgtacggatcatggggtgagcgccgccagggcggcggtgagtcgggaggggtcctccaggaggacgctgcgagtgtgcgtcgacggtgacggcgacggcgagggtgacgcggccggcagctgggagaccttggtcactcgggagaccttggtcacgtggtagccgccgccctcggccgcgaccaggtcgaggtggtcgccggggggccgcccgcagcggcgttcgcagccggaccagtacagcggcaggccctgcggggcgagttggcccagggcggcggtcgcgtcagcccgcacgtcggcgtgcgacttggcgcatccgggccgtccgatacaggcgcccacccgcggccaggc

SEQ ID NO: 1946 - DNA, 1243 bp, Unknown
  Kingdom: Bacteria, Phylum: Actinobacteria, Class: Actinobacteria, Order: Streptomycetales, Family: Streptomycetaceae, Genus: Streptomyces
ggccctcgaccagctccatcacgatccatggacggccgtcgtgttcgagcacgtcgtgcacggtgaccacggcggagtggttgatccgtgccgccgcgcgtgcctcggcccgggtgcgtgccaggaggaccgcctggtcgctctccgagacgtagagcgcggcggtcaactcctttatcgccacggcccggtgcagcacctcgtcgtgcgcgcgccagacccggcccatgccaccgctgccgatggagtcggcgagccggtagcggccggcgagcagctggccctgcatctgattcacgtttccccgcaatgttcttgacagggccagcgtagggaccggccccccggcagggaaccggtgggggtaccaagagacagcactgtgacagttgtcgcttcctgagggtcgaggcaactaccgttacttctacggctcaaccggtgtaccggtacgtcgccgacgcctgttcgtacagcttgctcacctggtcccgctgggactccgggccccgcacctgcaccacgtggtagcggccgtcgaggaggacggcgaggttgcgcacgaacagctgccgcccgcccgcgccgctccaggtgaactgtccctcggccatggtcttcccgcccacctggatggtccgcagcccggacgaggtggcccagctggagtcgcggtagccctgcagctcgcgctccgactcacgctgatacaccatcgggtcgctgccgaagcgggccgcgctgtcgcgtccgggcacgacgatcagctcgaagtccccgtgggagtacaccacttggcccaggctgttcttcggcgtacggctccagccgctcgcgacggcgatctggaacccggcggcgtccttgcgcagcgcgaagccgccgggcaggccggcgccggtggtctgcgtctcggccgcgccggacgactgcgaggggctgccgccgccgtccgccgtgctccggccggtaccgggcgcgccgctcgcgtcggagccgcccgagggtgccgcgggccggactcgcccggcccgcggcacccgtacggtcaccaccggccccgtcgccgctgccggagcggtcggacttcggcatgaacagcatcgcgtacgcgaccgccgcggccagcaggaccagcaccagcaggagcagcagccggcccaggctgcgcggcgaacgggcctcctgcctggcccgcttgtgccgcccgtggtgggcgggcagcgcggcgcgccgcctgccc

SEQ ID NO: 1947 - DNA, 578 bp, Unknown
  Kingdom: Bacteria, Phylum: Actinobacteria, Class: Actinobacteria, Order: Streptomycetales, Family: Streptomycetaceae, Genus: Streptomyces
ttccgggcgcgccggagcgcgccgggtccgacgcgctccggcgcgcccggaaaagcgcactgaacgtagccgcgcgactgcgcaaacgattccttggcggtcaaggaatccggtcggcgcggggaatctcgcggagctgaattgccgctgtttacgcgggaatcccgtcaaacctccgccaccgcctccagcggccggtccgcgggcggccgggcgggcgctagcgtgcgcgcggggcgcgtcgccgaagccgaggggcgcaccggagcctgacgggtggtcacgcgggcgccagcacaacgggagtgggtctcaccgcgccgtcgccgtgatccgttcgctctcgatgcgcttggccagcccggtctcgtccagccggtccagattgcggcacagtacgaccgacccgccggccgcgagcggcgcgtacaggcccgcgctcagcccctcccacgtgtcgtacggcagccccgacagcagccgggagccgggtcccgtcaggtccagtccgggcgcgtcggcgcggagtacacggcggccgaggtcgtggaacgggcccgcgccgacgcgcccggact

SEQ ID NO: 1948 - DNA, 647 bp, Unknown
  Kingdom: Bacteria, Phylum: Actinobacteria, Class: Actinobacteria, Order: Streptomycetales, Family: Streptomycetaceae, Genus: Streptomyces
  misc_feature (164)..(243): n is a, c, g, or t
aacggggcgtcgtcgcggaccgggccctgctgcccgagggcctggacgacgcctacccgctgtcgcagaaccagaccggcatgctggtcgagaccctcgcctccgacggccgcaacaactaccacgacctgacgtcgttcctggtccgcgacgacgccccgttnnnnnnnnnnnnnnnnnnnnnnnnnnnnnnnnnnnnnnnnnnnnnnnnnnnnnnnnnnnnnnnnnnnnnnnnnnnnnnnnggtccgcgacgacgccccgttcgacttcgccgccctggagcgcgcggtcgcccgggtcggcgcccgccacgacatcctgcgcacctccgtcgacctgaccggctacagcgtgcccctgcagctcgtacacgccgaggtcgcgatcccgctcggccgggccgacgtacgccacctctccgaggacggactccgcgccgaactggcggagttcgcggcccgcgagcgcgccaccctgttcgacatggcgtcgtccgcgccgctgctgcggatcttcgtgcacgtccagagcgacgaggcctggcgcatcaccttcaccaagagccacgccatgctggagggctggagctaccacaccctcctcaacgaactggtcgacacctacaaggcgttgcgctccggcgccg

SEQ ID NO: 1949 - DNA, 1974 bp, Unknown
  Kingdom: Bacteria, Phylum: Actinobacteria, Class: Actinobacteria, Order: Streptomycetales, Family: Streptomycetaceae, Genus: Streptomyces
ctcgtggccggtgcggcgcccgccgcggcggccggcagcctcatcaccgtcctcgacaactcgcacgccgactcgatcctcgaggtcgaccgcacggcgaacctccagaccggccacggcaccgcgggcagcgaccacgacggcagcgccgtcgacgtcgtcgaagccctcgtgggcgcctcccgcgccggtgagggtgagcgggacggcggctgacccgtccgtccggcccccacccctcacccgtaccgggcgccgcacgacgcggcgcccggtacgggcgtcccggcccaccgagcgaggtgcgggcgccgcgtacgccgaacggccccgagccggactccagcgacggaataccacgcggcgttccggtgctcttgggttaccggggctcgtgtgcggtcggccgggcgcgagcggggtgcagcgagcgcgctgaagggctggtgggcacatgacggcagaccggacggctcccgtggtcagaacgccgcacggggcggtacgcggaacctacgagcacggggtggccgccttccgcggcatcccgtacgcggcaccccccttcggcccccgccggttccggccgccgcagccgcccgagccgtgggacggcgtacgggacgccgtcgcctacgggccgaccgcgccgaagccgccgtactcggaggccttctcccagtacctgtccgatccgtccgtgcccggcgacgactgcctgaacctcaacgtatggacgccggatcccagtcccggagcccggctgcccgtcctggtgtggctgcacggcggcgcgctgacccgcggctcgtcggccgtgcccgtgtacgagggccactccttcgcccgtgacggtgtcgtcctcgtctccgtcaactaccgactgggcgtggagggctacggactgttcccggacgcccccgccaaccccggcctgcgcgaccagctcgccgcgctgcgctgggtccacgacgccatcggcgccttcggcggtgaccccggccggatcaccctgtgcggccagtcggccggtgcgatcagcgtcggcgccctgatcgccgccccgcaggcccagggcatgttccggcgggccgtcctgcagagcgggccgccggaggccacggaccgtgacaaggtgcggcggatggtgcgccgcatggcgacccggctgaaggtaccggccaccgccgaggccttcgccgccgtcgaccgcgacctgctgctgcgcacccaggccgaggtcggccggctcagcagcccggtcctcggcggccccgccttcggcatcgtcgtcgacggcgacctcgtgccccgcgacccgctggaggcgctggtcgccgaagaggccgcccggggcgccgacctgctcatgggctggacccgcgacgagtaccggctgtggctggtgcccggcggtctcctggagcgcgtcgaccggctcggcccggtcgccctggccggtgcgatggcccgctgccactgcggtcacgaggtcgtccgcggctaccgcgccctgcggccccgggccggcgccgccgagatcgtcggccagctggtcaccgaccacctgctgcgccgccccctgcaccgcctggccgacgcccgcccgggttcggcgtacgtgtacgagttcgcgtggccgtccctgctgcccggcctcggtgcctgccacgccctcgaactcggcttcgtcttcgacaccggcgacgtaccggactcgcgccggctcgcgggcgagggcgccccgcaggaactcgccgacgccatgcacgcggcctgggtgcgcttcgccacggacggcgaccccggctgggaggcctgggacccggcgcacccggtccgcgtcttcggcgacggaccgccgcacaccgcgtacggcccacgggacgccgacttcgccctgtgggccgacccggccgccgccgccacgaccggaccggccgccgccaccaccggtcccgccgtcaccaccac

SEQ ID NO: 1950 - DNA, 1180 bp, Unknown
  Kingdom: Bacteria, Phylum: Actinobacteria, Class: Actinobacteria, Order: Streptomycetales, Family: Streptomycetaceae, Genus: Streptomyces
cggctggtgaccgggcgggggcggcccgagtcggagttcgacgcggaggaggtgttcgccgcgtgcgccgagaccggcaccgctgtggagatcaacagccgcccggagcggctggacccgccgcgccggctgctgcgccgggctgtcgcggcgggcgtgctgttctccgtcgacaccgacgcgcacgcgcccggccagctggactggcagatccacggctgcgcgcgggccgaggagtgcggggtgccgcccgagcgggtggtgaccacctggtccctggaggagctgctggcctggacgcgggagcggcggacaccggccggagtgaccggcggctgacgtggtacccgcacggacggcgcgtcgcgcacccgccggcgccgacgacctcatgacgtcgtgactccctggcatgacgtcatggcgtcccgacgtcaagacttcgcaggagaagggaacctcgatggaccgtgccgccgtcttcgatgtcgacggaacactcgtcgacaccaaccacctccatgtcaccacgtggtgggaggcgttccggcaggcgggccaccgggtcccgatgcacgccgtgcaccgctccgtgggcctgggctccgacgatctgatcgcgcacctgctcggcgacgaccgcgacaaggagcaggacgcggccctgaacgccgcccacagcacgctctacgcccagtacttcgaccggttgcccgccctcgacgacgccggccggctgctgcgccgcctgcaccaggacggctggacggtggtcctcgccacctcggcgagcggcccggaactggaggcgctgcgccgggcgatcgacgcggacgacgccatcgccgccaccgcgagcgccgacgacgtcgaggcgggcaaaccggcgcccgaaccggtcgagcacgccctggaactggccggggtgcccgccgagcgcgcggtgttcgtcggcgacaccgtgtgggacatgcgggcgggcagccgggccggggtgcgctgtgtgggcgtcctgtgcggcggcattccgcgcgccgacctggagcaggccggggcggagacggtctacgacgatcccgcgcacctgctggcctccctggcgaacagcccgctggcctgacatgccgggacggactcctggcgcacggcccgggaatgtgccgtgcgccaggagtccgtc

SEQ ID NO: 1951 - DNA, 1945 bp, Unknown
  Kingdom: Bacteria, Phylum: Actinobacteria, Class: Actinobacteria, Order: Streptomycetales, Family: Streptomycetaceae, Genus: Streptomyces
cgagacccaggccccggccccgacaccggccccgtacgccaccgaccccacggagttccgatgacgaccgatcacgaccggagcagccggaaggcgggtacgggaccctcctcctggggcgggccccaggaggagggtcccgtacccgcctgccggctgctccggtcgtgatcggtcgtcatcggaagtccttggggtcggtggcgtacggggccggtgtcggggccggggcctgggtctcggcccggacctggggcgagccggcggtcgaagggagctgcgtgtgtgagtgcgcgtgcgagtgcgggtacggctccggacgtgccggcatcggcggtacgtccctggcgacgtcggccgcgggcgtagcggcgggcaggtcgcgccgttcggggaagacccaggcgcggaagagcaggaagcgcaggacggtcgccgcgaggttggcggccaccaggaccgccagctcggtggagtgcgcgggcgagctggtcgccgcgctcagcgcggccagggaaccgctggtcagcgcgaggccgatggcgaagacgaccagaccctgcgcctggtgccgcaccgcgccgcccggcccgcgcacgccgaacgtcagccgccggttggccgcggtgttggcgaccgccgagaccagcagggcgagcgcgttggcgatctgggagccggcgaactgccggaagaggctgtagagcagcaggtagaagagcgtggacaggaccccgacgacacagaacccgaccagttgccgggccagtcctccgggtacgtcctgcaggtcccggtcgcgcgggtcgtcgccgaagggccgggcgagccggtccagcggcagcgaaccggtggccagcgccttgccgacgcgccacacgcccttcaggtcgtcggtcgccgtcctgacgatgtgcaccgtggagtcggggtcgtcgacccagtcgaccggcacctcgtggatgcgcagaccggcccgttcggccacgaccagcatctcggtgtcgaagaaccacccggtgtcctccaccagcggcagcagcacccgggccacctcacggcggatcgccttgaagccgcactgcgcgtcggagaagcgggcctgcagcgagccgcgcaggatcaggttgtaggagcgggagatgaactcgcgcttggcgccgcgcaccacccgcgagctgcgggcgagccgggagccgatcgccaggtcggagtggccggagatcagcggcgccaccagcggcagcagcgcgttgaggtcggtggacagatccacgtccatgtaggcgaggaccggcgcctcggacgccgaccacacggcccgcagggcgcggccccggcccttctgttcgagacggaagctgctgaccccggccagttccgctgccagccccgccgcgacccgcggcgtgctgtcggtggaggcgttgtccgcgacggtgatgcggaaggcgtacgggaaggtgcgggtcaggtgctcgtgcaggcggagcacgcagggcccgaggtccttctcctcgttgtagacggggatcactacgtccaggacaggcgtaccggcgtccgtggcggggaggtgctcccgagccgggagggtaccgggagaagagtcggttcgcatggcggcgactcttctcaacccccctgtcgcacccgtgtggtgacgctgtgctgggcctgtgagtacgggcccgggacggcctcgcgcacgacttcgggggcggcctcgcgcacgacctcgcgcacgacctcgcgcacgacctcgcgggcggcgtcgcgggcggtctcgcgcacgatctcccggacggtatcgcgggcgatctcatgggcggtctcgcgcacgacggaggtcccgggtccggctccggcgggcgcccggagggcgggcaggtgcaccgtgaaggcggtccgcccgggcacgctctccacggtgacggtgccgccg

SEQ ID NO: 1952 - DNA, 995 bp, Unknown
  Kingdom: Bacteria, Phylum: Actinobacteria, Class: Actinobacteria, Order: Streptomycetales, Family: Streptomycetaceae, Genus: Streptomyces
cccggcaccggcaagaccaccgtggcccggctgtacggcgccgtcctcgcgtcgctgggcgagctgcgctcgggccacctggtggaggtggcccgcgccgacctggtcggcaagtacgtcggcgcgaccgccatcaagaccaccgaggtcttcgaacaggccctcggcggggtgctgttcgtcgacgaggcgtacacgctggcggccgagccgggctcgggcggcgccgacttcgggcaggaggcgatcgacaccctcgtcaagctgatggaggaccaccgcgacgacgtggtcgtcatcgccgccggctactcggcgcgcatgcgcggcttcctcgactccaacccggggctcgcctcacggttcagccgcaccgtcgagttcgagaactacaccgccgacgaactcgtcaccatcgtccgcgcccactgcgagcgcaaccgcctcaccctcgccgacgccaccgggaacgcgctcgccgtccacttcgaacggatgccgcgcgacgacgcgttcggcaacgcccgcgaggcgcgcaaggtcttcgaggagatggtggaccggcaggccctgcggctcgccgggtcggcggacgtcaccgaggacgagctgaccctgctgctgcccgaggacgtcagcgaggaagccgcggcagccgtcgcggccccggccccgggcggcgcgggtcacggctcccgggtcgacgaactcctcgccgaactgggtgcgttggtgggtctggacggcgccaagaaccaggtccgcgatctcgtcaaccttctctccaccgcccgccgccgccgggcgagcggcctgcccgcacccgccatcggccaccacctggtcttcgccggcccgcccggcacgggcaagacgtcggtggcccggctgtacggcgacctcctcggcgcgctcggcgtgctgccccgcggccagctcgtggaggtggcccgcgccgacctggtgggccgctacatcggccacaccgcgcagct

SEQ ID NO: 1953 - DNA, 611 bp, Unknown
  Kingdom: Bacteria, Phylum: Actinobacteria, Class: Actinobacteria, Order: Streptomycetales, Family: Streptomycetaceae, Genus: Streptomyces
cgccgccctcggcaacctgtacaccgaggtcggtgaggagcaggcgcaggaagcggtgaccgccgcctgggaagcggggatccgctacttcgacaccgcgccgcactacgggctcggcctgtccgaacgccgcctgggcgccgccctgcgcgggcgtccccggtcggcgtacacgctctccaccaaggtgggccgccgcctcgaacccgcctacggcaccgggaccggcaccggcgacgacctggccgcaggtttcgcggtgcccgccacccaccgccgcgtctgggacttcaccgccgacggcgtccgccgcactctggaggcgagcctggaccgcctcggcctggaccgcgtcgacatcgtctacctgcacgaccccgacgaccacgccgagcaggccttccgcgagggatacccggcactcgagaagctccgctccgagggcgtcgtcggcgcgatcggcgcgggcatgaaccagtccgcgatgctcacccgcttcgtccgcgacaccgacgtcgacgtggtgctgtgcgccggccgccacaccctcctcgaccacagcgccctcgccgacctgttgcccgccgcccaggaacgcggggtctcggtcg

SEQ ID NO: 1954 - DNA, 1988 bp, Unknown
  Kingdom: Bacteria, Phylum: Actinobacteria, Class: Actinobacteria, Order: Streptomycetales, Family: Streptomycetaceae, Genus: Streptomyces
gtgctcgtgctgtactcggacggcctgttcgacccccgccaggacgaggccgccaccctgctcggcgccgccgcggacgcgcccggcaccgacctggagggcctggccgaccgcctgctgggccgggcgaccgggccgcacggccggcgcgacgacgcggcgctgctcctggcccactacgaggggccggacacccggcaggtgccccgcaccggacacctctccatccagcgccgtgacctgcgcggtgtcggtcaggcgcgggcgttcgtgcacgagcggctgtgcggctggggcctggcggacctgtcggacgacgtcgaactcgtgacctccgagatcgtcaccaacgcgctcgtccacgcgggcagcgacgtcgacgtgcggctgcgggtctacgacgaccggatccgcctggaggtacgggactccgcgagcaatccgcccgtacccgccctctactccctgtccgacgagggctgctcccgggccgagcacgggcgcggactcttcctcgtggacgccctggccgacacgtggaacacctctccgaacgggcgcggcaagaccgtgtggctggagatggacatcccgccgtcgcaggagcgtacggccgccgatacggagagttccggccgaccggtcgaatgacttgacacctgacctcggcacacctcagccgcaacgtcctgagacgacttctgaccgtcctcgcggccggtgtgccgccggcggcggcggtgtacctgccgaccggagcctcggcggccaccgggagccacgcctttgcctggcagtggtgtccgggcgcgcgcagagccgtgtgccgagcgcgggtgcggtcggcgcgcccggcagttggccgccgaccgcggtggcccggtgtggagtcccaggcaccggtcgcgcctgccgcgctccgacaccgggtgtacggcggagcgcgcaggatcctggagatggccgccatcgcttcgggggaagtgagcgaaggcggtcatcctggtccccgccaccaggccagccaattgatcaccatggcggcgggggtctctgtgtggctcaacggtccccggggcaggcggagttggcgtcacgggaagaagaatgccgtgaggtgcgcccggttcccctcgggatgccgtcggctctccgtcctgcaggaccctagaggccgagatcggcggccaggcagttgagacgcacctcggggtcgtaggcgccctccgccgtgttcctcgggttcgcctgcttctcctcgaccatgtcggcgtaggagatgcgctcggggagcgtgccgaaccgcgcctgacgggctgcggctgcgtcgtccaccgtgatcttgatgttcatcgtcgactccgctgggttccgcggcggatggttccgtcgtgtccggatgccgggagtctgacacccaccggcgtcacctgtcaaataggtgacgccggtctcggtgtgcgcaggactctccgacgccgtgccgggagccagttcagctgcttttggtcgaatatgtgtccccgggtgtgcgcctgcggagccggatccggccgccccgggcggggacgagcgtcaccgagaccagtcgcgcgggctcctggggcccggccggctcgggaacggccgacgcgaggaccaccttcaggacggtctcgatctccagttgggccagtgacaccccgatgcagcggcgcacacccccgccgaacggggtcagcgcgtacggagccgggtccgcgcccaggtgccgttcagggcggaagacgtccggctgcggccacagccgcggatcgaggtgggtgagcgggaacagcgccgcgacgaacgcgtgccgcggcaccgggtggccaccgagccgggtgtcccgggccgcggtgcgcatggcgttccagacggcggggcgcagccggccggactccttgaccgtggccttgagcaggcggtccgagccggcgtcgagatcggcgatcaggtcgtcgcgggcg

SEQ ID NO: 1955 - DNA, 1715 bp, Unknown
  Kingdom: Bacteria, Phylum: Actinobacteria, Class: Actinobacteria, Order: Streptomycetales, Family: Streptomycetaceae, Genus: Streptomyces
ggctggccgccgccctggtggccgcctgcgagcgcacgggcgtcgtcttccaccgcacctgggccgaacggctcaccgtcgagcgggagcgggccacgggctgcgtgctgcgcgacggcaccgcgctcggcgccgagcaggtggtgctggccgccggcagcctcagcggacgcctcgcgggcgtgccggacgagctgctgccgccggtgcggccggtgaagggacaggtactgcggctgaccgtgccgaagcggtacgcgccgttcctcagccgcaccgtgcgggccgtggtgcgcggcggccacctctacctggtgccgcggctcagcggcgagctggtcgtcggggccaccagcgaggagctgggctgggacaccacggtgacggcgggcggcgtctacgagctgctgcgcgacgcgcacgagctggtgcccggcatcaccgagctgccgctgaccgagacccgggccgggctgcgccccggctcccccgacaacgcgccgctgctcggcccgaccggactggacggcctgctggtggcgaccggccactaccgcaacggcgtgctgctgacgccggtgaccggtgacgtcatggcgcacgtgctgacgaccggcgagctgccggacgaggcccggtccttcaccccgcggcgttttcgcgccgccgccctcacggagcagtccgcatgaccctccccgtccgcatctccgtcaacggcgagccgcgcgagttcgcgcccggcacggccctcgacaccgtcgtacggaccctgaccgcggcccccaccggggtggccgccgccctgaacgagaccgtcgtcccgcgcaccgagtggcccgccacggccctggccgagggcgaccgcgtcgagatcctcaccgccgtccaaggaggctgacccatggccgacgaccccttcgtcctcggtggtacgtccttcacgtcccggctgatcatgggcaccggcggtgcgcccagcctggacgtcctcgaacgctcgctggtggcctccggcacggagctgaccacggtcgcgatgcgccgcgtcgacccgtccgtgcacggctccgtgctgtccgtgctggagaagctcggcatccaggtgctcccgaacaccgcgggctgcttcacggcgggcgaggcggtgctcaccgcccgcctcgcccgggaggcgctcggcaccgacctggtcaaactggaggtcatcgccgacgagcgcacgctgctgccggacccgatcgagctgctggacgcggcggagacgctggtcgacgacggcttcacggtgctgccgtacacgaacgacgacccggtgctcgcccgcaagctggaggacgtcggctgcgccgcgatcatgccgctgggctcgccgatcgggtccgggctcgggatccgcaacccgcacaacttccagctgatcgtggagcacgcgcgcgtgccggtcatcctggacgcgggcgccggcacggcctcggacgcggcgctggccatggagctgggctgcgcgggcgtgatgctggcctcggcggtgacgcgggcgcaggaaccggcgctcatggccgaggcgatgcggcacgcggtgacggccggccgcctggcccgcctggcgggccgcatcccccgtcgccacttcgccgaggcgtcgtccccgacggagggcctggtcgccctggacccggaacgcccggccttctgacgccggcaggaccgca

SEQ ID NO: 1956 - DNA, 1220 bp, Unknown
  Kingdom: Bacteria, Phylum: Actinobacteria, Class: Actinobacteria, Order: Streptomycetales, Family: Streptomycetaceae, Genus: Streptomyces
ggtctgcgagtacacctcggaggtcgcccaggtcgtcgaggacgcctggatctgcaaggtgtggcgccgcaccccggaactgtcggacctgtggggcaccgccggaccgacgccgaaggagtccccgcatgaacacccccaccccgccccgccgcgtcggcctcatcggctggggcgccatcggccgcgtcgtcggcggtgcgctcgccgcgggcgggatccccggcgccgagctggtgtgcgtggtcgacaaccggcccctcggggactccgcgcccgtcccgcagtacaccgtcgaacaggccctggaacactgcgacttgatcgtggaggccgccgggcagggcgtcgtgcgcgagtggggcgagacggtcctcgcctccggcaccgacctgctcgtcgcctcgaccggcgccctcaccgacgacgacctcgccaagcggctgctgcacaccggacccggccgcgtctacttcaccggcggcgcggtcggcggactcgacctgctgcaggccgtacgcgccatgggcccgctcgacgaggtccgcctgaccaccacgaaactccccgccacgctcgaacagccctggatggacgcggagttgctcagccgcatgcggtcggccaccggaccggtcgaggtgatggcgggcaccgcccgcgacgtcccggcgaagttccccaagtcgaccaacgtcgccgcctccgtcgcgctcgccgtcggtgaccccgacaccgtccgcgtcagcgtcgtcgcggacccggccgcccggcacacctcccacgtgatcgaggcgagcggcacgcacgggacctaccgcttcgaggtgcgccacctgcccgacgccgccaacccggccaccagccaggtcgtcccgtacgccgtactgcgctccctcgccgcgctcgccggacggacgggacacatcctgtgaccgccgcccacgacacctccggacccaccgcctacgacatctccggccttcacctggaggaggccggcgacagcggccccctgctgctgtgcctgcacggcatcggctcgtcctcggcggccttcgcgccccaactcgcggtgctcagcggggcgttccgagtcgtcgcctgggacgcccccggatacgccaagtccgcggacccgcaaggcccgttgacgatggacgactacgccgacaccgccgccgtgcgctccgcgcgcacggcggcggtgtcggcgtagt

SEQ ID NO: 1957 - DNA, 1828 bp, Unknown
  Kingdom: Bacteria, Phylum: Actinobacteria, Class: Actinobacteria, Order: Streptomycetales, Family: Streptomycetaceae, Genus: Streptomyces
catcgcgatctggccggacgacagcgaacacgcctagcgggcacctggggggctcgtccggccagatcgcgatgtggtccggttccagttccagggccacgcggtcgcgcatgccgagggcctgggtgtagtcggccgggagctggaggcggccggcgcggtccagcatggcgtactcgcggctcaccacccgctcgtcgcccgtcgcctcgtcgacctcgctgcggcgcagcacctccgtggaggtgcggccgtcgcggatggcgaccgtgcggcggacctccgtggccaccgcctggtcgtgggtgacgatgacgatggtggtgcccaggcgttcgttggcggtgcggaaggcggcgaagacctgctcgccggtctgcgagtcgagttcaccggtgggctcgtcggcgagcaggaccgcggggttgttggcgagggccaccgcgatcgcgacacgctgctgctggccgccggacatctggtgcgggcgccggtcgcggcagtcgccgacctccagcagctccaggagttccagcgcgcgttcggccttggcgcgccgggcgcggccccgggagccggccagctgcatgggcagcgcgacgttctgcgcggcggtcaggtagggcagcagattgcgggaggtctgctgccagacgaaaccgacgacctcgcgccgatagcgcagccggtccttcgcggtcatggcgagcaggtcgtggtccccgacccgggccgcgcccgccgtgggcgtgtccaggccggcgaggatgttcatgagggtggacttgccgctgccggacgcgccgaccagcgccatcagctcaccctggcgcaccagcaggtcgagcccctgcagggcctgcacctccacgccgtcggcggagaagatgcgtaccagccggtcgcaggtgatcagggcgtcgtggccgtaggcgggccgggtgcggtcctctgtggcgcgccgggccaggtcggcgagggtgggattcgtcgtcatcggaaggctcctgcacggcggctacggcggctgaggcgactatgacagctgcggcagcggaggctgccgcagctgctacggctacggcaggtactgatgtgaccgctgttacggctacggctacggcggcggcttcgcggtgcaccggggaccgtgctcatcgcgcgtcccccgcccgcagctcccgcaccgagcccctgcggcccgtccaccacgcctgtccgacggcgacggccaccgccagcagcaggacccccgccgccggcagggccagcgacagcgggtcggtgcgcagcacgttctcgccggcggagacggcgctggacggcagcgcgatggtcgtcaggtcgatgccgggggagagcaggcggatggtcgcccagcccgtcagcgcgccgcccgccgcggcgagcaccgcctgcgggagggactccaggacgaggaggaggcggccctgggcgcgggtgaggcccatggtgcgcagccgggcgagcatcgcggtgcgttccggcgcggcccgcagcagcgcgagcagcagggcgagcaccgcgtagccggtgccggccgcgaccgccgccgtgtagatgtgctcggcgccggactggagcggggagtcgacgtagcgggcgcgttcggcggaccgcagctgcacgccgacggacgcacccgcagcccggcgcagcgcgcccgcgtcgaggtggtcgccggccagcagcagcgtgctcgtgcgggcggcctggctgctcagcccggaccggtccacgaccaggaaccgggtgccgatcacggccggtgtccggtcgcggacgacggtgatgcggacggtgaccg

SEQ ID NO: 1958 - DNA, 1811 bp, Unknown
  Kingdom: Bacteria, Phylum: Actinobacteria, Class: Actinobacteria, Order: Streptomycetales, Family: Streptomycetaceae, Genus: Streptomyces
ctactggaccgcggcccacgcgcgcggccggggcgtggcaccccgcgcgctcgaggcgctgaccgactgggccttcgcgacgttcgccgcgcagggactgacccgcctgcgcctcgtgcaccaggcggacaacacggcgtcctgccgcgtcgccctcaaatgcgcctacgagctgaccgggaccctgcccgccgcgccgcccgtccatccgctcgacggacacgtccacacccgtgcgcggctcacgggcgcaggtccacgatccgcctgatcttgccgaccgaccgctccagcgactccggttccacgatctccaccgcgaccgacaccccgatgccgtccttcaccgccgccacgatggaccgggccgccgcccggcgcacctcgggcccggcgccgggacgggcctcggcacggaccgtgagggcgtcgagccggtcctcacgggtgagccggagctggaagtgcggcgcgacgcccggggtgcgcagcacgatctcctcgatctgggtcgggaagaggttcaccccgcgcaggatcaccatgtcgtcgctgcggccggtgatcttctccatccgccggaaggcccgcgccgtgcccggcagcagccgcgtcaggtcccgcgtgcggtagcggacgatcggcatcgcctccttggtgagcgaggtgaacaccagttccccctccacgccctcgggcagcacctcaccggtgagcgggtccacgatctccgggaagaagtggtcctcccagatgtgcgggccgtccttggtctccacgcactcctgcgcgacaccgggcccgatcacctccgaaagcccgtagatgtcgaccgcgtcgatcccgcaccgctcctcgatctcccgccgcatctcctcggtccacggctccgccccgaagacaccgacgcgcagcgaggtggaccgcgggtcgacgccctgccgctcgaactcgtcgagcagcgtgagcatgtacgacggcgtgaccatgatgacccggggctccaggtcctggatcagccgcacctggcgggcggtcatgccgccggaggcgggcaccaccgtgcagccgagccgttccgcgccgtagtgcgcgcccagcccgccggtgaacagcccgtacccgtacgccacgtggacgacgtcgccggtcctggcgcccgccgcgcgcagcgagcgggccaccatgtccgcccacatcgacaggtcgccgtccgtgtagcccacgatcgtggggagtccggtggtgccgctggaggcgtggatgcggcggatgcgttcgcggggcacggcgaacatcccgtacgggtagtgcgcgcgcaggtccgccttggtggtgaacgggaaacgggccaggtcggcgagcgaacggcagtcctcggggcggacaccggccgcgtcgaaggacgcccggtagaaagggacgttctcgtacgcgtgccgcagcgaggcgcgcagccgctcgcattgcagcgcccgcagctcctcgacgccgagccgttcccccgggtccagcagccgtgccgcatccgccatcgggactctccctcacctgccacgaccatacggtcgatcgctcgaccgatcattcggtcgagatgctggagatcagtaatccaggccaccgcgccccgggcaaggcccgacggcgaaattccttgccgtccacggccgcgtcggccaggatcggccgcatgccgagcttcaccgcgcccgacgggacccgtctcgcctaccacctgcgcggggagggcgagccgctggtcgtgctgcccggcggcccgatgcgcgcctccgcgtacctgggagacc

SEQ ID NO: 1959 - DNA, 2290 bp, Unknown
  Kingdom: Bacteria, Phylum: Actinobacteria, Class: Actinobacteria, Order: Streptomycetales, Family: Streptomycetaceae, Genus: Streptomyces
  misc_feature (1880)..(1954): n is a, c, g, or t
gcgaggaccacgccgagcgcgacgacgcccgctggcgccgccacatcgtcgtacggctggattccgcgcgtacgcccctcgtgcacaccacggacaccgcagacttccccccgacccgacccgaggccaccgcgccccgccgtccccaggagcagtgacacaagtgagcaccgaagaccttcccctcgcctcgaacggaggctgcggcgacggctgtgcctgcggcgcggacgccgacgaggagtacctggagtgcgggctcgaccccgcgctcaccgagctgctggcaggcgccggactcgaccccgtggagatcgaggacatcgccaatgtcgccatccaggaggacctcgcgaacggcgtggacgtgacgacggtcgcgaccatcccggaggaggccgtggccaccggtgacttcaccgcgcgcgaggccggtgtggtggcgggcctgcgcgtcgccgaagcggtcctctcggttgtctgcacggacgagttcgaggtcgagcggcacgtcgaggacggcgagcgcgtcgaggccgggcagaagctgctgtccgtcaccacgcgcacgcgtgacctgctgaccgccgagcgcagcgccctgaacctgctgtgccgcctgtcgggcatcgccagcgccacgcgcgcgtgggcggacgccctggacggcaccaaggccaaggtgcgcgacacccgcaagacgacaccgggcctcaggtccctggagaagttcgccgtccgggccggcggcggcgtcaaccaccgcatgtccctgtcggacgccgccctggtcaaggacaaccacgtcgtggccgccggtggggtcggggcggccttcaaggccgttcgggaggccttcccggacgtgccgatcgaggtcgaggtcgacaccctgcaccagttgcgcgaggtcgtggacgcgggcgccgacctgatcctgctggacaacttcacgcccggtgagtgcgaggaggccgtggcgatcgtcgacggccgcgcgctcctggaggcgtcgggccggctcaccctgggcaacgcccgcgcctacgcggagaccggcgtcgacttcctggccgtcggagccctcacccactcctcgccgatcctggacatcggcctggacctgcgcgaggcggagtaggaaccggccatgctcctgaccatcgacgtaggcaacacgcacacggtcctcggcctgttcgacggggaggacatcgtcgagcactggcgcatctccaccgacgcccgccgcaccgccgacgagctggccgtgctcctgcagggcctcatgggcatgcacccgctgctcggtgacgaactgggcgacggcatcgacggcatcgcgatctgcgcgaccgtgccctcggtcctgcacgagctgcgcgaggtgacccggcgctactacggcgacgtaccggccgtgctcgtcgagccgggcgtcaagacgggtgtgccgatcctgaccgacaaccccaaggaggtcggcgcggaccgcatcatcaacgcggtcgcggccgtcgagctgtacgggggcccggccatcgtcgtggacttcggtacggcgacgacgttcgacgcggtctccgcgcgcggggagtacatcggcggcgtcatcgcccccggtatcgagatctccgtggacgccctcggcgtcaagggcgcccagctgcgcaagatcgaggtggcccggccgcgcagcgtgatcggcaagaacaccgtcgaggcgatgcaggccggcatcgtctacgggttcgccgggcaggtcgacggcgtcgtgggccgcatggcccgcgaactgtccgacgacccggacgacgtcaccgtgatcgcgaccggcggactcgccccgatggtcctcggcgagtcctccgtgatcgacnnnnnnnnnnnnnnnnnnnnnnnnnnnnnnnnnnnnnnnnnnnnnnnnnnnnnnnnnnnnnnnnnnnnnnnnnnnacggcgcggtgcgccacaccgcacgccacgaacgcgccttatgtcgaatttgtctgattagcgcgtatggtcggcctatgcccacgccatacggaacccgcggcggcatggcgttcggcgcggaggagctgcgtgtgctccgccgcgccctcgccgtcgcccttcatctccgtcccgcccgcgccgaggacgtgcaggactgtctccgcctcgccgagtcgctcgacgaggcgatgcgcgagggtgctcggctgcgcgcgttcctggtggccgacctggcccgctaccgcgacgcgctgcccgggacggccgtcggctacctcgcgctcctcgaag

SEQ ID NO: 1960 - DNA, 2438 bp, Unknown
  Kingdom: Bacteria, Phylum: Actinobacteria, Class: Actinobacteria, Order: Streptomycetales, Family: Streptomycetaceae, Genus: Streptomyces
ggtcaggcgggatcggcggcggaggggctggtcggcggcagcggggcggcggcgagaagcgggatcaactgctcctcctcgtaagcgagatgattctccagctcccgagtgagccgtacgacctcctcgcgcgccgcgtcccgcggtccctccgccgagaccgcgcggcgcaggctgtcgacgaggccggcgatccgctcgtgctcctcgcgcagccggtccagggccggggcggactgcgggtgccgctcggcgaggaacgggaacagggcggtgtcctcaccggtgtggtggttgtgcaggccctggcagaaggtgaggcagttgacgcgcaactgcgcacccagcgtgctgccgtcgcccgccgccatctcctgccggatcagcgcgagttcgcggcggaacgcgtcatggaccactttgatcgcctcgccgggcgaggaggcgttgatgtgcggcggcccttcgcgctcgacctcgtacagggcgaccacgggaatgatccgctcggtcttctcctggtaggccgcccagccggggtcggcctccaccgcccgcgcgaaggcacggtcgcgttccgcgccggtcaggacgaccgcccgcgcctcgtacgtgaacgcaccgccctccacggtcgcccgcggacgggcgaggaggttgcggtaccagtccgggtgccggggcgagccgcccgccgacgcgatgaccaggacgcggtcaccgccgtcgggcagataggcgacgggggtggtgtgcggggcgccggtacgcgcgccggtggtggtcagcaggaggatgcgggcgttctcgaagtacccggtgagcaggccccggtgggcgcggaactcgtcgatgacacgttggttgaagtcgttgggcatgggctgctgtgtctgctttctctggcgttgctgctggcttctggcgcgaagcgcggaggcgcgctgtgatgcgctgcggtgtgtcctgtgcggtgctgtgcagaaggcgcagagaaaacggcgggctcctggcccgcgcggacctcactcggaggccgggcaaccaactcgctcacggcccaaggccgacccggcagtcatgggggagaccgtagccgcgcaacagagcccgcggcaacggactttcggccgactagggtcgcacgcatgaccgattcggagagcatgaattcagagaccgcgggttcggagatcgtgaattcagagaccgcgggttcagggcgtgctggttcacagggcgcgggcgcggccttccgggacattcccacgaccaccctcgccgacctcctgggccgtgagcacgtcatggacatcgggatccgcccgctgtggcagccggcgccgcgtgtggccggaccggccttcacggtgcggtgcccgcccggcgacaacctcatgctgcacgccgccatccaccgggcagcgcccggtgcggtgatcgtcgtggagtccggtgacctggactacgcgctcgccggcggcaacgtgtgcgccgtggcacagcgccggggcatcgccgcgttcgtcgccgacggcctgatccgcgacctcgcggaggtgcgcgaactgggcttcccggtcttcgcccgtggcgtcatcccggtccccggcggcaagtcggcgctgcggcccctgaacgaacgggtgcgctgcggcggcgtcgacgtcgaggcgggggacgtggtcgtggccgacgaggagggcgtggtgacggtcccgtccgcccgcaccgccgagatcctgcaggcggcccgcgcgaaactcgccaaggaggcagcccagtccctggacgactgggaggcggcccaccgtgcccgcatcgacgcgctgttgaaggaacggggctacgaggagacggccccgcctcgctgaggggcgcgcggtcggcgccgcgccgcaggtgcactcttgcaagcagtgtgcttgcaattgttagcgagggtggtgcatggtggagacatggcatcgctcaacgtcggcaatctcggtgagtacctgcgcgagcagcggcgcaacgcgcagttgtcgctcaggcagctcgccgatgccgccggggtgtccaatccgtacctgagccagatcgagcgcgggctgcgcaagccgagcgcggaggtgctgcagcaggtcgccaaggcgctgcggatctccgccgagacgctgtacgtgcgggccggcatcctcgacgccgagcgggaccgcgacgaggtcgagacccgcgccgtcatcctggccgaccccacgctcgacgagcggcagaagcaggtgctgctccagatctacgagtccttccgcaaggagaacgggttcggggccggcaaggcgggcaaccgggacgagaccggacagcaggacggccgcgcggacgccgacggtaccggtcgtaccggcggcaccgatggcggtgacggtcacggcggcgccgacaccggcggcggc

SEQ ID NO: 1961 - DNA, 1620 bp, Unknown
  Kingdom: Bacteria, Phylum: Actinobacteria, Class: Actinobacteria, Order: Streptomycetales, Family: Streptomycetaceae, Genus: Streptomyces
tggtcctcgacacgctgggcaagcgctgcccgcttccggtgatcgaactggcgaaggtcatcggggacgtgccggtcggcggcacggtccgcgtcctcgcggacgacgaggccgcgcgcctggacatcccggcgtggtgcgcgatgcgcggtcaggagtacgccggggaggaaccggcggagcggggtacggcgtacctcgtccgccgggtgtcctgagggaccggcctccgtccgcccgtcgtgctgacgggcgggctcaggggagaccggtcctggcgggtcggctcaggcgaggtgggtcctgacctcgcgggccgcgtcgtcgccgtacgccttcgtgaagcgctccatgaagtgggcgcggcgcagctggtactcctgcgtgcccacggtctcgatgaccagcgtggcgagcatgcagccgatctgcgcggcgcgctccagggagacgccccaggccaagccggacaggaacccggcgcggaaggcgtcgccgacgccggtcgggtcggccttgcgctcctcgtccgggcagccgacctcgatcgggtcctcgccggagcgctcgatgcgcacgccgcgcgagccgagggtggtcacccggtggccgacgcggtccaggatctcggcgtcgctccagccggtcttgctctcgatgaggcccttctcgtactcgttcgagaacaggtacgtggcgccgtccagcagtatccggatctcgtcgccgttcatccgggcgatctgctgggagaagtcggcggcgaacgggatggaccgcgcacggcactcctcggtgtgccgcagcatcgcctccgggtcgtcggcgccgatcagcaccaggtcgaggccgccgacacggtccgcgacggtcttcagctcgatgaggcgggcctcgctcatcgcgcccgtgtagaaggagccgatctggttgtggtcggcgtcggtggtgcacacgaagcgggcggtgtgcagggtctcggagatgcgcaccgagccggtgtcgacgccgtggcggtccagccaggcgcggtattcgccgaagtccgcgccggcggcgccgacgaggaccgggccggtgccgagctggcccatgccgaaggcgatgttggcgccgaccccgccgcgccgtacgtccagctggtcgaccaggaaggagagcgagaccgtgtgcagctggtccgcgacgagctggtcggcgaagcggccggggaaggtcatgaggtggtcggtggcgatggagccggtgactgcgatgcgcacggcgtggacgctcctggtgggcggagggactgacacttcacgctacccgttccgcacagagcgctgaagcgggcgaaactacccgatagtagatctttctcggcggcgtgtgacgtgcttacggttccgtcatgacgaaccacgaggtccatgctgcccccgctccggccgacctggacggtgatctggcgtcgctgcgcggcgactgcgcccggatggccccgcgctggtcggcccccggccggaagtccggccccgcccggtcggcggcggtctccgccgcccgcatccacggcgtgtcggtcccggactcctccgcccggctgctggaagggatgtccgagtacggggactgaga

SEQ ID NO: 1962 - DNA, 3177 bp, Unknown
  Kingdom: Bacteria, Phylum: Actinobacteria, Class: Actinobacteria, Order: Streptomycetales, Family: Streptomycetaceae, Genus: Streptomyces
gcgggccgcactgtcccgctcggcccaggccgcccgcctggactggctgcgcaggctgctcgcgcgggggtgagggtcaggcgggaccccgtctgttcgcgtccgcgacgccgggtaccggcgtaccgctcgggaagtcgttcttcaccgcgtcgacgccgtgctgcgggcgggccgggtcgaggaagctccaccgatcggtgcggcggtcctcggtgtccaggcgcacggcgtggtcacggtcctcgatcaggctctcgtcgcactcgccgtcacgattgacggaccacatcagcttcgggtcaccgtagggcagatccatgcccgggcggccgtggtcggtggtgtgaagcggtgggcctccaccttgaaccgggggcagccctgaccccggcagggtcgccaccgctcagggggtgaaacggcgcgagcgcgccggacacggccgcacggtcaccgcgccccggccagaagccccctcctccgccgactccaccgggccccaccggtccccaccggtccccaccggcaccggactccaccggattcgggcacacaactgttaccgacagcgattgtctgtcaacatcgtgcaaaggcggagcgaacggggcgcgtggtgtcgcagtcgatccaggactcatggcgtgtgcggattctcggcgcggacaacacaccggtgggatcgggtgttctggtggacggggggcgggttctgacgtgtgctcatgtcgtgcaaggcgcactggagttggcggaggacgagtccccggaggggcgcagcgtcgttctcgaccatccgggttccctgagcgatgaggtgtcgtacgcctcggtcctgccgcagggctgggcgccgccccacgaggaacgcgcggacgtcgcggtgctggagctgaccggtccgccgccctccgactgcgtcccggcccggctgcgcccgtgcggtcccgtgcgggagcgggccgtgcgggtcttcggccagtcctcgcccgccgtgcccggtctctgggcggccgcgcggctgctcggcgcgggcgggctgagcccggactgggtccagctggacggcggcctggacgggaccgaggggcgggtgcgcggcgggtacagcggggccggcgtcgtcgacgcggacgggtacgtcatcggcgtcgtcgtcgccgtactccgcccggccggatcccgtatcgcctggatgatccccgtcgaggccgtggtgcgttactgcccgctgctggccggggccgtgcacggcgagagcgtgcccgcgcccgcctggccgcgcggcgcggaccgggagctgaccaccgcgctggtgaagctgccgagcatgcgcgatccgcagcgccgcgagagcgtgctgcgcgacgccggggacgagatcttcgacctcgccgagcggtcgccggtcctggtcgaggacgtgcgcggggtcgtggcgctgtgcctgcagtacgcggacggcatcgaccggctcgccgccgcgctgcgctggtacgagcgcgggtcgctgccgatgcgggagttcgagcgcgtggtcctgcggctgcgcggcgacgcgggagcgacaccgtgacgggcaccggcggcacaccgcgcacggacctgttctgggaactggccggcctcatcgcccacatcccgggactcactcacccgcagccgatgcggcgcgccgcggaggcgttcgccgaacagttcgggccggtggacgccgaacgctcgggcatgctcagggaggacctctacgccacgctgcgggcctgcgacgcctaccccgaggggctgcggttctacctggaccggctgggcagcggacgtaccaggaccctggcgtggcgggccgtcgagcagatgtacctgcggctgtacccggagcggctgctcacgtccgccgagcgcgacgagctgtgcgccctgctcgcgcagcggtccgccgccactccgctggagccgctcgcgctgcgcttcctgccgttcctgccgcggcccgcggcgggcgacggcgccggcccggaggcggtcgcggaactgctggacgcgctggaggacgccctcgtcccggcggacgaggcgcacccgctgctctgtttcgtcgaggccgtcgcggcctgccagcaggggtcgctggaggccgggttgcaggcctggaacgacaaggtggcgcaccgcatcggctgcccggcggagctgctgcgcagggtccgcttcctggaggggacccgcgtagggcggccggccgagccgtaccggctgctcgtggagatcgtggcgcacccggccgcccccgacgagtaccacgtgcggggctggctgctggccccggcgcacgggccgcactccctgctcgccgactgccgggtggcctcgcgggccgcgctggagcagacggtcggcgcgctgcaccagagcgcactggaccggctcggggagctgagcgccgggatgaaggtggagttcctgctgccccggccactgctgtggctggacgtcgaccagttcctgatccgcccggccggatcggtggcccggcccatcggcgccgaccacacggtcctggtgcgcagccgcgaccggttccacaagcggtactggtggcccgcgctgcaccgccgtctggcatggctggaagcccatcccgacggcggtttcgaggccccggccgtgcggtacgtcgctcccggccgcgccccggagccgtacgacctgctgagcgaactgcgcgacggggagacgccgttctgcttcgtgctgctcgaaccgcccgcgtacgacggcgatctggcggccgatccggtctacgttcttctggaggtgggcattcccgccatcgtcgcgctgcgccgccagggccggcacgcggacgcgcggccccagttgtggaatctgctggccggaaggttggatgcgctgcccgaccgggtacgacatctgcggggcgtcggtccgggcggcggcgggtcagcggtgacgctggacctgcatcgccacgtcaccctagtgtgggacagccaagacggactggagggggcggaggccgcgctcgggcatccgcggaccgggggtggccaaccatgaccggggagacgaccgaccagcgtgaggcacggcagccccgtcctcccgcatggtgggtgttccgggacaacggcgcgcagcacgcgccgtccgaac

SEQ ID NO: 1963 - DNA, 762 bp, Unknown
  Kingdom: Bacteria, Phylum: Actinobacteria, Class: Actinobacteria, Order: Streptomycetales, Family: Streptomycetaceae, Genus: Streptomyces
ccccggcagggacccccgccgccccagatgcggcgtcgagttcagcagcccgaacaccgagtgcacggccgaccgcgccgcaggctcggccagctccgggtgcacctgccggaccacctccacccacagctcgacgtactgccgctgcagctgccgcaccagcttgcggtcgctgtcccggaggcggtccagctcgcggtcgtgcaaggtgatgagggaccggtcgtcgagcgcgaagtcgatgtgcccctcgatcagcgagtcgaggaccgcgtccggacccgccgccccgtccgcctccgcctccgccaggcgccgcttcgccccggtcagcagctgcccgctgatgccgaccagcagctccgcgagcatggcgtccttgccggggaagtggcggtacaggcccggtccgctgatgcccaccgcggcgcctatctcgtcgacgccgacgccgtggaagccgcgttcggcgaagagccgcgcggcttccctgaggatctgctcgcggcgggtgggggcgtcggttcgcgtggccatgagaacaattctagacagcggcgttagcgctcgttaacctggaggagatgggttaacgctcattaacagtggaccactgggtgaggggaccgcgaggatgcaggaggcaccggagctgacgagcgcggcagaccccgcgtcggaggcctggcaggccaacgaacaggcgcaccgggcgctcgtcgaggagctgcgcggcaagctggccgccgcccggctcggcgg

SEQ ID NO: 1964 - DNA, 1078 bp, Unknown
  Kingdom: Bacteria, Phylum: Actinobacteria, Class: Actinobacteria, Order: Streptomycetales, Family: Streptomycetaceae, Genus: Streptomyces
tcctcgtcgatcgccaccagcaggtcgtcccgctccgcacgcaactgtgctgtcagctcggtgacctgctccggcgaggcgacgttgtggccgaacagggcgacggcggccagcccttcgccgatgcggcggtgcacccagtcgggtgccgtggtgccggcgaatcccggctgcagcaccgcgagggcgtcgcgggcgagggactcgtggccggtggcactcatggtcatcgggggcgtcatcctttcgcggcgccgtcgctcggaccgcgctcacagcctttgccttgcgggggcggtgtccgcgtggcccctcgcgctgctaccgggggtccggcaccgattggtgtagaccttcatcggggagcttggcctagacttttgctcggcgtcaaggtcgcccgaccggtccgccctcctctcatctggactggaccaatggcgagttgagggttataacgggaggccggtgagacggccgggaaggcaggccgtgaccaacgctgtcagcagtgcccgccaccggcggccccgcccgggctgtcgcgtgcgggtggtgcccccgtactaccgcatcaagcagcacgttctggaaatgacggaggcgctggtgcccggctcccgcatacccgccgagcgattactcgccctccggttcgacacctcgcgtaccactgtccggccggccctccagggactcgcgcgggagagccggctcggccgtgtacacggggggaaaggcacgttcgtgggcccgacgcacggctctcccgggggttccgcctcggcctcggcccaggcccaggcgagcgcgtaccgcgcgtcggacggctgcgaccggccgtcggcgaagccacggcggtcgagacggggcaccgacacctgtcggtccgctgtatcccagccggtcaagggtgttggccgctcccggctcctcgtacaccgcactcgccgagcggcacggcgtgcgcctggcagacgccgagggggccttcgaggccgccgtcgcgaccccgtgcgaaaccgcacgcttcgccaccggcgtcgccctcacactcccgctgccgctgccgctgccg

SEQ ID NO: 1965 - DNA, 727 bp, Unknown
  Kingdom: Bacteria, Phylum: Actinobacteria, Class: Actinobacteria, Order: Streptomycetales, Family: Streptomycetaceae, Genus: Streptomyces
cccccggcagcatggccgccccccaccgtgacggcgaactgcgccgtaccttcccggcgctgcccgccctgcccgcgaccgccccggcgggccggacagaatccggtttcgcacgcacctggtggggcgaggcatgggtcaccgccctggaggagggtgcgctggacgcggcccgcctggcccggggccgcggttacgcgcagacgggacacgtggacgccatcaccgtgacacccggcctggtcctggcgtacgtacagggcagccgtccgcgtccgtaccgcgtccaggtacggctgcggacactggacgacaccgagtgggaccggttcctggacgccgccgccgagcgtcccggtcacatcgccgcgctcctcgacaaggagatgccgcagtccctgaccgagtgcggggttccgctgctgcccggcccgcacgacctcgaaccgcactgcgcctgccccgaccgcggccacccctgcaagcacgcggcggccctgtgctaccagacggcgcggctgctcgacgccgacccgttcgtcctgctgctgctccgcggcaggggcgagcgggaactgctcgacgccctgtcccggcgcagcgcggcccgcgccgcacgcgccgcccaggagcggggcccggaaccgctgccgggggagcgtgccgccgacgccctcgcgcgtcgcccgctgccgctgcccgccgcgctgccgcccccgccgcatcc

SEQ ID NO: 1966 - DNA, 725 bp, Unknown
  Kingdom: Bacteria, Phylum: Actinobacteria, Class: Actinobacteria, Order: Streptomycetales, Family: Streptomycetaceae, Genus: Streptomyces
ggaggggggtgagggggcggggtcggtggccggtggcgaggacgacggcgtcggtggtgaggctggtgcgggtgccttgctgggtgtgttcgaggtggagttcgattttgttgccggcgacgcggccggcggtgcggacgcggacgccgggggtgagggtggtgtcgggccagcctccgtggagggtgcggcggtagagctcgtcgtggatggcggcgagggtgtcggcgtcgatggctttgtggagttgccattgggcggggacgaggcggtcgcggacgggttcgggcagggcgtggaagtagcgggtgtagtcgggggtgaagtgttcgaggccgagttttgagtactccatgggggcgaatgcttcggtgcggccgatccagtggagtcgttcgtggccggtggggcgggcgcggaggaggtcgaggaagacttcggcgccggattgtcctgagccgacgacggtgatgtggcgggcggcgaggagtgtgtcgcggtggtcgaggtagtcgttggcgtggacgacgggggtgccgggggtgttggtgagggggcgtagcttgctcttatacacatctgacgctgccgacgatatgcagtgtgtagatctcggtggtcgccgtatcattaaaaaaaaaaatgcgtaccgtctccgccaccaggccgcgcagttccttttcgaaggcgatcggatagatgtcatggtacttctccggcgggtt

SEQ ID NO: 1967 - DNA, 933 bp, Unknown
  Kingdom: Bacteria, Phylum: Actinobacteria, Class: Actinobacteria, Order: Streptomycetales, Family: Streptomycetaceae, Genus: Streptomyces
cctcccgctcgcccggctgaccagcgtcgacaccaaggccgcagagcccggcgtcgtcgcggcggcctcgcggctgggggtgccgctggtgacgtactccgccgcggagctggccgctgtggacgtgccgaacccgtcggacgcgtcgctcgccaccctgggcaccccgtcggtcgcggaggccgccgctctggccggcggcggtgaactcctcgttcccaaacggaagtccaggccggcgggcggacgtccggcgatggcgacgtgcgcggtcgcacggctccccgtcgcacccccgccaccaggaactcccgaccggaccggacatcaccttcacgacgggcacacgcatgcgcatgcagactgaggatcacggggtggcgcggcagggcggcgggcacgatctgcgccaccacggggacgcggaggtacgggacgacggttcggcgctggtcgacctcgccgtgaacgtgcgcaccggcaccccgccggactggctgcgggagcgggtcgcgggctcgctcgcctccctcgccgcctatccggacgggcgggccgcgcgggccgcggtggccgcccggcacggactgccggtggaacgggtgctgctgacggtgggcgcggcggaggcgttcgtgctgctggcgcgggcgctgaaggtccgccggccggtcgtcgtgcacccgcagttcacggagccggaggcggcgctgcgggacgcgggacacaccgtgggccgggtgctgctgcgcgcggaggacggcttccggctcgacccggcggacgtccccgaggacgccgacctcgtggtggtcggcaacccgaccaacccgacgtcggtgctgcatccggcggcggtgctcgcccgactcgcccggccgggccggacgttggtggtcgacgaggcgttcatggacgcggtgccgggcgagc

SEQ ID NO: 1968 - DNA, 1681 bp, Unknown
  Kingdom: Bacteria, Phylum: Actinobacteria, Class: Actinobacteria, Order: Streptomycetales, Family: Streptomycetaceae, Genus: Streptomyces
agacgggcccgtcggagccgccggtcgcccgagagccggagggttcctccgtctccgctgcggtcgcgctacggtcgagccggacggtcagctcgtccggtgcggggccgccgggccggggtacggggccgacggcccggggctcctgccacggatcctcgacccgcagcgcgggcacggcaccggtctccgggaatctctgagcaccgtcgccctcctgagcgctccgcgcatccggtgcatccggtgcatccgctgcaccgccttcggcggcaggcaccgcaccggtcgccgacgcggcctcgggccatacgggttgggcttgttccagcccctttttcacgcgcacgttcgttcccccacgggagtgttccgggcgcgcctacgaccccgagcccgcgtcgccggaacaggcccccacctgcccgagcgccccccttgtcccaccctgctcggcgctcatgaacgtacgcccctggagaccgcccccaccgcgaaagatcaatggtgaacggaattgaccgattcgccgttggctggaacccatccggtttcggtcgccgtatctccgaccggcccggtctccggtctgatccttgcggcgggggcggtgtccttcgggcccgtcagcccgccgcgacaggaagcaggggaacgcccagaccgcggtacgcctcgggctcggtggtggcgacttcccagccggtcgtcatgctcatcacggctgcgtgcaggaccggccagccctgcccggggaagagcgaagcggctgtccggcccatggtgtcggcgacgacccggtcgaccgacgccacctccacggcggagagttgagccaggtacgtcgcgatgcccggacggcccctggtcgcctcggcgaggctgagggcggggacgatcacggtgaacagcgggtcctcgtgcgccgccacgatgaacccggacagcaggcggtggccccgccccagagccagaagaccgtggtggtccaggacgacgccatcgctcacgccgctgtgcccttgcggcgcctggcgtccgtgcgcgccttgctcgcggccagcatgccgcgcgcctcgaccaactcctcctcggacagcgtctgcccgtccagcagcgtttcctccacgaactgccgcgcctgctcggcccgccgacgccgctcgacacggctgcgcatggtctcgttgatcagcgaagacaacgacggggcttcaccggcctcgaccatctgctggagcgcatcgagcagatcgggatcgagggtgacggagatcggcttcttcgcgggcacgatacgagggtatcgtatggtcatgcgagagactcctatacggaaggacggcgggtgggatcagcagggctgggcagcgcgcatcgaggcgcgaatgcggtcgacgtgtgcgtgcacggtcatcgccggggtgcccgccgcccaggtcggaggcaccgtcccgctgccgtcccggcaggctcggcagagtccgcccggcagggcttccgggcggccggggactcggcagtcggtgcactccatgagagcgggaggtgcttgtcgcccagtcggggcgggcggcagtttgtcgaccagccgacgtcgcacgaacgcccccggcgcgtggacgtgctccggcaggccggtcacgaggacccgcgtcaggtgaccggcctgccggagcac

SEQ ID NO: 1969 - DNA, 2091 bp, Unknown
  Kingdom: Bacteria, Phylum: Actinobacteria, Class: Actinobacteria, Order: Streptomycetales, Family: Streptomycetaceae, Genus: Streptomyces
ctcgccctcacccacaccccgcgcgaagtgcagttctactgcctggacttcggcggcggctcgctcaccggcctggccggtctgccgcacgtcggtcaggtcaccggccgcctcgaccccgagcgcatggcccgcacggtcgccgaggtgaccggcgtcatcgcccgccgcgagcggctgttcgccgagcacggcgtcgagtccatggccgactaccgcaggcgccgggccgcgggcgagttccccgacgaggcgtacggcgacgtgttcctcgtcgtcgacggctggaacaccgtccggcaggacttcatggacctggtgccgacgttcaatctgatcgcctcgcgcggcctcaacttcggtgtgcatctgatcgtcgcgtccggccgctggtccgagatcagcggcgcgctgcgcgaccagctcggcacccgcttcgagctgcgcctgggcgaccccgtcgactccctggtcaacatgcgggccgccggcggcgtcccggcggtgcccggccgcggtctgaccgcggagcgcatgcacttcctcaccgcgctgcccaggaccgacggcgactcccgtgccgagaccgtcgccgagggcgtggccgcgctggtgcgggaggtggccggcggctgggacggcccgaaggcgccgccggtgcggatgctgccgctcaccctccccgccgccgaactgcccgctcccgacggcgatctgcgggtgccgctgggcctggaggacctgcgtctcgatgtgttccaccacgacttcgaggagcatccgcacctcgtggtcgtcggcgacgtcgagtccggcaagaccaacctgctggcccacgtctgcgacgcgatcgtcagccgctactcccccgacgaggcgcgggtgctccttgtcgacttccggcgcggcctcgccgacaccgtccccgacccgcaccggctcggctacgcggtcggcctcgacctgctgcgcaagatggtcgacggcgcggcccgggccctgaaggaacgcgtccccggacccgacatcggcccggcccggctcaagctgcgcgactggtggtcggggccgcggctgttcgtcgtcgtcgacgaccacgagctggtctccaccggcgggtacggcgcgaacgacccgttcgggccgctgcacgaactcctcacccagggaaccgaggtgggcttccacctgatcgtggcgcgcggcgcgaacggcgcgggccgtgccatgacgtccgacgcgctgctgcgccgcctggtggaggccaacaccccggtgctgatgctgtcgtgcccgccggccgagggccaggtcgtggccggcacgaagccgagggtgctgcccccgggccgcgcgctgtacatcacccgccgccgcaccgtccaggtgcagacggccctgcgggcctgacgggcccggacacgcgaaaggaacaccatggcccgccagaccgtcctcgccacccccgagaccaccgtcgccgccgcgctggacgccgcccgcccgggcggcgtcgtccggatccggcccgggcggtacgacgagaacctcacgatcaccaagatggtgacgctggtcgccgacgaaccggacgacccgcccgagatcgccccgcgcgacggctcggccgtgcaggtcctcgcggaagcagtcaagctgtccggtctcgtgctgcgcggcgccgacgcggacgcgcccgtggtggacgtgccgcgcgggcaggccgagctggagggctgcacggtgcacggcaacggctggaccgcgctgctgtcccgggagcgcggctcgctggcgatacgggactgccgcgtctccaacgcggcgggcgccggcctcgtcgacctctcgcccgagcccagcgtcgtcgccgactgcctgttccagaacctgggcagctcgggtctcgtcctgggcgaggacgccgtgacagtggtgcgctcgtgcaccgtacgggactcgcgcggcaacggactgctggcgaacggccgggccgccggcaccgtcacggacctcgtcgtccggcgcaccgtcaagccgggtgtggccctggaggagcaggcgggcacccggctggtgcgggcccgcacc

SEQ ID NO: 1970 - DNA, 669 bp, Unknown
  Kingdom: Bacteria, Phylum: Actinobacteria, Class: Actinobacteria, Order: Streptomycetales, Family: Streptomycetaceae, Genus: Streptomyces
ctcgtggtacgcatcgccgcccagcccgccgcgcacgaggccgcgaagccgtcgttgcgggcgatcgccgagggcgcccggtacgcgtggggccgcaaggaactgctcgggacgtacgccgtcgacctggccgcgatgttcctcgcgatgccgctggcggtgctgccgttcctcgcggacgagctgcacgcccgctggtcgctgggcctgatgtacgcggcgctgccgctcgggtcgctgctggtgagcgtgaccagcggctggacctcgcgggtgcaccggcacggccggatggtggtgctggcggcgctgctgtggggtgtctgcgtggccgtcgccggagtcgtcggcgatgtgtggctggtgctgctgtgcctcaccgtggcgggcggctgcgacatggtgagcgggatcttccgtggcgccatgtggaaccagaccatcccggacgcgctgcgcggcaggctggccgggatcgaactgctgtcgtactcggtggggccgcagctcgggcaggtccgctccgggtcggtcgccgcgtggtggggcgtacggacgtccgtgtggtcgggcggcgtactgtgcgcgggcgcggtggggctgctggcgctgtgcctgccggggctgatgacgtacgacgcccggacgaacgagcacgcggtgcggctg

SEQ ID NO: 1971 - DNA, 822 bp, Unknown
  Kingdom: Bacteria, Phylum: Actinobacteria, Class: Actinobacteria, Order: Streptomycetales, Family: Streptomycetaceae, Genus: Streptomyces
ccccaaggacaggggcccggaggcgacagaccgccgcacccggacccgcccggccccccgttccctggccctggtcctgctgtgcctgctgaccctggtcctcggcggcttcgccggctgggcgcacgcgcgcgcacggagcctgcacgacgacccggcggtccgcaacaccgccctgaccgacccggcccgcacgagcgagatcaagacgcagacggagcaggcggtcgcagccctcttctcctacaaccacgccgaccccggcacctacgacaaggccgtgaagacgctgctcaccggcaaggccgtcgcacagcacaaggtcctgctcgacagcgtgcgcacccgcgccgaccagcagaaggcggtcatcaccaccaccgtcaccgacagcgcggtcgagcgcgtcgacggcgaccgggcccgggtcctggtctacgccgaccagagcagcgtcagcaccgccgggaccaagggcaccacggccgcgaagaacaagcacgccacgaaggaccagcagggcacgaaggaccagcaggcggcgcaggaccaagggacgtacgcaggcgccatgttcgccgtcgacgtcgtcctgcgggacgggcactgggtcgtctccggcatcgacaccttcggccgctgaggaccaccgaccgacgggccgacgaggtcccaccgacagggagtgacacccatgcccgcacgccgtgtacgacgtctgcgcgcccgtacccgccagggcctgcgggcctccgccatcgccgtggccgcggtggccgcgctcaccgcatcccaggcgcccggcgccatgggggcggcggc

SEQ ID NO: 1972 - DNA, 1960 bp, Unknown
  Kingdom: Bacteria, Phylum: Actinobacteria, Class: Actinobacteria, Order: Streptomycetales, Family: Streptomycetaceae, Genus: Streptomyces
ccgcccacctcgccgccgccgtcggcacccccgtcgtctccctgttcgcccccgtcgtgcccgccggacgctggcggccctacggcgtcccgtacgtgctgctcggcgaccagaacgccccctgcgccggcagccgcgcccgcagctgcccggtgccgggacacccctgcctggaatcggtgaccgccaccgacgtgctcgccgccgtggagaaggtgatgaagacgtgaggatcctcatctggcacgtgcacggctcctggaccaccgcgttcgtccagggcccgcacacctacgtcgtccccgtcacccccgaccgcggccccgacggcctcggccgcgcccgcaccttcgagtggcccgactccgtcgccgaactcccgccggagcggctgcgcgacgccggcatcgacctggtggtcctccagcgcccccacgagtacgacctcgtacggcgctggctcggccgcaccccgccgatggtgtacctggagcacaacgcccccgacggcgacgtgcccgacacccggcaccccgtcgccgacctgcccgccggcatcccgctcgtccacgtcacccacttcaaccggctgatgtgggacgcgggccgcgccgagaccgcggtcgtcgagcacggcatcgtcgaccccggcccgctgtggaccggcgaggtgccgcacgcggccgtcgtcgtcaacgagcccgtacggcgcggccgtacgacgggcacggacctgctgccggggttcgcgcgggcggctccgctggacgtcttcggcatggggaccgacgggctcgctgcccacctcggcctgccgcccgaccggtgccgcagccacgaactcgtccagcgcgacctgcaccgcgagatggcccggcgccgcctctacctccaccccgtccgctggacctccctcggcctgtccctgctggaggcgatgcacctcggcatgcccgtggtcgcgctcgccaccaccgaggtcaccgaggcggtgccgcccggcgccggagtggtctccaaccggatcgacgtactggccgacgccgtacgggacttcgtcgccgacccgcagcacgcccgcgcggtcggcgaggcggcgcgcaccgccgcgctcgcccgctacggactgacccgcttcctggacgactgggagcggctgctgaaggaggtcacccgatgaggatcgccatggtgtccgagcacgcgagcccgctcgccgcgctcggcggggtcgacgccggtggccagaacgtgtacgtcgcccgtctcaccgaggagctggcgcgccgcggacaccacgtcaccgtccacacccgccgcgactcggccgagctgcccgaccgggtgccactgcccggcggcggcgtcgtcgagcacgtaccggccggaccgcccgaagtcctccccaaggacgccctgttcgcgcacatgccgtccttcggcgcccacctggcccgcgtctggcgccgcgagcggcccgacgtcgtgcacgcgcacttctggatgtccggcatggcctccctgctcggcgcgggaccgcacggcgtgcccgtcatccagaccttccacgccctcggcaccgtcaagcgccgccaccagggccgcgaggacaccagtccgctcgaacgcatcggcatcgaacggcagatcggccgcacctgcgaccgggtcctggccacctgctccgacgaggtccacgaactcgccgccatgggcatctccccgcgccaggtctccgtcgtcccctgcggcgtcgactccgcccacttccaccccggcgcggaccccgccaccgcgcccgcccccgcccgcgcgcaccggcaccggctgctctcctgcggccggctcgtccgccgcaagggctacgaccaggcgatccgcgccctcacccggatccccgacaccgaactcctggtcgccggcggcccgccggccgccctgctgcacaccgatcccgagg

SEQ ID NO: 1973 - DNA, 1349 bp, Unknown
  Kingdom: Bacteria, Phylum: Actinobacteria, Class: Actinobacteria, Order: Streptomycetales, Family: Streptomycetaceae, Genus: Streptomyces
accgctccggcccccgccgcgaccaccccgagccaccacatgggcgccgccccggcccgtacgacgacggccacccgggccagtccccgtccgcctcgtcctccccgctcgccgtgcttcccacggtctcgctctgcccgctctccacggtcctcgcgcgttccgcgtgccacgtgctgcctccttcgctccccggcacactccggctctcccggcacactccggtcagtccgggcgggaggctagcgagcgttcgtgagacgagtctgagagcacacggcggccagacggggggggcggcacaccgcccggcgccgcccggcccgttcagtcctcgaacaggccgcgggccgccgccttcgcgtcgaactcctccagccgcgcctgcgcgtcgggcaggtcgtcgcacatggcttccaggagcacccggcccagcagcatcggcgcgcaggcggtgtcgaaggcgagcccggtgccgacggccgcgggcagcagcaggtcggagtggcgggcgaccggcgcgaacgccgagtcggcgacggtgacgacggccaggccggccgccttggcgtaggcgagggtgtccaccacctcgcgcggatggcgcggcagcgcgaagcacagcagcgccgacgccccggcccgtacggcgccgtcgatacggtcctggatcatcgtgccgccctcgtcgagcagccgtacgtccgggtggaccttgccggcgaagtacgcgaagccgtacgcctgcgaggcggcggcccgcagtccgaggaccggcagcgggcgcgaggcggcgagcaggcggcccgcctgctggaccggcccgggatcggcgagcgcctcggccaggtgccggaggttctcgatctccgcctcgacggcctgctggtactcgttggccgcagcggggcggtccgccggttcggcgggtgcgacctcgcgcaggtggcggcgcagcgccgggtagccgtcgaagccgagggcgaccgcgaagcgggtgaccgacggctggctgaccccggccacttcggccagctcgacgctggacaggaacggcacctcggcggcgcgccggaccatgctgtgcgcgatgcgccgctgggtcggcgtgagccggtgcccctcgaagagctcctgcagccgtgcggcagggctgtcggtcacgctcatgacgtgctccccctccagaagtcgtcgacgccccgggagagtaccccccgaccagttgctattcagacaccaagaactctgcatgaagtcatacaggctgagcaagggaaccaccaagtgtcgcccggtcggcacgaggagtgaccgaatgcgtgctaatcgtgaacggacgcggtcgc

SEQ ID NO: 1974 - DNA, 2875 bp, Unknown
  Kingdom: Bacteria, Phylum: Actinobacteria, Class: Actinobacteria, Order: Streptomycetales, Family: Streptomycetaceae, Genus: Streptomyces
accgcgaagctgctggggcggcgcagcaccaggcccgtcgggatgccccgccccagcagcttcgcggtgcgctccaggcgggaccacagggcctcctggaagaccgggtccagctcgcgcggcgaccagtcgggctgggcccgccgcacgtcctccgcgtggacgtagaactcgacggtgttggccgcctcgtcgacctgcttgagctggaagggtgaaaaccgcggcgggccggtcctgatcagctggatcagctcctcgtacggcttcccggcgtactcctgcagaaccttctccagccgggacgccagcggcttgatcagcgcgcctcccgccgcgtccgggcgccgctcgcgcaccaccacgtgcgcggcgagatcacgggtgagccagccctcgcagagggtcggcgcgtccggaccggcggtctccaagaggtcggcgagcaggagccgttcacgcttggcaaaggtcgacatgggctcagcctacgactccgcgccgggtccgcccactggacggccgccgccggccgccggccgtgcgcggcacaatggcacccatgaccagcacgcccggcaccccccggcccagcagcctcgacccggagatcgccgcacgcctcaagcgcggcgccgacggcctcgtccccgccatcgcccagcagtacgacaccggcgaggtgctcatgctcggctggatggacgaggaggcgctgcaccgcacgctgaccaccggccgctgcacctactggtcgcgcagccgccgggagtactgggtcaagggcgacacctccgggcacttccaatgggtcaggtccgtcgcgctggactgcgacgccgacaccgtgctggtcaaggtcgaccaggtcggcgccgcctgccacaccggagagcgcacctgcttcgacgccgacgtcctgctcgaggacgcgggcacggacggcgccccctccgccgccgcggatcagtaaggtcggccgccatggacctcgagaccttccgcaaactggccgtcgaccgccgcgtcatcccggtcacccgcaagctcctcgccgacggcgacacacccgtcgcgctctaccgcaagctcgccgccgagcgccccggcaccttcctgctggaatccgcggagaacggccgctcctggtcccgctactccttcgtcggcgtccgcagctccgccaccctcaccgagcgggacggccgcacccactggctgggcaccccgccggtcggcgtccccgtggagggcgacccgctcaccgcgctgcgtgccaccgtcgaggccctgcacaccccccgcgacctcacccacgacctgggcctgccgcccttcaccggcggcatggtcggctacctcggctacgacatcgtgcgccgcctggagaagatcggccccggcgagcgcgacgacctgaagctgcccgagctgaccatgctgctcacctccgacctcgccgtcctcgaccactgggacggcacggtgctgctgatcgccaacgcgatcaaccacaacgacctcgacaccggcgtcgacgaggcccacgccgacgccgtcgcccgcctggacgcgatggaggccgacctgtcccggccggtcgcacagcccccggccgccctgccgccctccgaactgcccgagtacaccgcgctgtggggcggcgccgacttccgcacggccgtcgaggacgtcaaggaacgcatccgcgccggcgaggccttccaggtcgtcccctcccagcgcttcgagacgccgtgcacggcgagcgcgctggacgtctaccgggtactgcgggccaccaacccctcgccgtacatgtacctgttccgcttcgacggcttcgacgtcgtcggctcctcgcccgaggcgctggtgaaggtcgaggacgggcgggccatggtccacccgatcgccggcacccggccccgcggcgcgaccccgcagcaggaccaagccctcgccgacgaactcctcgccgaccccaaggagcgcgccgagcacctgatgctcgtcgacctcggccgcaacgacctcggacgggtctgcgagcccggctccgtcgaggtcgtcgacttcatgtccatcgagcggtactcgcacgtcatgcacatcgtctcgacggtcaccggacgggtctccgccggccgcaccgccttcgacgtgctgaccgcctgcttcccggccggcaccctctccggcgcgccgaagccgcgcgcgatgcagatcatcgacgaactcgagccctcccggcgcgggttgtacggcggctgcgtcggctacctcgacttcgccggcgactccgacaccgccatcgccatccgcaccgcgctgctgcgcgagggcacggcctacgtccaggcgggcgccgggatcgtcgcggactccgacccggtggccgaggacaccgagtgccgcaacaaggccgccgcggtgctgcgggcggtgcacaccgccaaccggctggccccgtagggcgagtgcgggagcgggcgggcggcggatggggtgcatctcacggaaccccgggtgacggtcggccccggctccacgcgatagtggagtacgtgactgctgttcctcacccccgtaccgaagccgccgctcccgcccggtccggccgccgcagcctcgccgtcgccctgctctgcggcgcgctcggcgcggccgtcgcgctgctcgcctcccggcagcgctgggcggagggcaccgcgtcggtggccggcggcgccttcccgctgagcgccaagggcagcgaggtcacgggcgtgcccgcggcgctcgccatagtgggcctggccgcactcgtcgccgtcttcgccgtgcgccgctccggccggctgctggtctcggccctcctcgcgctctccggcgc

SEQ ID NO: 1975 - DNA, 2091 bp, Unknown
  Kingdom: Bacteria, Phylum: Actinobacteria, Class: Actinobacteria, Order: Streptomycetales, Family: Streptomycetaceae, Genus: Streptomyces
cgtccttggcgatcgcgcggatcgtcgcccgttcgtacccgtccgtcgcgaaccgcgtccgcgcgatcgccaaggacgccgggatcgacccgtccatggtcatgcgctactacggcaacaaggagagcctgttcgcggcggccgtctccgtcgacctgcggctcccggacccgtcggcgctgcaccgcgaagaggtcggccgcgcactcgtctcccacttcctgtcgctgtgggaggagaacggcgaactgacggcgatcctgcgggtcgccgtcaccagcagcgccggggccgagcgactgcagggcgtgttccgggagcaggtgctgccggtcgcccgggcggtgtgcccggatcccgagcaggtgaccgcgcgggcggccctgtgcgcgtcgcaactgctcgggctggccctcacccgctacgtcctgcgcatcccggcggccgccgccctggcgcgcgaggaggtcctggcgtggctggcgcccaccgtgcagcggtacctgacggctccgagcccctgacggcgtccagccctgtcagctccctgctcctgacggtccggcggacaacgcacggagggcgcccgttccgcccgcgtacggcgatgcgtacgcggggcgggacgggcgccctccgcgggaattcctgaggtctccgggcggaccgggtcggccgtgcccggaggtgggcgtcaggccttgacgtccacgttccggctggtgccctgctgcttgtgggacttgtccagcaccatgaccagcccggcgatgaccaggaacaggacgagcgggataccgacgaagagccccagcgtctcggcgacgccgatacccttgccggggtcgtcaccgtcgtcgcgggtcaccgcgagcgcgggggacgacatgagcagcatcatcagcgtcgtaccggccgccagggtgccggcgcgcagggcgttcttcttgtccacagtgccaaagtagcgaacgccggaacggggcgcgcgcccggggtgccgtatgagccccgcaggccctccgcgcgcccccgcgctcaccccgccgcgcccgccgtaccgctcactccccgttcgcttccatgcccgtcgtcccggcgcgcagcacgtccgtcagcgcgtgcaggcggggtgcggcggcgaggtcctccagtgtcacgggccggccctcggcgtcggcgacgggcagccgccagttcggatactcgtcccaggtgccggggaggttctgcgggcggcggtcgccgacggcgtcgggaagccagagaccgaccatgcgggcgggcgtgcgcagcaggaagcggtgcacggcgcggatcccggcctcgatacgagcctcggcaccggactgcgcagtggcctccccgctggtctgcgtaccggcctcgccaccggcctgcgtaccggaccgcgggtccagcaggcccagttctcgcagcagcgccagccattcgtccgcgtcggccgcggcctccgcgcgctcctcctccagcgagcgggtgagcaggccgaggcggtggcgcagtgcgacgtgctcgccggtgaggcgggccgcggtgggcggcaggtcgtgcgtggtggcggtggccaggcagtcggcgcgccagcgctcggggggcagggggcggccgtcgccgtcccagtcccgttcgaaccacagcaccgaggtgccgagcacgccgcgccggtccagggtctcgcgcacgccgggttcgacggtgccgaggtcctccccgatcaccacggcccccgcccgcgaggcctccagcaccagggtcgcgagcatggcgtcggcgtcgtagcggacgtacgtgccctccgtgggcgggcggccctgcggaacccaccagagccggaacagacccatcacgtggtcgatgcgcagggcgccggcggagcggaacagggcgcgcagcaggcggcggaacggggcgtacccggaggcggcgaggcggtcggggcgccaggggggcaggccccagtcctggccgcgggcgttgaaggcgtccggtggcgcgccgatggacatgccggcggcgaagtggtcctgctgggcccaggcgtcggcgccgccggggtgcacgccgacg

SEQ ID NO: 1976 - DNA, 1103 bp, Unknown
  Kingdom: Bacteria, Phylum: Actinobacteria, Class: Actinobacteria, Order: Streptomycetales, Family: Streptomycetaceae, Genus: Streptomyces
catggacccggccagggtgctggccctggccgcgcacctgggcgacggaccactgccccgtgtcctcgtgctcgcctgcgaacccgcggccaggaccggatccgacgaggacatcgcgcccggactcagcgaccccgtgcgctgggcggtcggccacgcggtggacgccctgcacacactcgtccccgtcctgctcgcggaccccgccgcccccgccgccgccctgccgttgcgccgcccggaccaatccggaccaccgcgcacggccgcgctgccgcacctcacggccggcgccgtccacgatcggtgaggcgccggtcgtcccgtacgagcggccccctcctgaaccgactgtgaggagaagtgccatgtgccggtccgtcgacgtcgagcaggccgtcctcgccaagaacgaccgtctggcccgggacctgcgcgaagacctcgcccggcagagcgcggccgtcgtgaacatgctgtccagtccgggcagcggcaagaccgaactcctgggccgggtactggcccgagcagtcgccctggacatccgggtggcggcgctgaccgcggacctcgcgaccgagaacgacgcccaccgcctcgcccggtcgggcgcgcccgtacgccaggtgctcaccgacggactgtgccacctcgaagcccgccagctgcgcaccaggctggcgggctggctgccggcggacaccgcgctgctgttcgtggagaacgtcggcaacctcgtctgcccggcctcctacgatctcggtgagcggctgcggatcgtgctgatggcggtgaccgagggcgaggacaaacccctgaagtaccccaccgcgttcggctccgcccacctggtcgtcctcaccaagacggacctggccgagccggccggcttcgacgaggcggccttccgcgcccacgtgcagcgggtcaaccccggggtggaggtcgtacgcacctgcgcccgcaccggcgacggcgtcgacaccgtactggaacgcgcgctcgccgcccgccacgaggccccgacgcaccgcccacccctggccccgcacccgcacggccacgaccacggacatcacgaccacccgcacgcccccgat

SEQ ID NO: 1977 - DNA, 1727 bp, Unknown
  Kingdom: Bacteria, Phylum: Actinobacteria, Class: Actinobacteria, Order: Streptomycetales, Family: Streptomycetaceae, Genus: Streptomyces
cgccgcgcgcgggtgcgccgaactgccgcagccggtcagggagatcgccagggtcgtgcaggccaccatcgcggcggccgtccgtatcgcaccgctttttcgcatggcgcccatgatggcaccgcgttccggccgcccggcgccggggtctcccggccgttccgtggggctggtggcggccgttctgtggggccggtgggggccgttccgtcacccgaatggccctctgtggcagcgtgcctacggctgatcgggtgtctcctggagtcagagaggcgtccatcaagggagccgatcatgtatgagatgtgtgcaggagtcgagaaaccgggcggcgcactggtgtggcatgtcatggccaagaacacggtgaccacgctctgcggccaacggctcggtcggcgtgtcgacggggcgaacgcgcagcgggccggtcactgttccacgtgcatggccttgttcgggaagctgatgaccgctccaccggccatcggttctcccgccggcacggaccactgacggtccgcgccacaggggccctgtccgccggggaacatcccggcggacagggcccttccaacggctcccggcgtgcgtgacgcgcgacggggcgtcagctcttgccggttcggtgagccggacggcgagtgccggctggggccgccgggtcgggcggggcggacagcggtaaacggtttgaccatcttttgccaacgtgaccccatatcgcattccggcggcggccgatgggtaacactgagcggcggaggggggaggtgtgcggcggcgccgctgtgccgtcgtgcccgtcccgaagtgtcgccggccttggggaaggcggcagggggaccagtcggggggatgcatgacgcagtcggttccggggcaacgcgctgcccgggaagagacgttcgccgggcacccggagcttccggtcgtcgtgatcggtgccggtccgtacggactgtccgtcgccgctcatctgcgcgccgcgggcctgccggtgcgggtcttcggtgaggtcatgggcagttggcggcacgccatggcgaccgggatgttcctgaagtcgacaccggacgccgtcgacctgtccgtgtccgagcccggcggccggctggcggatttcctgagggtgcacggcgagccggaactgaccgagctgacgccgatcccgtgcgacgtgttcgtccgctacgggcagtggttccagaagcggtacgtcggtgaggtggaacccgcgcgggtggccgcagtggaacgggcggcccacggtgcggggttcgccgtgctgctggacgacgggcaggaactcgcggcgcgttccgtggtcgtggccaccggtctgaacgggctggcacacgttcccgaggtgctgcgccggctcgcgcccgacgggccgggcgccggcgccctggtgtcgcacaccagtcaccacaccgacctgtcccggtatgcggggagccgggtcgccgtggtcggcggcggccagtccgcgctggagagcgcggcgctgctccacgaggcgggggccgagacgcaggtgctggtgcgggagcggagtctgctgtggggtacgacgcccgacctgcggcggccgtggccgctgcgggtgctcaggcccggctcgccgctggggacgggctggatcctggccggggtgtgccgggccccgggcgcggtgcggcagttgccggccgccgcccggctgcagctgttccggcgcg

SEQ ID NO: 1978 - DNA, 2913 bp, Unknown
  Kingdom: Bacteria, Phylum: Actinobacteria, Class: Actinobacteria, Order: Streptomycetales, Family: Streptomycetaceae, Genus: Streptomyces
ctcgctccgggacgcgacggatcccgcctccgtcgcgtcccggagcgaggcggtcgatctggtggcccgggtcgccgactccgtacgccgcaccgctttcttcctcaccgaccgtcgcgcacatcccgccgacggaaccgaccgcttcctttccgcggaacaagccctcctcttcggacatccgctgcacccggctcccaagagccgcgaagggctctccgaagccgaagcccgtcactactcacccgagtcgcgaggctccttcgccctgcactggatggcagtggcgccctccgtactcgccgccgactcggcctggaccgagtccgggcgacccctgtccgccgaccgcatcaccgcccggctcgccgggaccgaactgcggatgcccgacggtcatgccgctctgcccctgcatccgtggcagttgcgcgaggtactgcatcaccccgaggtgatggcgctcctcgacgccggcctgctgcgccacctcggacctcacggtcctgcctggcacccgacctcctccgtacggaccgtccaccgcaccggcacgcccgccatgctcaagctgtccctgggcctgcgcatcaccaactcccgccgtgagaacctccgtaaagagctgcaccgcggcgtcgaggtccaccgcctgctgcgcagcggtctggcccagcagtggcgggcggcccacccgggcttcgacatcgtgcgcgacccggcctggctggccgtcgacgaccaggacggagccccggtgcccggtctggacgtgatggtccgtcacaacccgttcaggccgtcggacgacgtctcctgcatcgccggcctcgtcgcgcccaggccgtacccctggagcgtgccgtgcccaccaccggcggcgaaccagccccagccggtcgccggccggaccacgcgctcgcgcctagccgaggtcatcacgcgtctcgcctcccgcaccggacgtccgccaggagccgtcgccgccgagtggttcctgcgctacctcgatcaggtggtccgccccgtgctgtggctggacggcgaggcggggatcgccctggaggcgcaccagcagaacaccctgctcctgctcgatcgcgacggctggcccgcaggcggtcgctaccgcgacaaccagggctactacttccgtatgtcccggcacgcggaactcgacgcccggctgcccggcatcggtacgcagagcgacaccttcgtctccgacgaggtcaccgacgaccgcttcgtctactacctcgccgtcaacaacgtgttcggcctcatcggagccttcggctcccagcaactcgccgacgagcgcctgctcctggccgccttccgccgcttcctcgctgacgccgccggtccagggcgcatgcgctccaccctgcccgctcgcctgctcgactcacccgtcctgcggtgcaaggccaacctgctgacccggctgcacggtatggacgaactcgtcggaccggtcgacacccagtccgtctacgtcaccatcaccaaccccctccactgctgaccgccgcccgcctcacgaccggctccgccgagtccagcgaccggttccaccaccgactccactgcggactcgtcttcgccactccacctccggtcagccacaccgcacgcctcccgccgaggaccgtctcaccccggctccatcaccgccttccgagaggagcgcccatgcctcccaccgatgccggcgccgcaccccgccacgcccccgccgccccgtccgctgccggtacggacgtgagccctgcggctaccctctgcgacaccggctcggccacgaccggtgccggctcctgtcccggacccaccgaggggcgcaccgacggtgaggacacgctcgacctgcgcctgcccgaggatttcgtcgcgctgttcgccgagccggaccgagcctgcgccgccggcccggccgacctcctcgacggtgtcggggactggggccccacccccacccccgtcggcaccttccagttggtcaccgtccgaatcgagcgtgacctaccggtcatcagccgctggatgaacgagccggcggtcgccgagttctggcacctggccggcccccagagcgtgaccgaggaacacctgcgcgcgcaggtggacggcgacgggcgcagtgttccctgtatcgggctgctggacggcatgccgatgagctactgggagatctaccgggccgatctcgaccccctggcccggcactactgcgcacggccgcacgacaccggtatccacctcctcatcggcagtgccgccgaccgtggccgaggcatcggcagcgccctgctgagtgccgtggccggcctggtgctcgccaaacgccccagctgcgcccgcgtcgtcgcggaacccgaccttcgcaacgcgccctccctctccgctttcctggccgccggcttccggttctccgccgaggtcgatctgcccggcaagcgggccgccctcatgcttcgggaccggtcttcgcgcaggccgctgtgacagccggccacgtccttgtgacttctggtacaccggccggcccgatccggttcccgcttccctcgcgccgtctcggcaccaccccgatccccggtccggacgggtccgccaccggtgccggaccgaggaggctcggcatcggtgccggacaccggagacttcgagtcggtgccgcacagcgaagacaaagcaccggtgccggacggaggaggccgcgcacgggcgccggatccgggggactcctcggcagcgcccggccgagcgcccggccgagatcgctccgcgccggtgcggagcggcgtcgcaccggtgctccgccgccggtcccggcctccgggatccgcggtgatccgccgccggtccccgcctccggaacccgtttgtcagtcccgagccgtaggg

SEQ ID NO: 1979 - DNA, 755 bp, Unknown
  Kingdom: Bacteria, Phylum: Actinobacteria, Class: Actinobacteria, Order: Streptomycetales, Family: Streptomycetaceae, Genus: Streptomyces
cggcgcccgcacggtcatcgcctcactcggcgcgaagggcctgctcgcgcacacctccgagggcatgtggcaggccgccccgcccgcccgggtgcacggcaacccgaccggcgcgggcgactcggcggtcgcgggcctgctctccggcctggtggagaacctgccctggcccgaccgcctggcccgcgcggtcgccctgtccgcggcgacggtgctgtccccgaccgccggcgacttcgaccgcgccgcctacgacaagctgctggggcaggtggaggtgacggggcaggtcagcgcggcgtgagggtcagccgccggacttgacccagcccttgaccagccagacccggtcgagataggcgtcgcactggtcgccctgctcgcacgagatcttgagggtgttggtgcccttgttgagctggacgtagttgaaggtcttcgtccagcccttctcgtagtcgccggcgccggcgccggcccagttgatcagcttgacggcggtggtggacggggtgccgttgaccgtgagagtggccttgccgtccttgccggggacgctgtagccgaggtagacgctgtacttgccgtcctcggggatgccgttgaccgtccaggtgacggaggcgccgggcttgttgaagttgttgacgtagacgccgtcggccgcctgggcgcccttgacgtccgaggcggtggtcgcgccgccgcccagttgcagcgccttggcgtcgatcttcgggagttcgccgtcggcg

SEQ ID NO: 1980 - DNA, 1125 bp, Unknown
  Kingdom: Bacteria, Phylum: Actinobacteria, Class: Actinobacteria, Order: Streptomycetales, Family: Streptomycetaceae, Genus: Streptomyces
cctgggccgtcgtgcggcccaaggggtggccggaggcggccctggccgtccccgccgcctgcgtcgccgtcgccaccggggcgatctcgctcgaccacgcgcgcgccgaggcgcagcaactgggcccggtggtcgggttcctggccgcggtgctggtcctcgcccatttctgcgacgtggaggggctgttccaggcctgcggggcgtggatggcccgccgggcgcgcggccgtccgctgcggctgctgacggcggtgttcgcgctggcgtcggcgatcacggccgtgctcagcctggacgccacgatcgtgctgctgaccccggtcgtgttcgccaccgcggcgcgtacgggcgtacggccgaaaccgcacgtctacgcctgcacacacctgtccaacaccgcctcgctgctcctgccggtctccaacctgaccaacctgctggcgttcgcggcgagcgggctgagcttcacccggttcgccgcgctgatggcgctgccgtggctggtggcgatcgccgccgagtacgtggtcttccgccgcttcttcgcccgcgacctggccgcgtcggcgcccgcgccggacaccggcgaggcccccgcgttcccggtgttcgcgctggtcaccgtggcctgcacgctggccgggttcgtcctgacgtccacgttcggcgtcgaaccggcgtgggcggcgctggcgggggcgctggtgctggcggggcgtgcgctggtgcggcgccgggccacggcgctgaccgtggtgcgggcggcggcaccggccttcctggcgttcgtgctggcactcggcatcgtggtccgtgcggtggtggacaacgggctcgcccacgcgctcgggcacctgctgcccggcggcaccgggctgcccgcgctgctcgggatcgccgcgctcgccgccgtcctggcgaacctgatcaacaaccttccggcggtcctggtcctgctgccgctgaccgctccggccgggccgggcgcggtcctcgccgtgctcctcggcgtcaacgtcggtcccaacctgacgtacgccggttcgctggcgaccctgctgtggcggcgtatcgtgcaccagcacgaacacggcgtggacctcaaggagttcacccgcctgg

SEQ ID NO: 1981 - DNA, 1455 bp, Unknown
  Kingdom: Bacteria, Phylum: Actinobacteria, Class: Actinobacteria, Order: Streptomycetales, Family: Streptomycetaceae, Genus: Streptomyces
cgccatcagctccagcacctccagctcgcgcggcgtcagccgggacagccgccggtccggacccgaacgccgggccagcaactgctggatgacctgcgggtccatggccgtaccgcccgcggcgacccggtgcaccgcgtccacgaactgggccgcgtcgaacacccggtccttgagcaggtacccgaccgcgccgttcccgtcggccagcagctcgcgcgcgtacaactgctccacgtgctgggagaggaccagcaccggcagccccggccgctcccgccgcgccgccagcgcgcactgcagcccctcgtcggtctgcgtgggcggcaggcgtacgtcgaccacggcgacgtccggctgcaactcggccagcgcacgggccagttcggggccggagccgacggccgccgcgatctcgaagtcatgggcctcaagcagccggaccagtccgtcacgcagcaggaacaggtcttcggctaggacaacgcgcacggaatctccatggtgaccatggtggggccgcccgcggggctgctgacggccaggacgccgtcgaatgtaccgagccgccgctcgacgcccgccagtcccgagccggccccgaccaccgcgccgcccttgccgtcgtcggtgaccgcgatgcgcagcatgccgtcgctgtggtgcaggtcgatccggacgcgccgcgcgtcggcgtgcttgacggcgttggtgagcacctcgctgaccgcgaagtacgccgccgactccacgggcgcgtcggctcggccggcgaggtcgaccgtcacctccgtgccgacgggcgtccgcagcgccagcgcccggaccgcgtcgcccaggccgcgctcggcgagcaccggcggatggatgccgcgcaccaggtcacgcagttcgacgagggcgtcggcggagttcttgcgggcctgggcgagcagtcgcttggcctgctccggattccggtcgatgagcgtctccacggtgcccaggtccatgcccatcgcgatcagccgggcctgcgctccgtcgtgcaggtcgcgttcgatgcgccgcagttcggcggcggaggtgtcgacggcgtcccggcgcgtctcggtgagcacccgcacccgctcggccagctcaccgctgtcgccgccgagcacggcccgggtcagccggaagtgcccctggagcaggagcgggttcaggtaccaggcggccacgaggagcgccaccgcgagagcggcggcgccgagggcggagccctgcccggagatcggcacgaacgcgtaccagtacccgacgtgcgtgccgtcggtgaacacccgccacagccccgccgccagcacgaagccctccagcgggtagagcagcaggacggcgggcagcagcgcggtcacgaaccctgccgtcatgtcggtcagcagccagccgaggtcgcgccaggtcgccggatcgccgagcatgccggtggtg

SEQ ID NO: 1982 - DNA, 2082 bp, Unknown
  Kingdom: Bacteria, Phylum: Actinobacteria, Class: Actinobacteria, Order: Streptomycetales, Family: Streptomycetaceae, Genus: Streptomyces
gccgccgcctgcgccgccctgctgggcgggacgtggatctacgcgggagtgatcagcggttccgacacgatgctgtcggtcgtcggccaggcgatcggctatccgctcgtcctgtggtggttcggccacgtcgcccgtaggaccgccgagctgaccgtgcagctgcgcgccgagcaggcccgccgggcccgccgcgaggtcgccgacgaacgggtacgcatcgcgcgcgaactgcacgacgtcatcgcccaccacatggccgtcatcaacatccaggcgggcctggcccggttcgtcttcgacaccgacgcccgcacggcacgcgaggcgctcaccgccatcggcagcgccggcggcgaggccctggccgaactgaggcgcatgctcggcctgctgcgctcggacgacgtggacgccctggaggggctgggcggtccggaggacggccgcgccgccgccgaaccggcgcccggtctcgaccggctggaggagatggtggagcgggtcagagccggtggcgtacccgtcgaactgcgggtgcgcggcacccccaggaccctctcgcccggcgtgcagctgtgtgtctaccgggtggtccaggaggcgctgaccaacgtgctgaagcacgcccggggcgcggacgccgtcgtcgaactcgcctaccttccgggcgagctggacgtatcggtcaccgacgacggaacggatccggccacaatccccggacccggcggccacggcttgatcggcatgcgcgagcgcgccaagctctacggtgggacgatcgtcgtcggcccgcgacgcgaggggggattcggcgtgcatctgacccttccgacgccggcgcaggaccaggccgcacgccggggagacgccgtcgcggaatgatcgacgtgctggtggtggacgaccagttcctcgtacggagcggactcgccgcgctgttgcgcgccgctcccggcatgcgggtcgtcggggaggccggcgacggggcggaggcggtggccctgaccgcgcggacccggcccgacgtgatcctcatggacatccgcatgcccgggatgacgggcatcgaggcgacccggcggatcctcgccggcgacctggaccccgcgccgcgcatcctgatcctcaccaccttcgacctcgacgagtacgtgtacggcgccctgcgggccggcgcttcgggtttcctgctcaaggacgcgggtccggagcgcctgctggcggcggtgaccgccgtgcacgccggggactccctgttcgcgccggtggtcacccggcggctggtggaggcgttcacggagcggacggacagcccgcccgcgcccgcggaatccccggccgggctgcacgcgctgacctcccgcgaggtcgaggtcctccgtctggtcgcccgcggcctgaccaacgccgaggccgccgaccgcctcttcatcagcgaggccacggtcaagacccacctcaaccgcacgatgaccaagctcagcctggccagccgcgcccaggcggtggtcctggcctacgagacgggcctggtccgcccgggaggcgagagctgacttccgggatcttccctgacctccggggatcttccgggacctcaggggatcttccgggatctatggggcctgccaggacctccggggcctccgggggcctgccgggaccttccgggatcgggtccgggggagggtaatccggcccgctactgggtagtctcggctgacatggagcacgaggtgttcgttccggttccggtccggcggctgcgggcggtgctcgccgaccccgcgcgggtggcccgggcggtccccgggctccagcaggaggcgggcaccgatcccgtcgccggacgcctgaaggtccgcgtcggcagcacctccatcacttaccgcggcaccctgcgcgtcctggcccgcgacgacggcgggtacgccgtcgagggcgaggcggccgagtcccgcggcagcggctcggtcaaactcgcgctcacccttcgcctgcgggacaccgacgagggcacggccgtcgtcttcggcggcaccgcctcggccggcggccgggtcgccgagctggccc

SEQ ID NO: 1983 - DNA, 1955 bp, Unknown
  Kingdom: Bacteria, Phylum: Actinobacteria, Class: Actinobacteria, Order: Streptomycetales, Family: Streptomycetaceae, Genus: Streptomyces
ccggacggcggccgacagcgccacggacgtcctgcacccgctgatcaccatcgcccgcggtctgggccggctcgccgcggccggccggcgcagatgggcccagacccccaaggaccggcgcggaccgctgctgttcctggtggccgcggtgatcctggtcgtggcgctggtgccgtacgccccgctgctggccgccgtggtggtgacgggggcagccgcctggcacggccgcgaccgcaccccgcccgagccggcggactccgacgagccgcgcaaccagcggctgagcacgctgtacgaggccctggtcccgtacttctccgccgccgaggaccccgcaccgctgtacgcgcacggcggcgagtgggagaaggccttcccgtcctacgccttcgacgactccgggcgcgtctcccatctgctgatccgctacccggcgtacttcaccgacggcgagcccgaggcacgcgcgcggatcgagcacctgctgaccgccaaggccggccgcggccgggagtacctcttcgtctggaacgaggagggcaacgaactctccgtcaccgtgctggccccgctgcccaccggcatcgccgcccagcgtttcgtcaccgcaccgggcgagacggtgctcggcttcaccgacccgagcgaggtccagcgcacgctgccgctcagctacggcgaggagcagcacgacgtgccgccggtggtctggcgcaccggtctgcgctccaccgagccccacctgctcgccatggggcagccgggcagcggcacctcgaccctgctgcgttccctcgcgctccaggcgctgcagcacggcgacgtcctgatcgtggacggcggcggcaccggggagtacgcctgcctgatcggccgggacggagtcctcgcggtcgagtgcgggctggccggggtgcggacgagcctggagtgggcggccaccgagaccgaacggcgcctgatcgccgtcaaccgggcgcggcaggccggccacccgccgccggacgacaccaagcgcccgctgtggctgctgctcgaccggccgaccgcgttcacgcacctggccgccgcggacggccgtgaggacccgcaggcactgctccaggtgccgctgcggcacggccgggcggtcaacgtcacggtcgtcgtcgccgagcagttcgacagcgcggaggcgctgagcgacgcgctgcgccagcacacccgcgcgcgcgtggtgctcggtccggccacggcggagcaggtgaaggccgtgctcggagcgccgccgcacaccacgccgctctcggtcgtcccgccggggcgcggctacgcgcggctgggcacgggcgccgtgcaccggctccaggtgccggccacgcccgatccgtacgacgactcgacgaacgacgtgctgcgccgggcggtgcaggagctgctgccgccgaagacgacgcccgcggacggcgagacggtgccggaaccgacgacggtgaagacggcagcgaagacggcggtgaaggtgacgaagtccgcgaaggtcgcggaggcggaggaggccctggggacggaggaggccgcgggaacccaggaggccgtacggtcggaggaggctttggagacggtgaagtcctcgacggcggcggagtccgtggatccactggaggccgtggacgcggccgtggccgagccgtcctgacctgccgccacggagagggggccggtcacggcggcttctgctggcggaggcgcggcacggcggcttctgccggcagaagccgccgtgaccggccgcgcctccgccagcagaagccgccgtgacccgccccctctccgtggcggcaggtcaggacggctcggccacggccgcgtccacggcccccagtggatccacggactcccccgccgtcgaggacttcaccgtctcccaagcctcctccgaccggacggcctcccgggtttccgcggcctcc

SEQ ID NO: 1984 - DNA, 735 bp, Unknown
  Kingdom: Bacteria, Phylum: Actinobacteria, Class: Actinobacteria, Order: Streptomycetales, Family: Streptomycetaceae, Genus: Streptomyces
gaggacgacggtgaccgcggcccggcccgcggcggccagtgcgcgccggcgcggcaggcggccgagccacagccgcagcaggagcaccaggccggcgccgagcgtggccatgtaggcggtgtagaagttggcgatccaggcgagcgccacgatcaccacgcccagcagcctgcgccgcccgctgagcgcccattcgccgaccaggcacagcaggggcagcgcgacgaggccgtccagccacatggggttgtacgaggcgtccgccacggaccagccgcacagcgcgtaggcggagccgagcagtcccgccgcccaccagcggccggggcgcaggcgcagcagcagccaggccatggcggcgccggcggaggcggtcttcagtacggtgacgacgtagaccgcgaggtcgatctggtcccgtgggaacagagcgaccagcagggcgaaggggctgctgaggtaggttccgaggtccggcaggaagctggagccgtagccggactgccagttgacgaggagcccgccgtcggcgcgtccgtggagcaggtcccacaggtgggcgtggaacggcacgtactggttgcccaggtcgttgacgctgcgggtgcgggggccgaaggggtagctgccggcgacggcgtcggcggcgcagaaggcggtgacggtgatcagcgcggcgagcagggcggcggactgcgccggccgccgccaccagggcagggcggcggaccgtcc

SEQ ID NO: 1985 - DNA, 1027 bp, Unknown
  Kingdom: Bacteria, Phylum: Actinobacteria, Class: Actinobacteria, Order: Streptomycetales, Family: Streptomycetaceae, Genus: Streptomyces
gcgctggcggcgcccgactggacggccgtcgcgatcagcgcggcgacaccggccagcgcgatgccggccgcgcggcggtgggtggtgtgggaggtgcgtctgcgagagctgctgctactcaacactgactccttctgcgtggccacggatcgcgcggccaggggggagatccggacgcggggcgagccgtccgggcagaactgcgagaacgcggaaccaggtgcggacgtgcgaggtgcggaacgtacgtggtgcggtcgtggtgcggacgtacgtggtgcgggccggggccacagtccgcggaacggtggggggtgctgtggggtgactgtgaacggccgaggggaagattggcaggagtacgcgacccttgtcaggagcgcgtcatcaacttggctggaaaacgttcgttgtccggaagttcatgttcggtatacgaactggacggacgagggcgacggccgcggggatcaggggggcggtcaggtcccctccgcacccggccgtgccgatggcgtcggaggggccgggggcccagggcgaggaggttcccgtcctgggccggggtggtgtgggtcaggagccggtgccggcgtgcaggacggcgaacaggccttggacgcgggtgtcgtccggctggtgccaggggcccgcgacgtggccggttgccgtcgggggagcgggcggcggggtgtcggacggggccggggccaggacccggtgcaggcggagcgacgtgccgtcgggggcggcgagttccgtggcccggtgggtgtccgtgaccgtggtgaaggtggtggcgatcgggcgcgtaccggcgtaggagcggacgatctcgtggtccggggtgttgctgacgctctgtgcctggggctcggcccggccgtcgatcagggcggccaactgggcggtgagcaccgggtcgtggcagccgtcgtaggcccagcgcggacccagcacgccgtgctccatggtgccgaccagggcgtgctccgcgccgtcgagcggggcggcgcggtaggtgagg

SEQ ID NO: 1986 - DNA, 2615 bp, Unknown
  Kingdom: Bacteria, Phylum: Actinobacteria, Class: Actinobacteria, Order: Streptomycetales, Family: Streptomycetaceae, Genus: Streptomyces
ggcctcgggtacaggcgatgaagccgacggccgtgccgcgcaggcgcagcggcacgatgaggaaggaggcggagcgcagcagggcgtccacgcccgagtggtccggcccggtcttgcgcagccgttcgacggtgtgctcgtcgacgccgtcgagcagttgcgtctgtccggtcgcgatggcccgtgcgtacggcgtctcgcgcgggaagaccaggacctcgtcggccgggagcaggtgctcccagtcctcggcggcgtccgaccctatgcgcacggcgagcctgcgggcctcgatctgtggcggatcggacgccaagcgcgcctgttcctccaggagccagcgctggagcaggtagaccgaggccgcgtcgcagaaaccgggtgccagcgcgtggacgacgtggcggccggtcagccgcaggtcgagttccgaaccgatggcgtcggcggcgggggagaagtaccggcggcggaccgtggccgaggggcgcgggccctcgggttcacgcgggacgcgggattcggtgcgttctgtgttccgcagggtcgttgccttccgggtggggccggtgtcggcgaagggcggtccaggcggcctaggagtcaggggggtccggtggcgtatgccgtgggcaactatatgatgcccagtcaaggtcacctagacgtaggggagttggtcatgcctgagggtgacggtctgccgcagggtgtggatccgggcaaggccagtgtggccaggatgtacgacgccatgctgggcggtgagcacaacttcgccatagaccgggaggcggtggccgccttcaccgcgatcgacccgcaggtgcgcaccctggcccgcgccaaccgcgccttcctcggccgtgcggtgcgcttcctggtcgaggcgggcgtccgccagttcatcgacctcggctccggcatcccgacccagggcaatgtgcacgaggtcgcccaggcggcggcacccggcgccagggtcgtctacgtggacaacgacccggtggcggtcgcgcacagcgaggcactgctcgccgacaacccggacgcgacgatcgtggcggccgacatcaggcgtcccgaggagatagtggccgcccccggggtgcgcaagctcatcgacttcgagcagccggtcgccgtcctgatgatcacgatcctgcacttcgtcacgcacgaggaggacccggccggcatcgtggccgcgttccgcgacgcgctgcccgcaggcagctggctcgcgctgacccatgccacggacgaggaccgtccggacaccgccgccgccgtcggacagctctaccgagaccgggcgacctcccccgtcacggcccgctcccacgacgcgatcagggccctgttcgacggcttcgacctggtggacccgggactggtccacgtcccgctgtggcgccccggccccgaggacgagatcccgccgaacccgtcctcgtactgggtctacgcgggagtgggccgcaagagcgcgtaggcgcccgcgacgctcccgtggcacgctggccgcatgtgcggccgctacgtctccacccgcgggcccgaggagctggcccggcacttcggcgtgagccggtggaaccccgaggagacgctggagcccagctggaacgtcgcgccgaccgacagcgtgtgggccgtcctggagcgcgccccgcgtggggagcccgcgacggctttgccccgccgtgagctgcgggtactgcgctgggggctggtgccgtcctgggcgaaggacgcgcggaccggcgcccggatgatcaacgcgcgggtggagaccgtgcacgagaagccggccttccgccgcgccttcgccgcacgccgctgcctgctgcccgccgacggcttctacgagtggcaggcggccgaggcgcagggcggcggggcgcgcaagcagccgtacttcatccaccccgaggacggtgcggtgatggcgctcgccgggctgtacgagtactggcgcgacccggcggtgaaggacggtgacgacccggccgcctggctgacgacctgcaccgtcatcaccacggacgccaccgacgcggccggccggatccacccgcgcatgccgctcgcgctcgccccggagcactacgacgcctggctcgaccccgctcaccgggaccccggcggactgcgggaactgctgagccccccggcggacggccggctcgacgtccggcccgtctccacggccgtcaacgacgtccgcaacaacgggccgagccttctggcggagacggccgcgccctgaggtgctcacacggctccgccccggcgcggcgctcacacgccgaagcgcgcggaggcgctcaccgtcccgtgtccgccgtcatgcggtgcagcagcaggaacaggcgggcccggtcgtcgcccgacagggcggcgaagcacggggccagcacctcgtcggcgacccggtgaccggcggccaggcccccaagctgctgcgccgcctcgcaggggcccgcacccccgccctcctggtgtggggcgagagcgaccgcatcgtcacccccgcctacgcccgcgccttcggggacggccgcctcgaggccgtcgccggggcggggcacctcccgcagctccggacggcc

SEQ ID NO: 1987 - DNA, 1252 bp, Unknown
  Kingdom: Bacteria, Phylum: Actinobacteria, Class: Actinobacteria, Order: Streptomycetales, Family: Streptomycetaceae, Genus: Streptomyces
ctcatgcgtcaggtgtggggctgggagttcggcgacctgtcgaccgtcaccgtgcacgtacggcggctgcgggagaagatcgaggacgatccggcgcgcccccggctgatcagcacggtgtggggcgtgggctaccgcttcgacccgccgccgccgagcgggccgggaccgggcgggggcggggcgcctgatggccggtgacatgctgctcatcgccctgtacgcggcgatcggcgcggcggcggccgggctggcgggcgcggtggccctcagggtgctgcgccaccggtcggtcgcgctgtcgctggccgtggtcgcggccgtcacggtgacggcgatgttcgccggcaccctgctggtgtcgtcggcgatgctcctgtccgaccacgacctgtgggtcgtcaccgtggtgtgtgccatggcggcggtcgcctccctggcggtggcgctcgtcctgggccgcagcgtcgtcaagggcagccgggccctcgccgaggccgcccgcgccctcggcgacgacggcgggttcaccccgcccgccgagccggccgtggccgaactcgctgcactcagccgtgagttgtccgccaccagcgccagactcgccgcctcgcgtgagcgggagcgcgcgctggaggcctcccgccgggaactggtcgcctggatctcgcacgacctgcgcactccgctggccggcctgcaggcgatgacggaggcgctggaggacggcctggccgacgacccgcgtgactatcacgcgcggatccgcgccgaggtcgagcgcatgagcgacatggtcggcgacctgttcgaactctcccgcatccaggccggcgtcctgaccctggaccgtacccgcatgtcggtctacgacctcgtcggcgatgccatcgcgggtgccgacgcgctggccagggagcaccgggtacggctggtgggggagggcgtggagccggtgccggtggaggtcgacggccgcgagatgtcccgcgtcctggccaacctgctcgtcaacgccatccgccgcaccccggcggacggtgccgtcgccgtcgcggcccgcagggaggcggacagcgtcgtcctgtcggtgaccgacggctgcggcggcatccctccgcaggacctgccgcgcgtcttcgagaccggatggcgcggcagcgacgcgcggacgccgccggccggggcgggcctgggcctggccatcgtccgcggcatcgtggaggcccaccggggccgggccaccgtacgc

SEQ ID NO: 1988 - DNA, 1664 bp, Unknown
  Kingdom: Bacteria, Phylum: Actinobacteria, Class: Actinobacteria, Order: Streptomycetales, Family: Streptomycetaceae, Genus: Streptomyces
cggctcccccgtctgccccgccgcccgccggccgctcggcctgcgcgagcggaagaagatccgcacccgtgaggcgatccgcgcggcgacctacgcgctggtccgggagcaggggtacgacgccacgacgatcgagcagatcgccgaacgggccgaggtgtccccctcgaccgtctgccggtacttccccaccaaggaggacatcgtcctcaccgacgagtgggacccggtcctggcccgggaactgcgcgcccggcccgccgacgagccgtggacgcgctccgtccgcctggtgctgcacaagaccatcgaccagggcatggaccaggacgccgacgtgtcccggctgcgcacccggctgatggtcgaagtgcccgcggtgcgctcgcggatgatggagagcatgtcggtcaccgggcacctgctctgcaccgccgtagccgagcgcaccggccgcgatccgaaaggcctcgaagtgcgggcctgggccatgtcgctggtcggcgcgctgatggagaccaccctgttctgggccgagcggggccaccgcgacgacctcgcggacctcgtcgaccgcgcgctcaccgtcctcgaacgcggcctgcccccggaaaacagctgaggcaccggcggccggccgtgccatcctgaccgggtgaacggtcccgagatccacgtcgagttcgcccccggcctgcgcctgttcgtgccgcacacccgccgccggggcgccaccgcggtcctcaccgacggcgtctcctcgctcggccacgtcgtcgaatccctcggcgtcccgctcaccgaggtcggcacgctggtcgtcgacggccgcgaggtgcccgtgtcgcacgtcccgcgggcggacgagtccgtacaggtaggcgcgatcgaacgcccccagcaggtccccggcgcgcccctgcgcttcctcctcgacgtccacctgggcaccctcgcccgccgcctgcgcctgctcggcgtcgacaccgcgtacgagtccacggacatcggcgacccggccctcgccgcccgctcggccgccgagaaacgcgtcctgctcagccgcgaccgcggcctgctgcgccgccgcgaactgtgggcgggcgcctacgtctacagcacccgccccgacgaccagctccgcgacgtcctcgaccgcttccaccccgacctgcggccctggacccgctgcaccgcctgcaacggcctgctgaaggaggccaccaaggacgaggtggccgaccagctcgaacacggcacccagcgcacctacgacgtcttcgcccagtgcagcgcctgcggacgcgcctactggaagggcgcccaccacgaccagctggaggcgatcgtggaacaggcgttgagtatgcgcacgcaggggagttgagtacgcgggccgagcagcggggcgccccggaccggttggctggagccatgacagcgacgacgcggaacgcggcaggcgggaaacccgggcacggcagcacggtgtgggccgccgtgggactggtcctgctcgtgcccatggtcatcggctccctgctcctcgccctgtccaccgagcacggcacgcggtgcaccatgtacggcgactactaccaggactgccaccagggcggcggagaacaggacgtagaggaaggctccgccgccctggtggcagt

SEQ ID NO: 1989 - DNA, 994 bp, Unknown
  Kingdom: Bacteria, Phylum: Actinobacteria, Class: Actinobacteria, Order: Streptomycetales, Family: Streptomycetaceae, Genus: Streptomyces
ctcactgcggctcactgcggccaccgtgactaccacgccgtacgggctaccacgccgtacgggccgccttgtcctccgcgggcagcaggatccacagcgcgatgtagagcaggaactgcgggccgggcagcaggcaggacagcaggaagatcacgcgcatcgtggtcgcggaggtgccgaagcggcgggccagggcggcgcacactccgccgatcacgcggccgtgggtggggcgggcaagggcgctcatctcggtgcctccgtcggctgtcggtgcggggcctccccgtcggcggccccgtctgacatccacgctacggagacgaaggcggcagagcgtcgctccacggggcgatcccgaccctgggaatcgtcggggtccgcccctgagaggcgtcctgcgggcgtacggccgcccggccctgccgctccaccctgcgacggaggcgggcgcgcaccaccgggacgaccgcgacgtgggtgagcgcgaccccgagggtgttcaggagcagggtgtcgacgtccaccacacggccgggcacaccggtctgcaacagggcgatccccagcgacaccagtgcgccggcggcggtcgtgcggacccaggacggcacgggcgaggagtcggtcctgccgtgcaccatgggcagcagcacgccgagcggagccagcagcaccagcccctcaccgatgcgccgggccgcctcggcaccgccgagcgcgaggtcggcgcggacggtggcgagcggccggagattggccggcatcacccaggggacgtccagcggccgcagcatcagccaggcgacgaacgcgagatgggcgacgaggaggacaccccctgtcacgcggacgcggaacgcggcgctgccgccgatggagccttgaagctgcacgccccccaagacgcgccccccctgtggcgtgggactcattgcgaggtgggccgggtgggcccggaaccgtttgtgccggggggcgcgtcttggggggc

SEQ ID NO: 1990 - DNA, 556 bp, Unknown
  Kingdom: Bacteria, Phylum: Actinobacteria, Class: Actinobacteria, Order: Streptomycetales, Family: Streptomycetaceae, Genus: Streptomyces
accctggcctggtcccgctcccacccggcgcgcgtcctggccaacgacgccaacgtccaggccgtcgccgcaccccgggccggcctgctcgcggcacacttctgggccgcgggctcggtggacgggctcagcgcggacggccccggcaccgtcctcgtgtgccgccgcgaccagggcatatcggtcgcggtggcggacccgggccgtacgacgacgaccctgaccgtgcggctgcccttcccggtgggccgggtggtccgcgccgacgacaccgtgtcgctcacaccgggccgccgccccgtgctcaccgtccgcgtgaacggctcacgaggccatacgcacacggccctgctgcgctagcgcacgcctcccgggcccgggcgggccgggcggggaccgccttcaccggcccaacgtcaccggcccgccgtcaccgatccaccctcaccggcccgccgctaccgcacgtcatccacccgcatcgcactcgtatcgcacccgtatcgtccgccctccggcgaaggagccagcgaaccgccatgcccgccccgcactt

SEQ ID NO: 1991 - DNA, 2454 bp, Unknown
  Kingdom: Bacteria, Phylum: Actinobacteria, Class: Actinobacteria, Order: Streptomycetales, Family: Streptomycetaceae, Genus: Streptomyces
cgtggcgcgccgcgccgaggagcggcccagggacgcgatgagcgtccggtcggcctcggcacgcaccgcctcaccggcctcgataccggccgccgtgcgcatctcgtggctgcgctccagctcctcgatccagcggtcgagcgccgtcagcagccggtactgctggtccaccacgctctgccacagcgcggggtccatgagcaggtcggccgcggcctcggcgccgtagagcgagccgtactgcacactgcccggcggcacctgcatccagaacacgtcgtcgtcggcgggcgcggtgccgcgctgtccggccgtcggcgcctggaagaggaccgacaggctccgcccgaccccgagcgccagcgcgtactccagggggctggtggccggcggtacgtactgcgggttgccgtacgcgtcgtacgaccacgtctgcgtgctcgcctgctggtacagctcgcgcagcccgacgcggcgcaccacgcagtcgcgcagcgggcgcgcgaccagcgtgtgccgggggcctgtgaccgggccgagcagcagcgagcccgcctccagccggcccaggtggtgccagtggccctgctgctgcgcgtccaccgcgaacaggtccaccgcaccggccgccaccagccacagcacctgcggaccctccaggtcgagccgggagacgcccgtgcagtccagcggcgtgcccagggacccgaacgccccgaggaccaggtcgccctcaccgacggctgtcatctcaccgctccccgaccagcgccgcgtacacgccgccgcgcgccaccagctcctcgtgccgcccgcgttcgacgaccgtgccgtgctccagtacgacgatctcgtcgctgtcgcgcaccgtggacagccggtgggcgatcaccacacaggcgcagccgcgccgccgcaggttgtccatgacggtctgctcggtctgcgcgtccagcgcgctcgtcacctcgtccaggacgaggatgctcggccggcgcaccagcgcccgcgcgatctccaggcgctggcgctgcccgccggagaagttccggccgtcctgctcgacccggctgtggatgccgccggggcggcgcgccaccacgtcgtacagggcggcgtcgcgcagtgcctcaagcacggcctcgtccgggaccgacgggtcccacagggccacgttgtcgcggacggtgccctcgaagaggaacacgtcctggtcgacgaaggacaccgaggcggccagcgcgccgcgcggaatgtccgcgaggtgctgcccgtcgaggcggatcacgccctcccacggcgtgtaaaggccggagatcagccgggacaccgtcgacttgccgctgcccgagccgccgaccagcgccacctgctgccccggccccacggtgaggtcgaagccggtcagcagcggcttgtccagcgggctgtagccgaaggagatgttccgcagctcgacatggccgcgcagccggcgcgtggagtcgccggtgccggtccgggagtacagcgggtcggcgtcgaagttctcgacgtccttgagccgggcgacgtcggccgcgaagtcctggatgcggcccgccacgccgttgagccgggtcagcggcgcggtgaagcgggtcaccagcgcctggaaggcgaccagcagtcccaccgagacatggccctcgaccgcccgcatcccgccgatccacaggatcagcgcgctgttcagcgtggccagcgccggggcgaccacgcccagccaggcgctcggcaccccgagccgctgctgctcctccagcgtggtggcgtgctgcccggcccaggtgcggaagtagccgtcctcgccgccggtcgccttcatcgtctcgatcaactgcagcccggtgtaagcggtgttcgtcagccgcgcggtgtccgcgcgcagcttcgccgtccgggtcgcgcgcagccgtacggccacccgcatcgccaccacgttcagcagcgccacgccgatgcccacggcggtcagctgcgggtcgtaggagtagagcagcacggcgtacagcacgacgacgatcgcgtcgacgcccgcggcggacaggtcgcgggccagcgtctcggcgacggcgtcgttggactggagccgctgcaccaggtcggcggggctgcgctgggcgaagaacgtcaccggcagccgcagcagatggcgcaggaagcgggcgctcgacagggtggaggagacgatgcggccgtgcagcaggttgctctgctgcagccaggtcaggacgacggtgagcagcacacacgcgcccatcgccgcgaacagcacgcccagcagcgaggtctggccgccgatcaggtacgagtcgatgtaggtgcggctgagcgcgggcaccgccgcaccggccaccaccagcagcaggctcgcgaggaccgccgccggcagcgtgcccgcggtgccgcgcagccgggccggcagggcgccca

SEQ ID NO: 1992 - DNA, 670 bp, Unknown
  Kingdom: Bacteria, Phylum: Actinobacteria, Class: Actinobacteria, Order: Streptomycetales, Family: Streptomycetaceae, Genus: Streptomyces
cccggccctcgtacgaccgccgtcgtcccggtgtggcggcggccctggatggtgctgggccgggacaccttcgccggtgacgtcctggcccgcctcggcgtcgaccacctctacgcccgccacgccgagcgctatccgcgcgtcccggtcgaggaactgcgggcggcggcccccgacgtcgtcgtcctgcccgacgagccgtaccgcttcaccgccgccgacggcccggaggccttcaccggcctgccctgcgcgctggtcagcggacggcacctgacgtggtacggaccgtcactggccgaggctccgcgggtgctgggcgaggcgctgcgagcagcgcgccgctgaccagtccacggaccgtgtgcacggccgcggcggcccaagcggcgaccaggacggcgtacaggaccagtgccagggtgtcgtacacggcgaggtgggtgtgccgggcgagcgccgacgcgccggtcacgcaggtgcccaccgggaaggtgaaggaccaccacgtcagggcgaagcccatgccccgccgggcggcgcgcaccacctgggcggcggcgaaggcgaaccagagcacggcgaagcccatcaccggcaccccgtacagcagggcgaacacggcgaaaccggtgtcgtaaggggccggtacgacaccggtttcgccgtg

SEQ ID NO: 1993 - DNA, 501 bp, Unknown
  Kingdom: Bacteria, Phylum: Actinobacteria, Class: Actinobacteria, Order: Streptomycetales, Family: Streptomycetaceae, Genus: Streptomyces
  misc_feature (247)..(364): n is a, c, g, or t
tcgacgcgtccttccgcgccgtcggcgtgcccggccggccgcttcccgaggacatcggctccgtccgggtgctggacgagccgctccagctcctcaccggccccgcccacgcgctggcgggcgcccgctcgctgaccctcgcccagctcgccgggcaccggctctggatgcccggcatcgtccccggcaccgagtgggccgcctactacgacgacctcgtcgccgagttcggcctcaccatcgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaccttcatgggcgagcacacccgcctcgtctggcccgcgggacacggtctgcgccgtatcccggtgaccggcccggcacccgtctacccgcactcactcctgtggcaccgcgacaacccccacccggccctggcc

SEQ ID NO: 1994 - DNA, 4790 bp, Unknown
  Kingdom: Bacteria, Phylum: Actinobacteria, Class: Actinobacteria, Order: Streptomycetales, Family: Streptomycetaceae, Genus: Streptomyces
gcgggcgaactttcgccggttcgcccgctcctcgtctgtactcgccagtaatctgatcggccgtgaccagccgacacagatcgtccgaccccgtcccgacgtccccggtgctcaccggcacccagctcacgccccgccgccgtacggtcgtcaaggccgccgcggccaccgccgtcctggccgcgccgctcgccgccgcgctgcccgcgcgcgccgcgaccgccgcgcccgccttcctgcacggcgtggcctccggcgacccgctgcccgacggcatcctgctgtggaccagggtgaccccgacccccgaggccgtaccgggctccgggaagggccccgacaccgaggtgagctgggaggtggcgctcgacaaggcgttcacctccgtcgtcgcccggggatccaccaccgcgaccgccgccggcgaccacaccgtcaaggccgacatccggggtcttcggccggccactgactactggttccgcttctcggccggcatcgccgactcgcccgtggcccgcacccgcaccgcgcccgcccacgacgccgccgtctcctcgctgcgcttcggcgtggtctcctgcgccaactgggaggcagggcacttcgcggcctaccgtcacctcgcggaccgcggcgacctcgacgcctggctgcacctcggcgactacatctacgagtacaagtcgggcgaatacgcggcccggggcacggtcgtacgcccgcacgaaccggcgcacgagatcatcacgctcgccgactaccgcgtccggcacgccaggtacaagaccgaccccgacctgcaggcgctgcaccacaaggcgccggtcatcgcgatctgggacgaccacgagttcgccgacaacgcctggtccggcggcgccgtcaaccacaccgaaggcgcggagggtgcctggcgcgaccgccaggcagcggccaagcaggcgtacttcgagtggatgccggtgcgcccggcgatcgcgggcaccacctaccgccggctgcgcttcggccggctcgccgacctgtccctgctcgacctgcgctccttccgttcgcagcaggcgtccaccgggtccggctcggtcgacgatccggaccgtacgatcaccggccgtgcccaactggactggctcaaggcgggtctgaccgcgtccgacaccacctggcggctggtcggcaactcggtgatgatctccccgttcgtcgtcggctcgctctccgccgacctgctgaagccgctggccaagctgctggggctgccgcaggagggcctggcgatcaacaccgaccagtgggacggctacaccgacgaccgccgtgaactgctcggccacctgcgcgcgaacgccatccgcaacaccgtcttcctgaccggggacatccacatggcgtgggccaacgacgtaccggtggacgccgggacgtacccgctgtcgccgtcggccgccaccgagttcgtggtcacctcgctgacctcggacaacctcgacgacatggtcaaggttccggagggcaccgtctcggcggtggccgcgccggtgatccgggccgccaaccggcacgtccactgggtcgacaccgaccgccacggctacggcgtcctggacatcaccgccgagcgcgcgcagatggactactacgtcgtctccgaccgcacgagcgcgaacgcggcctcggcctgggcgcgttcgtaccgcacgcgcagcggcacgcagaagatcgagcgggcgtacgccccggtccggtgacctgctgaagcaggctcacccgatgccgcaggctcactgcaggccgtcgaggaagccgagcgccacccgccaggcggcctcggcggcctcggcgtcgtagtccggcaggtcggggtcggtgaagaggtgtccggccccggcgtaccggtagatctccacgtccgcgccggtgcggcccatctgcaggtaccaggcgctcaaccagtcgtccgtctcgaacgggtccggttcggccacgtgcagctggaccggcaggtcgtcggcgtggacgcccggcgcgatgtcggacgtcccgtgcaggagcagcaggccgcgcgccttgtcgtcgccgagggcgagggtctgggcgatggaggcgccgagcgagaacccggcgtagaccagaccgcgctccgagtacggggccgcggccagcacggcccgtctgagcagctcgtccttgccgatctcgtccttgaacgccatgccgtcctcgaccgattcgaaggtacggccctcgaagagatccggcgtccacacctcgtgcccggcaccgcgcagccggtccgcggcctgccgcaccgcgggtgtgaggccatgggtcgaatggaagagcatgatgttcatgaggccatggtgccagccgggtacgacaacgcccgtgcgcacccgcccctgcgcggacgcccgagcgcacccgccgcgtgcggacacccgttgcgccccgcccggatgtgaacgtcctgcgtgggcctcgccacacgggcccggccctacccaggaaccgccgcaagacacatgttcgtgtccggccgccgccggttacgttcgctggcatggagaacgcactccgcccgctcatcgtgatcggcggctcggtcgtcctcaccctggtcatcggctgggccaccgacctgctgctgcgcaaggccgacggacggcaccacgagacaccgctgtggggccagctgcgccgcgcccgcgtgccctaccaactcgtcctgtgcgccgccctgctcagaggctcctacgaccgggccgaactcgtggtggcgcaccgggacggcgtcgggcgggcgctgaccctggtgctgatcgggtcggcggcctggctcaccgtccggatcgcggcggccgtcgtcgagacctcgtacgcgcgctacgccagcgcccgcgcccaccgggacccggcccgggtgcgccgggtacgtacccaggtcgagctgatcatgcgggtggtcaccgcgatcgtcatcgtggtggccgccgcctcgatgctgctgaccttcccggcgatgcgcgcggccggcgcctcgctgctggcctcggccggcatcctcggcatcgtcgccggtgtcgccgcgcagtccacgctgagcaacatgttcgccgggctgcagatcgccttcggcgacatggtgcgcatcggcgacaccgtggtcgtgaacggcgagtggggcaccgtcgaggagatcacgctgaccttcctgacggtgcggacctgggacgagcgccggatcaccatgccggtctcgcacttcacgtccaacccgttcgagaactggtcgcgcggcaccccgcagatgaccggcaccgtcttctggcacctcgaccactcggctcccctggacgcgatgcgcgagaagctgcgcgacatcctgcgcgagtgcccggcctgggacggccgcgcctacaacctgcacatcaccgacacgaccccgaacacggtcgaggtacgggcgctgatgaccgcgaaggactccgacgacatctggacggtgcgggtcgcggtgcgcgaggagatgctccgctggctgtgcgaggagcacccctacgcgctgccccgcgtcaacacggccgaggcggttgtgccccggagccgggccggcgcgaacggcgcggacggtggcagtccggcgcggcccggcccgctctccgtgccctctctggacaagtcccgcacgggccgcggctgaggaaaatcggccggtgggccgtccgccggtgtctcagcggccgcgctccgcgccgccgttgacctggatgatctgcgaggtgatgtgggcggcggccggcgaggcaagccagtgcagggtggcggcgacgtcgcccggcgtgcccgcccgcttgtccgaggtctccgcgatgagccgcgcacgccgctcctcgtccatcgcgtcaccgaagaactcggtgtcctcgatgtagccgggcgcgacgacgttgaccgtgatgccgtgcggccccaactgccgggccaggtcgtgcgcgtacgggtgcagggccgccttggctgcggcgtaggcaccgctgccggaaccccggtaggcggcgatggagctgaggaacagcacgcgcccgccgggctcggcgagccggtgcttgagggcctcggtgagcaggacggcggtcagtgtgttgagccggaagttgaccgtccagtcgtcggcgacgcggtcgagcggatcgtcgcgttccggtcggggctcgaggcttcccgatcctcccgcgctgtggatcaggacgtccacggcgcccatctcatcggccacgaaacgggccacccgccgtacgtcgtccacgtccgcgaggtcggcggcgcaggtgagcgccccgggcaccgccgccttgcgcagcgcctcctcccgccgcccgagcagcaggacctgatcgccttcggcggcgaacgcctgtgccgccgcgagcccgattccggtaccgcctccgctgatcaccacattgcgtgtcatgtacccgagcctagttcccgaccgccgccgacgagggtcagcgcaggctgcgtacgtcgaggtggcgcagcacccggtcgacgatctcggggtcggcccccggctcactgcgggccgcgagcacctcgtgccgtgccgcgctcagcatctcgctctggatccggcgcagccgtttgatcctgcgtacgcgattctcctgggcctcgcgacgctcctcgtcgccgatctgcgggttgatccgcagcccgatctcgaaggcgcgccgcagcatctgctcggagacctcgtccggcaggtcctcgaccgcctc

SEQ ID NO: 1995 - DNA, 1127 bp, Unknown
  Kingdom: Bacteria, Phylum: Actinobacteria, Class: Actinobacteria, Order: Streptomycetales, Family: Streptomycetaceae, Genus: Streptomyces
tcggtcaccgcggacgtgcagggcggctactgggcgatcgaccggttccgtacgaccctggacaccctgttcaccgtgcaggacctggccacggcctccggcgaccaggaacgggagctgcacgtccgcggtgaccgacgccccgagccgggtgggcccgcaaccggacccgtgcgtctcggcgacgtcgtaggtgccgagccacaccgtcgggcgtacctcgtggaagtcccggggcacgtcgtccgtgcaccggtcggacgagtagcaggcgcacagggcgtcgaacacgatccgggcgtcttccttggtgcatccgctcagctccaccgacacggattcggggtgctccaccgacacggactccgaatgcgctcgctcgctctccatcgtgatcgctcctctcgtggccgcgctgcactaccgcacagggggttccccggaagcagcgctccaccctccctcctcccagcaaagcaccgcctctcccgatgcaccaggacccgtccggcgtccccgggccgccgccgcggcggtccctccggcggattcggcgggacggccgcccgggtgttgagagatggtggagggaagcgacggaccctctcggacatgagccggggcgcggtacgacggggtgtgccggcaccggggacgggcgggccgcgtggacgggtgaaggcggtgcgtgggatgactgcagccggggctcccctggccgagggcgacgagccggtgtccggcccggtgcagccgagcgggctgctcgacgtgctgcgcgtggcctccgtcgtgctggacgccgaggggcgcatcgtgctgtggagtccgcaggccgaggagctgttcggctactccgcgcgcgaggcgctgggccagtacgcggcccggatcatggtcaacgaggaacacctcgacgtggtcatcaagctgttcaccgacgtgctgcgcaccgggcggagctgggcgggcgcctttcccatccggcacaaggacggcagcacccgtctggtcgagttccgcaacatgcggctgctggacgaccgcggggacgtctacgcgctcgggctcgccgccgaccagtcgaccgtacggcggctggagcgcgagcgcgtagacgtccccgc

SEQ ID NO: 1996 - DNA, 1267 bp, Unknown
  Kingdom: Bacteria, Phylum: Actinobacteria, Class: Actinobacteria, Order: Streptomycetales, Family: Streptomycetaceae, Genus: Streptomyces
ccactcccccgcggcggggctgctcgccggcgcgctgaccgtcaccgccgtccacgtcctgctcgcccgcgcgctcggcgcccagggcgtcgaacccgtcctcggctccatccgttccgtcacacgaaggctccggcatggcctctcccgctgaaaccgccccgcccgccgacgccggcgagcccgccctgccgttcccctgggtggcgatgtaccactcggtgggcgaccgctccgaggacccgtaccgcatcaccgtgacgcccgagcggctggccggtcagctccggtggctgcggcggcgcgggctgcgcggggtgtccgtgcgcgagctgctggccgcccgcgccgagggcggcggcaagggcctggtcgggctcaccttcgacgacgggtacgccgacttcgtcaccgccgcgctgcccctgctgcaccggcacgcctgcggcgccacgctgttcgtgctgcccggccggctcggcggcgacaacgtctgggacccgcgcggcccccgcaagccgctgctggccgccgacggcatccggcacgcggccgccgagggcgtcgagatcggctcgcacgggctgacccacaccgatctcacccgcgtcgacgaccgcgccctggcggcggaggtcgccaccagccgcgcgcagctcgaggagctgaccggcgcccgtgtggacggcttctgctacccctacggcgcggtcgacgaccgggtcctggccgccgtacgggaggcggggtacacgtacgcctgcgccgtcgacgccggcccgctcaccggcccgcacgcgctgccccggctgcacctcggacagcgggacacggcctggcggctgcacctcaaacacgggctgcacgggctgcgccggcgccgcgtgaggggcgtgtgagatgcgggtcctgcacatcatcaccggcctcggcgtgggcggcgccgaacagcagctgcgcctgctcctgcgccatctgcccgccgcctgcgacgtggtgacgctcacctgccccgggccggtcgccgacggcctggccgccgacggcgtccgcgtcgtccacctcggcatggccggcaaccgcgacctgtccgcgctgccgcgcctggtccgggtgatccgggcgggccgctacgacgtcgtgcacacgcacctgtaccgggcctgcctgtacggccggctcgccgcgcgcctggccggcgtccgcgcggtcgtcgccaccgaacactcgctcggcgacgggcagatggagggccgcccgctgacgc

SEQ ID NO: 1997 - DNA, 2438 bp, Unknown
  Kingdom: Bacteria, Phylum: Actinobacteria, Class: Actinobacteria, Order: Streptomycetales, Family: Streptomycetaceae, Genus: Streptomyces
ctcatcggctgggcgggtacggccggactcggcggggcggcggcgaccctgctgccggccacgaccgccgaggcccggccggagtccgggacgccggcagcgcgatccggtgacgccgtcctccccgggttcgacccggtacgtccaccggccgtgccgctcgcggtccggtcgccgtatctgaacgcctggatgccggccgacaacctggcgggcacctggcccacgttctggaccggccgcaccaccgcgatgtccggcatcgcgcagatcgacggcgtccccttcctcttcctcggcgcccccaacgtccccggccatgtgctgcgcggcatggtgcagcggtccctgaccgtgaccgccacccgttcgcagtacgtcttcgaggccgccggcgtacggctgacgctcaccttcctctcccccgtcgaaccgggtgacctgcggcggcagagcatgccgctgtcgtacgtgacggcggaggtccgcagcagcgacggccgcccgcacgccgtccggctctacttcgacatctccggcgaatgggcgcacgcggaccccgggacgaagatccgctgggagcagaaggagacggccgccgccggacccccgccggtgacgaccctcagctgcacaccggacaccccgaaggaactcgccgaggtcgccgacaccgccacgtggggaagcgtgctcttcagcgccacccggcgccccgggatgacctggcagatcggtgccgacaccaccgtacgcccggcggccctcgacaacggcggcctcgcggacaccgccgacaccggacagccccgggcgatcaacgaccactggcccgtcttcgccttccacttcgacctcggcccggtggaccgcaagccgcagtccgcggtgctctccctcgggcacgtgcgcgagcccgccgtcagctacctcggcagcccgctgccgccgctgtggcgctcgcactggccgtcctgggagccgatggtggccttcttccacgccgaccaggaggccgccgcgtcccgtaccgcgcagctcgacagccggatccggcgcgacgcgaccagggccgggggccccaagtacgcggcgctgtgcgcgctttcactgcgccaggcctacgcggggaccgaactcgtcagccgcgacggcacgccgtgggtcttcgtgaaggagatctccagcgacggcaacgtctgcacgaccgacatcgcctacccgtcgatgccggccttcctgtacaccgatcccgcctacctgggcgccctcctggcccccgttctggagtaccccgagcacggcggatggcccaagacgttcgcgcagcacgatctggggtccagttatcccaacgccaccggccacaacgacggcaacgaggaggacatgcccgtcgaggaatcggcgaacatgctcatcatgtccgccgcctacgcggcacgggcgggcagagcggcggcgaaggccttctgcaccgggcactacaggatcctcaagcagtgggccgactatctcgtcgacaacgcgctcgacccgggctaccagaaccagaccgacgacttcaccggcttcatcgggcacagcgtcaacctcgccctcaagggcatcctcgccatcggcgccatgagccgtatcgccgccgccgcgggccgagagcaggacggtgcgcactaccgggccgtcgccgaggactacgtatcccagtgggccgccaaggcccaggacgccgggggcgaccacctgaagctggcctacgaccagccgggcacgtggagcctgaagtacaacggctaccccgacgcgctgctcggcctcggcctcgtgccggactccgtcgccgcccgggaagccgcgtggtacctgacacaggtcaaccagtacggcgtaccgctggacaaccggcacgcctacaccaagggcgactgggagatgtggaccgccgcctggctgcgcggccacccggtcagcgagtacctgatcggcgccctccacgacttcgcgcacaccaccgcgtcccgcctgcccttcaccgactggtacgacacggtgacggaccgtcagagcggcttccgggcacgcccggtgatcggcggcgtcttcgccctgctcgcattggacgcctgaccgcgccgcccgcacacccctcccgtacggacgcggttcccgaaccgtaaggagactccatggaacgccgtacgttcctgaccggctccgtgtcggtggccggcgccgtcgcgctgaccggcaccgccgcccccgcacacgcctccccgtcggcccctggccccgtggccgcggccgccggctccggcccccactacacggccaaccgggccccgctgcgaaaggagccgttcctgcggctgccgcccggcagcatcaccccgaagggctggctgcgcacacagctcgatctgcaactcgacgggctgaac

SEQ ID NO: 1998 - DNA, 2087 bp, Unknown
  Kingdom: Bacteria, Phylum: Actinobacteria, Class: Actinobacteria, Order: Streptomycetales, Family: Streptomycetaceae, Genus: Streptomyces
tcgccctgcccggcgtcctggcggtcctcactcccgagaacgcgccccggctcgccgagccggaggacgcggcgctcgccgtgctgcagggtcccgacgtgccgcaccgcggctggttcgtcgcgctggccgtcgccgagtcgctcgaggcggctcgtgccgcggcggaggcggtccgtgtcacgtacgcgcgggaggaccatgacgtcacgctgaccgtgaaccatccgggggtctacgaaccggagaccgcgaacggcggtttcccgggccgccgcgaacacggccatccggagagcgccttcgcctcctcgcacgtccggatcgacgtcctctaccgagtgccgccgctgcacaaccacccgatggagccgcacaccagcacggcgcactgggacggcgaccgcctgatcgtgtacgcgtcgagccagggcggtacagccgtacgcgacacgctctcccagttgttcgagatgccgcaggagcggatcaccgtcatcgccgagcacgtcggagggggtttcggctccaagggcaccgcgcgccccgatgtggtgctcgcggtgatggccgcgcgggtgaccggacggcccgtcaccgtggcgctgccccggcgctacctgccctcggccgtcggccaccgggcgcccacgctgaaccggctccgcctgggcgcggatcacgagggccgcctgacgtccctcacccacgtcgccaccacctggacctcgcgcatcacggagttcgtggagcaggccgcggtgcccgcccgcgtcatgtacgcggcgccgcagagcctcaccacgcaccgggtggtgcgcctggacgtgccctcgccctcctggatgcgcgcacccggcgaggctcccggcatgtacgccctggagtccgccatggacgaactggccacggaactcggcatggacccggtggagctgcgcctgcgcaacgagccggaccgggagccggacagcggcaagccgttcagcagcaggaacgtcgtggagtgcctgcgcgagggcgcccggcggttcggctgggagcggcgcgatccgcggccgcggtcgcaccgggaggggcccctgctggtcggcctcggcgtcgcctcggccacctacccggtgtacgtgcagccgtccgccgcgcaggcgcgggcgctgcccgacggcacgttcgtggtggggatcaacgccaccgacatcggcactggggcgcgtacggtcctggcgcaggtggcggcggacgcgctcggggtaccgctggagtcggtgcgcacggaggtgggcgacagcgacctgccgcccgcgtcgctggccggcggctcctccgggaccgcgtcctggggctgggccgtgcacgacgcgtgcacccggctcgcggcgcgtctggccgaccacgccggaccgccgcccgggtcggggctcagtgcgcgcgcggacaccaccgggcaggccgacgccgagagttcctacgcgcgccacgccttcggcgcgcacttcgccgaggtcgccgtcgacacggtgacgggcgaggtccgggtgcggcggctgctcggcgtcttcgcggcgggacgcatcctcaacgcccgtaccgcgcgctcgcagttcatcggcggcatgaccatgggcctgggcatggcgctgaccgagggcagcaccatggatccggtgttcggcgacttcgtccagtcggacctggcgtcgtaccacgtgccgacgcacgccgacgtaccgaaggtggaggcgtactgggtcgacgagaccgacacccggctcaacccgatggggagcaaggggatcggtgagatcggcatcgtgggcagcgccgccgccgtgggcaacgccgtccaccacgcgacaggggtgcgcttccgggaactgccgctgacaccggacaaggtgctcgccgggctctccggactgccccgctgacggatgccggggcatttccggaccttcgtcaggaaatgccccggcatcggtggcggtagcagtgacggtgctcagacctcggggtgcggtgccgggtggcgttcggccacgtgcaccatcagcagcagcgtgagggccgccagcgaggcgagcgcg

SEQ ID NO: 1999 - DNA, 1010 bp, Unknown
  Kingdom: Bacteria, Phylum: Actinobacteria, Class: Actinobacteria, Order: Streptomycetales, Family: Streptomycetaceae, Genus: Streptomyces
gtccgtgtgcaacgcgtccgcgaagttcaccttctccgtcgtggcggacgcgttgcacacggacggtcggtagccgtccgccgcgagggacttggtgccgctgtacgtcgtcagccaggtcgtacggcaggacgtcggactcacggacttgtgttcgccggagatgctgaccgaccggttgtgccaggtcagcgtgcctcgggtgtaggtgttgccgtaggggacgtcgaagtggctggtggggtcggcggcggaccgggctccggcgggtccggcctgaccgagaagcgtggcggcggtgagcagcagggtgccgagacctgccgcgaactgcttgcgcatcgtgtgctccacagggtgtcgagggccgcggcgcggatctgtccccgcacggcctcgtggggggtgacgcgtcgagtatggcggaaggatcggcgtgttcgtggcgatttggccagtctgacgagcggcagggagcgacgccggttcaggtgcccgcgcccgcccgggtggcggcgcgcagtcgcggatccctgcggcgctgcgacaggtgctgccggggcaggccggccggggcaggtctggtgcggtggccgggcggctcggcgagacagtgggccgtgtacagacgtacggcgtcgtacaggcggtagcgggtctgtcccgtaccgtcggttccgctgacgtgggtgacctggcggtggagcagctcgtcgaggaggtcaacggcgtgttccctcgacggcgtcacccgggccgtcacctcgtcgatgccgaaggcgccgcgcagaggcgcgagttggtccagtgcggcggcgatctggggcgggagcccttggtggtaggcggcgacgctgtcctgcagtgccaggtcgccgacgcgcaggaagcggaggcgttgttcctcgtcggccaggcggtgggccaggtcgcgcagggagcggtgcgggcgggtggtgagccacaggccggcgatgtgcagggccagcggcagccgtgcgcacaactcc

SEQ ID NO: 2000 - DNA, 817 bp, Unknown
  Kingdom: Bacteria, Phylum: Actinobacteria, Class: Actinobacteria, Order: Streptomycetales, Family: Streptomycetaceae, Genus: Streptomyces
ccgcgaggctgcgcaccgtccaccccggcatggacgccaccgccttcgccgaggccggtgagggcgcggaggccggcggcagcggcgcgtcggcgcaggcgcccgccccggacacgctcgtctgggtcggccgcatcgagcccgccaaggacctggtgtccctgctgcacgccttcgcggaggtccgctgggcgcagccgcgggcgcggctgcgcatcgtcgccacggcgccgccgaacggccccgaggccgccgcctacctgggccactgcaaggcgctggccgcccagctcttcccggacgaggccgagggcccgcacacggtcggtgagaacccggtctccttcgaggaggtcggcggcccggagacgccgagcctcgccgacgcctacgccacgggtgccgtgatcgtcctgtcgagcgtcgtcgagggcttccccaccgggctggtggaagcgatgttctccggctgcgcgacggtctccacggacgtcggcgcggtcgtcgaggtcatcggcggtacgggcctggttgtgcccccgcgcaatccgcgggcgctcgccgaggcgtgcgtgaggctgctgcgcgaccccgagcgccgtgcgcgcctgggagccgccgcccgggcccgcgcgctcgaactgttcaccgtcgagcagaacatcgcggcatttcacggcatttacctggagatcgtctcgcggtgcccggtccggcgcgtcgtcctggacgactccggtgaaccccttccgttcgccgccccggccgagtcccacctcccgggccgctggacgagccgggccgccacggccgacac

SEQ ID NO: 2001 - DNA, 1132 bp, Unknown
  Kingdom: Bacteria, Phylum: Actinobacteria, Class: Actinobacteria, Order: Streptomycetales, Family: Streptomycetaceae, Genus: Streptomyces
cgttcgccgccgcggccgtcctgcgcgaccacgaccgctgcgcgccgctggacaaggtcgtgcactaccccccggcggacgtcgtggacaactccccggtcaccgggcagcacgtcgacagcggcatgaccgtgggcgagctgtgcgcggcggcgatccagtacagcgacaacacggcgggcaacctgctgctgcgcgagctgggcggaccggccggcctcacccgcttcctgcggtccctcggcgatcaggtcagccgcctcgaccgctgggagaccgacctgaacaccgccgtaccgggcgatccacgggacacgaccacgcccgaggcgatcgcggcgagcctggagcgggtgaccctggggcgggcgctgacgggcggcgaccgcgagcagctcgtcacctggctgaagggcaacaccaccagcgccgaacgcttccgcaagggcctgccgaagggctgggtcatcggcgacaagacgggcaccggggactacgcctccgccaacgacatcggggtcgcctggacgacacgcgggacccccgtcgtgctggcggtgctgacctcgaagcccgcgaaggacgccgccgtggacaacgccctgatcgccgaggcggccggtgtcgtcgcgcgcaccctcgcccccggcgagtgacgaccggcacaccgcgctggcaccgcgtccattctctgactaaggtcagagaatggacgcggcacagatcgaacaggtccggcgcttcaaccggaccgtgaccgaacgcgtgggcgtgctccacgaccactacctcgggagcgaccggcccatcggcgaggccagacttctgtgggagatcggcgagcggggccaggacgttcggcggctgcgcgagcgcctcgggctcgactccgggtacgtcagccggctcctgcgctccctgcaggccgacggcctggtgacggtggagccgcagccccgcgaccggcgggtgcgcacggtccggctcaccgcggccggccgcggtgagcgagccctgctcgacgcccgcagcgacgacatggccggctcgctcctcgaaccgctcaacgacgcccagcgtgcccggctggtcgccgccatggccgaggtcgagcggctgctgacggcggcga

SEQ ID NO: 2002 - DNA, 737 bp, Unknown
  Kingdom: Bacteria, Phylum: Actinobacteria, Class: Actinobacteria, Order: Streptomycetales, Family: Streptomycetaceae, Genus: Streptomyces
gctcaccctggccgcggcgacggccacgccggtcgccgcggccagggtgagcagcgaacgccgggacggcgacgagggcggctggtgggtcggcaggggggtcggagaggaatcgcgcactccgggaccgtacaaagggagagcggcccggtgcacgaccggtcttcaaaggctgatcaaaagatcaccgagctgccacccgaacggcacacaggacaggccgccgcgcgcgccgggtggaagggtgttcacggtgtcgctggttcttcgtcgctgattctttgccgctggttctttgccgctggttcttcgttgctggttcttcgttgctggtttttccttgcccggttcttccgaggagtcgccgtgacctgttacgaccgccgtgatctcggtctgctgctgctccgcctggggaccggcggcgtcctggccgcgcacggggcgcagaaactgctgggctggttcggtggggccggtctggagggaaccggccgcttcatggagtccgtcggctaccggccgggcaaggcgagcgccatggcggcggggctggcggaggccggcggcggtctcctgctggcgctgggcctggccaccccggcggcgggcgcggcggcggccggcgcgatggcgggcgccgcggcggtacacgccccgagcggcttcttcgcgcagagcggcggctacgagtacgccgcctccctgggcctcacggccaccggcctggcgatcac

SEQ ID NO: 2003 - DNA, 685 bp, Unknown
  Kingdom: Bacteria, Phylum: Actinobacteria, Class: Actinobacteria, Order: Streptomycetales, Family: Streptomycetaceae, Genus: Streptomyces
ctggacgagcgggtggcgctctaccgcgagctggcggcggggcgcgccgagccggcggagctgaacctgctcatccagctcgtcgccgtcaccgacgatcccgagccggtgctgaggcccctgctggaacgccatccgcagctgaccccggaggatgccctggcgctgccgatcgtgctggtgggcaccctggaggagatcgtcgggcgggtgcgggcacagcgcgagcggttcgggttctcctacctgacggtgctggaaccgcacatggaggcgttcgctccggtggtcgaggcgctccgggggcagtgagggggtcacggcttgcgaccagggggctgggcttgcggagccgcgggatttcggggcgcggcgggcgccggggccgcgcgtccgcatgctggaattcggctccccgtcctcgccggcgtgatgtgatcacgccatgaccgaccacccccgcatccgccccgcgacccccggcgatctcgccaccgtgctggccttctggcggacggcggcggagggcacgagcatcagtgacgaccaggacggcgtggcacgcctggtcgaacgcgacccggaggcgctgctgctggcggaggacgccggcgagctggtcggcaccgtgatcgcgggcttcgacggctggcgctgccacctgtaccggctggcggtgcatccc

SEQ ID NO: 2004 - DNA, 1164 bp, Unknown
  Kingdom: Bacteria, Phylum: Actinobacteria, Class: Actinobacteria, Order: Streptomycetales, Family: Streptomycetaceae, Genus: Streptomyces
ctcccgccgacccgcgggccgcccccgcggcgccgccccgctccaccgccgactgggacacctgtctggccgtcgcccgcgcactcctggtcgtcgacgcccacgaccagccgctcgtaccgggttacgagaagatcctcggctccggactgccccgcgccggcaccaaggcggccaagaagatcctggtcgtgggcgccggaccggccggactcgtcgccgcctggctgctcaagcgcgccggacaccacgtgaccctgctggaggccaacggcaaccgcgtcggaggccgcatcaagaccttccgcacaggaggccacgagcacgccgcacagcccttcgccgatccgcggcagtacgcggaggccggcgcgatgcgcatccccggcagccatccgctggtgatgcacctgatcgagcaactcggcctgaagaaacggccgttctacctcctcgacgtcgacggctccggcaagcccgtcaaccacgcctggctgcacgtcaacggcatccgcgtacgccgctccgactacgcgcggtccccgcgccgcgtcaaccagtcgttcggcgtaccgcgcaagtactgggacacgccctcctcgaagatcctcggcagcgccctcgaccccgtacgcgacgagttcagcacggtcggacccgacggcaaacgggtcgacaaacccatgccggagcgggtccagggctgggcgcgcgtcgtccagcgctacggcgactggtccatgtaccggttcctgaccgagcaggccggtttcgacgagcgcaccatcgacctgatcggcaccctggagaacctgacctcacggctgccgctgtccttcatccacagcttcatcagccagtccctgatcagcccggacaccgccttctgggagctgaccgggggcacggcgacgctcccggacgccctgctgcgccaggtgtccgacgtgctgcgccgcgaccggcgcgcgacacacatcgagtactgggacaccggccggcagcagggaccgggcgacgacaccgcgcacgtacgccgggacggcccgcacgtgtggatcgacaccgtgtccgagggccgcgacggcaaggtcgtgcgcgagcagttcaccgccgacctggccatcgtcaccgtgccgttctccgggctgcggcaggtgcagg

SEQ ID NO: 2005 - DNA, 527 bp, Unknown
  Kingdom: Bacteria, Phylum: Actinobacteria, Class: Actinobacteria, Order: Streptomycetales, Family: Streptomycetaceae, Genus: Streptomyces
gcgcgaaagcggccgggcgcgggcgaggcgaaggcggccgtgagcggcgcgaaggcgggcgcggcgggcgaggtgccactcccggggggaggcgcgccgctccgggcgagggcgtgggcccggggaagggcgccgcttccgggtcgggccgggcccggtcgtgccgtcagatcagggtgaactgcccgccggggccctcctcggcgtggtccaggaccgaagccgggcggcgggccccctccgggaccggcagcactcccgccgcccgcagatcggcggccgtgaccgggtccgcaggctccgctgccgccgactcctccaggtccgcccgcagttcacccagcagtgccagcacggtgatcagttccagcagctccgaggtccacgcctgcggccaggcggccgggcggaccgccgccagggtgcccggttcgcccgcggccgtgcgggccgtgaaccactgctccaggacccggaccgcaccggccgtgaagtcccaggccgccgcgggcaccggggagacgcgg

SEQ ID NO: 2006 - DNA, 564 bp, Unknown
  Kingdom: Bacteria, Phylum: Actinobacteria, Class: Actinobacteria, Order: Streptomycetales, Family: Streptomycetaceae, Genus: Streptomyces
ggcaggacggtggcgcccgcgtcgtccagtgcgaccagctgccgcagtgtcggtccgttcagcggggtctcccgaacggccacgaccagcggcctgcgctccttgagcgtcacgctcgccgcccgttgcagcaggtccttcgacagtccgagcgcgacacccgccacgcacgccgtcgaggcgggcacgatcagcatgcccttcgccgggtacgagcccgaggacggtccggcggcgaggtcaccggcgctccagtgccgtacgtccgtggtgtccgcgtcgaacgtgccgggcttgccgtcggccccgagggacagccattcccgcaggtcgtcgcgccagtgggcgtccctgaaggagatgccggtctcgtcgagcagggtgagccgcgaggcccggctgaccaccaggtcgacgctctgaccggcgtcgagcaggccccgcagcacagcagccgcgtacggcgttccggacgccccggacacccccacgatccaaggcctgcgctgcgtttctcctgcgttcacatgtcgagcctaccggtgggccctgggccgctcggag

SEQ ID NO: 2007 - DNA, 842 bp, Unknown
  Kingdom: Bacteria, Phylum: Actinobacteria, Class: Actinobacteria, Order: Streptomycetales, Family: Streptomycetaceae, Genus: Streptomyces
ccgcaccccggggacgggccgcccccgcagcccccggttcaggaccgtcacatcccagccgcgcccgaccgccgcctcggcgacggcccgtcccgcgaaatccgaaccacccagcaccagaagtctcatagcggtgactgtgcccggcccggccgcggaagggaacaggtctctgctgtcggcagagccgtccgccgcggctcgacgggtcaacgagcggtcgtcggcgcgtacttgtagccgacccggcgcaccgtccggatcgcgccccggtgctccgcgcccagcttgcggcgcagccgggcgatgtggacgtccacggtacggccgtcgccgacgtggccgtagccccagaccgtggtgaccagctggtcgcgggtgtgcacgcggtgcgggtgcgcgacgagatgcgcgagcagctcgaactccaggtaggtgaggtcgagttcacgtccgccgacatcggcgacacgccgcaccgtgtcgatgcggacgagcgggtcgccggcgtcggtgccggggacgggcaccgcctgcgggtggtccggcacggccaccggggcgaacggcggctgctggtcggccggtacgagcaccaggtagccgaccatcggcggccggcccggcaggacgggcagggcgtgctgcggagccggcagccaggtggcgcccggcggcaggaagtccgccacatcgaggacctcgtcccgctccacggcccgcagccggtgccgtgctgcggagggagcgggggaggggggggtggcggggagggcggcggtggtcagggaacgagtggtcgccatgagaggtcagctctttcgcgcgaggagtccgtcggt

SEQ ID NO: 2008 - DNA, 3581 bp, Unknown
  Kingdom: Bacteria, Phylum: Actinobacteria, Class: Actinobacteria, Order: Streptomycetales, Family: Streptomycetaceae, Genus: Streptomyces
ggcgaggagcgggtcgcctcggaacgcgaggcggcgctcgacgtggtcgccgcctgcggtttcctccccctcgccatccgcatcgccgcgtcccgcctcgcggcccggcgcacctggacggtgtccgtgctcgccgccaagctggccgacgagcggcgccggctggacgaactccaggcgggcgacctggcggtgaaggccacgttcgaactcggctacggccagctggaaccggcccaggcccgcgctttccgcctcctcggtctcgccgacggcccggacatctccctggcggcggcagcggccgtgctcgacctgcccgtggaggacacggaggacctgctggagtctctggtcgacacctccctcctggagtccgccgcccccggccgctaccgcttccacgacctggtccgcctctacgcccgcgcctgcgccgaacgcgacgaacagcccccgggcgaacgggacgcggcgatgtcgcgcctgctggacttctacctggcgacgacggcgggcgtgtacgcgatcgaacgcccgggggaccggctggtggagcacctggaggagacgcggtacccgggcctggtcttcgaggaccggcaccacgcccaggactggctctacgcggaggcgcacacgctgctggccgtcgtccagcagtgcgcggaaggcgcagtgctccgtcgcgcggtggacctgctgtgggtggcgaaggacctcgccgagtcgggtgcgaactccaagcagtacgaggcggccgcgctcgccgtgcgggaagcggccgaccgggcgggcgacccgaaggccaggagccgcgcgctcaccacactcaccaacgtccacctggtggccgggcgtttcagccaggcggacgacgaagcccgcctggcgatggaactggcccgcagcgccgacgacctggcacccagctgctgggcggccaacgaccgcggcatcatcgcgctttaccagaaccgtcacgccgacggcgaggcctacctgcgtcaggccatcgaaagcttcggactcgacaggaacctcgcgggagaggccagcgcgctgtgcaacctctccaggatccacctggcgatgggccgggttgccagcgccgtggagctggcccagcggggcatcaccatctacgaccggctggggcacacactgcgcggcgccaacggccgttacgcactggggctcgcgctcaccgggcagggggcgcttggccctgcggtggagcggctgacggaggctctggaggtcttccgggacagcaggcagcggctctgggagggaatgacgctcttccggctcgcggaagcacacctcgccggacagcgccccgccaagactgcggccctcgccgagcaagcgctcgcggtcctgcgcggcatcggcggcgaatggcgtcgcggcaacgtgctgaccgtcctgggccgcgcgctcgacgggctgggccagacgggacgcgcacaggcgtgctggcaggaggccctcggcatcttcgagcaactgggctccgccgaggcgtccgacgtccggtcactgctgacgccccgcgccgccgcgtagcgcacgacggcgttcatcattcgtttatctccctacggcacgctcgtcctgtcgatccgtcgcgtcggggggcagacgggtcagcggtgatcagcaccgctagggtgaacgaccctgatatgcccgtccggcggccctcgggggagctgccggacgggcaacggcccatcactgaacgggagctgcgagtcaatgagcgatgtcaagaaggaccctgtggtcaagccgctcgacaaccacgccacggacctggagaacgtcaccacgctcgacaaccacgccaccggcgaggaagtcaccacgctggacaaccacgcgacgggcggcacggtgaccccgctggacaaccacgcgacggacgagaaggcctgaccggagtcacacgggggaccacacgggggtcacgggggaccacacgggggatcggccgcggcggcgcggagggggagccgtcgcggccgacgtgtgttctcagccaggcaccgtgaccggccgtcacccgtcggtcagtcggtggccggggcctccgggtccaggttgcagtgggccacccgggacgcgtcggcgggtgtgccggcgtccaggcgtaccgtctgcttgccgttcgcgggtacttcggtctcccgcagggcggagtggatctcgtcgccgtgggcgttctcgaaggtgacggtgaccgcgaaggtcgcggacctgtcgttggggttggtcagttcgacggtcgcgtacggcttcttcttcgtggcgcagctcaggagccgcgcccgggcggcctggagctgcgacgccccgctgccgccggacggcgtggcggtcgaaccgtaggacgggtggcggcggtggtaggagctgccgccggtcgtggccgtgccgctgcttcccgagccgtaggagtcgccggagccgccggccgaggagccgtacgcgtcgtcgtcctgcgagccgtacgagtcgtcgtcgtccgccgagccgtaaccaccgcccccggacgaagaggacgaggacgacgacgaggtgtcgtggtcctggtgcgagctgctgcacccgcctccgccgctgccatgaccgctgtgcccgtggccgcgggagaagcccgtcagggccagcaccacgaccgccagtaccgctgtgaacctgagattgcgcccccgtatccgcatgggcggcaccctacccggtggtgcgtgccgtgcccgtgcccttctccgcgtccagggcgtacacgcagcggtccttgctgcaggcgtagacgacgccgtcgcggacgaccggtgagccggtgatctcgccgccggtcgccagtttccagcgcaggcggccgtcgtcggccttcagggtgtacaggaggtggtcggtggagccgaagtggatgcggccctcggcgaccgccggggagccgacgatctcgccgccggactggaagcgccacttgggcgtcccggtcaccgcgtccagtgtgtacaggcccttgccgctgccgacgtggacgtggccggcggcgaccaggaccgggtcgacacaggagcgcgcctcggtggcgatgcgccagcggtcgcggccgtcggtggcgtccagcgcgtagacggtgccgaggtagtcggcgaggtagacaccgccgccggtgaccgcggggccgggcgcgaaggcgggcggggagaggaagaccgcgggggcctcgaagtgccagcggacgtggccgctggccacgtcgagggcgacgacgcgggtgccggccgagacgtacacgtagccgtcgggggctgccgtgaggcggaccggcacgccgccgcaggaggccgcgtcgccgatcgggtaggaccagcgttcgtcgccggtgcgggcctccagggcgcgcaggcgggcgtcctgccagacgtagacggtgccgtcgtgcagggcgggccctgcctcgggggactcgaagtcggtctggcagccggtgatctcccacagcttctggccgccggcggcctcccaggcctggacgccgccggcggccagaagctgtg

SEQ ID NO: 2009 - DNA, 887 bp, Unknown
  Kingdom: Bacteria, Phylum: Actinobacteria, Class: Actinobacteria, Order: Streptomycetales, Family: Streptomycetaceae, Genus: Streptomyces
  misc_feature (509)..(523): n is a, c, g, or t
ggccggggggccggacgcagggacgtgcggcgctcagcgggggccgacggacagtgggccaggtcacgcacgggcggcggccacaggccggactcgcggtcgtaccccatcgcgcggtcggagtcagggacagacagcggccgggggcctgactcagggacgtgcgccgctcagcggaggccgacggacggtgggccaggccaggcgcgtgcggctcctgggcgccgggcgcaggtcggcggggccggggcggcctgcgtggcggcgtggcgcatcgttgccgccccgcgcgcctgcaggcgtactccgttcccccgggtcaccaggccggggggctggcgatggcgcgggagaggacgtcgtccaggacgcgggccgtggtcggtatgtcgagctgggagttgtcgatgatgggcaggccggatccgtaccagccggccatgcggccgtggatgcgggcgacctcctcgtcggtgaggcgacggttgccggtgcgctcggcgttgcgnnnnnnnnnnnnnnnagccgccgaggccgacgaccgggcggtccgggaagacggcgtcgtcgaggatgcaggagatgccgttggcgaggaagttgcgcgcggcgaagccgcaggtgcggcgggcgaggcggtactgcgcctcggagttgtcgttccatcccgactgcgggttggcgaagccggagcggacccattcgcggacgtcgtcgaggctgatgtgcgcggtggggacccggcggtgctcggcccagtgcttggcgacactggtcttgccggcccccgcgggcccgatcagcaggacggcgagcgtggtggtggtcgggtcgggcacggtctgggcgggcggcgcggccggcatggcgaccgggccgcccggcgg

SEQ ID NO: 2010 - DNA, 656 bp, Unknown
  Kingdom: Bacteria, Phylum: Actinobacteria, Class: Actinobacteria, Order: Streptomycetales, Family: Streptomycetaceae, Genus: Streptomyces
ctcgggccgcacggtgcggatccgcctcggcgggcacagcacggcgccgcacggtcccgagccgtgcggcgccgtgctgtgcccgccgaggcggatccgcaccgtgcggcccgagggtgccgacgggtctgagcggtcgcggtcggggaacacgggggagatggacaaagacgagcttccgcccgacgaccgggccgtggaggtgtacctcgacctgctgcggatccggatgcccgaggacgactacgagctcctgctcaccgtcgtcgacccggtgctgcgcgccatacacgagcaaggggaccaaggggtgcccaccggggacttcccgctggacgggccgcagacccagggcctgccgcagcagatacgcgacgaggcggccctggtcatcgccaccgcggtcaccggacgcctcgacaacgagctggtcgtcctggacatcgaggagaccggtccggtccgggtggtcaccgacgccacgacggccgccgacccggagcgcctgacggagatcgccgactacatccgcgaccggcaccgcgagaccgaggaactgcgcggcatcgccgccgccagtgacctcccgaccgatttctgaggccctgcctcaccactccccgcgccaccgcatccgcctcaccgcttgggcgtcg

SEQ ID NO: 2011 - DNA, 889 bp, Unknown
  Kingdom: Bacteria, Phylum: Actinobacteria, Class: Actinobacteria, Order: Streptomycetales, Family: Streptomycetaceae, Genus: Streptomyces
ggtgctggaccagggtgccgcccagtgcgacgttcagcagctgcatgccccggcagatgccgagcagcggcaccctggtccagcacctggacgggcacgccgggacggtcggtgtcttcggcacccatctggtcactccggtgcccggcacccggtacgcggcggcggtcccggaagcggcgaccgtccccgcctaccaccaccaggccgtcgaccgcctcggcacgggtcttttcgcctcggcccatgcgccggacggcacgatcgaggcggtcgagccaccgcccgccggccactgggtcctcggcgtgcagtggcatccggagatgggcgaggacgtgcgggtgatgcgggccctgatcgaggcggcgaccgcgaacagccccggctgagccgatcccccgggggacacgatcggtcggccgcccggcgttctcagcgcgcgtccgagcgggtcagggagagcaggtcgcgggccggtcccgtggggcggtggcccgtgggccagaccgcccgcaggtcgcgccgcagggcgatgccctcgaccgggacggtgaccaggcggcgcagggacagttcgtcgcccacggcgagttcgctcagcaccgccgggcccgctgcgctgaccgccgccgccttcaccgccgtcgtcgaggagagttcgatcagcggacgggccaggccgcccagcgccgcgtccaggacctgccgggtccctgagcccgtctcccgcaggatcagcggggtcgccgcgagttccgccgcgtccagcgggcgccgccgcccacccgcgggcccggcggcggcgcccgctggacgcggcggaactcgcggcgaccccgctgatcctgcgcgcgacgggctcagggacccggcaggtcctggacgc

SEQ ID NO: 2012 - DNA, 1218 bp, Unknown
  Kingdom: Bacteria, Phylum: Actinobacteria, Class: Actinobacteria, Order: Streptomycetales, Family: Streptomycetaceae, Genus: Streptomyces
ctcctggccgcggccggtgagcatcaggtcatacgcccgcgcgcgccgcgtactgcgccagttccgcaaggaactcctcgcgcacggcgggcgccgcccacgagatgccgatggcgttgcgctgcagccgcaccaggtcggcgccggacagggccgcgggctcggcgccccgtgcggacggtcatcccgcggcgagcacccgccactcgcgcgagccgatgtcggcgggcgtgccgtcgaggatccgggcggtgcgcgccgccggttccagggcgaccgtcgcgaggctcgcccagcgctggccgagcggcttgtccaggtcgggcaggcaggtcacgggcggctcgccgtcgcccgtcacgaggaaacccgtgaggtcctcgagcgtgtccggcgcgccccggcgggccagccgggcgcccacgaagtcgaggcgctcgcccgagtcgggctggtagagccacgtcttctcgccggcggcgggccgcggtgtgaggaagtggttcgtgcgcaggaacgtaccgtcctcgggttccacggcgaacacaccgacggggctcaggtcgagcaggacggcgtccgtctcgtcgaagagcgcgaacgacccggacgacgcaacaggcgccccgcgcacgatctcgacggcctccgcgacactgcccgcctcttccaggacgaccgccgcgagcacgtggaccgggacgccgccgacgccgtcacggacgtgccccaggatgttgaagtgcagtgcgagaccggcgctgttgacaccgatcttgccgaggatgccgtcctcggtgagcccgacgacgtcgtgccggccgccgcgcacctccaccgtgtgccacagctcgctcagttcgacgtgccagtcccaggtctggacaccgaacgtgcgcggtgccgtgccgtcccgcccggcgacgcggcgcacgatcgtggtgcactcgcccggcggcaccgaggtgctgcgggccaggatctcggtgcgtgcgttgagcgcggcgacacgccacggctcgactccggcccctcgggcgatgccctcgatctcggcgcgcgccgccgggcggaaggccccgatcacgtcgagtgcgcggtccgcgtcggcgcgcacgtcggtctcggtgacgccgccgagggcgaagagccggtcgtacacgtcgatcgcggcgggcagggtgtcgcgcagctgctcgccgcgatcgacgtgtacga

SEQ ID NO: 2013 - DNA, 816 bp, Unknown
  Kingdom: Bacteria, Phylum: Actinobacteria, Class: Actinobacteria, Order: Streptomycetales, Family: Streptomycetaceae, Genus: Streptomyces
acgtgttcgcgctcgcgccccgctgcagggccgcgccgtcggtggagtcgacgccgccggtgcgggtgacgcggaaggcggggccggtgtcggcgccgccgtcctgcttcaggtagcggtcgaaccaggtcgtcacgcgggcctggatccggtcgctctccaggtcgccgccgtcgtggccgcccgcgatccagtccacgtcgacgggcgcgccgcccgcccggatcgccttctgggcggcgtcggcctggccgagcgggaagagcgagtcggtctggccctgcaccagcagggtcggcaccttgatccgggcggcgacggcggagggcgagcgctcctggaggatccggcgcgcctcggcgtccggtttcccggactcggcgacccgctcgtacatccggcacagcgcgggttcgaagcgggcgcagccgccgccggagttgaagaagatccccgcccagagtttcttgaagacgccgttcgggaacagggcgtccgcgaggttccagtaggtgatctcgggggcgatggcgtccacgcggtggtcgtatccggcggcgagcagggagatcgcgccgccgtaggaggcgcctgccaggccgacgcgcgggtcgccgggtccgtcgaggcggacctgcggctgccgggccagccagtcgatgagcttgctgacgtcggcgacctcgcccttcgggtcgttcagcccgatcttgccggtggagcggccgaagccgcgcgccgaccaggtcagcaccgcgtagccgtcaccggcgaggttctcggcctgcttccgtacgtcgtccttgctgccgccga

SEQ ID NO: 2014 - DNA, 2864 bp, Unknown
  Kingdom: Bacteria, Phylum: Actinobacteria, Class: Actinobacteria, Order: Streptomycetales, Family: Streptomycetaceae, Genus: Streptomyces
gctgggcgagctggtcgaggcgggcggcgcgcagggcctcctggacctcggggtcggcgcggaaggcggcggcgcgctccttgaggatgaggtagttgcgcatgcagccggccgcggaggcccacacgccgtcgaagtcctcggtgcgcgggggcttgaagtcgaagtggcgcgggccgtcgtagccggcgctctccagcaggtccacgagccagaacgcggcccgcaggtcaccggcgccgaagcgcaggtcctggtcgtacttgatgccggactggccgttgaggtcgatgtggaagagcttgcttgcccacagggcctgggcgatgccgtgcgggaagttcaggccggccatctgctcgtgaccgacctcggggttgacgccgtacagctcgggccgttccaggcgctcgatgaaggccagggcgtggccgacggtgggcagcaggatgtcgccgcgcggctcgttcggcttgggctcgatcgcgaagcgcaggtcgtagccctgggaggtgacgtactcgccgagcaggtcgaaggcctccttcatccggtccagcgccgcgcgtacgtccttggcggcgccggactcggcgccctcccggccgccccacgccacgtacgtcttcgcgcccagctccgcggccaggtcgatgttgcggatcgtcttgcgcagtgcgtagcggcgcacgtcacggtcgttggcggtgaacgcgccgtccttgaagacagggtgcgtgaagaggttggtggtggccatcgggaccgtcatgccggtcgcttccagcgcctgacggaagcgcttgacgtgggcctcgcgctcggtgtccgaggacccgaaggggatcaggtcgtcgtcgtggaaggtcactccgtacgcgcccagttcggacaggcgctgcaccgactcgaccgggtccagggcggggcgcgtggcgtcgccgaaggggtcccgtccctgccagccgacggtccacaaaccgaacgtgaaccggtcctcgggggtgggctggtagttcatgccgcggctcctcgctcgcttgcgactatttcgtcatggcgatttacaaattagtatgccgacgcgtccctgggaagggacaacgggacgccgaccggttccgagggcggggactatgccccggcgcaccgggaaagccgcaggtccgagcctgatgaaccgcgaaaaagaggagtgccgatgtcagcagccgagggtccgctcgtcgtcggtgtggactcgtccacccagtccaccaaggcgctcgtggtcgacgcggccacgggccgggtcgtggcgagcggccaggcgccgcacaccgtctccgccggcgccggccgggagagcgacccgcgtcagtggtggcaggccctgtgcgcggctctgcaccagtgcggggaggcggcgcgagaggcctccgccgtgtcgatcggcggccagcagcacgggctcgtcaccctggacgcgcacggggacccggtacggcccgccctgctgtggaacgatgtgcgctcggctccgcaggcccgccgtctggtggccgatctgggcggtccgaaggcctggtcggaccgcaccggcagcgtgccgggcgcgtccttcacggtcaccaagtgggcctggctcgccgagcacgagcctgaggcggcgcggtcggtggcggccgtgcgcctgccgcacgactacctgaccgagcggctcaccggccagggcaccaccgaccggggtgacgcctcggggacgggctggtgggcgtccgccaccgaggcgtacgacgaggagatcctcgcccgggtcggcctcgacccggctctgctgccccgggtggtacgaccgggtgaggtggccggaacggtgcgcgacatccacgacctgccgttctccaagggcacgctggtggcgcccggtaccggcgacaacgccgccgcggcgctcggcctcgggctgcgcccgggcaccccggtcctcagtctgggcacgtcgggcaccgtctacgcggtctccgagcaccgtccggccgatccgtccggcacggtggcgggcttcgccgacgcgcgcggcgactggctgccgctggcctgcaccctcaactgcacgctcgccgtcgaccggatcgccgcactgctcggcctcgaccgggaggccgtcgagcccggcgccggggtcaccctgctcccctacctcgacggcgaacgcacccccgacctgccgaacgcctccggcctgctgcacggtctgcgccacgacacgactgccggacagctcttgcaggccgcctacgacggcgccgtccactcgctgctcggcgcgctggaactggtcctggaccaggacgccgaccgcaccactcccctggtgctgatcggcggcggcgcgcgcggcagggcgtggcagcagaccgtacgacggctctcgggtcgtcccgtgcgcatccccgaggccggggaactggtcgcgctgggccgcggtcgcccggcgctggaagacggccgacggtccggtgctcgacgccgtggcgcgggacgaggcgacactggagaggatctccggggtactctccgacgcggcgccgctgctggagcgggggacgcgggaccactgaacaggaccggcggggccgcggtcggacaccggtcggcgggccccgccgccggacaccgaccgaggacgaccgaggcatgaccgcaccgctgaacgagccccgccccaccggtccggggcgcgcactgtcggacacccagcagggcatgcgccgccgcacgggtgagaccgatccgcgaggcgaccgcggcccgcgacagcggtccctcggcgctgacggtgtgcaggacacgggcgaggttgcggcggcgcatgccctgct

SEQ ID NO: 2015 - DNA, 1175 bp, Unknown
  Kingdom: Bacteria, Phylum: Actinobacteria, Class: Actinobacteria, Order: Streptomycetales, Family: Streptomycetaceae, Genus: Streptomyces
  misc_feature (381)..(382): n is a, c, g, or t
catcctgccgcacgccgtcacccgcgtcaccgagccgctcggccggcgcctggccccgctcctcgcggtgctcgcgccgtacgccaggaagctgaaaccggtctacccgcgccgcggccgcaccggctggcgccgctggatgccctcctggcggcagtggatcggcctcgcgttctccggcatcggcctcaccacgctgttcctggtcgtcgcctacgccgccacggacatcccggagaacctcaactcgtacgccacccagcaggacaacgtctacttctggtccgacggcacgcccatggcccgcaccggctgggtgcagcggcaggcgatgccgctgaaggacatacccgaggacgtccgctgggcggtgctcgccgnncccagcagtacgtcaagaacgtctacctgacgcagaaccagaccgtcagccgcaagttcaccgaggcgatgatctcgctcaagctcgacaacaggatgagcaaggacaagatcctcgagggctatctgaacaccagctggttcggccgcggcacctacggcatccagcgcgccgcccaggcctactacggcaaggacgtcagcgaactcaacgccagcgaggccgcgttcctcgcctccctgctcaagggcgctggcctgtacgaccccacgctcggcccggcgaaccacgaccgcgccgtcaagcgctggaagtggaccctggaccgcatggtcaagatcggcaagctgtccaaggacgagcgcgccaagtacacgacgttccctgagccgctcaagcgcaacccgctctccgacaccggccagcagagcgactacctggtcgaactggcctcccagtacgccaaggacgcggcccacctgtccgacaaggacttcgacctgggcggctaccagatctacacgaccttcgaccgcaagcgggagaccgccctcaccgacgtcgtcaccaaggcccgcaagaaggccaaggagagcgacccggcagcggcgaagaccgcccactacggcgccgcctcggtggccgccgacggccggatcgtcgccgtctacggcggccccgaccaccgcacccagggcttcaacgagtccaacgcggccaccgtaccggccggctcggccttccagccgttcgtctacgcggccggcctggagcacggcgtcgtcaagcagcg

SEQ ID NO: 2016 - DNA, 1871 bp, Unknown
  Kingdom: Bacteria, Phylum: Actinobacteria, Class: Actinobacteria, Order: Streptomycetales, Family: Streptomycetaceae, Genus: Streptomyces
gtacgggccggtgtcccggggagcacggcggtggtgagcggggcggtgagtgtcaccggggtgaaccaggaggcgtccagcggcggcagggtcaccgaggaacgggccgaggccaggccgggcggcgcgggcagcgggtccacggccgtgctggtggcgggcgggagcggcggccagggcgcccaggggcgcggcggcggcggaggcggcgagcgcggtcagtagaccgcgacgggaggtgtgtgtcatgtccaccatgatcgggtacagcacggcggccggacccgccggaacccgccgaaccgcccactcgtcccgaaatacgcgacgggcagtcccacttgaggcggccgatcagatacgctccgcgcccccgggcggcgaccccgcaccgaccgcccgggccaggtacggcgccgtggcgctgccctgcgccccggccacctgcgccggtgtccccgccgctacgatccggccgcccgcgtcgccgccgcccggacccaggtcgacgacccagtcggcgtccgcgacgacggacatgtcgtgctcgacgacgaccaccgtgtgcccggcgtccaccagaccgtgcaactgccgcatcagcacctcgacatcggccggatgcagccccgtcgtcggctcgtccaggagatagagggtgtgcccccggcgaccgcgctgcaactcgctcgcgagcttgatgcgctgcgcctcaccgcccgacagctcggtggcgggctgccccagccgcagatagccgagccccacgtcgagcagggtgttcaggctgcgggcgacggccggggtgtcggcgaagaactccgccgcgctctccaccgtcaggtccagcacctcggcgatggagcgcccccggtacgtcacgcgcagcgtctcggggttgtaccgggcgccgccgcagtccgggcacggcgcgtacgtgctcggcaggaacagcagctccacgctcacgaacccctcaccctggcaggtctcgcaccgccccccggccacgttgaaggagaaccgccccaccccgtaaccgagttcacgggcggcctccgtccccgcgaacaccttccgcacgacgtcgaacagcccggtgtacgtcgccaggttggaacgcggggtgcgcccgatcggccgctggtccaccgacaccagccgttccacgcccggcagttcctcggtgatcgccccgatcagcgtcgacttgccggacccggagactcccgtgacggcgctgagcacacccagcgggaactcggccgtcaccgcccgcaggttgtgccgggtgaccggccccacggtcacccagtcgcgcggctgccgcccctgacgccggggcccggagcccccgccggacaggaaccggcccgtggccgacccggccaccgccgccagtcctgccacgggcccgctgtgcagcacccggcccccgtgctcaccggccagcggacccacgtccacgacccagtccgcgccccgcacgacgtccaggtggtgctccaccacgaacagcgagttgcccgcgtccttgagccgctgcagcaccgtgagcagtgcctcggtgtccgccgggtgcaggcccgccgacggctcgtcgagcacgtacaccaccccgaacagccccgaccgcagctgcgtggccagccgcagccgctgcagttcccccgccgagagggtgggcgtggaccggtcgagggagaggtagccgagacccagctcgacgaccggcccgatacgggacctcaggtcgtcggtgagcagccgggccgcctcggaggcggtcccccggagcgttccggccagctcggtcagcggcagcgcggccagctcggcgatcgtgcgcccggcgacggtgaccgcgagcg

SEQ ID NO: 2017 - DNA, 1053 bp, Unknown
  Kingdom: Bacteria, Phylum: Actinobacteria, Class: Actinobacteria, Order: Streptomycetales, Family: Streptomycetaceae, Genus: Streptomyces
atgccacccgcccccacctgacttccacccaccgcgacctcgcagcccgactcgacaccctcgtgcgctccagagctgccgcacccggccgaccggcggccaacgacatcccaggagccccgaacggggaatagcgcgacatgagagcgccgcctcttcggcagtcgtccagcgcaacgtgctgacggtcgaggcggaacgccgtcagagtgttcatctcccgggcgacagaaccgggtggccggtccgcggtgcgcgggtggcaccacgcaagcggtacctgaccaaccgtcacgcacggggcggggtacggctgaacgcgggctcctagatcgccatgccggcggttcgaccccgtggggcggcttgcggatgaggacggtggagggcaccgggcccccggactcgatgatcggtcgcggcggaagtcgtacgccttgtcggcccgtacccggtccagccgtttgggcggcctgccggcccccgagccggggcactcggatcgcctcaaggagcggctcggactgcggggaatcaccccgctgtctcggccgtgatcaccaccgacgggggcttctggtcctgccccgagcgcgaggtgggtctcgctcgtcagtccgccccgcccgaccgcccgagtccgtggtcggccggctcgacgaagactgcgcccggcggctccttctggagatcccccgtttcgacgccccgacagcgggctgacggtccggcagaccgtggagtcgttgtgcgtcgcccggggagggggacgaaccggtgaggagcgacatacctccgaattcgcttgacgcaaaggcgctttcggccatgcgcccgagtgcgcgctccgcatggggccgcccggagatcgctcgttcgtggcattctgttgactcccacgaatcactgtcggcaccagcggatgccgtaccactcaaaggcaggtactgatgcggcccggagacgagcgagcgggtcccggccccggcccggcttcgctcaccggcgcgtccgccaccgccggcgttcgccgcgcccccgcacgcctctcgc

SEQ ID NO: 2018 - DNA, 1460 bp, Unknown
  Kingdom: Bacteria, Phylum: Actinobacteria, Class: Actinobacteria, Order: Streptomycetales, Family: Streptomycetaceae, Genus: Streptomyces
gagccgggcgccgcgcaggaaggtgccgtcgccgcccagggtgacgatgaggtcggggtcgccggccgcctccacctcgtcaccggcgctgcgccggccgccgtcgttccacacgtcgatgtcggtgcaccgcacgccgtgctcctcgcaccaggcgtgcacggtccctccggcggccacggcctcgggccgcccgccgtgcgcgaccaggccgatccgacgcactgtcacagctcccgcgggttcccctcggtgggagccggtagcggaggaatcaggtaaagcaatcgtatggtccagtccaagtaatcatctggtccagaccaatccgttgacgtgcccgcaacagcgtcaggaagctggggcgacttccccaccacctcccctccctggaggcacgcagtgagacgtcttcgcgcatgtctgggcgcgaccgccgccgtcgccctcgccgccctcggcaccaccgccctggtcgccggcaacgcctcgggcgcgccgagcgcactgagcaaccgctggtacgccgcggccccctacctgatgccgctggacaacgacccgccggacgccggcgccatcatggacgccaccggcctgaaggcgttccagctcgccttcatcctcgccccgggcggcggcggctgctcgcccacctgggacggcacggccgcggtctcctcggacacagccgtgaagtcggtgatcgacgccatccgcgccaagggcggcgacgtctccgtctccatcggcggctacggcggcaccaagctcgggcaggcctgctcggacgcggccgccaccgcggcggcgtaccagcaggtcatcaccaagtacggcctgcacgccatcgacttcgacctggaggagcccgagtacgagaacaccgccgccatcaagaacgagatcggcgcggcgaagatcctccagcagaacaaccccgggctgtacgtctccgtcaccaccgccggcaccgccgacggcaccggctggttcggcaagcagatgctgctggaggccaagtcgcaggggttcaccccgaacaacttctccatcatgccgttcgacggcgggttcaacggcgcggcctcccagaccagcgcgctgaccaacttcaaccagatcctgcagtccacgttcggctgggaccaggccaccgcctacgcccacgagggcttctccggcatgaacggccgcagcgacaccggggagatgttcacccaggccgacttccagaccgtgctggactacgccaccagccacaacatggaccgcttcaccttctggtcgctcaaccgggaccggcagtgctcgccgcccgacaacggcggccgtacgtccggcacctgctccagcgtgccgcagaacgcgtgggacttcggcaagtactcggtgaagttcgccggcgcgaccccgcccagcacgccgcccacgacgccgccgcccacctcgccgccgcc

SEQ ID NO: 2019 - DNA, 1548 bp, Unknown
  Kingdom: Bacteria, Phylum: Actinobacteria, Class: Actinobacteria, Order: Streptomycetales, Family: Streptomycetaceae, Genus: Streptomyces
gtacggcgtcgcggcgcgccctgcggacctggtccgggatcctgtgccgaccgcgtggcacccggcaccggagcagcgccgggaccggtcccaccaccggccccggccccggctcccgcacccgagggcgaaccggcgcccgtacctgaccgcgagcccgcacccgcccctccgccggagccggacccggcgccggatcccgcgccggagccggactccgtgccgggctccgcctcgggcccccggcgctgtgcctcggctcccgggtgcgggccgggcccgccctgcggttcccggccgggccgcgactgcggtcgtgcttgcggccgtggctgtgccccggtctccggctgctcggccccggccttcggctgcggctcgtcgctcatctcgtgcacggactcctgtttcgcctcgtacgttcccgtacgccctcatgcggcttctgccttctgcgcccccggatgaagactctcgtaccgagcgttccgttcccgcgccccgcaacttccggcgcgcggaaaatgcgtggcacgtcaccttccgtgcgcactaggctcctgcgcttcggtgtcggcggagcttggagggcgtgacgtgggcgctggacggttgtacgtggccgtcgcggcgggcggattcagacggtacgcgacgtatcgggccgccacggcggccggggtgttcacgaacacggtcttcggcctcatcctcgtgtacacgtacctcgcgctgtgggacgcccgtccgcatctgggagggtatgaccactcccaggcggtgacgtacgtgtggctgggccaggcgttcctggcgacgctcgcgatcggcggcggcggggtcgaggacgagctgatggagcgcatccgtacgggtgacatcgccacggatctccaccggcccgccgacctgcagctgtggtggctcgcggcggacctgggcagggcggtgttccagttgctgggccgcggggtggtgcccttcgtcttcggggcgctgttgttcccggccatgctgcccacggacccggtgacctgggtggcgttcctgggcgcggtgccgctggcgatgctggtgagcttcgggatccggttcctggtggcgctgagcgcgttctggctgctggacggggcgggtgtcgtgcagatcgcgtggctggcggggctcttctgttcggggatgctgctgccgctgaacgtcttcccgggcgccctcggcgaggtcgtacgggtactgccgtggtcgtcgctgctccaggcaccggccgacgtgctgctggggcacgcggatccgctgcgcacgtacgccttccagggcgcgtgggcggcggcgctgctggcggcgggtcggctgctgcagacggtggcgacgcgacgggtggtggtgcagggtggctgagaacaccggcggcgcgggggacgcggtaccggacggtcccggtaccgcaggggccgatctgggcgccgtatccgccgctcccggcgccgcaccggctgctcgcggcgccgcaccggccgatccgggagtcgcaccggccgatccgggagt

SEQ ID NO: 2020 - DNA, 3120 bp, Unknown
  Kingdom: Bacteria, Phylum: Actinobacteria, Class: Actinobacteria, Order: Streptomycetales, Family: Streptomycetaceae, Genus: Streptomyces
cggccacccgggccgcggcggcgccctcggcttcgccgacccggacgcgggcatcgccttcggctacgtcaccaacggcttccgttcgagcgtgacggcggacccgcgggcccaagccctggtacgggcggtgcggaccgccgcggcgcggaccgcctgacgctccccgcgcgccgctcgcccagacgaacgctcagacgtggatgggcgaggacgtgcggcccgacgcgctgtcgatctcctcgtgcgccttggtgagcagttccatggcgagttcgttgagggcacgggccccggcgatctcctcgccgacgcgcggctggtcggagtcggtccggtgccggctggcccgcccgtgcgcccggacctcgctgccgtcgggcaggcggaccatcgccaccgcccgcgtgtgctggccgtcctcctcgaactccagctccacgtgccatcccacggccgtcttcatcatgaccatcacctccgggaacacctccttccagggtgctcccttccccaccgccgtgcagcaccagcccctgccggagggaagcgggtcctaaccggcgtgcagcatcaggccgatgccgacgaccagcaggccggccgcggcgatccgcggcgcgccgaagcgctccttgaagaagagggcgccgatggccgcgccgacgaggatggaggactcgcgcagcgccgagacgggtgcgaggtcggccctggtctgggcccacagcacgagtccgtacgcggtcacggacagggcggcgccgagcaggccgagggcggcgtgcggacgcagcacggccgtggtccggccgcgccagcgcgtgacggcgtacgccgggatcaccacgccctggatcgccatcagccaggcgatgtaaccgagtgacgacccggaggcgcgcacgccgagcccgtccacgaccgtgtacaccgcgatcgacagcccggtcgccagtgcggccccgaccgccgtccagtcgggccggcgtccgcgcagcccccacagcgccaccccggtcagtcccgcgcacgacagcgcgatgcccgcgctcgcccagacgtccggcacctcgtgcgcgaagacggcggccagcacggtgacgacgagcggcgcggtgccccgggcgatcgggtacgcctgcccgaagtcaccgagccggaaggaggtcatcagcagggcgtagtagacgatgtgcacgaccgccgacagcagcaggtacggccacgcgcccgccgccggtaccgccgtgaacggcgccagggccgcgccgatcagcagcccgccgccggagatcagcgtgaagccgacgagcttgtcgggtatgcggtgcgcgagcgcgttccagcaggcgtgggtgactgcggcgagcagtacggccgccgtgaccagcggtgtcacgccgtacgctcgcgcacgtccacgagactggccccggcctgtgtcaccagcgccttgggttccatcgggaagacgctgtacggggtgccggccgcggcccacacgacgtcgtgctccagcagcgaccggtcggccaggacccgggtgcgcgtgcggtgcccgaagggcgggacgccgccgatggcgtacccggtggtctcgcgcacgacgtccgccttggcccgggtgaccttgtccgcgcccagttcctcccggacccgctccacgtccacccgggaggcgccgtccatgagcaccagcaccgggacatctcccccgggctcccgaccgggctcgagcaggggggacccccatgccgtgaagatcagcgacttgcagatctggctcagttcgcagccgacggcggcggcggcctcggcggcggtgcgggtggcctcggggaagcggcggacctcggcgaggagttccccgaggcccagttcgcgcagcgcctcggcgaagcgggggtgggcgtcgggagcaccgttcgtcatcgtcatgcccggcacggtagcggtgggcagccttgcccgtacaacaccggggacggcacgggacagacggagggcgcggccccctcggggagccgcgccctcgtcctcgtgtccgtcaggccagggccggttccctgtcctcgccggggtccgggcgccgggtgtcgtgggcgcgcaggccctcgccctccacgtcgacgttgggcagcgcgcggtccagccacttcggcagccaccaggccctgcggcccagcagggcgaggacggccgggacgatggccatgcgcacgatgaacgcgtcgaagaacacggcgatcgcgagcccgaaaccgatcatcttgatcatcgactcactggagccgatgaacccggagaacacggcgatcatgatgaccgcggcggccgtgacgacccgcgcgccgtgccggaagccggtgacgacggcctggcccggctgctcgccgtggacgtacgcctcccgcatccgggtcaccaggaacacctcgtagtccatcgcgaggccgaagacgacgcccaccatgaagatcggcatcatcgacatgaccgggccggtctcctccacgcccatcaggccggacagccagccccactggaagaccgcgacgaccgcgccgagcgccgccatcaccgacagcaggaagccgagcgccgccttcagcgggaccaggaccgagcggaagaccacgatcagcagcaggaaagccaggccgacgacgagggccaggtacgggaacagggcgtcgttcagcttctgcgagacgtcgatgttcatcgccgtggagccggtgacgagcacctcggcgtccgtcttgtccttgatgccgctgcccgcgtcgcggatggcgtgcaccaggtcctcggtggtggtggaggacggcttggagtccgggatgacggtgatggtcgcggtgtcgccggccttgttgggctgggccggagtgaccgtcacgacgtccttgaggcccttgatgccgtcggtgacctcggtgaaggcggccttcgggtcgtggctcctcttcgcgtcgacgacgaccatcagcggcccgttgaagccgggcccgaagccctcggagaggaggtcgtaggcgcggcgctgggtggtggagacgggctgggagccgtcgtcgggcaggcccagttcgagggaggcggcggggacggcgg

SEQ ID NO: 2021 - DNA, 1119 bp, Unknown
  Kingdom: Bacteria, Phylum: Actinobacteria, Class: Actinobacteria, Order: Streptomycetales, Family: Streptomycetaceae, Genus: Streptomyces
  misc_feature (462)..(550): n is a, c, g, or t
agccgccgcccggcatacgggcgcccagcgcgccggcggccagcgccgtgtcgacgaccaggtccagctccgggcaggagatgcggaagtcgtcccgcagggaggcgtggccctcggtgaggaccggtccgatcgcgcgggcgccggtggattcgaggagggcgatgacgcgttcgacgcgggcgtcctccgtcaccacgtggcggaccaggcggcggatctcctcctcgtcgccgagccgggccagggccgcgtccagatcggcgtgggccacgtcccgcagggcgtcgacgccgagcagggccgcgcccttctcgcagccggcccggcgcttgccgtactcgccgtcgctgtgcgcgtgcttgacgcgggtgtcgacgacgagcaggcgcagaccctcgcgtgccaggtcgaaggggatctggcgctgggacaggtcgcgggtgtcgaggaagagggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcgggccagctgccagggcttcaggccgagttcgtacaggtcgttcagggccagggcgacgacgacctccagggccgccgaggaggacaggcccgctccggagggcaccgtcgacgtcaggtggacgtccgcgcctgccaccgcgtgccccgcctcgcgcagggcccagacgacacccgccgggtacgcggtccagtgcgcgtcggacccgggagccaggtcggcgacgcgcagttcgaccgggtcgccgggtacgtccgccgagtgcagccgcagcacaccgtcgtcccggcgggacaccgccgcgatcgtgtcgtgcggcagggcgaacggcatcacgaagccgtcgttgtagtcggtgtgctcaccgatgaggttgacgcggcccggtgccgcccacactccctgcggtgcggtgccgtacagctcggcgaaaccgtcccggacctgctgtgcccccactactgctccctggtggtgtgctgtgcgaactcccaggcgtccgcgacgatgcccgcgatacgcttcgctggaacccgtcccgcgcggccctcgcggccgtggtcg

SEQ ID NO: 2022 - DNA, 2084 bp, Unknown
  Kingdom: Bacteria, Phylum: Actinobacteria, Class: Actinobacteria, Order: Streptomycetales, Family: Streptomycetaceae, Genus: Streptomyces
caggccgaactcgcctggcgccgggagctggcggcgcggaccctcgccgacgtcatggacgacgcccggcgcagcgcccccggcctgccgcagcgcgtccgccgctggttcgcaccggcgctgagctgacctggtctgacctgacctgcacccacacccagggggattttcggtccgacccggccggccgttcccgtcggcccgaatccgggtggtgaccgccgccgcggtgacgcggcaccaggccacggagtaatcctggacatcgaatgtccaggaccgatcgaaccggctcactccgggctttccacagtttccgaactaccagtgacgaggagcagaatcatgaccgctcgaccgcatcgccagatgtgcgagacgttaggggccgtgtggccggcgacgggaggccgggcatgaccgcggtggaccgccccgctcccccggcccccggcacgcgttcgccgctgaggtcctggctcgccgtctgggccgtcgcgctggggatcttctccctgatgacgtcggagttgctgccggtcggcctgctcaccccggtcggttccgacctgcacgtctcggaaggcacggccggcctcatggtgaccgtgcccggcctggtggcagcggtgtcggcgcccctgatcacggtgacggccgggcggctggaccggcgcctggtgctgtgtgtcctgatcggcctggtcggcgcggccaacctggcgtcggccttcgcgccgaacttcgccaccttgctggcggcccggttcctcgtcggggtgagcgtcggcggattctgggccatcgcgggcggcctggccgtccggctggtaccggagaagcaggtcccgcgcgcgatggccgtcatcttcggcggcgtgtcgaccgcctcggtcgtcggcgtaccggccgggaccctggccggtgaactcagcggctggcgcaccgcgttcgccgccgtgggcctgctcggactggtggcgctggtctgcaaactgtcgctggtgcccccgctgcccgcgacccagacgatccgcctggccgaactcccgcggctgttcggcaagaacgccggcgtacggatcggagtggccgtcaccttcctgctgatcaccgggcagttcgtggcctacacgttcgtccggccgatcctgcaggacatcagcggtgtagacccggacctgatcagcacgctgctgctcggctacggcgtggccggcatcgtcggcaacaccgtggccagttcctgggccgcccgcgacgtacgccgcaccctgctggtcatcgccctcgcgctgaccgcggcgatggccctgttccccctcgtcgggaccggccgcgtgggcggcatcgggctgctcgtcgtgtggggcctggcgtacggaggcgtctccgtgagcctgcagacctggatgatgaaggccgcgccggaggcttccgaggcggccagctcactgttcgtcgcggcgttcaacctgtccatcgcgctgggtgccctgatcggcggtttcgccgtcgacgccctggcgacgtccagcgtcctgtggctcggcggcgccctggtgctcctcaccgcgctgacggcctggagcgcgcgcaggacgcagctgacctgaggtccgccgagcccgctgctggctcccggacaccgggcaccggacaccggatcgcggagcacacccccgtccccgcgatccggtacggcccgccccggcggcctcctgtgcgaggcgccggggcgggccactcatcggcgcggcaccggtccgagaaccggtgccggcggcgcgcggggcaggcgtcatgcctcccgcgtactcccgtgcgggggcagcgacggtgtgtgcatccatgcgatccggtcgtgcagttccgtggccgagagcgaggccagcatggcgttgcggtcgtcggccgcggcaccggccggatgccacagccgtacgctctcgcgggcggtgagctggagggcggcggtgcgttcgcggcgctgcacgttgtaggcgcgcagccgcgcggggaacgcggatgccgggcagtcgaggaggtcgccgaggacgacggcgtcctccagtgcctggcag

SEQ ID NO: 2023 - DNA, 1295 bp, Unknown
  Kingdom: Bacteria, Phylum: Actinobacteria, Class: Actinobacteria, Order: Streptomycetales, Family: Streptomycetaceae, Genus: Streptomyces
gacggcctcccgtccgccgaggaggccgcgtgcgaggggtgttgacggggttcgcggtcatcgcggtcgtcatcgcggtgggttacgtgctcgggcggcgcggttcgctcggtgaccagggccgcgaggtgctgacccggctcgccttccaggtggccaccccggcactgctgttcacgacgctcgcccgggccgacctgtcggtggtgttctccagccggctcctcgtgacggcgatgagcacggtggcggcggcgggcgtcttcacggcggtcggcgtcgtacggcgctggggtgtgggccgcaccacgatcggcgcgctgtgctccagttacgtcaattcaggcaacctcggcatccccatcgccgcgtacgtcctcggtgacgcctcgctggtggcgccggtcctgctgttccagcagatcgtcgtcacgcccgtcgcgctgacggtgctcgacctgtccggcgcgggcgagaagggcccgctgtggcggcggctgctcacgccgctgcgcaatccgatcgcggtgggcgcgctgagcggtgtcctggtctccgcgaccggtgtgcgcctccccggcccggtcctgcaaccgctgaccctgatcgccgacatgtccgtcccggccgtcctgctggccttcggcatcgccctgcgcggcagtgcggccccgggccgcgggccggaccgccatccggtgctgctgtcggtggcgctcaagtcggtgggccagccggcggcggcctgggcgctggcggcgggcgtcttcggcctgcacggcgcggccctgctggacgtggtggtgacctcggccctgcccgccgcccagaacctgttcacgtacgcgagccgctaccagaccggcgagaccctggcccgcgagtcgatcctgctgtcgacggtcctggcggtgccggtgctggtgggggtggcagccctgctggggtgagggccgtcagccggctgagagccgaacgggaccggcggcagtccaccggtcccgttcaccctgacgagggccgcgaccacagcggcctccggccgcgggcaggtcaggcgatacgttccagcaccaccggggaggcggtgaagtccgtgccggacggggcgatgtcgtacgagccctcggtcgcctggagcgcgtactcgaagcgctcgggggtgtccgtgtggagggtcagcaggggctggccggcggtgaccgtgtcgccgggcttggcgtggagttcgacgcccgccgccgcctgcaccgggtcctccttgcgggcgcggcccgcgcccgcaaggaggaccc

SEQ ID NO: 2024 - DNA, 998 bp, Unknown
  Kingdom: Bacteria, Phylum: Actinobacteria, Class: Actinobacteria, Order: Streptomycetales, Family: Streptomycetaceae, Genus: Streptomyces
agcgcctccgccaccgccgcccccgtctcctcgtcaggaaccaggaacgccgtcgtcggccccgaccccgacaccagccccgccagcgcgcccgccgcccggcccgccgcgagggtgtccgtcagggacgggcgcagggacagggccgcgggctggaggtcgttggtgagcgtggcggccagagcgtgggcgtcgcccttcgccagggcggccagcaggtccgccgaggccaccggttcgggaatctcccgcccctgcgccagccggtcgaactcgccgtagaccgcgggcgtggacagcccgccgtcggcgaccgcgaacacccaggggaaggtgccgcccacctccagcggcgtcagccgctccccgcgccccgtgcccagcgccgccccgcccaccaggctgaagggcacatcgctgcccaactcggcgcagatgtcgaggagttcgtcgcgggaggcgccggtgccccacagcgcgtcgcaggccaccagcgcgcccgcgccgtccgcgctgccgcccgccatgccgccggcgacggggatgtccttgtcgatgtggatgtggacggcgggagcgcggccgtggcgctcggcgagggcgagggccgcgcgggcggccaggttcgtgcggtccagggggacctgaccggcgtccggacccgcgcaggtcacgcgcagttcgtcggcctcggtgaccgtgatctcgtcgtacaggccgacggcgaggaagacgttcgccaggtcgtggaagccgtcggggcgtgcggcgcccacggcgagctggacgttgaccttggcggggacgcggacggtgacgctcactgggcttcgggctcctcgggtcagacggcgcggtgctctgcgatccgcgcgaactcttccacggtcagcgactcgccgcgcgcctgcggcgacaccccggcggccaccagcgccgcctcggccgccgccgccgacccggcccagccggacagcgcggcccgcagggtcttgcgg

SEQ ID NO: 2025 - DNA, 1551 bp, Unknown
  Kingdom: Bacteria, Phylum: Actinobacteria, Class: Actinobacteria, Order: Streptomycetales, Family: Streptomycetaceae, Genus: Streptomyces
gtgacccggccgtcggcgcggggcagccggccggtggtcagggaggagtggccggcgaggtcgttctgcgcgacgaggcggacctgcgcggggacgccgctgggccgcgggatccacgggtccgggactgtcaggtcgtcggtgttctgcacgccgtacgacgactggccgaggtcgacggtgagcggctgcgggacggcggcgacgaccttgcggaactggcggcccagggcctgcggcagcagcgcccgttcccgctcggcggccgggaactggaggccgggctgcggggcgctgacggccagggtggtgcgtctcggggtcgcctgctcgatggcgcggcccaggccggcgtcctcgtagtggtccagggcgcgcgggaaggcggcggccaggcacgcggtcagcgcgaccagcagggcgagggcggcggcggcgcccggcgcggtgcgcagccgtacccggacccaggcgggagcgacggtgttcacctcactcacctccgcggtctcgaagggacaccgccgggtcggcccggcgcagggtcagcaccgccgtgacgacgagcggcgcggcggcgacggcggccagcagcagcgccacctggccgaccggcagttcgaccagtacgtccggcaccggtttagcggcctgcccggtcagcacgatcagcgggatcacggcccgggtcagcaccgtgcccagggccacgccgaccaccagggccagtgcgaccagcacgccctgttcggcggcgagcatccgggcgagctggcggcgcggggcgcccagggcacgcagcacggcgaactcggcgtcccgctcgcgcagcgccccggccgcgctcaccgcgaagccgagcgcggccagcgcggcggcgacgatcgcggccgcggtgaacgcggcggccggtccggcgccgaacgggtcgtcgcgcagctgtccggcgatctcgtcgcggacgacgacctgtgccggatcgacgtcgggcagggagcgcagggcggcggcgacatcggcgctgtgccgggagtcggtgcgcagccaccactcggtgggctcggcgctctcgccgtagcgcgactggagcagccggttgaccgcccgcaggtccatgaggaggcctccgccgtcgtgcgccgcgtccggtgcggcgctctggcccgccccggccgtggtcggcagctgccgtacggagcggacgatccgcaccggcaggttgcggccggcgaacgtgacgtccatgcgctggccggcgtgggcgccggcggcggtcaggaagcggtcggtggccacggccgtgatctccgcctgcgcgggctgcgtgacctggagccgtacggagacgaccgtgcccaccgcccacatgtcctcgtgcggtacgtaaccggtgccgtaggtgacggtcagcgggcggccggaggtcaccttcgcccccgtcggagtgttcccgccgtcgggaagggggtccgcgccgccggtggtcgccgccgtccaggccgtgggcagcgccagttcccgcgcggtcccgtcgctgcccacggcctggac

SEQ ID NO: 2026 - DNA, 1604 bp, Unknown
  Kingdom: Bacteria, Phylum: Actinobacteria, Class: Actinobacteria, Order: Streptomycetales, Family: Streptomycetaceae, Genus: Streptomyces
tgcccctcgtcgaccgcacccggcgaccacctgcccgtcggccgtcagccgggatccgcgccgggtgcggtcgacgaggggcaggcccagcttgcgttccagcgccgacagccgcttgctggcggacggctgggtgatgcccagctccccggcggcccggccgaggctgcccagctctccgacgagcaccagcagccgcagggcctcaacgtccgggggagcactcatggtctcagcatacggacggaatctgtaccagtcagtgggccaagtcattcccgtcggctatgacctccccccgaagagtgggctaccggcctggtcagcggctgcccacagtgaagatcatgagacaccgcaccggcgcggacgccaccaacgacaccgatcccgggcccaccggccacaccggtccgaccggttccgctcccaccagtgctcccgctcccgccggtccgagcggtccggccggtcccacgtcgtcgggcggagcgcccgcctccgtacgggccgggctggcgcagcgcgcgccggggctgctgctcgccgtggtcgtggccgcggcggcgacggccgtgggcggttggtttcccgtcgtcggaggtccggtctccggcgtggtcatcggcgtgctggtggccgcggtgcggcgtccgggcgagcggttcaagccggggatcgcgaccgcgagccggttcgtcctgcagctagcggtggtcatcctcggatgtcagctgtcgctggcgcgggtcgtggaggtcggcggcagttcgctgccggtgatggtgggctcgctgaccgcgtgcctggcagccgcgtacctcgtgggccgcaggctgggcatcggcggcgacctgcggaccctcatcggagtgggcaccggcatctgcggtgcttccgccatcgcggcggtcaccccggtcatcggggccgccagtgccgaggtcgcctacgcgatctcgacgatcttcctcttcaacatctcggcggtgctcctcttcccgttcctcgggcatctgctggggatgagccagcacgccttcgggctgttcgcgggcaccgcggtcaacgacatgtcctcggtcgtcgcctcggccgccacctacggggacgaggccggccagtacgcggtcgtcgtcaagctgacccggaccctgctcatcatccccatctgcctgggcctggccgcactggcgaggcgccgcgccgcgcgcacggcagcgggcgtgggcacggaagcgggcgtgggcacggctcacccgtcgcagcgcaccggtggcgccccgcgtccgaacgtcttctccctcgtgccctggttcctcgtgggcttcctgctgaccgccctggccaacaccgtcggactcatcccggccgcggcgcaccacggcctgaacacgctctccgtcttcctcatcacggtggccctctccgcgatcggcctctcgaccgacctgggcggcctgcgccgcgccggaccccggccgctggtcctgggcgccgtcctgtggggcgtggtgacggtcacctccctcgcactgcagttcgtcaccgcctcctggtgacccgcgtgttcctcccgtccgggggtgggcacgggtctcgtc

SEQ ID NO: 2027 - DNA, 656 bp, Unknown
  Kingdom: Bacteria, Phylum: Actinobacteria, Class: Actinobacteria, Order: Streptomycetales, Family: Streptomycetaceae, Genus: Streptomyces
ccgccgatcagcacgaacacgacgagcggaacggtccgcgccgccgcgaccagccccacgtcggtcgccgagccgcccaccgccagcacagcgaacgcccccgcgaccagcgccccggaactgccgaggcccgacacgacggcggcaccggtcagcaacgtgtagttgcgcccggcccaggacggacggcgaaggcggcttcgagggggagtcaccccgggattatccccgtacgcacgacacgacccgtacgcacaaaacaaaaggaaaggaggtgacccactcctttccgctctcaacgtatagcgcaccaggggacttgcggcaaggcccccgccgtcccgcacaatgaccggcccgagccggccacagatgcggagcatcccacccgtgaaccccctgaccaccagcgtgttcgaccttcccgagcgcctgtccgccaaggccgaccccgcgctgaccgcgtccgacgaacagcacttcgcggccgtcgcccagtgcctggaggagtcggtcgccgaactgtccgaccgcctcgacgcggcccgcagggcgccaggcggcctcggccggcaggccatggaccgcgacgcggaggtccaccggctgtccgcccggctgcgcaccctgcgccgcttcggcctggacctgtgcct

SEQ ID NO: 2028 - DNA, 1117 bp, Unknown
  Kingdom: Bacteria, Phylum: Actinobacteria, Class: Actinobacteria, Order: Streptomycetales, Family: Streptomycetaceae, Genus: Streptomyces
aaggggagggcgggcagttcgaggcgttcggcgtccatggccgaagtctcccacccgcctccgggcgacccgcagcgccctgcgggaggccgcccccggggtgtgccgtcagcgttccagccggccgtcgtagcggcgcggcaggccgagggggttgtcgtcgcgcagttccggtggcagcagggcctcgggggcgttctggtacgccaccgggcgcatccaccgctcgatggcggtgccgcccacggaggtggacgtggaggtcgtcgccgggtaggggccgccgtggtgctgggcgggggccaccgcgacgccggtcggccagccgttgacgaggacgcggccggccagcggggtgagttcggcgaggagtccggggccgcgtccctcgccgtccgcctcctcggcggagaggtggaccgtggcggtgaggttgccgggcaggcgggacaggacagccgtggcctcgctctccccggtgtagcgggccaccacggtgaccggtccgaagcactcctccaggagcaggtcgtgggtgcccgcgccggtcagcttcccggccgggacggtcaggaaaccggcgctcacggtgtgctcgccgccggcgcccggggcgacgggggactcgacgtcggggagcgcggcgcgttcggcgacgccggcgaggaagttgtcgcgcatgcggtggtcgagcaggacaccggcgccggtgccgccgacggcgtccgccagggacttcaccagtcggtcgccggacgcacccgccggcacgagcaccaggcccggcttgacgcagaactgaccgacgcccagggtcatcgacccggcgagacccgccccgatggcctccgcgcgctccccggccgccgcctcggtgacgaggacggggttgagggagcccagctcgccgtggaacgggatcggcaccgggcgggccgcggcggcgtcgaacagggcccggccgccgcgtacggaaccggtgaagcccgccgcggcgaccagcgggtgcccgatcagctcgacgccggcgcggaagccgtgcacgaggccgaggacgcccgccgggatgccgtgctcggcggcggcaccgcgcagcacctcggcgacccgctgggac

SEQ ID NO: 2029 - DNA, 2313 bp, Unknown
  Kingdom: Bacteria, Phylum: Actinobacteria, Class: Actinobacteria, Order: Streptomycetales, Family: Streptomycetaceae, Genus: Streptomyces
agtggttggcggtgcccacgatcaccagcagcgtcagcagcgggtgcagcagccacagccagcgccaccgcgaccgggtggccacgatcagcgcgatcgacaccatgagtgcccagccgaagtgcagcgagggcatggccgcgaactggttcgacaggtggtccgtcttcggcggtccgtacaccgagggcccgtacacgcgtgcggtgtcgatcaggccggtggcggccagcatgcgcggcggggccagcgggaacgtgagatgcagcaccagggcggcggcggtcagcgcggccagggcgcggcgggtccagacgtagtgcgccgggcggcgcaggtagagccagacgagcagcccgacggtggccgggaagtgcacggtggcgtagtaggtgttcgcgatgtgcaccagggtgtcgccgtgcagcagcagggactgcaccgcgccctcgccgggcaggtggaccgcccgctccaggttccacacgtggtgcgcgtcgcggaaggcctcgccggtgtggtcggcggccagctggcggcccaccttgtagacgaggaacaggcccgcgacgagcagcagctcgcgcacgagtgcgggccgggcgggcctcgtgggctccgcggcggcggcctcgtttcgggatgtcatgccccggccccttcgcgtgcggtgtgcgtctgtgacgtgtgcgtgtgtgacggatgcgcgtgtgatgcatgcgcgtgcctgccggtacgggagtggtggccgccccggtagcatcgatacgacatcgtaccgatacgccagtgtaccgatacggtggagtaccggtacactggcgtatcgattgaggtgtctcacagagaacccacagaacaccgaagggtcctggggagcggctggagccgccctcggatcacgagtgacagcgaggagaagagcgatgacgtcgcaggccgcgaacggaccggacacggttgtcgcctcgcgccgctccaagatcacgcccgagcgtgagcaggagttcttcgacgccgtcctcgaacagatccgcgagtgcgggtacgacgccgtcaccatggagggcgtcgccgccagcacgcgctgcagcaagtccacgctctaccggcagtggaagaacaagccgcagttcgtggtggccgccctgcgttcgaaccggcgtacgcgcttcggcggcatcgacaccggttcgctcgccgaggacctcctgcaggccgcgcgggccgcgggggagtggtccggcaaggacacccggctgctgcaggcgctcggccacgcgatcatgcaggacccggaactgaagcaggcgctgcgcgagaccgtcgtggagcccgagatcgccgccctgcgggacatcctgcggcgcggggtcgagcgcggggaggtcgacgcggacaacccggcgctggcgtacgtgcccgcgcagatgttcggcgtcctgcgcatccgtcccgtgctggaggggacgtacgcggacgcggactacatggtccggttcgtggaggccgccgtgctgcccgcgctcggcctcaccacaggactcaggccgccgtccacgggatgactggacggtgacctgtgcgcgccgcaccgtggggacgggggcggcgcactcccggccgggccgggttcctctggagcggagaggaacccggcccggccgacattcgcggcggcgcctcacacgttctggccgctgcccccgcccgaggacaccttgatccccgcggtgatgtcgtcgagcacggactgctgctggtcggcgtccacgccgaaccgcaccacgaccagccgtccggggttcgcgggcgacgggaaggccagcgactcgaccagcccgtcggagcccttgctggtgaccgccttccagcggaccaggtagcccttctgcccggccaccgtcaccgccttggaggcgagcacctggtgggaggtgatcgcgccgtaggtcttgccgccgtaggactcctcggcgttggccgcgatgtcggccttggcgacctgttccgcggtgctgccccgggtgcccagcaccagcgccggcgccgagtacgcgccgcccttggtgcaggacttcgaggtgtcgccggggcacttgtagctgtcgtcggaggtgatctgggcgcccacgcccatctgctggccgtaccagcccttcggcacgggcaggctgatgccgttggccgggtcgggcaccgacccgctcctgatcttcggtgcctcggccccgccggagcccccggaatcccccgagccgccggacccctcggacccgccggagtccccggggccgccgaacccgtccgagc

SEQ ID NO: 2030 - DNA, 654 bp, Unknown
  Kingdom: Bacteria, Phylum: Actinobacteria, Class: Actinobacteria, Order: Streptomycetales, Family: Streptomycetaceae, Genus: Streptomyces
tgcggtgcgcgggcgccgggagacagcgggatgtccgcgcaagtggtccgccccgcaagtgcgttcccgccgtcttctcactcgtgcggatgacgcgctccggcgcacccgcaccggccgccgccccgcgcgagcggccgcccggcacggaacacccgtacgtcctggcatccttggcgaagaacgcggtacgcccaggaggcgcgcacgggccgcgtcgcgcccccgataccttctgtacgtttcttcgtgaccgcaccacgccgaaccaggagccccgcccgcgtgagccccctgagcagcaacgcaccgcccggtcagtcgccgctgcgcaccgtgcaggtggtcggcgggggcaacgcgagcagcagtgcgcacgtgcgttcgctggccgcggggctcgtcgcacggggcgtgcgggtcacggtgtgcgcccccgtggaggccgaccacgcctacgacttcaccggcgtcggcgccgaccatgtgcacgtaccgcgcagcaggagcacggcacggaaggaggcgtgcagtccgtgcgcgtgcacgaggtgggcctccgtgccgtgctcgcgctgcgcggacgccgtacgcccctcgtcgtcacctggcacaaccgcgcccatgccgagggcgcggttgtgccaggtgacg

SEQ ID NO: 2031 - DNA, 1938 bp, Unknown
  Kingdom: Bacteria, Phylum: Actinobacteria, Class: Actinobacteria, Order: Streptomycetales, Family: Streptomycetaceae, Genus: Streptomyces
cggcaccacccgccggtgggcgatgacgagccgggccaggacagcgcggtgccgcgggcccttgagcgcgagcggctccccgtcctcgtcccaggcggccacggcccccagcaccccgatctccacacgcaccgccgccgtcccttctgcccgctcgcccccaacctagtgtgaccggatcggttcgccgggccggtggacgcggagtggaccccggcgggcgcgcggacgcggacgacgagtgacaactacctgacggtgaccggattcagtgctgtgacccgccggattcggctgggtctaccgcctgccgtgccgggtggagcccgcacccggaagggcgcgttcatccgttgctgatcggagccccgcaggctggacgcaccggcccggcggcccccgccgcgacggtccaccgaatcaagacggcccaccgttcaaggagcagcacgccatgacacacacgatccccggtttcgagcagcagcgggtccgcgtcgacgagggcgtcgccctccatgtcgccgtcggcggcagcggggcgccgatcgtcctgctgcacggtttcccgcagacccacctgatgtggcggcacgtggccgccgacctggccgccgatcacacggtcatctgccccgacctgcgcggatacggtgccagtgacaagccgctggaggacggccccgacacgtactccaagcggaccatggcccgcgacatcgtcacgctcgcccgcgccctgggccacgagcgcttcgccctggcggggcacgaccggggcgccctggtggcgttccgcgccggactcgaccacccggacgccgtcacacacctggcctgcctggacgtcctgccgaccctggacatgtgggaggcgctgcacgggacgtcggccgcggtcggcttccacctgtacctgatggcccagccgcccggcctgccggaggcgatgatcgaggcgagcgccgatgcgttcttcgcccacttcctcgacctgtgggccgaggaccccgacgccctgccggcccccgtacggcagacgtacctggacgcctgccggggcgcggtgccgtccatcgtggcggactaccgggcgtcggccggcatcgacgtggagcacgacagggcggaccgcgcgaacgggaagcagctcgcgatgccggtctccgtgctgcagcaggactggggcgcggcgctcggctacgaggccgccgccctgtggggcgcctgggccgcggacctggaccactccaccgtctcctgcggccacttcatggccgaggaggcacccgaggacatcgcgaaggcactgcgggcgctgatggaccgctgacgcttcacctcctcgaactctcctataccgccaagctttgcgcgcctgcaaccgggtcacccgaaggtgtggaacggtggccccgggaactgacggcatatgccccactgccgtactgtcacgtccctgcccgcaagttgggcgggaaaccgctggccataatggggagaggacggcgccggggtggttgcggacaacgaggagtggggcgagcgggcggcctgccggaccgcggatccggacgagctgttcgtcgagggggccgctcagaacagagccaagatcctctgcagcggctgtccggtgcgcaccgaatgtctggcgcacgcgctcgacaaccgtatcgagcacggagtctggggcggtatgacggaacgggagcggcgcgccctgctgcggcgccggcccacggtgacgtcctggcggctcctgctggagacggcccgcacggaacacgaacagcagggccgccggaccgacggtccgtaccgggtcgaccgaccgcgccggggcgacggcccgtaccgatccgaccacccgcgctgggcggagcgttgggcggcgacgggctgaccggctggggccgccccgttcgccggccggtc

SEQ ID NO: 2032 - DNA, 883 bp, Unknown
  Kingdom: Bacteria, Phylum: Actinobacteria, Class: Actinobacteria, Order: Streptomycetales, Family: Streptomycetaceae, Genus: Streptomyces
gttcctgggcggccttgaggcaaccgccgatgtcgtcgagacggaggggcagccgcagcacggcggcgcggcgctcacgcgcggccgggtccgtggccagccggcgggcccggtcgacgtggccctgcgtggcgcgggcggcggcagcggcgacgtccggctcgacaccgtcgcggcgtacgagcatgtcggccaccgcgtccaccgacggcgtgcgcaggttcaggtgacggcagcgggaacggatcgtgggcaggacgtcctcgaccgacggggcgcacaggagccacaccgtgcgcggggcgggctcctcgaccgccttcaggacggcgttggcggacttctcgttcagccgctcggcgtcctcgaccaggatcacctgccagcggccgttggcaggagaggtgaacgacttgcggacggtgtcccgcatgtcgtcgacgaggatctgcgcgccgacggcggcgaccgtggagacgtcggcgtgggtgccgaccagtgccgtatggcagccgtcgcagaagccgcagccgggaactccgccgagagcgcggtcggggctgacgcactgcagcgcggcggcgaaggcccgtgccgtctgcgtgatgcccgctcccggggggccggtgaacagccacgcgtgcgtcatcttcgacgcctccggcggcggagtgccggtgacggccgccgtcaccagggcgtcggcgtcccgggcagcggcggccaactgctcgctgaccttctcctgcccgacgaggtcgtcccacacgctcatgggtcacgccgccctttcgtcatggttcgtggtgcgggatccattgtgcgggggaccactgacaacgggtgagcggacgggcgggcgggccggtggtacgggtccagg

SEQ ID NO: 2033 - DNA, 628 bp, Unknown
  Kingdom: Bacteria, Phylum: Actinobacteria, Class: Actinobacteria, Order: Streptomycetales, Family: Streptomycetaceae, Genus: Streptomyces
cccgcacccgctccgtacactgcgggtgtggctgagcacaggacgagtggcgcgacgagcggtgacgaacggccggccctgccggcgacgagctgggcggtcctcggactgctctccttcggtgaggaactctcgggttacgacctgaagaagtgggcggactggtcgctgcgcttcttctactggagcccgtcgttcagccagatctacggcgagctgaaacggctggagaaggccggttacgccacctcccggatggtcgcccaggagaccggcaaccgtgacaagcgcgtctaccggatcaccggcgaggggctggaggcggtccgcacctgggctcgcgaggcaccggtcgaacccccggtgctcaagcacggcgtcatgctgcggctctggctcgggcacctgctggagcccgagcagatgcgcgaggtgctcggccggcaccgcgcctacgccgagtccatgcggcggcgcgccgaggccgacgtcgagggcgccggcgacgaggaggcctgggcctaccccgcgctcaccctgaagtgggccgagcgctactacgccgccgagcgcgacctggccgacgcgatgctggccgacatcgaggaacttcaccgcaggcagccgt

SEQ ID NO: 2034 - DNA, 946 bp, Unknown
  Kingdom: Bacteria, Phylum: Actinobacteria, Class: Actinobacteria, Order: Streptomycetales, Family: Streptomycetaceae, Genus: Streptomyces
gctccggacagcagaccgccacagcccggcggacgacgtggacgcgcggcacaggctggcgggcggcagggcccgaggccgtcagcgcaggcacggctggacggcagcgggcggcggcacgacagtctctgtccccggcggttctaccgacggtagaatcgatggcatgagcaagccgacgagtatcaagaccagcgaggaagtgcgcgatcggctgcgtgtcctcgccgaggagcgcggcaccaccatcacggagctgctggaagagctcgccacccgcgagctcacggagagcgagcgggagcagcgtgctgccgaggcggctcgtgagctcggcatcgagtacaccgagcaggttcagcaggtcggccgggacgcctgggcgaagatccgcgcccatcagggcggcgccgccgcatgaacctgacggccgtcctggaccacacggctctggccgctctgtaccgcgcggactctttcttcactggcctctacatcgaggcctcgcgcggcaccggccgtgtcatcatcccctcactgtccgtgctcgctgccgaacggcaggttgcgggcgccggcaagcacgcagcatccctgcgtttcgcggagaacgttcccttcaccgcggcgcacgcagtggatgcgatggactgggcagacgtggactggccagtggcccacgctgctgcgatcgcctggcacgcggtaaaggcgggggagccgctgacggtcctctcgttggaacctgaactgtacgcgggtaccggcatcactccgctgaaccccacttgacccgcgcctcctcaaccaggcagctagacccgcccccggactccccggactccaccacccagccgcacctgatcaccgcgcggctcgtcaccacggcgaccagcacggccggcaccgacgcggcgcgcacggtcctggtcctgcccccccccgg

SEQ ID NO: 2035 - DNA, 2999 bp, Unknown
  Kingdom: Bacteria, Phylum: Actinobacteria, Class: Actinobacteria, Order: Streptomycetales, Family: Streptomycetaceae, Genus: Streptomyces
gccgtgcccggtaccgcgcccgcacggcatgccccgtccgcagccctcggcgcccccaccgtccccggttccctgaccgccgtacggctgcccgcgcgatgcgcaccaccccgccaggacggtccgtggcagtggccgcgcccggggcggtgaggtgtgctccgaagcgcccggttcggtgtggcgctcacgaggagccctccccggtgcccgtcccgtgcgctgcgcccacagccgccgcgcgccccgggcccggccccgtcaccggcggggtcgccaggtctggcctgcctggcgccgcggcccccgtgcgcgcctggtccgcgcggcgccacgtctcctccagtgaggcaccccgggacacgctcacggccgtccagcccgcgtcgtggagcatccgcagccgctccgtggcaccgtcggccgggccgccgggcccgtcggccgtctcccggccccaggcctcgctgtccagcacgaaggcgaccccgcccccgctgcgctgccgcatcttggcggccatcgtggcctgcgcctcgtcgaggtcgccgaggaaggccaccagcaggccctcgttgccgccgcgcagcacgtcgtacgcgcgcgacaggcccgccccgtccgagtggtcgatcacggcgagggtgtccatcagcagcccggccgcgtccgccgactccgggccggagcccgcgaacccgtcggagccctcgcccggcaccgaactgccggtgtccgtcagcagccttaccgagaagccgcgttgaagcatgtgcatgagcacggaggcggcccccgacaccgcccattcgaaggccgagtcgggacccgcgccccggtaggcgatcgcgcgggtgtccaggagcaccgtgcagcgggcgcgctgcggctgctcctcgcggcgcaccatcagctcgccgtagcgcgcggtggagcgccagtgcacgcggcgcaggtcgtcgccgtgccggtacccgcgcgggatcacgtcgtcctcgccggccagcgcaagcgaacgctgcctgccgtcgccgtaccccttggcctcgccgcccagccgcaccggcggcagcggctgcacgcgcgggacgacggtgagcgtgtcgtacgtcgagaaggagcgggtcagttcgcacatcccgaacgggtcggtcaggcgcagttgcaaaggaccgagcggatagcggccccgcaggtcggagcggacccggtaggacacctcgcggcgaccgcccggctccacccggtcgagcacgaaacggggccggggcccgaggacgtagggcacccggtcctggagcatcagcaggcccgtgggcagccgggagacgttgtccatccgcaggtggacgcgggcctcggcgccggcgggcacgcgcgcgggggagaggcggcggctgccggcgacccggtagcgcgtgcggtagaggacggccgcgcagagcaggggcaacgcggccagcagcagtcctacgcgcagcagttcgtcctgtccgaggatgtacgcgcagacggccgccgcgatcccggcggccaggaaggaccgtccgcgggtggtgagccccgccagcgcggtgcgcatgccgccgcgtccgccgtgctcgtcctccgcgcgcgtgggccccccgtccgtcatcacagcctccgcggctgctgccggccgaactccggcgtggtgtggcccatgccgagaccgccgcccgcctgggccgccgcgggcaccggggtgtgctgcacgatctcctcgacgacctgctcggccgtacgccggttgagctgcgcctgcgcggtgggcagcagacggtgcgcgagcaccgccacggcgagcgcctgcacgtcgtccggcagcgcgtactcccgcccgctgagggcggcggacgccttcgcggcgcgcagcaggtgcagcgtcgcgcgcggcgaggcgccgagtctgaggtcggggtggctgcgggtggcggcgaccaggtcgacggcgtaccgctgcacggccttggccacgtgcacggaacgcacggcctcgacgagcttcacgatgtcgtgcgcgtgcgcgaccggctgcaggtcgtccagcgggctgaccccgccgtgcacgtccagcatccgcaactccgcgtcctggctcgggtagccgatggagacccgggccatgaagcggtcgcgctgggcctcgggcagcgggtaggtgccctccatctcgaccgggttctgcgtggccaccaccatgaaggggctgggcagttcataggtctgcccgtcgatggtgacctggcgctcctccatggactccagcagcgccgactgggtcttcggcgaggcgcggttgatctcgtcgccgatcacgatctgcgcgaagatggcgcccggcttgaactcgaagtcccggcgctgctggtcccagatggacacgccggtgatgtccgacggcagcaggtcgggcgtgaactggatacgccgcaccgagcagtcgatggagcgtgccagcgccttggcgagcatcgtcttgcccacgccggggacgtcctcgatcaggaggtgtccctcggcgagcagcacggtcagtgagagccgtacgacctcgggcttgccctcgatcaccgcctccaccgaaccgcgcacccgctccgcggtggcggtcagatcctcccccacgctcgacctcgctcgcgcgggggcacccccatggctcgctcgatcgtcataggtcgtcacccggccctcctcggcccttccccgcacccgtcaccgggcgggggattacccaaatttccgggccggcgtcccgctgcgcggaccggacccaccccgaacacggacatcacgccggaaggtcccgcgtgatgtcacacccgcattcttgccgccgttaccgattcgtgtcactcgcctgtggacaactggccgcgatattcaggttctacgacttttcgccggggacggcgtggagcccgcccctggtcacctcggcccgccgtgcgccggcctgccgcaggtgggcggcg

SEQ ID NO: 2036 - DNA, 2351 bp, Unknown
  Kingdom: Bacteria, Phylum: Actinobacteria, Class: Actinobacteria, Order: Streptomycetales, Family: Streptomycetaceae, Genus: Streptomyces
acctggtcctggcgcggctcgcctcgccggccaccggcatcacgcccgtgccgctcgccacgacgccgccggccgccggtgacgaggtcacggtggccggtttcggccggaccaaggacgagtgggcgccgctcaagctgcacaccggcaccttcagcgtcgactccgtgaacagcggcacgctcgccctgcacggcaagtccgcggcggacgccgtctgcgccggtgacgcgggcggtccggtggtgcgccagaaggacgggaagacggaactggtggccgtcagcagccagtcctggcagggcggctgcttcggcaccgacccggccgagacccgcaacggcgccgtctccacccgcctggacgacgtggcgcgcggcaacgtcctcgcctccggcggcgtcctgctgcccggggacaccctcacgtcgaactccgcccgcctgaccatgcaggacgacggcaacctggtcgtcgtctccgactcgggccagacccggtggtcgacgaagaccggcggccacccgggcgcccgggcgcggctggacgcgaacggcaacctggccgtggtcgccggcgacggcaccaccgtcctgtggcagaccggcaccagcgccgccggcggctcgctcgtcctccaggaccgcggcaacctcgtcctgcgcaacgccaaggaggaggcgcagtgggccgcgggcacgacggtccgtcacgactacaacggcgacggccgcagcgacatggccgactggtacgacttcgcggacggcagcgaccagatccacgtcttcccggccaccgcgagcggcggcttcggaaatccggtccacggctggcagactccggccggcaactactacgccgagaacatgaagcgcttcaccggcgacttcaacggcgacggcatcgcggacgtggccaccttctacggctactccacgggcgaggtcgccctgatcacctggctcggcaagggcgacggcaccttcgggggcccgcagcgctcctggagcgccgccaccggctggacgttctcccacatgaccgtcaacgcgggcgacttcaacggcgacggccgtgacgacgtcgccgtctggtacgactacgccgacggcagcgacaagatccacaccttcctctcccggtccgacggcggcttcaacagcccgttcgtctccttccagcgcaccagcggctgggaactcgcccacatgaagttcaccaccggtgactacaacggcgacggccgcgacgacctcgccgcgctctacggctacgccaccggcgaggtcaagctcttcaccttcccagccaagcccgacggcggcctcggcgagcccgtggcgggctggaactcgcccaccggctgggagttcgcccgcgcgaccctcgtctcgggcgacttcgacggcgacggccgtgacaacgtcgccgcctggtacgactacgccgacggcagcgacaagctgatcggcttcacccccagcggcgcggacggcgtgttcggcaaccgcaccgagctgtggtccacgccggcgggcaactactaccgcgacaacatgcagctcgtgaccggtgactacaacggtgacggccgcgacgacctcgccaccttctacggctactccgacggcagcgtcaagaccgtcacctggaccgccaaggccgacggcaccctcaacgccccggccggcagctggtcagcggcgaagggcaactggaccttcagccgcgtccacatgatcgagcgctacaacagcccttcctagcacgtcagcacagcaactaaccaggaaaccagggcctcttgacggcccgcggacctcgattcgagtccggcgggccgcaggaggccctggtgccgtatcgcccgcccgccgtccgcggcggtcgtcagttcgcggacccgcgatccggccgggaaacgagggcgtgcacgacgccggccaccaccgcgatgccgacgccggtcagacacagggcgcgggcggtgctgccgtggtcgaccaggatgccgccgagggcggcgccgagggcctgaccgaggtagatgccggaggagttgaaggagatgacgacgctgggcagcgtcggcaccagctcggtcagccggtggttgttcggggtggccacggcccagccggcggcgccgttgagcgccatgacgacgatgacgggcacgagcgaggtgcagaccgtcagcagcgcgagcgtcccgatgagcagggcgacggcgcaggtcagggtacgcgccgcacccaggcggtcggtgagcaggccgctgccgaaggagccgaggatgccgccgaggccccaggcgagcagcgcggcggcgagtgcgctgccgtgga

SEQ ID NO: 2037 - DNA, 705 bp, Unknown
  Kingdom: Bacteria, Phylum: Actinobacteria, Class: Actinobacteria, Order: Streptomycetales, Family: Streptomycetaceae, Genus: Streptomyces
cggccaccacctcgcgggcgagggccagcaggtcctcggtggtggcgccgccgcggttggtgagggcgagcgtgtgcttgccggagatacgggccgggcccgtgccgtagcccttggtgaagccggccttgtcgatcagccaggccgcggaggtcttggtgcgcccctcccccgccgggtacgcgggcggctcggcgccctcgcccagccgctcccgtacgcgcgcgcggaacgcgccgaactcggcgtccgtgaggatcgggttggtgaagaaggacccggccgaccaggtgtcgtggtcctcggggtccagcaccatgcccttcccggcgcgcagcttcagcaccgtgtcgcgggcggtggcgagcggcacgcggtcaccggcggacacgccgagggcgcgggccgtctcggcgtatctgaggggcgccgacaggccgcccgcgtcctccaggccgaagcggacgcgcaggacgacgtaccggtcggggtgctccttgaagcggctgtgccggtaggagaaggcgcagtcctcgttggccagggtcaccgtctcaccggcggcgcggtcgtaggcgacgacctcggtgagggtggcggagacctcctggccgtacgccccgacgttctggatgggggtggcgccggcggagcccgggatgccggagaggcactcgacgcccgcgagcccggctgatcaccgcg

SEQ ID NO: 2038 - DNA, 673 bp, Unknown
  Kingdom: Bacteria, Phylum: Actinobacteria, Class: Actinobacteria, Order: Streptomycetales, Family: Streptomycetaceae, Genus: Streptomyces
ccggggaactgcaggtcgtcgacggcaccgcggacgtacagcccggagccgccgaccaggatcggccagcgtcccccggcgagcagggcgtcgatgtgttcgcgcgcgagccgctggtactcggcgacggaggccgtgacggtcacgtcccagacgtccaggaggtggtgcggcacgccgccgcgctcctcgggcgtcagcttggcggtgccgatgtccatcccgcggtagagctgcatggagtcggcgttgacgatctcgccgcccaggcgttgggccaggaacacgccgagatcggactttccggccgcggtgggaccgacgacggcgatgacgcggggggcggggggtgcgctgctcaccgcaccagtctcgcaaacctccggcgggcgcctcgaacgagttacgtgacgggacgcgagcaaggtcgttgcccgttgcgaggttcccgcgcccggatgccggcgggccgtggtccgagcatcgcggacggacgcaccgggctacgcgggattccgcccgcacgagtaacgtatggagttgacatgggcgtttttgcacgacttttccggaggtcgaaggccacagaggaggcgtcggccgccgaggagcctgtcggcgcggcagcgatcggcccggccgcggccgtccccgaggcggccggcggctcctc

SEQ ID NO: 2039 - DNA, 2762 bp, Unknown
  Kingdom: Bacteria, Phylum: Actinobacteria, Class: Actinobacteria, Order: Streptomycetales, Family: Streptomycetaceae, Genus: Streptomyces
gcccggctggccggcatcgacttcaacgcgtgcccgggcgcgcgggacaagccggggtccatggagtgcggcaccgtgtccgtgccgctcgactacgcccggccggacggcatctcgatccggctcaccgtcagccgggcgcgggccaccggcaaggatccgcgtcccggtgccggcggacgcgcggtgccgcgtcagggcgccctcgtcttcaacccgggcggaccgggcggcgacggtatgtcgttcccgctggtcgcactgctgcccgagtggaagcgggtcgcggctgcctacgacctcgtcggctacgccccgcgcggcgtcggccgctcggcgccgctgtcctgtgtggatcccgggaccttcttcaaggcgccgagcccggcgccggaacacccctcgacggcgtacaagaagaagcgcgtcgcctcggcacgggcctacgcccggggctgcgcccggcgctcgggctccggcctgcgcttctacacctcgctcaacaacgcccgtgacctggaggtgctgcgcgcggcgctcggcgagcggcggctgacgttcatgggcgcctcctacggcacctacttcggcgcgctgtacgcgacgctgttccccgcgcacgtacgccggatggtgttcgactcggccgtgaaccccgacccgtccctggtgtggtaccgcgacaacctcgaccagtcggccgcgttcgagacccgctgggcggacttcagggcgtgggtggcccggcacgacgacgtgtaccggctcggacgtacggcggacgcggtgcgggccgcctacgagaaggcgcgcacgcgcctggccgcgcgaccggcgggcggcacggtgggccccgggcagttgcagggggcgttcctgaacgccgggtacgacgacggcttctggccggccgccgccggcgccctggccgcctacctgaagggcgacgagaagccgctggtcgcgctggccgcgccgtaccgggcgggcgccgccgaggcggagaacagtgccgcggtgtacacggccgtggagtgcaacgactcgccctggccgaccgacttccgggtgtgggaccgcgacaacacgcggctcgcccgcacggcgccgttcgagacgtggggcaatgtgtgggcgaacctgccgtgcgcctactggccggtgccccggcagcgccccctggacgtgcggaccacgccgggcctgctgccgcccacgctggtcgtggccgccgaacgggacgcggccacgccgtacggcggcgccctggaactgcaccggcggctggccggttccacgctggtgaccgagcgcggcgcgggcacgcacggtgtcgcgtacggtccgaaccggtgcgtcaacgcgtacgtggacgcctatctgctccaggggcggctcccggggcgctcggcgcagtgcgccgcgcgcccggagccgcgcccggaacgacggccgtgagcgctcaggcgagcccggcgaccaggtccgccacgtccttgcggcggccggtgaagaacggcacctcctcgcggacgtgccggcgggcctccgagccgcgcaggtggcgcatcaggtcgacgatgcggtgcagttcgtcggcctcgaaggcgaggatccactcgtagtcgccgagcgagaaggaggcgaccgtgttcgcccgcacgtccgggtagccgcgggccatcttgccgtggtcggcgagcatgcggcggcggtcctcgtcggccagcaggtaccactcgtaggagcgcacgaacgggtagacgctgacgtagttgcgcggcgtctcgtcggcgaggaacgccgggatgtgcgagcggttgaactcggcggggcggtgcagcgccatgttcgaccacacgggctccagcgcgcggccgagcttcgtgcggcggaagaggttgtacgcctcctggagctggtcgctggtctcggcgtgccaccagatcatgatgtcggcatccgcgcgcagacccgagacgtcgtacgtgccgcggatggtcacgtccttcgcggcgagctggtcgaacagttcctggacctcgtcggcgtagcccgcacggtcctcggggagcacgtccttcagcttgaagacggaccacagcgtgtaacggatgacctcgttgaggtccttggccagcttgcccttgttcgggatcctgccggagtcggtggtggaggcgtcgtcactcatgggcctattctcccgctccgccgtgcagactctgcaccgggtgggcggtgagttcctgcacagcgcggaggtcgcccgccagctggtccacggcggcgtacgcgctcgcgatgcaggccgggatgcccacgccgtcgtagaccgcgccgcacaccgcgaggcccgggagctcggccacgtggtcgcggacgcgggccacgcgcgcgtggtggccgacggggtactggggcaggccgtcggtccagcgggtgacgcgggtctgcagcggcacggcgtccagtccggtggcctcgcgcaggtcgcgccgggagaggtccaccagctcggcgtcctcgcggcccaggatctccgtctcgccgtagcgcccgacggaggtgcgcagcaccagcacgtccgggtcctcgtcggcgatccagccccacttgcgggaggcgaaggtggccgccttgatcgtgcgcccgtcgaccggcggtacgaggaatccgctgccctcgggcagcgcggcgtcggcgcggcggtaggcgagggtgatcagggccatggacgcgtactcgacgcagcgcagctc

SEQ ID NO: 2040 - DNA, 556 bp, Unknown
  Kingdom: Bacteria, Phylum: Actinobacteria, Class: Actinobacteria, Order: Streptomycetales, Family: Streptomycetaceae, Genus: Streptomyces
ccgccgggcggtgtacggcttcctgggcggcttcggcggcctgatctgcctgctgcgcggccagtacgtcgtcgccctgctcctcttcgcgttcggcgcgttctggaccgaggtgggcatctggtcggcgatccgcatccgccgggacgtgatcgaacggacgctgcccgacttcctcgacgtcctcgccgtcgtcgtcagcgccgggctcggtttccgccaggcactggagcgggtcgcctcccgctacgagggcccgtgggcggacgaactgcgcatcaccctgcgccagatggacctcggcatgagccgccgcgaggccttcgcggaactgcgccgcaggaacgactccgaacaggtcgcgatgttcgtcacggccctccagcagggcgaggaactgggcgcgccgatcgtcgacacgctcgtgtccctcgccaaggacatgcgccgcaccgacgcgcagaacgcccgccgcaaggccgcccgagcggtccccaaggccaccatgatgatcaccacgttcatggtcccggccacgctcatcctcctcgccgcg

SEQ ID NO: 2041 - DNA, 1007 bp, Unknown
  Kingdom: Bacteria, Phylum: Actinobacteria, Class: Actinobacteria, Order: Streptomycetales, Family: Streptomycetaceae, Genus: Streptomyces
cgcggagccgcccgcgcgggcggctccgcgggctttcaggcctggaccgccgccgggtccatccacatgacctcccaggtgtggccgtcgaggtcgtcgaaggagcggccgtacatgtggccgtagtcctgtgtgtcaccggtcgccgtgccgcccgcggcgatcgccttgtcgaccagctcgtcgaccttctcgcggctctcggcgctcaggcagagcagcacctcgctggtgcgggtggggtccgcgatctccttcttggtgaagtccgcgtagcgcttcttgccgaggagcatggcgatgatcgtgtcgctgatgacgacgcaggcgcagtcgtcggtggagaactgcgggttgatggtgtagcccagctcggtgaagaacttcctggacgcggccacgtcctcggtcgccaggttcacgaagatcatctgctggtagctgttcgacatggtgggtctctccctctgcggcggtgccgccgtccgtgctgttcggtggggtagaccggggcccggcgcggaactcatcggtgccggggatcttttttcgtacgggttttcgtgcgggtgtttcagcgggccagtggcagggccgcgaggccggcgatgaccagggtcagcgggacgaacagggccagcagggcgccggcgcgcagggccgcggcggaacgcagcgtggtggcgggggcgccgagcctgcgcagggcggcgatggtcgcggaccgggactggcgggcctccacggcggcggtgagcagcgccgccacggcgcagccggccacgaggaggccgccgagagcggtgagcgggccgagggccggcgacgagccgccggacagcgcgacgccggcgtaggtgccggaggccaccgcgcagacgacgcccagcggacggccgatccggcccgcctcctccatcagcacgcggcccgccagcagccgtacggcgccggggcgcacggcctggaggaggcggccgcacaggtgggtgaggccggggccggcc

SEQ ID NO: 2042 - DNA, 832 bp, Unknown
  Kingdom: Bacteria, Phylum: Actinobacteria, Class: Actinobacteria, Order: Streptomycetales, Family: Streptomycetaceae, Genus: Streptomyces
gacaccccgagcagcccgccgccgacgacgaccgcccgcactccgggccgcaccgacgccgacaggcccaggcagtcgtccatcgtgcggaacgcgtggacgcccgcgggaagcccgcgcccggcgccgaacaggccacgcagcggcggcagtaccgggcgggagcccgtggccagcaccagcgtgccgtagccgatgaccgagccgtccgcgcagcgcacctcgcgggccgcgcggtcgatgccgacgacgcgggcgcggaccagcgcgggcggcgcgggcagcgtgatcacctcgggggcgtaccggccggccagcacctccgcgagcagcacccggttgtacggccggtgcccctcctcgccgacgaccagcgcgggtatgcccagttcaccgagccgccgggcgagggccacgcccgcgagcccggcgccgatcaccaccacacgcgcgtccgaggtcatgcccctgagcgtgcggcgcggacgttacccggcggcatcaccaccgtttcccgcgcggaacgctgcgctcagcggacgcgggccgggactgtgaggccggcgggagaccgtgacaccggcaggggacggggaggccggccgcggtgctcccgtacgtacctcagaagtccctcatatgcgtggacctggcacataccgcgtccctagagtcatgatcatgcctgacatatccctgaccgtggtcgtcctcctgtgtgtcgccgccttcgcggcggggtggatcgacgccgtggtcggcgggggcgggctcctgctgctgccggtgctgctgctcgggctgccggccgggacctcggcggcgtccgcgc

SEQ ID NO: 2043 - DNA, 840 bp, Unknown
  Kingdom: Bacteria, Phylum: Actinobacteria, Class: Actinobacteria, Order: Streptomycetales, Family: Streptomycetaceae, Genus: Streptomyces
  misc_feature (512)..(615): n is a, c, g, or t
gttcttgtcgagcagccggtcggtgcggcgctcggcgatggagccgaggtcggcggcggcgatggcgaggaagtccaggacgtaggcgaccggggcgccgtggaagttgccgttggactccacccgccctcccccggtgccgaccccaggcagcacgacggggttgtcgacggcggaggccagttcccgctcggcgacgaggcgggcgtgcgcgagggtgtcccggccggcgccggcgacctgcggggcgcagcgcaccgagtacgcgtcctgcacgcggggcgcgtcgtcctggtggtgcccggtgagctgggagcccttgagcacggcgagcatgttggcggcggaggcgccctggcccgggtgcgggcggatggcgtgcagctcgggcgcgaggaccttgtcggtgccgagcagcgcctccagcgacagggcggcggtgatgtcggcggacttgtagagggtgtcgaggtcggcgagggccatgaccagcatgccgagcatgccgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcagccgagggagccgtactcgtgcacgaggggggtgatgcccgcgttgaggacgtcggccatggtctgcgcgacctccgggcggaccccggtgtgtcccgagcagacggtcttcaggcgcaggaacatcagggcgcgtacgacctcgcgctcgacccgcgggcccatgccggcggcgtgcgagcggacgatgttgcgctgcagctgggcgcgcagctccggg

SEQ ID NO: 2044 - DNA, 639 bp, Unknown
  Kingdom: Bacteria, Phylum: Actinobacteria, Class: Actinobacteria, Order: Streptomycetales, Family: Streptomycetaceae, Genus: Streptomyces
cagggcgtcgcgaggccgacggcgctcacccgcacgggctcgccggtggccaggcacctccgctgcggcgacggcaccgggtaccgggtgggctcgccgaccccgacgacccggtccggctcgtcctgctggatcgacagatgggcagaccggcgcagcgtggccgtaccgcgctccgcccacgcggccggcatctgccgcgccgggacgacgtcgaggaggtccacggcgacgaagtcggcgatctgcgggacgacgacctccgccagctcccgtacggtccggtcgaggtccagcgtggtcccgatgtgctcaccggcggcgttgagcagggcgagccgctggcgtgaggggtcctggccggtgaggtcgagcgtggtgtagcagatgccgagggtgcggccggaggcgtccttcagcgggaagaaggcacgcagcctggagcagcccggttgcggtggccccggcgcgccgggccggggcggtagggggtccagggtgatccggaagcgaccggagagcagggtctgccgcgcctgccggctcaccaccggcgagaccctggcggcacgggcgccccgggggacggggtccgggtccgagcgggcggagtccgctgcggctgcgcttgccgcggcc

SEQ ID NO: 2045 - DNA, 938 bp, Unknown
  Kingdom: Bacteria, Phylum: Actinobacteria, Class: Actinobacteria, Order: Streptomycetales, Family: Streptomycetaceae, Genus: Streptomyces
cgccgaggccttcgacgacctgtgccacgagcggcgcgaccagggcgagcagtggaccgccgccaccgccgcgcttgcccgggaggcgatcgaggcgctgctgcgggcgggccgggcggccggcgcgcgcgccgtgtgggaccggctgggtcccgcgacccgggagcacggccggttccggttgctggaggcggagctgctgctcgcggaaggccatcgcgaccgggccggggccgtcttcgaggacggcttcgaggtcgccgacctcagggagggcgacgagcggatcggccgggtgtgggaacgggcggtgggcgggccgctgccggagcggtacgacttccggatgcggcccgaatcgccctgaggaccggcttgcggctgaggctcgcgtgcggaccggttcgcggttgcggctcgcgagcggaccggttcgcggctgcagctcgcgagcgggtcaggcgcggcggtccacgtactcgtagaccgccccgtccggatgcacggcgatcagattgcggcccgccggagtcccgaccgggcccgcgatgacgcgggcgcccagctcggtcagcacccggtgggcctcgtcgacgtccgcgacggcgatcgtcgccgccaccttgcgcagcacctccaactcggctgcgggcccgctcatcagcaggaagcatccgacggcggccaccttcaccccgccgcgctcgaaccggagggctctggcacccgccagacgttcgtagaaggggagcgcggactccaggtcgtcgacgcagacgcgcagggtggttcccagaatctccatgcggagaagcctagttgggggcggtgtccaaggagatcgcttgcggcgatcagcggtggcaggtggtagtggtacgtggtcgcgcacagttaccggcgcagttatacgtacacccgtgcgggtacccgcacgg

SEQ ID NO: 2046 - DNA, 2010 bp, Unknown
  Kingdom: Bacteria, Phylum: Actinobacteria, Class: Actinobacteria, Order: Streptomycetales, Family: Streptomycetaceae, Genus: Streptomyces
gccgccgcgagcgcggcggcgatgccgtggaaggagcgccgctcggcgtgggcgcgggccgtcgtgccctcggcgtccggcagcagcgggtcggcgcccgccgcgagcagcacctccaccacctcctggtgggtgcgcccgccgtcaccgaggatcaccgcctccagcagggccgtccagccgagccggttgacgtggttcacgtcgatggcggtctcggccaggaccgcccgtacgtacgccacgtggccgcgttcgctggccgggatcaccgacactccgccgaaccggttcgtcaggctcacgtccgggccgcccggcagcagcgcgcgcatcatcgccacgctgccggtcacgccggtggccagccaggcactgtcctggcgttggtcctgcgcgttcacgtccgcgccggccgcgaccagcacctcggccgcggccacctggtcggcgagggccgcccgcagcagcggcgtacggccctcctcgtcgcgtgcctccaggcccgcgccggctgccagagccgcgcggacggtgcggacgtcgccgttccgtgcggcgtccagcagggcgcggtcggcaggggaaagtgacttcttggccacgacggaactcctccacgggatggcggcgacaacggacggaagcggaaggacgaaagcggaaggacgaaagcggtaggacgaaggcggaaggacagtgtggcggcgcgcggggcgggggaccccacgcgccgccaccgatcggcccctggacggggccgccgctcatccgggcgggacgagagaccggatcagagtgaccgggtcgaagcgagcggaccgaggcgacgggatcagattgaccgggtcgaagcgaccggatcagatagtccggatcagagtgacggggtcagcggccgttgctgatcgccgcggcgccggcctgggcgaacttctcgtccaggtcgccggagggcgcgcccgccacaccgatgcccgcgatcggggcgttgtcgtacgcgaccggggcgccgcccgccaggaacagcgtgcccgggatgtccttgagtgtgggcgccgactccaggcgcttgaccagctgggaggtgggcgcgttccaggagacggcggtgtacgccttcttgatcgcggagtcgtacgcctgcgggccggcgccgtcgccgcgcagggtgacgatcgtgttgccgttgcggtccaccaccgcgacgctcacccgctggccctccttctgcgcggccttgagcgccgcctcggcggcgtcggtggcggcgtcgaccgtcaggtgggtgctggtggtcgtggccttcgccttcaccgcggcggtggccgcgaccggagtggcggccggggtgtcggcggacgcggagaccgcgccggccacaccggcaccgaccgcggccacggccgccacggaggtgacgaccttggcgcgggtggagaacttcttggccttgtgctgcattacgggcaactccccagtcgtgtcgcgtcccgcccgctgccgcggggccggccggcgtcgcggcctttccgtccggtgcgggggactcagcgcttcctgcgctgtgcctccagcctcagcccgcccaccccgcccacccgtcggcgtaccggctggtcccggcgagcgggacggcgtacggcagggtcatccgaacggttgaccccggcgggcgccgccggggcgacaatgtcagtgctcgcccaactcggcagccatgtccgtacgtcccgaagtcccggccggggaggagcagcccatgccgtccatgccgcccatgccgttcaggagccgaagctccccggccggcccgaaggccgtcgacggcgaggcgcgcaggctcgcgctcgtcatccatctggcgttcttcctgctgctgctctccgccctggtccgctacgtgcagcggcacggcgcccagccgcaggtgcccgccgtcctcgccctggccggcgtgctggccctgctctacgtcgtcggccggcggacggcgacaggcgcggccac

SEQ ID NO: 2047 - DNA, 1113 bp, Unknown
  Kingdom: Bacteria, Phylum: Actinobacteria, Class: Actinobacteria, Order: Streptomycetales, Family: Streptomycetaceae, Genus: Streptomyces
gccaaggcggctgctgcggcggaggctgctgcggctgagacggacggtcagcgcggcgtgctggccggtgaacggatcgtgaaggagttcctcgcggcggtgcggatcccgccgcgctgaccgtccgtctcagccgcagcagcctccgccgcagcagccgccttggccgcccgcgccctgggcgcgcggcgcgctcgccgagccgcccacggcgaccgtggacagcagcttgacggtgtcgtcgtgcccggcggggcaggtcgccgggtcggcggactgcgccatgggacggttcagttcgaaggtgtcgccgcagctgcggcagcggtactcgtagcgaggcatgggtccaggttagggcctgtccggcggatcatgctgcaggtcagcagcggtgcggatcaacccaggtgagcggggtctggcgcgtccacatgcaaggggcgccgacgggcgtgaccggagacacaaccttggtggttcttgtgtgttcgcttctgtcccgttctcctgcggaggaattgaaaagacggctgataattttgtctcgccgtgagagccgcgcagcggctgggggtgaggggacaggcggccgcggttgcggcggctgtgtcgacccgcgcgagcaacacgaggtgcggagggagacgcagtcgtgaccgagtcagggcagggggagggccttccggaggaaggccgcccaccccgggtgcgccgcgccgagccgggcagcgccccggacgcgccggacaccgcgggcgacgaacccgggacgcgcggacgcgcggacgagaccgtccagttgaacgtcgacgccctgcgccgcaaggcacgcacaccggggcaggccccggacgccgccccgcagcgcccggacgagacgatgcggctgaaggtcgacgccctgcgggggcgcctgcccggccgctcgcggcggccggaggaccgcgccgagcgcgaaccggacgagcccggcacacagggaccggacaagccgcagccactaccgcagtcgctcccgcagccgcacgagaccatgcaactgcgcgtattccggcagaagtcggacccgacccgcgtatccgacccgacccgcgtatccgacccgacccg

SEQ ID NO: 2048 - DNA, 4401 bp, Unknown
  Kingdom: Bacteria, Phylum: Actinobacteria, Class: Actinobacteria, Order: Streptomycetales, Family: Streptomycetaceae, Genus: Streptomyces
ggcctcttcgttccagcgccgcccgcccccgttcgtcaccctgtgctcctctcacattcccagcaggccggccaccgtcccggcggacgcgaacagggtcagcaccgactgggcgtcggtgagcagttcgcgcagccgctgccgtccgctctccccggcggtgccggtgcgggtgatctcgtcctcggtgtcggccagcgtcgcggccaggacccgggtctggtcggtgtcgcggacccggcgcagatcggcgcgcaactcccgtaccgcggcgagcagttgctcggcggccgggtcgcgcggggccgcgtggtggtggctctcggcgtgcgcgtggctgccgatggcgaaggtgctgtgcgagacgtcgccgatgctgacgcccggctcatccgcggtggtcatcgctgcccgttcccttctgtagtgcgggaccgccggtctgcggtgcaggaccgccggtctgcggtgcgggaccgccggtcgtggaggaggcggaggagttgtcgccgacggcgaaggtgctgccctcgacgctgccgatgtgcacgcctccgttgctgatgttgttgatctgctggacgaactcgccggtctggtagccggcttcggcgagggcggcccgtacgccgttcgcgacccggtcctggatgctcttgaggtaacgggagacgtccatctcctggaactgcgaaccggcctcgaccgagcccagttcccgcacggaaagcgcgggcccgtccggcagcgcgcccgcgtacccgccggtcagctgccgccagccgtagaccacggccctgccgaggacgaccagggagccggccagcgagcccggtacccgggtcacggcccaggccgccttgccgagcacgttgttgtgccggaaccggtgggccgtacggtcggcctccttgaagtcctggcgcaccggcagcagcacgtgcggggcgacctccagcatgagcatgccgccctgggtgtggatgcgtacgaagaccgtgacgaccagctcctcctcccagccgccgacgcggatgcgcaggaagtggcggcgcttctcgccgccctcctcgaccgcgcgcgcccggtgctcctcgtaggcctccggctggtacggggcgtcctcgcggcgcagcagcccctcggcgggcaggaacacgcactcgtcgatctccaggtggcgcagccggtcgcgcacccccgcccccgcgtactcggcgggcagccgaagccgctcgaccagcggccggatcttctccagcaccagccggttgctgatcggctgctgcttcttcagcgcgtcgggcttcagctccacggcgagcacccagtcgcggtacgccgcaccggccccgcagaacggacgcgcctcgtggtacatgatcagcggtgcgtgctgctcggtccggatgcggtgcttgagccactggaagcgccggctgtcgccgcgctcggcggggtcgttcgccgcgtccgggaagcgctgcggtgacagctcggccgtcagggcccgcgcgaactggccgcgctgcccggccagacacagtgcgatgagcgccaggatcaccagcgtggcccaggcctgccagggcttgaacacccgcgcgagccccgcggcgccggcggtgaggatgtcgatccagctgaacgagggcccctcgccgtacagtccgcccgacccgtacggatcatacgaaccgtaggggtccctccgggagccgaacgggctgtcgtcgtccccggcgccgaacgccgccatcacggtgaacaccaggaacagcgtgaaggtgatacggccccaccagcggaagaagaaggcgggcaccacgcggtacatcggcgcgaccggggcccggcccctgatccagcggccgatcgcgaggtacaggctggtcccgaggaagagggccagcaggccctgggtcagtgccactcccaccagccacaggccgaggaccgcaccggcccactggagctcctgccgccgggcgcgcagcgcgtgcgcgaggacccgggcggcgtcgagaccgagcgagggcgccacgaaccgccgtacgttgaggtgcagttcgtcgatcacccggtgccggtatccggggtccaggtatgtgcccgcgcacagcagccgggtggcctcgctggcgtgcggcggggtgggcggcgggccggacgccgccgcgggcacccactgcggttgcggtggttgctgcggctgttgtggctgctgcggcacataagcggtgctcacgcgagtcccccgaggcgtgcaaagtcactgctctgcaatgagctgacaaagcatcagcatagagtgacgggcggtacggggggaagcgagatacggcggcctcacccgcccgggcatgacggacgcccggcattcctgcgcggaacgccgggcgtcgtcgaaggtgcggaactcagatgaggccgagagcgcggaccgcctcgcgctcctcggccagctccttgacggaggcgtcgatacgggcgcgggagaagtcgttgatctccaggccctggacgatctcgtacttgccgtccttggtggtgaccgggaaggaggagatcaggccctccgggacgccgtaggagccgtccgacgggatgcccatggagacccagtcgccctcggcggtgccgttgacccaggtgtgcacgtggtcgatggcggcgttggcggcggaggcggccgacgaggcgccgcgggcctcgatgatggcggcgccgcgcttggcgacggtcgggatgaagtcctcggccagccacttctcgtcgttcacgacctcggcggcgttcttgccggcgaccgtggcgtggaagatgtccgggtactgggtggcggagtggttgccccagatggtcaggcgcttgatgtcggcgaccgtcgagcccgtcttcttcgcgagctgggtcagcgcgcggttgtggtccaggcgggtcatggcggtgaagcgctcggccggtacgtccggggcggcggcctgggcgatcagcgcgttggtgttcgccgggttgccgacgaccaggaccttgacgtcgtccgcggcgtggtcgttgatggccttgccctgcggcttgaagatgccgccgttggcctccaggaggtcaccgcgctccatgcccttggtgcgcgggcgggcgccgacgagcagagcgacgttggtgccgtcgaaggcgacgttcgggtcgtcgctgatgtcgatgccctgcaggagcgggaacgcgcagtcgtccagctccatggccgtgccctcggcggccttcagggccggcgtgatctccaggaggcgcagcttgaccggcacgtccgcgccgagcagctggccggaggcgatgcggaagagcagggcgtaaccgatctggccggccgcgccggtgacggtgacgttcacgggagtgcgggtcatggcgttctccgtatgacagctggcggtcggggcgtccctgccccgcggtgcaggatccccgcgtccggttgggggccgtacgcccaccacgatgatcgatcacacgtgcggatgatcgatctcttggcgtcaagagagatccagcggtcaggctatcgcgcatccggcatcccgcacggccgggtccctgtggcccgtcccacagagtgacccggggaccggcggatgacggacggtcgccgggccgacggcgggcaggcgaggggctcgtgacggtacgggaggcggccgcccgtccgggagaggagagacgaaggcggccgccggatgggggtaccggagcaccggactcccgtgggggtgacgtccacgtgccccgaacggcgcacctcatgcacgccccgccccatttctttccgaagccccgcttcccgcacccgggcaccgaggaaggcgggttgcgccggcgcctacctcgtgcagccctgctgtcccgacgcgagcgtcacgcacgccgtcgcctgggccgcgtccgtcacggccagcatcggtgtgtacgcgatggtgtcgcccgcggtcgcgagcgtgtcggtctgcgtccgcgcgccgaccgtgaccttgacctcgtcgccctgcgccgcctgcgtgatacggccccaggcggcaccgcaggtcttgctgaagcggacctcgacgacggtcgtgcccacggtgacgctccggtccgtggtcccccgctcgccgctgcatcccatggcctcggcgtccttgccggtgcagccgtccccggcgcacttcacgccgggcggcaggctggggccggtgctggcggagggcgagggtgacctggtcgccccccgcgccttcgtcccgccggtaccgccggtgaagtagaagacggccccgatcaccaccagcgtcgcgaccacgcccgccaggaacatcgtcagctgccgccggaacatcccgccgggagcgggagcgggagcgg

SEQ ID NO: 2049 - DNA, 510 bp, Unknown
  Kingdom: Bacteria, Phylum: Actinobacteria, Class: Actinobacteria, Order: Streptomycetales, Family: Streptomycetaceae, Genus: Streptomyces
gccgccgtcgagcacgagcgaggtgccggtgacgaaggccgcgtgcgggccgcagaggtacgccacggcctcggcgacctcgtccggttcgatcaggcgtttgacggcgctgtcctgcaggagcacctcggacaggacgcggtcctcggggacgccgtgggcctcggcctggtcggcgagttgcttctcgacgaggggggtgcggacgtaggcggggttgacgcagttggaggtgacgccgtgcggggcgccttcgagggccgttgtcttggacaggccctccaggccgtgcttggccgccacgtacgccgacttgtaggcggaggcccgcagtccgtggaccgaggagatgttgacgatccggccccatccctgtgcgtacatgtgcggcagggcgccgcggatgagccggaagggcgcttcgagcatcacggtcagtacggtgtggaagacctcgggcgggaactcctcgatggggcgtaccagctggataccggcgttgttgacgag

SEQ ID NO: 2050 - DNA, 1952 bp, Unknown
  Kingdom: Bacteria, Phylum: Actinobacteria, Class: Actinobacteria, Order: Streptomycetales, Family: Streptomycetaceae, Genus: Streptomyces
cgtcggagcagccgccccggccgagccgcaccgctcccgccacgcacccggcgccgcccgttccggcgggccccgtggcccaggtcgtcgcgctggtcaacaaggagcgtgcgaacgccggttgcggtcccctcgccgaggacccgcagctcgacgccgccgcccagggccactccgacgacatggccgcccgcggcttcttcgaccacaccaaccccgacggcaaggaccccggccggcgcatcaccgccgccggataccgctggtccacctacggcgagaacatcgcccggggccagcagaccccggagtcggtgatggactcctggatgcacagccccggccaccgcgccaacatcctcaactgctcgttcaaggacatcggcgtgggcgtccacaagggctccggcggaccgtggtggacacaggacttcggggcgaagatgtaggccttcaggcgccggaccggcacccgaactcggcccacacgatcttgccgggcgcccgctcctccacgccccacttgtcggcgagcgccgcgaccagcagcagccccctgccgtgctccgactccgccgacgcctccggctcccggacccggccgcccccgctgtcgtgcacctcgacccgcaggacgcggccctcgtgcagcgtgaggaacacggcgaacccgcgtccgggcggtacgccgtgcagcagcgcattggtcgccagctcgctcacacagagcagtacgtcgtcgccgcgtgcggtcagcgcccagtcggccagcgcggcacttgcgaactcgcgtgcgatccgcaccgacctgcgatccttgcggaagaacgcggcgcgggtcagggggtgttggacttctacgttcatgagagcgagtgtcactgtgcgtcactacagtggaccaatgagtgaagtcgtagctctcatcgctacgactccagtcgggccacttcacgtacgcacgggggaaagcacccgccatgaactcggggaagaggaacaagaaggtcagcacgtggcgcgcggtgggatcgctggtcgcccacttccgtaagcgggcgggcctcacgcaggagcggttcgcggaactcgccagcctccacgtcgacacggtgaggtcgatcgaacagggccgcctggccctccagccggaccgcgccgagcagttcgacgaactgctcgacacgggaggtgcgttggcggtgctcatcgcatctctgccggtacgggaccggatcgtgcagttcgctcaggggctggtggatcacgagcaggaggcagtggggatctactcgtacgaggctctggcggtcccaggactgctccagaccagggactactgccgagccctcttcgactaccgctaccctgcgctggagagcgaggcagccgagcagtgggtgaacacccgcatggaccggcagttgatctggcaacgtgaccggccgcccgtcggacacttcgtgctggaggagagcatcctgcggcggcaggtgggcggtccagaggtcatgcgggaccagatccgccagatcctgaagtacaccgagccgaccaacatgagcttccagatcatgcccatggaccgaaccccgcacgcctgcctggacggccctctggtgttgttggagacgcccgagcacgagcgtctcatctacctagaggtgcagcgcgcgagtttcctcgtcgatgatcccgacgaggtctgcgtctaccaccacaaatatgcgatgctgcggtctcaggcgctctcgccgaacgagagtgtgcgcctcctgaacggactgctaggagagtcatgaagaccgcatggttcaagtccagctacagcggcagccagggcggcgactgcctcgaagtctcctacgactggcgcaagtccagctacagcggcagtgaaggcggcaactgcgtggaggtcgccgccctggctgccgctgtagctggacttg

SEQ ID NO: 2051 - DNA, 1597 bp, Unknown
  Kingdom: Bacteria, Phylum: Actinobacteria, Class: Actinobacteria, Order: Streptomycetales, Family: Streptomycetaceae, Genus: Streptomyces
ggccggcagccgcggagtagcggctgccggccgcccctgccgcgtgcggtgcgtcacccgggagccattccgggtgacacgcgcggtgtcactccttgaacgtccccgaggtcgggcgccgggtggccgtggtcgccctgcgcacgtcggtgagcggccgcagccggtaggtgtagctgtagtcgcggtcggcgaggagcttgtactcgtcgtgggtgtgcgcgccccagctgttgtcaccgcccacccccatctgacggtggttcagccgcaggacgacctctgtgcgggcggtgagctggtagtcgtggcgcgcgccgaccgacaggtcctccggggtgaagtgcgaggcgttgaactccagcagcggctcaccggcggcgagcaggccgtgcccctgcccgtcggtgagcgcgacccagcggacgtcggtcttgttgccgttctcctgcggccggatgtagggcgtccactggccggatacggttccggagtacaggccgacgtcggtgccgtcgttgcggtcccagtggttctcctcgggtccccgtccgtagtagtgcaggtgctccaggctgctcggcaggaacagcagggtgccgatctccgggatgtagggcaggctcgcggcgcccgggtgcagggtgttctccaccttgatctcggcgttgccgaacaccgtgtacgtcgtggtgtacgcggactcgacgggtgcggtgggcagggtgccggtgaccttgatctcgacggcccggtcgcgcagggcccgtacgccgacgtccttcaccgtgcggcgggcaccggcgtcgcgccaggtctggttgcgggtgtgctggccgttgccccggtcgttgtcggtgggggcgcgccagaagttcggcgccgggcctgaggtgatcagtccgcggcccgcggcctcgtacgaggtgatgactccgctgcgcttgtcgacggtgacggagaagtccctgccggtgacggtgacggaggtgtcgccgtcctggtggcgcagtgccgggacgctctccaggggggccggcgtgacagcggggccgctcgcgtcgagccggagctgcgctctggccacctcgaagccgctgtcggcccagggggcggactccttggtggtgaaggagagttcgaggaagtactcggtgcccggtgccgggtcggcgggcagcctgaggggcacggtgatgtccttgcgggacagcggggccacgtccagctggtcacgcgtgagcctgccccggtgcacgacctcgccgtccgcgaccagcgaccaacttccgtcgaattcacggacgttggtgaacaggtactcgttggtgagtgtgatcgcaccggaggcggagaccgcttcgcccgaggccggtgccgcgttgatcgcctggtagacgcgcttgatctcggcggccttgccggtgtggccgcggtcggcggtgacgatgccgtcggcctggaagttgccgtcgttggggttgtcgccccagtcgccgccgtaggcgaggaaggtccgctcctttggccgctcgcgggtgacgccggcggtggcggcgtcgaaccacagccgcacgccctcgtcccgcgggccgcg

SEQ ID NO: 2052 - DNA, 1142 bp, Unknown
  Kingdom: Bacteria, Phylum: Actinobacteria, Class: Actinobacteria, Order: Streptomycetales, Family: Streptomycetaceae, Genus: Streptomyces
cggcgacggacgagcgcgtcgcggcggcggtggcgcgactgacggcctgaggcggggacgccggccgcctggctgtggcacgtgagaggggcccggggaagtcgttccccgggcccctcccaccgtgcacgtgctgcggtcagccgcccagggggaggccctggaccggcaggccctgcgtcggcaggccgcccttcgtcgccgtcttcgcggtgtcaccgaggagaccggccgcggtgcccgccgcgtcgcccgccgtcttctgcgccacgggcgtcgtcttcttcacgagcttgccgccggtcttgcccgcggccgggacggcctgcttgagcgccttgctgccggtgtcgcccgcgaccccggtgacgtgctgcgccgcaccgtccacggtgttgccgacgctcgccccgtccagggcggtcagcccgccgaggttcggggtggccggcagctggggcgcggcaccggcggagccggccgcaccgaccccggcagccgccccggcggcgacaagcagcgcggcacgggcgatccggcgggtcagggggagggacatgttgctccttcgacgggagagaaccttgaagtgtccgaccgggcccggtacttcaccggagtccgcggggccctcggcgggccgggctcggacgcagtgactaccgctcgaagcgcgcgaaggttgcggcggggcaacgtaaagagttggtaatgcgtcgcattatctgttgtggataaaaacgggcaaagggcgaccggccggaaagtctgctgaatccttacaccagcgtgcttccaagggatccggcgcccagccgggtgacagcgcgaaaacctgcgcacaccgtggcccggacccggcccgcgccacccgggggagtgaagatccgaactagcgcccggtcgtgatgcggaccgagcccgtacccgtgccggcgccgtcgccgttcttcccgtccgccgcctgccactcgccctcggtgaccccggcggtccactcccggccggcgtaggagacccgctcgatgtgcagcgccgaggcgttggccaccgcccagtgcgccagctgccagccgcgctgcgaccggctgagcccgtcacgcgagccggtgccggcccgtaccggcagcgtcaccgtccgc

SEQ ID NO: 2053 - DNA, 782 bp, Unknown
  Kingdom: Bacteria, Phylum: Actinobacteria, Class: Actinobacteria, Order: Streptomycetales, Family: Streptomycetaceae, Genus: Streptomyces
tcgccggccggggcgagttcgccgtcctcgtcggtcagggcgagcgcgccgagccagggttcgtcgccgggttccagtccggcgtcgcggacgagcgcgaggacggtgtcggcgagttcctcggcgtccggggtgtcctcgtcccaggcgccgccgtcctcgtcgagggaggcggcgaccgcggcccgcacctgcggggtggtgagcaccgcgcgcggcgtggcgggcagggcgcccagcttctccaggatcgggtgggcggcgtccgggtgggcgaccttcaggccgagccgggcgaggacgtccgggtcggccagggcggcggcgtcggcggcgggcagcagcacctgccggggcccgatcgtcgtacggccgtccgccaggggcaccggtagcccggagagccggtccgggtcgacgccggccaggctgtcgtacagccgccgccaccactgcggttccttctccaggccggccagccggtccacggcgtcggtcagcgggacacgggccacgcccaacgtgcgcagttccgcgcggcgttcgagcccggcgggcagcagggtgggcagcacctcggcgaggacccgtacggtctcggcgcccgccccctccaccacctcggcgtcgcggggccgcagcgagacgggcaggtcctccgcgtcctgcgcctcggtccgctcggcaagggggaactggacggcaccctgcgccaggcgatccttgagcggctgccgcgcacctccttcctgccgcccgccgccgagcggaccgaggcgcag

SEQ ID NO: 2054 - DNA, 1475 bp, Unknown
  Kingdom: Bacteria, Phylum: Actinobacteria, Class: Actinobacteria, Order: Streptomycetales, Family: Streptomycetaceae, Genus: Streptomyces
gcacggtggtggggggtgccgctcaccgcggcggtgacgttggcggtgctgcccgtgctgctcgtgccgctgaaggagtggatcgcgcggccgggcacctcggccatgccgccgggcaccgggtacttcccttcggggcacaccgccacggcggtcctcgcctacggaggcgcggtcatcgtgctgctgccgtggctgggcggggcgccggcccggcgaggggtggtcgccgggggcgccctgctggtgctcggggtgtcgtacgggctggtgcggcgcggttaccactggccgctggacgtggtggccagctggtgcctggggccggtcctgctcgcgccgctcctgctgctcagccggaacgcgcgtctcaaccggaggacgcctctcagccgaagtacgcgtcgaagttcttctggaactgccagtccccgaagcggtcccagttgatcgaccaggtcatgaggccgcgcagccccggccaggtgccgtgggtggtgtacgagccgcagttcgtcttcctggtgaggcagtcgagggtcttggtgacctcggccggcgcgacgtagccgttgcccgcctgggtggaggccggcatgccgatgccgatctggtcggggcgcagcggcgggaacagggcgccggtgtcgccggccaccgggaagccggtcaggagcatgtcggtcatcgctatgtggaagtcggcgccgcccatggagtggtactggttgtccaggcccatgatcgggccggagttgtagtcctggacgtggagcagggtcaggtcgtcgcgcagggcgtggatgaccgggaggtaggcgccgcagcgcgggtcctggccgccccacttgccggtgccgtagtactggtagcccatctgcacgaagaaggtctccggagccatggtgaggacgaacttggcgccgtacttggccttgagggtcttcagggcggagatcaggttgacgatcacgggcgtggtcgggttcctgaagtcggtgtcgccggtgttcagggacagggagtggccctcgaagtcgatgtcgaggccgtccagtccgtactcgtcgatgatcttcgagacggaggagacgaaggtgtcccgcgcggccgtggtggtcagctggacctggccgttctggccgccgatggagatcaggaccttcttcccggccgcctgctttgctttgacggcggccttgaagtcggcgtcgctctcggcgttcgggcattcggtgaccgggcagcgggtgaagcggatgtcgccggaggtgaccgaggtgggttcgccgaaggccaggtcgatgacgtcccagctgtcggggacgtcggccatgcgggtgtagccggagccgttggcgaaactggcgtgcaggtagccgacgagggcgtgggtgggcaggcccgggttgccgccgtcgccggggccgccggggccggccgccgtcgtcgcggtcaccggcgccgacttcgcg

SEQ ID NO: 2055 - DNA, 2293 bp, Unknown
  Kingdom: Bacteria, Phylum: Actinobacteria, Class: Actinobacteria, Order: Streptomycetales, Family: Streptomycetaceae, Genus: Streptomyces
gacggttcggcagcgccgccgaagtggaacatgacggacgggcagccggcggcgctgccgaaccgtccgaaatcctcactggccgacaagggggtggccaggacgtgggtcagcgtgcccgcgcgctgaagggccgtcagcagccgctcggtggcgatcgggtcgttgaccgtgagggggaaggggtcgtacgtcgtgatgtccggcgtgcggtcggcgccttgcgcatcggcttccgcgtggacgatgcgccgcaggtcggtgaggatccgctcgcggcagagttcctcgaacgtccgcaggctgcacagcagttccgcggtgtgcgggatgacgttcgccccggtacccgtgtggagggcaccgaccgtcaggaccggggaggggaccaagcccgtcgtcccagcgacgcggcggaccgagcccgtcggtgtgtcacccgccgggcgcccgcagccgccgtacccgggcggggacggggccggtggactcgcgggggacgtaggtggcgcgcagggtgtgcctgcgggggcgggtcgtggagccgttgatgcggcgtaccaggatgtcggccgccaggccgcccagttcctgcaccggctggctgaccacgctcagcctcggccggacgagcgtggcccagtcggcgtcgtcgaagccgatgacggagacgtcgccggggatgcgggcgtcgaggtcgagcagggcgtcgagggtcccgagcgtggccacgttgtcggtggtgaacagcgcggtgggccggtcgtgcgcgctcatcagctccagcacggccgagcgcgcccaggcccggtcgtacccggtgtggcggatcagttccgccccgcgggggatgccggcggctcgcagggcctgccggtagccggtgagccgctcggtcgtggtccagatgtccgcaccgggtgccagccgactggcgttctgatcgggggacgccgaggtgaccaccgcgatgcgggtgtgtcccgcgccggtgaacctggacaccgcggccttggcggcaccgcggttgtcgacgacgaccgtgtccagcgtggcgccgctcagcgcacggtccaggaggaccacggggatgcccgcggcgacagccttgtcgaggtgcccgtgatcggtcgcggcaggcgccacgaccaggccgtccacccgccgctcgatgaacatctgcaccgcggccctctccgtgtcgccgttctcgtcgctgttcgcgaggacgacctgcaggccggccttggccgcgacgtcggtgacaccgcgcacggcgcgggcgaagtaggcgttctccacgtcggcgacgaccacacccagcgtgtgggtacgtccgctgatcatgctccgggccaccgcgttggtgctgtagcccagttcctcggcggcggccaggacccgctccctggtggccgcgctggacgagccgtacccgcccaggactcgggcggcggtggcctgtccgacgccggcgtgccgggcgacgtcggggatggtgacgcggcgcggcggtggtggggtctgcggcatgggcggtctttcgtaggtgacgggtcggcggacgccgaggaaccggccgatgaaattcgctgccattcaaccattgacgggctgcggctgtccgtgtgtaaggtctggcccgttggtaacgttatcaatccctcaccggtaccgacaccgcctgccttttcaggccgggcccggcacggctgcccgtgtccggcccgagcccgcgccccgaacaccggaggtatcacggatggcaaccgacaccctctcgccgccaccggccgctggccccgccatcacgctcgtcgacgtggtcaaggacttcggcggcgccggcgcccgggacgcggcggtcgtccgcggcgtcgacctggtcatcggtgagggtgagttcttctcgctgctcgggccctcgggctgcggcaagaccaccaccttgcggatgatcgccggtttcgaggaacccacctccggccagatcctcctccatggccgcgacatggtcggcgtccccgccaacaagcgcgacatcaacatggtgttccagtcctacgccctcttcccgcacctgagcgtcgccgacaacgtggcgttcggcctgcgccgcaggcgggtgcccaaggacgagatccgcgaccgggtcgagaagatcctgcacaccgtcgaactggccgacaaggccgaccggcgtccccgccagctctccggcggccagcagcaacgtgtcgccctcgcccgcgccctggtcaaccgcccccgcgcgctgctcctggacgagccc

SEQ ID NO: 2056 - DNA, 3258 bp, Unknown
  Kingdom: Bacteria, Phylum: Actinobacteria, Class: Actinobacteria, Order: Streptomycetales, Family: Streptomycetaceae, Genus: Streptomyces
cacgcctggacgcccgccgtcatgggcgcgagcgaggaggccggcacgatctacgcccggcacggcctggacgccctggaactgggcgacgaggccatcgtcgacgtcgccgacttcagcctcgacgggcgcgcgatgcgcgtcgtgcggcaggcccacaaccgggtgcgccgggccggttacacggtcaccatccgccgccacgaggacattcccgacgacgagatggcgctgctcgtcgagcgcgccgaccagtggcgcgacggtgccaccgagcgcggcttctccatggcgctcggccgcctcggcgacccgggcgacggccgctgcgtcatgctggagtgccgggacgcggacggcgagccgcgcgcgctgctgagcttcgtaccgtggggcgagcacggcctgtccctcgacctgatgcgccgcgaccgcgacagcgagaacggcctgatggagttcatggtcgtcgaactgctgctgcgcgcgggcgagatcggcgtacggcgggtctcgctgaacttcgcgatgttccgctcggtcttcgaacgcggggcgcggctcggggccggtccggtgctgcggctgtggcgttccgtgctcaccttcttctcccgctggtggcagatcgagtccctgtaccgtgccaacgccaagtaccggccggtgtgggaaccgcggttcctgctgttcgccaagagcgccgacatcccgcgcatcggcatcgccagcgcccgcgccgagggcttcctcacgccgcccgcgctgccgtcgttcacccgccgcgcccggcgctccgcaccggcggaatccgccgacacgtcggtcaactcccatggctgacgggcgttttcgcattcggtagccttcagggcatgacgcggtccgggggacacgggaacagcgcggccgacggcgacgcgcacgacgaggagcacgaggagcacgaggagcacggagaagcacggggaggcggcgtcgacctgctcggcagcggcgccgaaccgctccaggccgaggatcccctccgcatcggcgggatcccgctggtgggcaagctcggcgcgggcggcatgggccgcgtctacctgggcgtgcacgaggggcggtacgcggccgtcaagcaggtgctccccctgctcgccgaggaccaggcgttcctgcggcacttcggacacgaactcgacaacctctcccggctcccggagcacgccaccgcaccgctgctggccagcgaccgggaggcgaagccgccctggctcgccaccgcctacgtccccggcctcaccctgaacgaggccgtcgggctgctcccgggagggctgcccggcgacgcgctgtggctgctgctgcgcgaggccgcctcggcgctgcgcacggtgcacgacctggagatggtgcaccgcgacctcaagccgtcgaacgtgatgctgacgctcggcggctgcaccctcatcgacttcggtgtcgcccgcgccgccgaccagagccggctgaccaagaccgggatggtggtcggcaccccctcctacatgtcgcccgaacaggcatccggtgcccggacgctgacgggcgcggcggacgtgttcgcgctgggcgcgctggtcgcctacgcggtgagcgggagttcgcccttcggcgagggcgcgggcctcgacctgctctaccgcatcgtccacgacgagcccgacctccagcagctccgcgaacgccacccggacctcgccgacgtcgtcgcctcctgcctggacaaggaccccgagggccgccccaccgccgccgaactggtggaactcgccgacgcgaagggtccctccgggaagccgctgtggcccgaggcggtcacggcggtgctgacggagcgggcggcgttcgcggccacggtcccggcggccgaaaccctcccgggcctgccgccgggccgggagggcacgaaggaacccaagggccgggaggaagccgagggcacgaaagaacccgacggcgcggcccggcccagggccatggaagcggagaagcccggtggccggaaggagcaccggcgccgcaagcgcgtcctgttcgccgtcgtacccgtcatcgtcgccgcgggcgcgaccacggccgtccagctcatcccgtacgcgtccggggatcccgatgccggtggcagcccgtccggccgctcctccgcgagcgccgccatcgcatcggccgcgcccacgtcgtcctcgactaccgccggtcccacgaggtccggttccgccgcacccggcaagaacgggaagaacgacaagagcgacaacaacggggcggacggaaaagacgggaaggacgggaaggacagcacgaacggcgacgctgcaggctcgggtgcccacgacacaggcagcggcagcggcagcggcggtggcgcgaaccacgacggcggctcgggcaccggctcaggttccggaagcgggaacgccaacggcaacgacgggtcaggatccggctcgggctccggatcagggtcgggctcggggacgggctcgggctcgggctccgggtcagggtcggggacaggctcgggctccggatccggctccggcaggccgcccgcgtccggcggcacgcacgtctaccgcaacggcggcatcggaaagtgcctgaccagcgtgtacatggccgcggccaccggtgactgcgcggactcgaccgccgcctggaccgtccgcagcgcctccggcggcgccttccagctggtcaacaagcagagcggtcagtgcctgagcgcgaacttcaacgggcagacggtactcacgggcacctgcgacggcggcagcccgaggctgtggcgcgccggttccgggaacaccctggtcagcgtcttcaacggcggctgcctggacgtcggctccaacaacagcgtctcgaccatgtcctgcacgtccgggaaggcctcccagagctgggcgaaggggtgaccggccgcacccgccaccccgctcctcaccgcgcccccgcgcccccgccctcgaaccgttcccgttcccgttccgcgcccacggtgaagccgatcacggcgccgccgccctcgcgccggcaggcgaacggcgcgcccccgtgggcgatggcgacctcgcgcacgatggacaggccgaggcccgaaccgggcagggagcgggcgtcggcggcgcggtagaagcggtcgaagacgcggatcaggtcgccctccgcgatgccgggcccgcggtcgaggacctcgacgcgcaccgtgcccggccgggccggtcccag

SEQ ID NO: 2057 - DNA, 754 bp, Unknown
  Kingdom: Bacteria, Phylum: Actinobacteria, Class: Actinobacteria, Order: Streptomycetales, Family: Streptomycetaceae, Genus: Streptomyces
tcgccgcgcggctcgtaccgcgtcagcgaccgggtacgggccagcaggcgccgcatccccgcgcggtcaccgacgagcccgtgcgcccgcgcctgcaccagcacgttgccgaacgcggcggcctcggtgggtccggccaccaccggcagcccgcaggcgccggcggtcagctggcacagcagggcgttgcgggtgccgccgccgacgatgtgcacgacgtcgacggcccggccggcgagctgctgcgcctgctggacggcccgtcggtgggcgagggcgagggagtcgaggatgcaccgggtgatctcggcgggggagccgggcacgggctgccccgacgcccggcacgcctcggcgatccgctccggcatccggccgggcgccaggaacgccgcgtcgcccgcgtccaccaccgaccgcagccccggcacccggtccgcctgccgcagcagctcgcccagctccggctcgccccaggcccgtacgcactcctggagcagccacaggcccatgatgttgcgcagatagcggaccgtgccgtcgagcccgagttcgttggtgaagttcgcggcgcggctctcctcggtgaggaccggcgcgtccagctccaggccggccagcgaccaggttcccgtgcagatgtacgcgaaccgctcgccggtggcgggcaccgcggccaccgcggacgccgtgtcgtgcgaggcgaccgtggtgaccggcaccggtccggcgagcccggtctcctccagcacac

SEQ ID NO: 2058 - DNA, 1473 bp, Unknown
  Kingdom: Bacteria, Phylum: Actinobacteria, Class: Actinobacteria, Order: Streptomycetales, Family: Streptomycetaceae, Genus: Streptomyces
gtcggggacacgcccgccggacccgcgatgcccggcaggggagcgccgggcgccagggcgctgctccagcgggggcccttcgccttgccgccgttcgacttcccgccgttcgccgtggtgccgttcgtcttactgccgttcaggtcggcgcccacagacttggcaccgttcgaagcggcaccgttcaccttggcaccgttcggaccgggggcaccgttcgccttggcaccgttcggcttggtgcccttgatctccgtgatctccgacccgggtgccggcgcaccgaactcacccagcgccgcgcgggcctgggcgatgcggatggcctccatggtccggtcgtggcgcaactcggagcggctccaggcgcgttccgccagctcccacatcgtggtcaggtgcaccgggttggtctcggtgacctcggccagggcgaccaccgcgcccttgggtgccagcagccggccgttgaggtaacgctcccaggacgtcttgctgtagccggtgcggtcggcgagcgcggcgatgctgaggccgtcccggtccacgagccgccgcaactggctcgcgaactccttgacctgcggatccagttcctcgggcaaggccttccaacgaggcatcgctgcttccccctcttccacccggtacgtgccggtacttccccgcgcgtggtgcccggtcgggcgggggcacgcgccgttgcgctgatggcccacgctagcccggttgccggacgacttcgcccgggacccctattttgtcaacacatcgacacaccgcgggacagccccgcccgtgtcacaccatccccgtgtctcgccaccccgcgtcagacccgcgtcagacctgagtcaaccctgcgtcaaccacgcatcagcccagcgcgacagcacccacgaccgcggtcaccaagagcgcggcgagcagcgcgacggcgtacagcagcagacgtccgccgggcgcgcctcgcggcgcgcccgggtactcccgccgccgctgtcgctcctgccgctcctccgggcggtcccaccacggaacggtgggcacctcctcgtaggcctctcgcacctcgccgccggagccctccgcccccggctccggaacggactcgggcgccgtccccaccgccgtcgcagccaccggcctgggccagaccttgacggccatctcccagcgcacggtgtggcgttcggcgtccgctccggccaggcccgcgacccggcacagcgcggcgaccgcctgccgtggcgggggctggccggcgttgaggtagcgctgccaggaggacttgctgtacgcggtgcgcgcgccgagcgagaccaggctgaggccggtcgcatccttgaggagccgcagttgctccacgaagtgccgtacctccggcggcagatcgtccggcaacgactgccaggcgcccatcgctcacctcccggcgtcccacgccgcccctcgccctgctgctcgcgctgc

SEQ ID NO: 2059 - DNA, 2786 bp, Unknown
  Kingdom: Bacteria, Phylum: Actinobacteria, Class: Actinobacteria, Order: Streptomycetales, Family: Streptomycetaceae, Genus: Streptomyces
gggtcctagcgtgagggacgtgccgctcgcccgggcacgtgggagtccgagcaccgggtcccgtacagacccgctcagccccctgcccgcgcgatcccccaccggccagcccacgaggagacgcatgttcggcctcacccgcgccagacccggccgctgcggacggaccgccgccgcgctgtcggccggcgccgcgaccgtgctgctcaccgcgccctgcgcgatcgccgccgcccagcccggcgccggcgtaccggagtccgtcgtcggcggcacaccgaccacgacgagcgcgtaccccttcgtcgtccagctcaccgacgccgccggcaaccagttctgcggcggcacgctcgtggcggcccgcaaggtggtcacggcggcgcactgcgtgtccggcgagagcaccgggagcgtgcgggtcgtcgggggccgcaccaacctcgacggcaccgacggcacggtcagcgacgtcagcgggatctggaccgacccggactacacggacgccgcgaacggcgacgacgtggccgtcctgacgctggcgaccgcgatgccgtacgccccggcgaagtacgtctcgcccaccgacaccggtgtgtacgcggccgggaccaccgcccgcgtcctcggctggggcaccaccagcgaaagcggcagcccgtccaaccagttgcggaccgcgaccgtaccggtcgtggccgacaccggctgcgcgagcgcctacggctccgacttcgtcgcgagcgacatggtttgcgccggatacgaatccggcggcacagacacctgccagggcgacagcggcggtcccctgctagtcgggggcgtcctggcagggatcacttcctggggggacggctgcgcggaagcgggccgtccgggtgtgtacacgaggctgaccaccttctccgacctggtcacggcacaggtcggctcctgaggtccgagtgacccaggtggcccagggctcccggggaatccccgggcgcgtgccagggggcgttgcgggcctccacgagcggcccgcaacgccccctttccatccggcgcgcagcggcgcgccccagctttcgtcaggcaccgtggatccacagccgcacgggtctcggccgggatgtggtaggcgtcgacgaaggcgccgagggacaacggcaggccgccagttcggcgaggtcgatggcgtcccacgcggccggcgggtggacggcggggagcgcggccaccagggcccggccacaggggcacgccggcacgcctggcacatgctcggcggcgcgcacggtcgaacagcgcgccgcccaggtctcgttccagccgcttgggcgtccaacatccgctgcgtctccgcggtcgcctcccgccgccgggcccggtgtccgcgtcgggcaccgcggtcagtcggccctcacgtccacgtccgactcggcgaacaccgagaccaccgcgtccatgtatgcgctccccagtgcctcgcgcgagacggcggcgtcgtgccacagcacgccgagggggcggtcgctgtccctgcgcatggaccgcaggcagtcgtgcagcgcgtccaggttggacccgaagtagccgcccggcccgttcaccgcctccccgagggcgcagtagaaggagtccctggtggtgacgctggagccgtcgatcaccactgtttcggcggttccgtaccgggtcgcgcgccggccggcggtgaaccacgcggtctgcaccacgtgcagccagctctcgtgcgccgcggacgggtagcgggtccactcgccgggctcggccgggccgccgtcggcccacctcggccagatccgccccgcctcggggtactcacaggtgtggccgtggaaggtccagtcggcgtcgggccgctcgcccgcgcccgcggacgaatcgggcgccgcggccgacgcccggccgatgtggtacgcaccgaccgtgccgccgtcacggccggccacttccagtcgcgcgttctcggtcctgcgccgcgccgggtcgcaccggtgcgtccgcaggaaggtgaccgccggcggcggctcctcctcggggtccacgaagaatccccggatgtcctccgcggcgacgagcacgtgccgcgactcggcgtcgacgagccggtacaggacgccttccggtggggtggagctcattgcgtgaaaccgatccgtccaggagagccgacctgtcgcgggccgtacggcgcccccgcgggccgaagccgggcggacgggggccgatacgaccgatcccgagcctacccggcttcgaccagcgggctctcagcccccgccgctcacttcttggtccacccccagtcggggaagtgcggggcggtgaaccgctggatcttcttgtagtgggtcgaggtccacccgatgatctcggttccgttggggagcgtcttcaccaggatgcgctcgttctcccccgcgcccgggacccggtactccttggcacccgcccacttcggccactcatgcccgaggtaggtgtcgtgcgagaccagttcgccccgcttgtaggcgtcgtaggcgtccgcgatctcgttgctcatgcccttgggcagtttgtccgacagacggccgttggggcaccggttgttgtggacgagtacgggcgtgctgcccgccagcacgtagtaggtgtgcaggccggcgaccgtcaggttgtggacgcgctggtcctcctcgacgtgcgtccgcgccgcggtgaccggggcggacgcaccggccggcgtggtcagcggcatgcccggccgcagatcgcccgcgtcgcgccaggtc

SEQ ID NO: 2060 - DNA, 1220 bp, Unknown
  Kingdom: Bacteria, Phylum: Actinobacteria, Class: Actinobacteria, Order: Streptomycetales, Family: Streptomycetaceae, Genus: Streptomyces
cccgctgctgctgccgctcgccctggcgctcgcccggctgcgcgtctcccgcgcggcactggtgaccggcggggtcgcgctggcctccgccgtctacggggcgttctggctcaacggctccggaccaccgtgacgagccggaccaccgtgaccggaccggcggcccgcgcgcttcatgatcattcctcatccggttccggcgcgccccgctcgcagcgccccgtgcacgaacggtgaattccagccgtccgttccgtcgacgtattcataagcagccgataaggaccaccggaatgatcaaaggaaatgcatgccggtggtcgccttcatttgcgaaatcctgggaaatcaggccccgttgagagcaatcccacatcacatcgtcatcacaaaccacgtgattcgtcagggaagtgcgctcactcgctgtaacgtcgattaggtgcgtaccgaaggaaccctcacccgcctggaccgggtgttcgccaggctggaccgtgagccacagcggccggcgcacatcgacatgccgagaatgagcaggcaccgggtcgtgctgttctcggcgaccctggccttctacctggcgatcgtctgggccgtggtgaccacctcctggctggtccgcctggactggcaggtcatgttcttccggccgtaccagcagtggccgcagatccacgcgttcctcgactactacgtggtcctcggccagcgcggccccaccgccgtgatggtcgcctcctggctgggctggcgctcctggcggcagcacacactgcgcccgctgctcaccctcggcgcctcactgctgctgctgaacatcaccgtcggcgccgcgaaatacggcatgggacgcctcggaccgcactacgcgaccgtcatcggctccaacgagatgggtctgggcggcgatatatttcccagcggccacaccgccaacgccgtggtgacctggggcatcctggcctacctggcctccaccccgaccgcgcgccgctggctgtccgcgctgtcggcggtcacctcgctcggcgtcggcctcaccaccgtctacctggggacgcactggctcagcgacgtggtgctcggctgggcggcgggcctgctgatcctgctcgcgctgccctggtgcgagccgctgatcgcccgcaccgagaacgccatcttcgacctgcgcgaccgctggcgcgaccgccgcggcctgcccgccccggtgc

SEQ ID NO: 2061 - DNA, 1067 bp, Unknown
  Kingdom: Bacteria, Phylum: Actinobacteria, Class: Actinobacteria, Order: Streptomycetales, Family: Streptomycetaceae, Genus: Streptomyces
gccgtgacggcgctgaaggcgctggacacggcggagccgcccgccggaagcgtgctgaacctgctggaggacgcgctccagggcgccacccgcgcggtggcggacgtcaccggcggcgaggaggccggtacgaccctgaccgcgctgctgtggaccggctcccagccggccctcgtgcacatcggcgacagcagggcgtatctgctgcgcgagggcgggctgttccgggtcacccatgaccacaccgtggtgcaggcgatgctggacgaggggcggctgactccggaggaggccgtgagccatccgcagcgcgcgctgctcctcaaggcgctggacggcggcggcaccccgcccgtcccggacctgcgcctgcacgacgcgctgcccggcgaccggtacctgctctgttccgacggcctgaccggcgtcgtccccgacgaccgcatacaggcgctcctggccgccaacccggccccggacgcggcggtacgggccctggtcgacgcggcgaacaccgccggcggcccggacaacatcagctgcgtcgtcgccgacgtggtggagccggaggcggcctgacggcgggtgggatgcactcctgggtgcccctgagcactcctcagcgcaccgggagtcgtatgacgatctgatccgaacaagggatcagttgttccctggaacaggtgatcgtcgcagaagtgatcggtgcggggcacgcggggcggacgatactgacggtgcgcaagcgacgggctgcagaccgtggtcggcgcgggtcccacacgaagcactacaaggagaatgcacgatcatgaatttcctcactgacgtcctcgccggcctcatccacatcgtcggctggctggtctgacggcagcggcagcgcaggcagcacggcggcgccgtctccccgtcccagggaggcggcgccgcccgcgtgtgtccggcggtcacctcaccgccgctccacccccacggcccgtacgatctcctgccgcacggacccgccccggtcgtcggtggccgaggcccgcagcgagacggtggccgcgccgcgcggcacgctg

SEQ ID NO: 2062 - DNA, 994 bp, Unknown
  Kingdom: Bacteria, Phylum: Actinobacteria, Class: Actinobacteria, Order: Streptomycetales, Family: Streptomycetaceae, Genus: Streptomyces
cgccgcggatgccgggactccggtcatctgcccgcctcctcactccacccgagcgaacccgccagcggctcggccaccaggtccacgccctccgtgccgatcaccttcgcctcgaccatacggccgggggccagcccctcgccgtcggtgagccgcacctggccgtcggtctccggtgcctggtgcgcggcccggccggacacaccgtcctcgggatccaccgattccacgagtacccgcagcgtctcgccgatgcgctcctcggcgcgctgggagacgagttcctcggccagccgggagacacgtgccagccgctcggcgacgacctcctcgtccagcttgttctcgtacgtcgccgcttcggtgccctcctcgtcggagtagccgaagacaccgatggcgtcgagccgggcgccgttcaggaaccgctccagctcggcgaggtcggcctccgactcgccggggaagccgacgatgaagttggagcgcacaccggcctgcggcgccttggagcggatggtgtccagcagctccaggaagcggtcggtgtcgccgaagcggcgcatggcgcgcagcacgccgggcgcggagtgctggaaggagaggtcgaagtagggggcgaccttcggggtggaggtgaggacgtcgatgagtccggggcgcatctcggcgggctgcaggtagctgacccgcacccgctcgatgccgtcgacctcggccagctccggcagcagggactccagcaggcggatgtcgccgaggtccttgccgtaggaggtgttgttctcggagaccagcatgatctccttgacgccctgctcggccagccaccgcgtctcgttcagtacgtcgctggggcggcgggagatgaaggagccgcggaaggaggggatggcgcagaaggaacagcggcggtcgcagccggaggcgagcttgacggaggcgaccggggcgccgtcgaggcggcggcgcagcggcgcgcgcggtccggagg

SEQ ID NO: 2063 - DNA, 1168 bp, Unknown
  Kingdom: Bacteria, Phylum: Actinobacteria, Class: Actinobacteria, Order: Streptomycetales, Family: Streptomycetaceae, Genus: Streptomyces
ctcctcggcgccgaccacgccgacaaggcagcggacgccgccgaggaggccgtgaagtacgcgggtcaggccgtcgactacgccaacaagtcgaccgcccacgccgcggaggccgtgaaggccgccaacaccgccacccaggccgtcagcgacgccctcgaggtggagaagaacgcccgcgccgccgaggcgcagaccctggagcaggacaagcagcaggccatcgaggaggcccggcagctcgccgccatcgagcagaccgagctctccgacgtccgcgagaagcggctgatggaggagcgcaccacacaggcgaccaaggacctcgtctccaaggcggaagaggccctgtactccggcgacatgccggccgccgcgaccctgggccggcaggccgcggtcgccctgatggacgcccgcggggccaacacccggcaggccgcccagcacgccctcgccggctccgacgacgacgtctacgcctggatcgacctcgaccgggccctcgcccaggcgcaggacgaccgcgagaccaccctccacgtggcgacggtcggcggaccgaaggtcgccgcggcagccgcggcagcgctggagagcgccgactccaaggccgtcggcgacttcctcaccggcggcatgaaacgtgcctcggacgaggacctgcgcgtcgccatcaacaagatcatcaatgatgacgcgggcaaggccgtcaaggaggccgccaacaaggcgctcgacgagaacaccaccgagtccctcaactacttcttcgaccatgactacccgctggccgtccaggaggacgaccgggtccgggccagcgagctgatcaacaccgcgggcgccttcaccaaggcctacgcggaggtcgcgctcgaaggaccggcgtggatgctgcgcaacttcatcaccgtgatccagtaccgcacggcgcagctcgacttcgacaccgccacccacgtcgccgccatccgcggggccatcgccgccgccgcgaagatcgcggagaaggcgcaggaggacgcggccatcgcctcgaaggccgccgccgacgcccgcaaggccgccgccgaggcccaggagtgggcgcagaaggcgctcgactccgccgccaaggccgaggactacgcccagcaggcgcgggacaacgccgacgccgccgaca

SEQ ID NO: 2064 - DNA, 835 bp, Unknown
  Kingdom: Bacteria, Phylum: Actinobacteria, Class: Actinobacteria, Order: Streptomycetales, Family: Streptomycetaceae, Genus: Streptomyces
cagctcgctgatccgcacccgcggccggcccggctcgaccagtccgccgaaggcgaccggaagccccgtcgcacgccgcagccgcaccagcgcaccccggatctccgccgccccggacgcgtccgccgtcacccgctcgtcccttcgtcacgcctcccgcgcccaccacacccccgttcgggggtagtgagacctgcatcacggattacacgatggagccggggcgcacggcaatggtccggatgctggaccgcacatggaggacagatgacgacggcgacggagaccttccgcggggcacgggacttcctgctggcacaccgtgaggactacgccacggcctacgccggcttcgagtggccccgccccgaccacttcaactgggcgctggactggttcgacgtcatcgccgagaacaacgaccgcaccgctctgcacatcgtcgaggaggacggcaccgaggtccgtctctccttcgccgagatgtccgaacgctccgaccgcgccgcgaactggctgcgggcgcgcggcgtcggggccgaggaccggatcctcgtgatgctcggcaaccaggccgagttgtgggagaccgcgctcgccgcgatgaagctgcgggcggtcgtcatccccgccaccccgctgctcggccccgacgacctgcgcgaccgcgtcgagcgcggccgggtcgggcacgtcatcgtgcgtgccggggacaccgcgaagttcgccgacgttcccggcacctacacccgcatctcggtcggcggggtgcccgaggagggctgggagccctacgaggacgcctacgcggccccggcggagttcgtccccgacg

SEQ ID NO: 2065 - DNA, 647 bp, Unknown
  Kingdom: Bacteria, Phylum: Actinobacteria, Class: Actinobacteria, Order: Streptomycetales, Family: Streptomycetaceae, Genus: Streptomyces
ccggggaggctcggggggagccacgggttccggcgcaggaggggaagagccgagggggccgggtcgacgaccgggccccctcgaagctgtccggacccccacgccgggggctcctggcagccggggatttctagaagaacaccccgcaccgcagcagcacgttcgcgtacggccgtgcctccccggtccgtacgaccagacgcgcgccccccgacagctccttgagccgctcgtgcgggacgagggcgaggtcggggaagcggccgtccagcagggcggcagccgccggattggccgcgcgcacctcggccgccgccgtcgcgccctcgatcaccagctcggccagcagcccgtccagcacctcggcgaaggacggcaccccggcgcggaacgccaggtccaccacccgcggcccggccggtatcggcatgcccgcgtcgcacaccagcaccccgtccgtgtgccccaactccgccagggcaccggcgagctgccggttcaggatgcccgccttcttcacagggcgtcgacctccgcagcggtcgggtacgactcctgcgcgccccgcttcgtcacggccgccgcgcccacccgggccgcgtacgccgccgcgtcctccagggacgcggcggcgtacgcggcccggg

SEQ ID NO: 2066 - DNA, 613 bp, Unknown
  Kingdom: Bacteria, Phylum: Actinobacteria, Class: Actinobacteria, Order: Streptomycetales, Family: Streptomycetaceae, Genus: Streptomyces
tccggccgcgcggccggagcccaccgcaccaccccctgaaggagaacaccagatgaccaccgcccgatccggagcgtccggagcatccggagccaccggagcgcacaccccgggagccgcccgatgagggttctgctgatcggagcaggcggatacctcggccgtttcgtcgccgaccgcctgctcgccgacccggccgtccagctcaccgcgctcggccgcggcgacgacgccgacgtccgcttcgacctcgccacgggcagccccggagcgctcacccgcttcctcgacgccgtccatccgggcgtcgtcatcaactgcgcgggcgccacccgcggcggcgcccgcgaactcacccggcacaacaccgtcgccgtcgccaccgtctgcgaggccctgcgccgcagcggatgcggtgcccgcctcgtgcagatcggctgcggcgccgagtacggccccagccagcccggctcctccaccgcggaggacgccgtgccccggcccggcgggcgagaagacgcggagcacgacggcgtcgagtccggaaccgaggacgagttcggtcgcggcgagcttgctgaccccgtacgggccgccgggccggggcacggcg

SEQ ID NO: 2067 - DNA, 1150 bp, Unknown
  Kingdom: Bacteria, Phylum: Actinobacteria, Class: Actinobacteria, Order: Streptomycetales, Family: Streptomycetaceae, Genus: Streptomyces
gtgcggccggagcgccgggcggcggccagggcgcgttcgcggacctcgtcgtcgaagtacggggcgaggcccagcagcgcgtcgtggatggacacctcgcgccagtgcagccgcgcccgcggcaactgccaccagccgctgggctgttcgggcgcggtcgacacgaaccggatccgcgcccacagcggcgcgaggctgcggtagtcctccaggctgcacaactgggcgagggcggacggcagcagcctgggcagcacgaaccccgccgagcacagcagcgcgccgagggaggccagcggcggggcgacctgtgtggacagcacgtccaggtcatggccggcccaccgcgcggccaccgccgtgtacttggtcagctggaagccgaccacgtccagcgcggaaccggcgaggatgaggcgcagcccggtccgcagcagcccggtgacctcgcggctccacttcacgcacagcacgcacgtcgccaccgtcgccgcgctgtgcccgatgaggtagagcaggatcatctcgcacaggtacggcgtgttggcgtagtacgtgtcgaggtcggtgagccgctcggtgcgggcgtcgcccagcgcgaacagcacgacgatggcggcgaccagcggcacgtaggcggcgatgctgcgcagcaccatccgccggacccggccgggcgggccgccccgccagtggatcagcaggatcagcagcgagcagctgtacgcgctgagcatgccgtacgtcagcggggcgccgaagttggggatgccggtgaggtcgttgacggcggccagggtcagcggtgccgagcagacgaagaccagcgagccgagcacgatcgacacgcacgtggacacggtcagcgggtcccgtacggcccgcagcggccgacggcacagcacgaccgccgacagcccgaacagaccggccgcgagatagacgacgaggctcatccgcgccgcctccgcccggcccggcggacggcggcccacggacgcggcgtcgccgccgccggtgcccctgtcacaccgcctccggcgcacgcgagccgcgcacggagcactgcgcggtgcgcagcacgtcggcgatccgcacgagcaccgcgagcccgggcacccgcccgcccggcgggccgtcgggcagtgtg

SEQ ID NO: 2068 - DNA, 2184 bp, Unknown
  Kingdom: Bacteria, Phylum: Actinobacteria, Class: Actinobacteria, Order: Streptomycetales, Family: Streptomycetaceae, Genus: Streptomyces
gtgatgaccgccctcctgaggggggtgagcgccgcggcggtgaacagcccggcgccggcggtgctgagggcggtcatcacggtgcgtctggtcaccatcacagaactcctggcggaagggcggaagggcggtcgggactgcgccgagtgcagcaggccgcgctcgcgtgcagatcgagaacgactcggtgacgtgtcctgacgcgctcggtgatcgcttgcgccgggcttgcggggcgctccgtatacctgggccgaccgatgcccgtgccccatacccctgcccggaaggctgactgtggaccttcgctactggctgccgcgcgcggtggacgtcgtcgaacgcttcgaggagcgcttcgggccgtaccgggagcatccctcgcaccaggtcgacgacgcggccttcggtgccgctttcaccgcgttcggcaagcggctcgacgacaactaccccttcttccatccgcggtacgcgggacagatggtcaagccgccgcaccccgccgcggtcgtcggctatgtcacggccatgctgttcaatcccaacaaccacgccgccgagggcggtccggccaccaccgagatggaacgcgagtgtgtggagcggctcgccgcgatgttcggcttcggcggcgcgcatctgggccatctgacgacgagcggcacgatggcgaacctcgaggcgttgtacgtggcgcgccagtcgcatcccgagcgcgggatcgcgttcagcaccgagtgccattacacgcacgagcgcatgtgcggggtgctcggtgtcgaggggcaccgggtgccgtccgacgcgcagggacggatcgagctcgacgcgctggagaagctgctggcgaccggccgggtcggcaccgtggtggtgacggcgggcacgaccgggctcggcgccgtcgacccggtgcatgaggtggtgccgctggcgcgccggtacggggcgcgggtgcatgtggacgccgcgtacggcggcttctacgccctgctgggccgttcggagcggtcggagggcatcgacgtacggccgtggagggcgatccgcgaggtcgactcggtcgtcgtcgacccgcacaagcacggcctgcagccctacggctgcggggcggtgctcttcaacgacccgcggacccggcggcacttcgcccacgactcgccctacacctacttcaccgacgcggagctgcacctgggcgagatcagtctggagtgctcgcgggcgggtgcggcggccgcggcgttctggctgacgctgcaactgctgccgctgacccgcgacggattcggtgaggtcctcgccggcagccgccgggcggccgcgcgctgggccggactgatcgaggagtccggggagctggagctttatcaggcgccgcagctcgacgtcgtcagctacttccccgccgtgcggccgttgtccctgtccgccgtcgacgcggcatccggacggctgctcgacgacggcatgtacgcggccgaggacccggtctacctgagtgtcctgcggaccgacgccgcggacttcgcacgccgcaggcccgacgtggtgcgcgacgccgacaccgcccgggtgctgcgcagcgtgctgatcaagccggaggccgaactgcacctggacgcgttgcacgcccgggtggagcaactggccgccgccgctcgcctgtagtcatcacagctgccccagcagtcacagctgctcagcagtcatcaacgggaggaaatccgtgaccgacctgtccacgatcgatgcgccgcccgcgacggacggcgtccccgtgcggcgtgccacgccggccgacgccggcccactcgcggccctgctggccgacgcctttctcgacgatccgctgacctgctggatcactccggaccccgagcgccgggcgcgcgtgctgcccggcctgttccgggtgttcctcgacatgtcgttcgcgtacgacgcggtgacctgcaccccggacctggaggccgtgctgctgtggacgcctcccggagcctgggctgaactggaggggcgtcgcacggagttcggccgccggttcgaggaggtgctcggtgagcgcgaggccgcggcgctggcgctgatcggcgagctgcaggccgcccggcatccgaccgagccgcactactacgcgtcgttcggcgcggtacgccgccgcgcacgcggtgcccggct

SEQ ID NO: 2069 - DNA, 833 bp, Unknown
  Kingdom: Bacteria, Phylum: Actinobacteria, Class: Actinobacteria, Order: Streptomycetales, Family: Streptomycetaceae, Genus: Streptomyces
ccccccggaaatcccacccccttccgctcccgcaaccggccgcgaaagccgctcgggccgggggtcttcatgggtgaccaggggatttgcccggtcggacggagggtaggacgcgggtaccacggaggggttgtgcggcggccgcgtcactccttcggggggcggctgcctggcgggaggcggggttcagaacagcctgaggccgtactccgtcgcgacctcctggagtgccgggtcctccaggcggacggggcggcgctccgcgtcctccaggtcgacgtcgtccaggaccgcccagcactggcggccgccgtagccggagcggtacgcgatgccctgggccagtctgtgcccggtccggtcgcgctgcgccaccgtccacgcggcgatctggcgggcgatcctgcggtcggtgccgtggatgtgctcgtcggcgagcccgttctccacgccccaggcactcagctcgctgtgcagctccttcatgaggacctcgcgggtggcggtcgcgtcgacgtcgaggaagcgggtgtccttgggcgggacgacccggacgaggacgtggtcctcgcgccagccggacgccagatgcccgggccgcatcgtgctgtgcctgtggtcccagtcgttgccgatgagccggcgcatcctcgggtggacccggaagtgcgccagcgcctccgcgtagcaaccggccaggtcggtggcgcagtagagcatcccgtgcgcggccaggctgaaccggcccgcgctggaaccctggctcgtctcgggctccagcctgttgtacgccagcggctggttccgcttgcccagccgctggcgtacaacag

SEQ ID NO: 2070 - DNA, 831 bp, Unknown
  Kingdom: Bacteria, Phylum: Actinobacteria, Class: Actinobacteria, Order: Streptomycetales, Family: Streptomycetaceae, Genus: Streptomyces
tgcccgtccggccggcgtgaccacggtgcaggcggcggcccgctacggcgaggcgctgcgcgacgatccctggctggagtcggtcccggtgacgctgagcgaggtgataccgataccggcaggcgactcctggcaactggccgacgccggttcggagcacgcgctgcccctcacctcggcggccctctcccggcccggtctctggcggctggtggccctgtcgggcggtgccccggtcacggtcttcggggagtgcggccatcgcgggttcactcctctgacggcctggccgcggggcgagggcgaggcggtgacactgtgctgacctggcgtacaccgtctgcgacatccgccccggtcggcggggctgtcgtgtccggcatcggagtgacgtcggcgcgcggagcgaggcgttgcccgcacagcgggaagtctcacccgaaaggcccacaacggcgacgaccacagcgacgacgacacctcacgagtccgccctttctcacccgattcacgcatttcttccgcctcaggggaaacccggcccgggtgaccctccgaccgccctcaggcgcgcggcaacggaaaggacgctcatgatcaggacccccgccccggtggaagcgcccgcagcgggcgcctgggaggagctggtcaccaccgccctgctcggcacggaccgccgcaggccaccggcgggcgcccccggccgggacgccccggctgcgctgctggacgcggcggccgcgcacactgtcagccgccgtgccggcctgctcccggcaccggcggccgagcgcccgacaccggcacccagggacacccgccccgccc

SEQ ID NO: 2071 - DNA, 705 bp, Unknown
  Kingdom: Bacteria, Phylum: Actinobacteria, Class: Actinobacteria, Order: Streptomycetales, Family: Streptomycetaceae, Genus: Streptomyces
cggcgggggcggtggtacgccgtgcgcgggggaggcgcaggcggcgccaggcccgttcgtggaccagggccagcacgagggccgcggccacggcgatgaggtgctcgcgtcctgccaggttgggtctgacgatcgactcgacgaccatcgagccgccggtgaggaagaagacgaccggggcgcggcggaccacggagaggtaggtgaacaggcccaccacggccgccgagggaccggtgtcgaggacgtgcccgatctccggcggcagcccgagcccccaccagccgggcccgatcgcgatcatcacgcgcacggtgaaggtgccggcgagggtggcggcgtaggagatgaacagggtgcgggcgcggcccagggtgagttcggcgagggcgaaggcgaggaagagctgggtgatgcccgcccagaccggcaggtccagggcgggcacgtacagggagacgggggtgcgggccagggccagccacagcggcaggtcggcctggacgccgccgaccgcgcggaccgccgcctcgccggtggggtgctgggcgacggcgtggaagaagatgacgccgaaggcggccacgaaggcgagcagcaggccggacagtccgcggcgcagcagctgccgtacggggtcgacgaccatggcgtgccactcgccgcgcagggtgcgtacggcgaacagcgcgagccggatcaccg

SEQ ID NO: 2072 - DNA, 636 bp, Unknown
  Kingdom: Bacteria, Phylum: Actinobacteria, Class: Actinobacteria, Order: Streptomycetales, Family: Streptomycetaceae, Genus: Streptomyces
cccccagaagccccgcccactttcgctgcccccgctcgaagccccggcggtccaccacggtgcagcgaatccacttgaccagcaccgcgccatcgtacggccccaggcgtggcgtcggtcactttcctggggacagcgcccgcgcaggcgtccgcgcgcgcgtggcacgatggacaacgagcgctccccacccggcggttggggcagacgacggcgcgtgaggacggggaaggggaggtccggtgaacgggctgagcaaagggatccgcaaggtcgaggtcgcactgaagtgggaccccagtccgacagggcagccgcccaccgatctggacatcgtggcgggcacctacctggcgagtgatccgtacggcacgccggactacctggtgcacttcgacagccgttcgcccgacggcacgatctacctgaaccgggacagcacggacggcaagggcttcggctgggacgaggtcatgacgctggagctcgaccggctctccgagcgctacgcgcgcgtggtggtcggcgtcgtcatccagcagagcgccgcgcaccgcaccttctccggcgtgctcgatccgggtctgcggatccgggagggctacaccgtgctcaccgaggacgacttcgacggcg

SEQ ID NO: 2073 - DNA, 1201 bp, Unknown
  Kingdom: Bacteria, Phylum: Actinobacteria, Class: Actinobacteria, Order: Streptomycetales, Family: Streptomycetaceae, Genus: Streptomyces
tcgtcaaggccgccgcggccaggacggcggtggccgcggcggccttgacgaccgtacggcggcggggcgtgagctgggtgccggtgagcaccggggacgtcgggacggggtcggacgatctgtgtcggctggtcacggccgatcagattactggcgagtacagacgaggagcgggcgaaccggcgaaagttcgcccgctcttcagcggggattggcgtgaaccggcccggacagtggcggatcacaggtgacccgcgcggttgcgggccggccggatcagcccttcagcgcggcagtgatcgccgtgttgaagtcctgcacggtcatcggcgcgttgtccgagccgggagaggtgagcttcttgccgtccatgaccaggctcggtgtgccggtcaccttgtccttgttgtcgtcgaacgtcttcgacatcgccatggcccaggcgtcgtacgtgccgttcttcacggccgtctggaacttggcgttgcccttgagcgccgagacggtgtccgcgatcttgagcaggtagctgtcgtccttgaacttgtcgtcgttctcgtccgggtgccacttggcggagtagagcgcggtcttgaactccaggaacgcctcggggctgacgttgagcgcggctcccagagcgctcagcgcgttcttggagccctcgccctggtcgtggtcgtcgaggaaggtgccggagatgaactgcatcttgaacttgccgtcgtcgaggtccttcttcagggccgggccgacggtctgctcgaactgggcgcagatcgggcagcgcgggtcctcgtagaccttgagggtcttcgcggccgtggacttgccgaggaccaccgtcgtgccgttcgtgcccgaggtgttggcgggcgcgacgaccttgtcgtccttgacggcgtcccagtggccgggcttgttggcctggacgacggcgtagccgatgccgccggccgccgccagtacgacgacgaccgccgcggcgacggtgatctgccgcttggccttggcgcgcttggcctcgcgctcgcgctcggcgcgcagccgctcccgggccgccgtcttcgccgactgtgcgttccgcttgctcatggtggtgttctcctgtgggacgcgcagcatcgtgcgcgggatgcgtgtgacgtggtgggggaccggtcggcccggaccgggcctcgcctgcgctctcgccctcggc

SEQ ID NO: 2074 - DNA, 969 bp, Unknown
  Kingdom: Bacteria, Phylum: Actinobacteria, Class: Actinobacteria, Order: Streptomycetales, Family: Streptomycetaceae, Genus: Streptomyces
gatgcacgagcggcgcgcggacgccgtggtgctggtcggcggcagcgtcgacgaccgcgcctacaaggccgagctggcgcgccgggcccgggagctggacgcgggcggttcgaagctggtgctgtgcgggcggccgtcgctcggcgagggcgtaccgacggtcggcgtcgagtacgacaacgagggcggcgccttcgcgatcaccgaccatctgatcacgcagggccatgagcggatcctctacctgggcgggccgcccggcctgtccacggcacgggaccggctcgccggtcaccggcgcgcgctcgaactgcgcggcatcgcgcgggacgcgcggctggagcagcccggcgccttcagccgcgccttcggctaccggcgcatgtcggaactgctgcgcagtgggccggagttcaccgccgtgttcgccgcgaacgacatcgtggcggccggcgcggcgcaggccctggaggaggccggggtgcgcgtcccgcaggacatgtcgctggtcggctacgacgacatcccggtggcgcaggagctgcggccacggctgacgaccgtccggatcccgctggaggagatgggccggcaggcggtgcggatcgcgctctacggcggcgacgaggacgactggcgcgccccgacgaccggcacgctgcgcctgggcacgcacatcgtcgtacgggagtcggtggcggcaccgcggggcgcggtcccggggagcgccaaggcgcgcaggggctgacaccgggccccggcgtgctcgattctgctcgcaaggacgctggttcggatagtaacgaacagaaactcggcgcaccctcttgcgaccggacagcaaacgcttacatgctggcgcgcagccccatccgctcgtcccgcccctcgccttgacgtcctccgtcccctgggagcccctggatgcgctctgcccacaagcccctccgtgccgatctccccgcccac

SEQ ID NO: 2075 - DNA, 548 bp, Unknown
  Kingdom: Bacteria, Phylum: Actinobacteria, Class: Actinobacteria, Order: Streptomycetales, Family: Streptomycetaceae, Genus: Streptomyces
cccgccgacaccgaggcggacgaggagggcggccgggagaccgtcgtcgtcgaggtcggcggcaaacgcctggaagtctccctgccctccagcctgggcatgagcctggcccgcaccggcctggccgccggcgccaagcccaagcgccgcgccgcgaagaagtccggccccgtcgcctccggtgacaccctcgcctccccgatgcagggcaccatcgtcaagatcgccgtcgaggacggccaggaggtcaaggaaggcgacctcgtcgtcgtcctggaagccatgaagatggaacagcccctcaacgcccacaagagcggcaccatcaagggactgaccgccaccgtcggcgcctccctcacctccggcgcccccatctgcgagatcaaggactgacacccgcaccacccgcacaccacaggcgcccggcggaccgcgacagcggaccaccgggcgcccgccttcgcacgagcacactctccacagcacccaccggcaacggcggcaagccctccgccgcacgccttgccgccgttgccggtgggtgc

SEQ ID NO: 2076 - DNA, 847 bp, Unknown
  Kingdom: Bacteria, Phylum: Actinobacteria, Class: Actinobacteria, Order: Streptomycetales, Family: Streptomycetaceae, Genus: Streptomyces
agtgcctggtcaccgccgggccgcgggacgtctggctggccaccggaggcggtgcgcacgcgcgcgtgctgcactcctcggaccgcgggctgacctggcgggccgccgaccaggcctcgccgaacgcgtccgcaacgacctccgacggcggccgtacctggcagccctccgccacgccgccgccggcctaccgctccggcgccgcctggctgccgcacacacacgcgagcgccctcgcggtcggcccgaccggcacggacctcaccaccgacggcggccggacctggcgcacggtcgacacggggtcgtacgacaccgtggactgcgcctgggacggcggttgctgggcatccggtgagaagggccgtatcgctcgactggaggactgaatatcgcctgatatgacgaactgttccaggatgcgggtatccgttccttgacagagaggaagtgaacggcatgccacgcggttccagttccaagcgggagcgtcagtacgagcacatcaaggagagcgccgaggaccggggagagagcaccggccgcgccaaggagatcgccgcgcgcacggtgaacaaggagcgcgcgcgctcgggggagtccaagaccgcgagccgcacctcgacgcaggacatgtcctccggcaagcgcggcggccagcgctcgggccggggctccgagggccccacctacgaccagctctacgaggaggccaagcggcgcaacatccacggccgctcggacatgaacaagcagcagctccagcaggccctggacaagcactgagccgagcccgcgagcgggacgggcccgcgcccgcacggaccgcgggcccgtcccgctcgcg

SEQ ID NO: 2077 - DNA, 2239 bp, Unknown
  Kingdom: Bacteria, Phylum: Actinobacteria, Class: Actinobacteria, Order: Streptomycetales, Family: Streptomycetaceae, Genus: Streptomyces
cgcgcagggcctgcggaagggcgtcggtgtgcgcggtgaacccgccctgcttgcggtcggccggcatcccgcgcagcgcgccgagcgcgcggcgggtgaactccctgacctcctcgccggtgccgagcgcggcacggatctcggcgacctcggcggccacgtcctccttcttgatccggttctgggcgtagagggaccgggacgccttctcccgctcggcggaggattcccaggcgagctccaactgctcggtggcgggaagctcgtcgcgctcgaacagcccctcctgctcgaaggagggggtctcgccgcgcaggatcagttcctcgaagaccgcctgcatggcgctctccgcctgctgcggcaccgggacggagatgccggtggcgcggcggatgcgctcgtgcttgcgcagcagcaccttcaggacgatgtcgtcgaccgggttgtccgcaccgtacagggtgagggccttcacggtgtccgtgcgctgcccgaaacggtcgacgcggccttcgcgctgttcgtggcgggtcgggttccaggccaggtcgtagtggatgacggcgtcgaaggactcctggaggttgacgccctcggacaggcagtcggtggccaccaggacgcgccgctcgggggccggctcgccgttctcgtcgatgccggtgagttcggcgatccggttcaggcgcatgtcgggcgagagctcgccggtgacggaggcgaccgccacgggatgctcggcgcccctcttgttgagcaccttcttcaggtggtcggcgacgtactcggacgtggcgatgtagcggcagaacacgatcggccggtagccggagtcgaggagatcggtgaccatcgccaccagcttcttcagcttggtgtcacgggtgggcccggcgagcctgcccgcggcctcggccatggcgaccagacgcgccttctcgtcggcgtcgagcccgtcgctgccgtcttcggcgaccgcgggtgtcgcagtgggcagcaggctgcccggcacctcgtcggcggactgggcgctgtcggtgtcggccgggtccgagacggtcgactgcccagtgcggtccacctcgtcgggggtgtccgcctcctggacgccggccctggtgttcagggaccgtacggcggcggcgggcgaggaggacagggtgcgcagcagtgccagcgtcgaccaccagcgctgccgctgctggagcgctccgtcggcggagcgcaccgtctcgcgggcgtacgcgaggacctcggcgagcagggtgcggtagtcgcggtgcagggtgtaggagacctcggtgctgtcccggctggaggggaagtgcgcgccgtcctggaagtcctcacggatgtcggcgcggcggcgctgtacgaagtactgggcgagcagctcacggcccgcgcgggactcgaagccgacggtggcgaggcgggcgtcgaggagcccgagcagccgccggaagggctcctccttgccgctgtgcggggtcgcggtgaccaggaggaggtggcgggcggggtcgtcggcgagcgcgcgcagcagtccgtagcgctgctgcgaggtgcgcgccgagacctgcgccgtggagtccgcgacacaggtgtgcgcctcgtcgacgatcaccaggtcggggcagttgcgcaggaagtcctcgcggtggcggggcgacttgatgaagtccgtcgacacgacgtaggcgccgtccgggcggaacacagactgcccgtacggtgtctcacgttcgagccggccgatcgtggcgggcagcaccagacgcgcgtccacgccgaacttgccccgcagctcggcccgccactgctcggcgagcgccggggagcacagcacgaccagaccgcgggcgtcgccctgcgcgagcagttcggccgcgatgagacccgcctcgacggtcttgccgatgcccacgtcgtcggcgatcagcagcctcaccgtgtcctggcgcagcgccatcatcaacggcaccagctggtacgggcgcgggtccacggcgatcgaggcgagggaccggaaggggccggccccggcccggaagccgatccgcagggcggtgcgcagcagaccggcggcgtgctggtcgccgagatcacccggcgtgggcggtgcgaacgtggcgggcaccacggtctccaggccgggcagcacccccgcgacatcgacgtcggcgccgcccagcgggcgcagcacgaggaggtcctcggtggagtcgggcagcac

SEQ ID NO: 2078 - DNA, 1448 bp, Unknown
  Kingdom: Bacteria, Phylum: Actinobacteria, Class: Actinobacteria, Order: Streptomycetales, Family: Streptomycetaceae, Genus: Streptomyces
gccggccggtccgtcgggttcgaccacgcggaagcgttccgcgacgacgagggtgtcgtcgtcgatgaccggggtgcgccccaggtactcgctcacgccctcgcttaggaagaactcctcgtgggccgcccgccattcggccacgccggagtaaccgcgcccctcggccagcgcgaagtcgtcgtcgatctccttcatggggacgacgcgcacgtcgacgagttcgatcgtgacggcaggacggccttcggaatcgagcaccgagaatcgctgaccgggcgccggcaccggctcccgggcgtgctcgtagatctccaggaggcccgtgagcgcggtcttgcgaccgctcacgatcgccgccacaccgcggtcacgttccggcccggggaaggcgagttcgagggccggaaggtcgtcatgcgccatccggcgagcgtacgcagcgcacacccgtcgatcaacccgctcgggcctcgggccggctcaggtgaggcaaggggcacgccccgccgacgccttccgtgccgggacgcggttcaccggacggaggggactccatgggcgtacgagacggtcacggtccgcctgccgccggacgcccaccaggacccgcacaccccgatcgcgtctcctgactggcggtcagggctgacctgtgtcaccgctgacgagcgttcaccgggagccgctgtgcacaccgcgtgcccgatcttggtctaggatccccggatcgtctcacaggggggagggcccatggccgaggacagcgcggtcaccggtagcggcgcggaagccgccgccgatgtcgtggaggaggaggcggtgcggctggtgtaccggccgcagcccggcgacacactggtcggcctgcgggtccgggcgcggatcaagcgctgggggctggtgctccgcagcgtgttcctcgtgctgtgggtgggccaatggctggtgggcaccatcaaccggggcagtgccgaggcggtctccaccgccctgttcctgttcgtcgtcctggtggtggccggctacccccggctgcaggccggccaggtgcagcggctcgtcggatggcagggcgagtaccgcaccaccgtctcgccggccgggatcaccgccaggagcgactacagcacgctcatccagaagtggtcggtcctccagggctaccgggagacgcgcggccacttcgtcctgctcagccgggaccccaacatcatgtgcctggaggtcctgcccaagcacgccctgagcacggccgaggacgtcgaccggctgcgggccctcctggaccggtacaccacccgcgtctgacgtccacgggcacggacctggcccccgcgccgcacccccggaccgtgccgagcgggcgggcgcgcgggcagcctcgcccggtcgggcgcggggaggtcagccggtcggcagggagccgccctggacggcctggatgt

SEQ ID NO: 2079 - DNA, 592 bp, Unknown
  Kingdom: Bacteria, Phylum: Actinobacteria, Class: Actinobacteria, Order: Streptomycetales, Family: Streptomycetaceae, Genus: Streptomyces
gcacgcccgcgggactgctgccgcgggcgtgccgtccggctcggaggcaccggggcctatgccgtccgggcctgtgccgtccggctccggagcaccgtccgtcctgcgctccgccgccgacggcctgctggggggctgggccgaaagcgtcacgggatcctccgtgtgatgtagggccaagcggcctgtcctgggctgtcgctgtcgctgtcgctgtcactgtcagctgcgtcggaggacgtcgtgggaacacggaacgccggcccggccgcgcggtcggcggtcctctcgtccgtgccgtccccgccctccgccgtacgtgtcccggtccccgggacctctggtacgggcgtggggtccggcagactgtccaccggtaccaccaggggagcggccgccgcggcgttgaccatcagcaccgcgcccgaaccgcgcaggcggcccgcgagttcgcccgcggggagggtgtcatggaccagtgccggggacatgaactgatgcgccggggaagtgaacgccaggaccaccggcgccccgtcggcccccgccgccgtcagcgggcggccgtccgtcccgcgcaccacgctcacct

SEQ ID NO: 2080 - DNA, 528 bp, Unknown
  Kingdom: Bacteria, Phylum: Actinobacteria, Class: Actinobacteria, Order: Streptomycetales, Family: Streptomycetaceae, Genus: Streptomyces
cggcaggtcgagcccgccgaacagcccggtcagcacgtcgcggatcttggcgttgcccgcccactcgtggtcggcgaggtcgccgatgacctcgtggcggacggtcgcctccgggtcgagcgagtcgtgctgcgtgagcacgccgaggcgcagcccgcccgcgtgcgtgacccgcccgctgtcggcctcctccgccttggccagcatccggatcagcgtcgtcttgccgtcgccgttgcgcccgacgaccccgatccggtccccttcggacacgccgagcgacacaccgtcgagcagggcacgcgtgccgtacaccttgctgacgttctcgacattgaccaggttgacggccatttcactcctgcccggggggatggatcagctttcaagcgtagggcctccgggaggggggcctcagcgtgggcgtgtcatcactctttgtgatgatgtgaccgggattcggccgctccggcgggaacgcaggtcgcaggatcccgcccgtgggaggaaccatgactgccgagccga

SEQ ID NO: 2081 - DNA, 1313 bp, Unknown
  Kingdom: Bacteria, Phylum: Actinobacteria, Class: Actinobacteria, Order: Streptomycetales, Family: Streptomycetaceae, Genus: Streptomyces
ccgcttccacgaggccgcggccgagcggcgtacggaggtcgtcctgtggggcagcggcactccgcgccgcgagttcctgcacgtggacgatctcgccgcggcctgcgccgtgctgctgcgctcctacgacggcgacgagccggtcaacgtcggctgcggcagcgacctcaccatccgtgaactggccgccaccgtcgccgaggtcaccggtttcaccggccgcatcgtctgggacacgaaccggcccgacggcaccccgcgcaagctgctcgacatctcgcggctcgcacagctcggctggaaaccggcgatcgagctgcgggacggcatcgccgccacgtacgcccactggcgcgcgggcctcgacgacatcgacggccaagacggctgaggaaccacggccgggcacgggccccggcggcgcccagcgcacgccggggcacggtgcggacatcagcggcctcctcagtacgccccgcggccgtcgaggacggcgcggaacgtgcgggccatgacatccacgtcgctggtgaacgaccagttgtcgacgtaggcgagatcgagccggaccgtctcgtcccaggacaggtcggagcgtccgctgatctgccacagcccggtcatcccggggcgtacggacagccgccgccactcgacgggcgtgtagtgcgccacctcctcggcgagcggcggccgcggacctaccagggacatgtcacccttgaggacgttgacgagctggggcagttcgtcgagcgaggtgcgccgcagccaatggcccacccgcgtgacccgcggatcgcggcgcatcttgaacatcgggccgtcgtgctcgttctcctcggtcagggcggccttctgccggtcggcccccacccgcatggtgcggaacttccacatcacgaagggccggccggagcggccgatccgctcgtggagatagagcaccggtcccgccgaggagagcttcaccgcggcagcgatcaccagcagcaccggggccagcacgagcagaccgagcagggccgtgctgcggtccagggcccccttgagcagcggctggacaccctcccgcaccggcggggcgacgcgcagcagcgacattcctccggcggacccggtctccagccgcttgacggacacctccaccagcccgggcgcgacgaacagctccagaccggcgtcgtgcagcccccaggacaggcggcgcagccgctccccggcgagccccggccccgggacgaccagcgcgagatcggcgccgagccggtgcacctcgccgacgaccagatcggcgtccgcggtgggggact

SEQ ID NO: 2082 - DNA, 511 bp, Unknown
  Kingdom: Bacteria, Phylum: Actinobacteria, Class: Actinobacteria, Order: Streptomycetales, Family: Streptomycetaceae, Genus: Streptomyces
gaccggcagcaccgcccacagcagcaccgcgcagacgccggcacggcgcccgtacacgtggtcggccaccgcgaagatcccccaggccgccgcgagcgaggcgagcacgctgacgacgaagcccgcgtcggcgtacgacagcgggcccaccgcggcccccagccgctccagccagggcagcagcgggaagaaggccaggtcggagtggacgtcgccgttcggcaggcgcacctggtagccgtagccgccgccggcgaccctggcgtaccagagggagtcccagcgggcggtcagcagggtgtacgcgctcttgccgcgcgccgcgctccagacggccaggagcagcaggcccagggcgcgcacggccgcgtacccgcacagggcgggggcggcccggcgcacggctgtcgggcggggcaccgccacacgcgtcgcgagatcggtcacgggctcgattatcgaccgggcggagcggcgggcggacagccggggcgcccgggccggacggcgg

SEQ ID NO: 2083 - DNA, 1032 bp, Unknown
  Kingdom: Bacteria, Phylum: Actinobacteria, Class: Actinobacteria, Order: Streptomycetales, Family: Streptomycetaceae, Genus: Streptomyces
ttggccgcggtggacttggcggtcgcgggcttgggggctgcggcccggcctgccgcggctttgacggcggcggtcttggccgcggtggtcttggccgcggaggccctggtggccgcggttttggctgtgctcgccgtcgatgtctgcttggccgatgccggtgccttgttcgccggtgcgctgttcgccggtgcctcgcttgcggaggtcttgcctgccgcgggcgggctcacggcggccttgcgggcagcagccctgcgggcggtggccctggccggagccgtctcgttcgcggtggccttcccggcagtggtcccgcgcgcggcggccccgacccccaaggacgccttcacggcggtggccttcgacgcggacgccttggtcgtggtcttggccagggacgacctggtccggctccggcctccggcggccgcctcgggctgctcccgtgtgcgcggtgcgccgtccgtgcgccgtccaggggacgagggctgttccgggtgttcggggtgttcggcacgggggcgggtgagccaggccaccgcggcaccggtgagcgccaccggccactcgaccagcccggcgatgccgagcacgccggcacccatgtagatcgcgagccgccgtccccggggcgacacggcgccgaccctgtccagcgtgccctgtgcggccctgcccacggtgccggcgccgggcaccctgcgcagcaccgaggcggcgccgtgcaggggcatcgtgaggaccgacgacttctgctcagccatgactctcctcgcctgggatgagtacccacgtccgtacccaccgggtgcccgcggccgcaccggtcatcccgccttactcagggaactcatactcagggaacgtcagggtcgcgctacgcgccaccgggacccgccgctcggtgtcggcccggcaccgctgtcggcgcccggagtggcccaggtgagagcaccgccggtgcggcggggggccggctaccggccggcccagcccagcacctcctcggtcagctgccgctgccggtcc

SEQ ID NO: 2084 - DNA, 1150 bp, Unknown
  Kingdom: Bacteria, Phylum: Actinobacteria, Class: Actinobacteria, Order: Streptomycetales, Family: Streptomycetaceae, Genus: Streptomyces
gcggcggccggtgcggcggcgcccaccgctgccgccgcccaggtgctcgcactcgtcaacgccgagcgtgcgaaggtcggttgctcggcactgacctccaacccgacgctggccaaggccgcgcaggcgcacagtgcggacatggcggcccaccagaacatgtcgcacaccggctccgacgggtccgcccccggcgaccgcatcaccgctgcgggctacgactggagcacgtacggcgagaacgtcgcctacgggtacgccactccggagcaggtgatggcggcctggatggcgagccccggtcacaaggccaacatcctcaactgttccttcaaggagatcggcgtcggcctggcccagcccggctcctactggacgcaggacttcgccaccagccgctgaacggcgctccccgtcggtcaggcgctgcactcggcgcgcacggcgtcgaccgcgtggtgcgcgtccgtcgcgcccgaggagttccagtccttgccccggtcgtgcagccgcaccgcgaagacaccgtcggtgatcttcacggacggtgacgtcacccactgcccccggtggtcgacctggtcgacgctgaacccggtcagggtcgcggcgctcgcgctcgacccgttgtgcagggtgtagtacgacgggtcgccgcccacgtgcttgacgctgctgtcgtccggcacgaacacactgacccggcagctgccctgggccacggcgcccgtccggaagacccacacggcgctgttgacgctgtcgcgggagtcaccgctcatcggcagcgaacggaaccggcccgagcagccgttggagctgtaaccgcccgtgtgggtggtccatccgtcgtcgtcgttggcgaccttggacgccccgtactcggagtacgaggcacccggggaggagcagtgcggaccgccgtacccggagtacgtggccgctgccttgaacgagctgtcggacttcttgctctgctgggccgggggcgccgccggccggccggtggagtcgccgccgcccgcggtacccgtgccggtcttcttctccgggctgccgccgccggcggtcttgtcctcgccgcccgtgtcggcgacggcgccggacggggacacggcaccgtcgggcacggtacccccgggcacggtgc

SEQ ID NO: 2085 - DNA, 934 bp, Unknown
  Kingdom: Bacteria, Phylum: Actinobacteria, Class: Actinobacteria, Order: Streptomycetales, Family: Streptomycetaceae, Genus: Streptomyces
ggtgatcacctcgctcggctgacgcgcccggcggcccaggggccctagcgtggcgggcatggacgagcagcgcgtacccgagggcgggccgccgcggtcatggcggcacgggcccccgtggcggcaccgcgccgacgggcaggagcggcccggcgcccactggccgtggccctccaccgcgctcttcaccgccttcgtgatcctcggcacgcacttctcggcccgcgcccagggccaccgcgaggcactggacccgtacgcctacgccctggtggtcgtggcggccgggctgctgctgtggcgcaagcggtacccggcgttcgtcgcgtacgggaccgcggcggccaccctggcctacttcgccgccggatacccgaacggccccgtcttcctgaccgtcgccgtcagctgcttcagcgccgtcgtcgccgggcggcgccgggccgcctggacgtccgtggcactgctgtgggccggacacgcgctcatcgcgctgtggctccaccgctggctgccgccgcccggcggcacgggctccggctggggacagcaactggtcatcgccacctgggcggtagccgtcgtcgccgtctccgaactggcccgcgtccgccgcgagcagtgggccagggaacgcgccgagcgcgcccaggcggcccggcggcgcgccgacgaggaacggctgcggatcgcccgcgaactgcacgacgtcctcgcccacagcatctccgtcatcaacgtccaggccggagtcggcctcgccctgctcgacagcgacccggaacaggcccgcaccgcgctcaccaccatcaaggccgccagcaaggaggcgctcggcgaggtgcgggcctgttccgggtcgctgtcgagcagggcgaggccgactccggcctggacgttgatgacggagatgctgtgggcgaggacgtcgtgc

SEQ ID NO: 2086 - DNA, 1576 bp, Unknown
  Kingdom: Bacteria, Phylum: Actinobacteria, Class: Actinobacteria, Order: Streptomycetales, Family: Streptomycetaceae, Genus: Streptomyces
cccttccgcatgcggcccaggtcctgggccgggagcagggcgacctcggtgtgctcgaccgggatgcggtcggcgagcggcacgtggtcctgggcgagctgcgccttgacctgggcggtgaccggggcgaggtcgacggtgaccgggcggtcgcggtcgtcctgctggtcgcgcagggcgcgcaggacggcgtcgtgggcgacccggttgccctcgttccaggcggtgcggaaggccgcggtctgcgtgaacgagcggaccgcgtcgtgcacgaagggtgccacggtggcgcgcagcacccgggcgtccgtctcgtggccgatctcgtccacgatgccgtcgccgaccgtgtccgcgatcgcgtcccgcacgtccgggtcggcggcgagcggcgccatcgtggtgacgtagtgaccggtgtcggcgagcccgtacgccgcccacgccgtcagcgcgccgaacggcacgagcaggcatgagagggcgatcagcacggccgacaggccgctgcgcaggcgtcgggtcaccctcccagccaagtcttccggcggcggccgcgcgagtggacgcacggcattcgggtgaccacgcaacggacacgcggggcgggagagggaaacgcgggcggggcacggccggcacgcgcgccggccgtgggttccggtctcctgccggggcccacggccggggtgcgtgccagggggcgtgcgggtcagtcgacgcggcggcccttggcgtcctcgtgcgtgtagacccagtagaagcagatcagccccacggccacgccgaaggccagcgagaggccgatggtcagcaggaccgattcgccggactggttgtagaggaagccgaaggccgcgccggcgaagaggaaccacaggaaggcgtgcagttcgcgcggcagccgcgaggccagcatcagcacgcccgccatgatcagcgtgaacacgacggcggtcacgaagccgaacaccaggttccccacggtgatcggcccgccggagcgccggttggcggcggcccagtagccgtagacgaggctgatggcgaacgtgcccgcccaccggccgacgaggtgcgtgcgggcgtcgaagatgtcgggtgtcctcggatgccgggcgtggggatccgcgccgcggcccgacagtgccgcatgagccatgagagcgctcctctctctcctcgcccccgcctaccagagcacacctgggcgacggccctggcaagtcggcggacagggatgtctccccggtccgcgcatctgcgcaggcggatgtcccaccgtcccgcacatcggcggaggcagatgttccacggtccggcacccgcccgcgcaccagcagcggttacggtgctgaggtacgcgaccgacgaccggatcaccgcggggggaccatgcccggaaccgtgctgctgctcgcggcctcgcccgtgggcaagggccgcctggtcgacgcggcgtccgtgctgccggtgctggccgccgtcgagcccgccgtgctgtccggcacccgcaccgcgagcgtcgtcgaactcgccgacccgctggagccgcaggccgtcctcacccggctgc

SEQ ID NO: 2087 - DNA, 2331 bp, Unknown
  Kingdom: Bacteria, Phylum: Actinobacteria, Class: Actinobacteria, Order: Streptomycetales, Family: Streptomycetaceae, Genus: Streptomyces
gctccgggccaccggcggcgcggagccggtcgcgctcgccgagcgggcggcgcggctgttcgccgccggggggacggcctgcgtggtcgtcgactgcgagtcgggaccggtgcggctcggcctggccgggcggctcgccggtgaactgggcggtacggcagtgacgttggacgagctgcgcgcggacagcatcgccgggctcgtacgggatgtgcagggaacttcgaggagggccgcgtaaatgccgcagggacagccgagtgtcgtaccggacgacgggctgacgacacgtcagcggcgcaaccgggcgctggtcgtcgtccacacgggcgtcggcaagggcaagtccaccgccgcgttcgggctggcgctgcgtgcctggaaccagggctggccgatcggggtgttccagttcgtcaagtcggcgaagtggcaggtcggcgaggagcgggcgctgcgcgtgctcggcgactccggcgagggcggcagcgtcgtgtggaacaagatgggcgagggctggtcgtgggtccagcgggacgcccagacggacaacgaggccaaggcgcgggaaggctgggagcaggtcaagcgcgacctggccgccgagacgtaccggctgtacgtgctcgacgagttcgcgtatccgctgcactggggctggatcgacaccgacgaggtggtggaggtgctgcgcggccgtccgggcacccagcacgtcgtgatcaccgggcggaacgccccggagaaactggtcggcttcgccgacctcgtcaccgacatgaccaaggtcaagcacccgatggacacggggcagaagggtcagaggggcatcgagtggtgatggtgacaccgtggtgacgtcctcctcgccgtccgcgcctgtgtcctccccgaccgccgtgccccggctggtcgtcgccgcgcccgcctcgggcagcggcaagaccaccgtcgccacggggctgatggccgcgctggcccggcgggggctcgccgtgtccccgcacaaggtcgggccggactacatcgaccccgggtaccacgcgctcgccaccgggcgggcggggcgcaacctggacgcctacatgtgcgggcccgagctggtcgggccgttgttcctgcacggggcgcgcgggtgtgacatcgccgtcgtcgaaggggtgatgggcctgtacgacggggcggcggggcagggcgagctggcgtccaccgcgcaggtggcgaagctgctgcgggcgccggtggtgctcgtggtcgacgcatcctcccagtcgcggtcggtggcggcgctggtgcacgggttcgtgtcatgggacccggaggtgcgggtcgggggcgtgatcctgaacaaggtggcctccgaccggcacgagacgctgctgcgggaggcgctggagtcggtgggcgtgccggttctgggggtgctgcggcgggcgccgcaggtggacacgccgtcgcggcatctgggtcttgtgccggtcgccgagcggcgggctgccgcggtggacgccgtcgcggcgatggcggcgcaggtggaggcgggctgcgacgtcgccgcgctggtggcgctggcggagagcgtgggagccttgtcgtgtacggcctgggacgcggccgaggcggtggggggttcgcccccggcggacaccggtcaaggagcaccggtgagggtcgccgtcgccggggggcccgccttcaccttctcctacgccgagcacaccgagctgctgaccgccgccggcgccgaggtcgtccccttcgatccgctgcgcgacgaggagctgcccgaggggacgcgcgggctggtcatcggtggcggttttcccgaggtgtacgcgggtgagctgtccgccaacgaaccgctgcgcaaggccgtcggtgacctcgcgcgcgccggtgccccggtcgcggccgagtgcgccgggctgctgtacctgtgccgggagctggacgggaaaccgatgtgcgcggtgctggacgcctccgcgcggatgagcgggcggctgacgctgggctaccgggacgccgtggccgtgagcgacagcgtgctcgcgggcgccggggagcggatgcgcgggcacgagttccaccggacggtcgtggagccgggtgccggcgccgcccccgcctgggggctgcggacgccggtccggcgggtcgaggggttcgtacaggacaacgtgcacgcgagttacctgcacacgcactgggccgccgcgcccggtgtggtccgtcggttcgtggagaggtgccggacgtcatgagcggcaggccggccgtgtccgcaggcgcgtccgggcccgcgtccgcgtccgcggtcgggtggcgggc

SEQ ID NO: 2088 - DNA, 1413 bp, Unknown
  Kingdom: Bacteria, Phylum: Actinobacteria, Class: Actinobacteria, Order: Streptomycetales, Family: Streptomycetaceae, Genus: Streptomyces
ctgccgcgccgccgccaggttgaccgcccgcgcggcctcgcgccgccccaccggccgcgccccggcctcggtcccggtgggagcgggccctaggcccagcgactccagcaggtactgctgcgcgggcatcagccgctcccatcccgtacgctgcgccgccgcccacgccccgagatcctcgccctgtacgatgacctgcccggccgcctcgggcagcgggccgccggccccgacgtgtgcctgcaagggcagcgcgcagcgtggagccggtctgccatcctgggagaatgtctgaccagcgcttccacctcaccctgaccgtcgccggccgcccggccgcgcatggctggtgggcgagtgaggagaccgcgcggggcaagttcatccggtgggtgggcgagtacggcggcctgccccacgctcgcgtctccctggtcgacgaaaccaccggcgccgaactgacggcctggcccgagccgtcgtgtcaacctgccgcgacgcgagtaagtgcctgttttcattccgaggccaagcgttctcccaggtagaaatcgaacggtcgtgaggtggccgcttctcactgggagactgagggctctgtctcagagctgaggagtggaagcatggccacgaggacggaccccgcgaagctggcgcgtcaggcccgagacctgatcgagcagctcaactgtgtggtcctggacgacgcgcgagcgttgtcggcgccagtgctgtcggagaccacccaggcgctcaagcagttggtcgagcggctcccgcaggcgttcgagcagacggccgacgtcttggagatgctcgccaaacaggacaaggtcgtggttgatcgtcaagacccgaaggctgctgtcgctgaagtagcggcagaactgagggccgtcggcgccagcagcgagcggttggcaaaggacctggccaatcccgcctcggccctgttcctcatgggcggccggtaatttcagagtcgcccgaagtccgggccccgaggctcggtgacctcttggtggccctgaccgcggtcagggccacggtgatcagtcgcggtgggcttcgcgggaggctggctgtccgcttctgcgggagcttcggcgggtgattcgcctggtcatgagtgtgatggcggcccaggtgatgagcgattccgagtgctggatgagccgttcgtagtcgcgggcgtgccgacgggcgtgcatgacccaggcgtgggagcgttcgacgacccagcggcggggcaggacgacgaatccggggacgttcttcgggcggctgacggtcttgatcgtcaggttcaggtaggtcttcgcccaggtcacgagctgtccggcgtaggcggagtcggcccagactcgcccgccggtagccccccggcctacgcggagggatccggctcttcgc

SEQ ID NO: 2089 - DNA, 1113 bp, Unknown
  Kingdom: Bacteria, Phylum: Actinobacteria, Class: Actinobacteria, Order: Streptomycetales, Family: Streptomycetaceae, Genus: Streptomyces
ggctcacctcgtccagcgtggcgccggccgggatcccgggcgcgaagtccagcgggtgggcgcccggagccgggcagtccgtgcgcccgcaggagcacgcgccgccgacggcccgcgcgccccgcaccacgtcccagccccacagtcccgtgtactcggccaccgcggtgcactccgacgagcggtacgaccggccgcgccgtcgcgcgccggagcggatctcgcgaatgccgccgatcgtgaaccccatgccccctccaacggatccgtccccccgatggttacgaggcggatgcggaacgtgacgctctgttcccgctccctccccggcgccgcccggttcaggcggcgcccggaagtgtcctgggtggtgcgcgtgacgacacgcgcctcctggtgcaccgctccacccgttcgcggttgtcctatgtcaagtgaatcgcgacaacgccaccgagagttcattcgaaggggtggcgaatggtggcgtttccgaaatccccatggcagcaccggtgatcgtaggattacggtgagtgtgcgagtcctgggggcacatgcgctcgtgggtatgccggaggcaagtcggtagtccgttcgaagggtggcgaccaccggacggcgagcggtattgaccggcattctgatagggcttggcgcactcggcgacaagtggtctcaggaatgggggcgttccagtgagcggcaacggcggtggcgggacgaacgcggcgagtgcggacaagcgcccgaacgagctgctcgcctcgtggttcgtgcgcagcggctggtccaagggagagctggcccgccaggtcaaccgccgggcccgccagctgggcgcgaaccacatctccaccgacacctcgcgcgtgcgccgctggctggacggggagaacccgcgcgagccgatccccaggatcctgtccgagctgttctcggagcgcttcggctgtgtcgtctccgtggaggacctcggactgcgcacggcccgccagacgccctccgcgaccggcgtcgacctgccctggaccggcccccagaccgtcgccctgctcagcgagttctcccgcagcgacctgatgctggcccggcgcggcttcctcggcagct

SEQ ID NO: 2090 - DNA, 521 bp, Unknown
  Kingdom: Bacteria, Phylum: Actinobacteria, Class: Actinobacteria, Order: Streptomycetales, Family: Streptomycetaceae, Genus: Streptomyces
caggtaggtcagctcgcgctccggcgagccgccggtgttgcagaccaccgccagccgttcgccgcccgcccggcctcccgggccgccgatctccgactggatcgcgctcgccatgatcccgaagaaggggtcggcgatgtcgttcacgaggatgccgaccaggtcggaggtggcggcggcgagcgcgctcgcggggccgttgagcacgtagtccaggtcgtcgacggccttgaggacccgctcccgggtggaggcggccaccgggtagttcccgttcagcacgcgcgacaccgtcgcgggcgagacctgggcgcgggccgccacgtccgccagggtcaccgtcatctcgtcgtcctccggtcgcgcatctctcgtcgtacgtgatcaggcaccgtccgcgcgcctgccgcggggccgtggtgccgtgcagaccttacggccactcgcccctttgttcgcccgctcgaacaacacgatgttcgcccactcgaacgcccctgccgacgtcgccccccccgaac

SEQ ID NO: 2091 - DNA, 1628 bp, Unknown
  Kingdom: Bacteria, Phylum: Actinobacteria, Class: Actinobacteria, Order: Streptomycetales, Family: Streptomycetaceae, Genus: Streptomyces
ggtcaggaactcctccgggccgaccgccgtagagctacggcggccggcccggaggagttcctgacccaggtcgacgtccaggtccagctccgcgtcgacgacgagtgggccgaccgccgcctgtggagcggcggcatcggcgtgcacgagggtcccgtcggagcgggcgcgtgctgtccgggcggccagggcggcctggcacaccagatcagcgtcttcctgcgcgaccaggcggagccgggcgccgccggctgacccggccgcgcccggcacgctcccgcacccgtctcagcgcgggagaccgtcgctcagtgcgggatgccgtcgatgatgtcgcgggcgccctgccgcagcagggccacggcgaccgaggtgcccagcgtcgcggcgtccagccgtccggcccactcgtgggcgttcagccgcaccttgccgtccggtgtgaacacacacgcccgcagggacagttcaccgctgcgctcgacctgtgcgtaccccgcgatcgggctgttgcagtgcccctgcagcacgtgcaggaacatgcgttcggcgctcgccgcgcggtgggtggcgccgtcgccgagcccgctgacggtcccgatcagcgcctcgtcgtcctcgcggcactgcagggcgaggatgcccgcaccgatcggcggcatcatcgcgtccacggacagcacctcgctgatcacgtcctgccgcccgatgcgctccagaccggacgcggccagcagcagcgcgtccgcctcaccggcggccagcttctccagccgccggttggcgttgccgcggaagggcacacacgtgaggtgtgggtgggtcgcggccagctgggcgatccggcgtaccgccgacgtaccgatcctggtgccgggcggcagctcgtcgagggtgagaccgccggggtggacgagggcgtcacggacgtcgtcccgcttcaggaacgcggcgaaggtggtgccggccggcagcggccggtccgcgggcacgtccttcaggcagtgcaccgcgagatccgcctcacccgccagcagcgcggcgtcgacctccttggtgaacgctcccttgccctcgaccttcgccagctcgccgagccacttgtcgccggtggtcttcaccggcaccacctcggtgcgcacaccggggtgcaggacggccaactcggcgcggacgcgctccacctgagcgagcgccatgggcgagtcgcgggagacgatacggatcagttccggcacggacatgcgggacacgatagaccttccccacggccccgcgtcacgagcccgacgggcgcctcacggccgtgtgtcgtccggcaggtcggccgccgcgtcctcgggagcgaggtcgggacgcaaccgcagccacgacggctggcgcagcatcccggcccgggtgcggacgctgtagcgcacctcgccgaccagccggggcagcacccagtgcgccgcccgggcggccggcacggggtcgaacgggcacacgtccgtcgccagggcgccgagcagcccggccagctccacccgctcggcctcgctccagccggtgcccacgctgcccacgtaacgcagcctcccgccgccccgctgacccaccagcaccgcgcccggcagacccgtcagccg

SEQ ID NO: 2092 - DNA, 1752 bp, Unknown
  Kingdom: Bacteria, Phylum: Actinobacteria, Class: Actinobacteria, Order: Streptomycetales, Family: Streptomycetaceae, Genus: Streptomyces
tcctcgaagacgacgccgtccaccgaccgcgcccagtcgagcagtccggcgcgccgccgggcggagcaggcgatgccggtggggaactggtgggacggcgtcgtcttcgaggacgactacgacggcgacttccgctacgaccgtgcgccggtcggcgcactccagggcctggaccccgagcacgtcgtctacgcgggctcggtcagcaagtccctggcccccgggctgcggctgggctggctgctcgtgcccgactccgtggccgacgaggtcgtcgaacgcaagcggaccatggacctcggtcatcccaccgtcgaccaggcgctgttcgcccacttcgtcgagcggggcgactacgaccgccagctgcgccgctgccagcgcgcctaccgggaacgccgggacgcgctcgtcgccgccctcgaggagcacttccccggcgtagggctgtcggggatcgcggccggcctgcacctgatcgcggagctgcccgaacggtacggccccgaggaccgcttcctcgcgcgcgtgggcgacgcaggcgtcgcggtgcgcacgctggcggcgtacacgcacgcgcgtgccggtgcggtgggcgaggacggccccgaggacgtcaggggcgtgcgcctggtcctcgggtacgcgcatgtgccgccggcccggatccgcgccggtgtgcggctcatggcggaggcggtcggcgcgcggggtgcctccgcggggtgagcgcggccgtgctgttcacctggggtttccgtgctcgccgtaccgcaccagtaggtgtggctgcgaccactggccggatctcgtccctggaggcgtctccatgtccccttggccccctcgtccctttcccggccgtcgcagcgtgctgcgcggctcgctggccgcgtcggcggccctgaccgtccccggagcgctcggcgcggcacccgcactggccctgtccggtcgtccccgggccgactggggcgtgcaggcgggtgacgtgagcgccgactcgggtctggtgtgggtgcgcgcggaccgcccggcccggatgatcgtcgagacgtccgccaccgagtcgttccgcgacgcccgccgctggcacggcccgctgctcggtgccggcacggacttcacgggcacgacgcggctgcacgggctgccgtcgggcgagcagatccactaccgggtgctcctcgccgacccgcacgacccgcgccgcaccggcgaaccggcgtacggcaccttccgcacggcccccgcgcgccgccgccagggcgtccggttcgtatggtcgggcgacctggccgggcagggctggggcatcaacgagtcgatcggcggctaccgcatcttcgacgccatggcgaagctggatccggacttcttcctgtgcagcggcgacaacatctacgccgacggcccgatccaggccaccgccgctctgccggacggcagcctctaccggagcgtcaccaccgaggagaagtcgcacgtcgccgtctccctggccgactaccgcggcaacttccgctacaacctgctggacggggcgctgcgccggttcaacgcccaggtgcccggcatcatccagtgggacgaccacgaggtgcgcaacaactggtaccccggcgaggtcatcggcggcggcaccccctacccgcccggcacccggctcgacgacctggcgctgcgggcccggcgggccttctccgagtacttcccgatctccaccgtgagcggccgtccggacggccggat

SEQ ID NO: 2093 - DNA, 633 bp, Unknown
  Kingdom: Bacteria, Phylum: Actinobacteria, Class: Actinobacteria, Order: Streptomycetales, Family: Streptomycetaceae, Genus: Streptomyces
ggtgcgcggaccgggccggcgcggcgggccgggcggcggcaccgcaggtctcggcggccagcagatctacggcggcggtcggcccgagctgctcggccgtgcgccgcagccgccgcgcggcgctgccgtccgccaaggcccgctccagcagttcgcgtacggtgtcccagtcgccggacgcctccagcgccgggcggagccgggccagcatgccggtcaggaccgtgcgggcggggacggcgcggcgggtgaccggatcgaccaggggcccttcgagtcccgagcgtgccgcctgccaggtggcggcccgcagccactcgtggtgaccgtcgcaccgggggtgctcccgccgggcgagccggacgcaggcgtcgtgcacgagcgcccggaagagcccggccaccagcaccaccgtcgccacgcgcgggcaggcgtcgcagatgcgcagttccagcgtccgctggtgcgcggagggccgtacgtcgtaatagaccattccggggtcgctgatgacccccgagcggatcaggtcccgcagcagcgcgtcgtaggaggcggcaccgcggtggcagccggccggtcccgccgtgggccagcgctgccacagcatcgtccgccagctcgcgtagccgg

SEQ ID NO: 2094 - DNA, 1072 bp, Unknown
  Kingdom: Bacteria, Phylum: Actinobacteria, Class: Actinobacteria, Order: Streptomycetales, Family: Streptomycetaceae, Genus: Streptomyces
cacggtccggtccggcggcgaagccggactcgcggccgcccacccggtagggcaccgtccgcagaccggccgcgcgcatcgtcgcctccaccgtccagaacacgcgcgggcgcgcggagaacggtcccgcgtgcaccgcgagccgcccgccgggcgccagggcgcgccgcgccaggccgtagaactcctgtgcgtacagcttcgtgctcgccgtgatgcccgggtcgggcaggtcctcgatcacgacgtcgtacgccgacgccccggcccggcgcagccagccgaaggcgtccgccgtggtgacgtggacgcgccggtcgccgtacacatgcccgttcagccgggacagcgccgggtcggtgcgggcgaggcggacgacctccgggtcgagttccacgacgtccacccgctggacgccccggtggcgcagcacctcgcgggcggcgaggccgtcaccgccgccgaggatcagcacgcgcgcgtgccggccggtcatcgccgggtggacgagcgcctcgtggtagcggtgctcgtcctggccgtcgacccgcagccgcccgtcgaggaacaggtccagcggacgcccccgggtgccgccggtgaggacgatctcctggacgccgctctgcagcgccacccgcacgtcgtcgccgtacaccgcgtgccgcgcggcccgttcgaagtcgccgaccatgacggcggccgacgccagcaggccgagcaccgcgacgttggcgaggagcagcagccagcgggcgcgccgggtcagatcgcggcggaacagcccgaggacgaggcagccgccggccacgacgttgaccgcgccggtgagcagcgcgcccgtcaactggcccagcagcgggagcaggaggaacgggaaggcgaggccgccgacgagcgcgccgacgtagtcagcggcgaacaggtcggcgaccgcgccgcccgcgtcctggcggcggatccgctggatcagctccatcagcagcggcacctcggcgccgatcagcagccctatcgcgagcgagaagccgaccagcaggcagcgcggcccgttggcccacaggccgccccc

SEQ ID NO: 2095 - DNA, 1595 bp, Unknown
  Kingdom: Bacteria, Phylum: Actinobacteria, Class: Actinobacteria, Order: Streptomycetales, Family: Streptomycetaceae, Genus: Streptomyces
cggcgccccgtacgtcccggtcgtccaggacctcatggacgccgccgccgcccagtccggcatccagggcggcggccgcgccgccgagctggccgagcgcgcggagtcgtgggtgctgcggcgtgccaccctggtcggcgtcatccacgagacgttcgtcgagcgggtgcgggccatgggcgtggaccccggccgcatccgcctggtgcccaactggtcccacatacaggcgccttccgcgccccgggagcgcacccgggagcggctgggctggcgcccggagcagaccgtcgtgctgcactccggcaacatgggcctcaaacaggggctggaggtgctggtcgaggcggcccgccgcgacccggccacccgggtcgtgctgatgggcgacggcaaccagcgcgagcacctcgccgcccgcgcccgcggactgcccaatctggaattcctgcctccggcggccgacgccgacttccccgacgtgctggccgcggccgacgtgctcgccgtgacccagcgtgcctccgtcctcgacatgagcgtcccctccaagctcacctcctacttcgcggccgcccgcccggtggtggcctgcgtcgccgccgaaggcggcacggcacgcgaggtgctgcgctcaggggccggaatcgtcgtggaaccggagaatcccgatcagtttctctcagcagtgcgtagactcgccgaagatccggcgaaggcagacgagttgggcgcggcgggaccgcgccatgtggccgcccatctgtcgcgggaggcgggtctcgcgcggatcgacgcgctgatcgacgaggctttggggggtctgggcaggtgagcgacgcacacgttcccgtccggggtgaggacgagccggagcagttgcgcgagcagttccgccaactgctgcgctaccgctggctgatctgcggcggcgtcggcgctggactgctggccggcgcctggctcgggatcaccggcgccgacagctacgccgccaccaccgacatcgtgctgcgcgcccccaccagcgatcccttcgcgccgaccctctccagcgacaagacgatcaacatgggctccgagcgccagaccgccctcagccgcaaggtcgccgagggcgccgcgaagcagctcgggatcgccgcggacgggatcgacgggctccagcacgggctccaggtcaccaacccgccgcagaccctcgtgctgcacttcacgtacaccgcctcccgcccgaaggaggcggcgcgccgcgccaacgccctcacgcagtcctacatcgacctgcgcaagcagcagtgggagtccgtgaggggggcgatgctcaagagccttcaggaccagctcgaccccgtcgccaagcagaacgacgaactctccaggcggatcaagcaactgcccaacggctccgccgccgactccgcctacgccgtgcaggccaacctgctcaaccgcatcaccgacctgcgcaacaagatcaccagcctgaaggcgctcgacatgacgcccggcaacgtgatccgcaacgccaccgtccccacctcgtccgacggaccgggtctgccgctctcgctgggcctgggcggcctcgtcgg

SEQ ID NO: 2096 - DNA, 780 bp, Unknown
  Kingdom: Bacteria, Phylum: Actinobacteria, Class: Actinobacteria, Order: Streptomycetales, Family: Streptomycetaceae, Genus: Streptomyces
gctctggcgctcggccgccgacccgtcggacacggccctgcgcgaccgggtggccgacgcggtcgtcgcggcccgcgcctaccggctgttcgcctaccggaacgtctcgcggatcgcggcgggtgaatcgatcggcgccgagtcgagtctgaacaaggtgttctggtcggagctggacatcgcgctgcacgagaccgccctggacctgctcggggcccgcggcgagctgtccgactcggccgccgacgcgcccgcgcacggcgcctgggccgagggatacaccttctccctcgcgggcccggtctacgcgggtaccaacgagatccagcgtgacatcatcgccgagcggctgctcggccttccgaagggacgccggtgatgcggttcctcctgaccgacgagcagcgggagttcgcccgctcgctcgacggcctgctggcgacggccgggactccggccgtcatacgggcctgggcggccggcgacccgggaccgggacgcgcgctgtggtcgaagctggccgacgcgggtgtcttcggtctcgccgtccccgagcgtcacgagggactcggtgtgctgccggtcgaactggccgtcgccttcaccgaactggggcggcacgcggtgccgggtccgctggtggagacggtggcggcggccgccttcctcgaccggctcggcgacgaggaggcgtccgccgcctggcttgcggccatcgcctcgggcgagtcggcggtctccttcgccgtgctgtccgacgacgccccgtacgcgctggac

SEQ ID NO: 2097 - DNA, 825 bp, Unknown
  Kingdom: Bacteria, Phylum: Actinobacteria, Class: Actinobacteria, Order: Streptomycetales, Family: Streptomycetaceae, Genus: Streptomyces
ccgcggccctctccggtgcctccgacggcggcacgctggacgagaaggccgcgcaggcctccggcgacacggccgccaccgccgcctcgctcagccacaccggctggccctacgtcgccgccgccggcggggtgctgctcctgctggccgggctgctcgccctgcgctacggccgtctgtggcccgccatgtcgggccgctacgagcgttccggggcgccccgcacccgcacgcccaagcccctcgatcccgaccgccccgaggacctctggaaggccctggaccgcggcgaggacccgaccggcaccggcccggcctgaccggcgcccggcgaagcccgccttcccgatgcccttcccgatgtgatgaaacgggtgcgcgatgagccacccccgctcacgtcccgtgcacgcgtacgggacaatggagccgagcgtccggctcagacacgtacaagcaacgaggagcaagtcatggcgggcagcagccacggtcacaccccggccgcctggaccggtgtcatcatcgccttcatcggtttcctggtcgcgggcgccttcatggtgatggcccagccggtcggcttctgggtcggcatgggggtcgtgctgctcggcggtgtcgtcggcggcatcatgcgcatgatgggcatgggccagaagaacgagcacccggtgcaccaggtcgccaccaagggcgagccggccggcgtcaagggctgacaccggcaccgccacggcggacccgtacgacacgacgtggaggggcggccccaggccgcccctcacgcgttccccacggcgtgccccgcacccgccccagggc

SEQ ID NO: 2098 - DNA, 1141 bp, Unknown
  Kingdom: Bacteria, Phylum: Actinobacteria, Class: Actinobacteria, Order: Streptomycetales, Family: Streptomycetaceae, Genus: Streptomyces
gacggtgtcgtcggggacgtcggggtgggtgtggagtcgggcgcgggcgagaagctggtcgatggcagtcatggcgggcaggctcacttcgggccggggatatgcaggagtgtttcgagggtggcgcggacgtggtggtcggtggcgtggatgagggcggtgggcaggcccagcaggtaggcgatgcggtcgtgtggaatgccgtgcaggtgctggaggacggcgaggtccatctgctcgtcgggcaggcgggcgatggcgtcgaacaggtcgacgagttcactcagggcgacaagatgcccggggtcctcggggtgccccttttggagcgcctgggtggagaagactgcggcgcgcaggtcggggtggccgttcgtgtggcggtgagcgcggatcacgacgcgggagcggaacaggcgccaggcgtagcggttgaggttggcgctggcggcggcgtgggcccagcggacccagaggatgtcgagcgcttcggcaaccgcccagcgggcgcgtcggtcggtgaggaggaaggcgcgggcgtagcgggtgtagtcgtcctggatgtcttcgatgaacgcctggtaaggcagaggcggtgactccgcctggtgtgcgacttggcgtatggagcggttgatccagtcgtcggctttatgggcttcgcgtgcggctgcggtccacagccggcgcagcggcgggctgggcaggcccagagcgcgggtgacgctgaaggtgatctcccagggcgggtagtagccgttgccgcgtaagagttcgctgatgcgcgttttggagtatccggagaggtcgaccagttcgtccaaggtgaggccgctggcgaacagaacgctgcggacgggttcgagccaggctcggtgagagaggcctgcggccggcgaaataggagccggaggtcggccccgcctcgctgcgggaggctgagctgggccaggaagcggcatcaccacagtcccccttggccatccggccccgcatggtcagcccggcctggcgctgcgccaccgccggcgcctggaacggtggccgggccttcgtcggctcctgtaccggcgagcgaaccggggggtgggtccgcatcaccactcgggctcttgtgggagaccgtgctgcaggggtcgct

SEQ ID NO: 2099 - DNA, 3439 bp, Unknown
  Kingdom: Bacteria, Phylum: Actinobacteria, Class: Actinobacteria, Order: Streptomycetales, Family: Streptomycetaceae, Genus: Streptomyces
ctcgccgccgctcccgagctggccggtgtggagcggctgccggagccgtccgcacgccgggcggcccccgcgttcgtcccgctggacgccctggcccgcccggcctcccggggctgacggtgcacgaggtgtcgatcgccgccgcgctcgtggaacgagccggggaactcgccctggccgagggcgcggagaccgtctcggcggtgaccgtacgggtgggcgagctgtccggagtcgtgcccgacgcgctggacttcgccttcgaggtggtgcgtgcgggcaccgcgctgtccggggcccggctcgtcgtcgagcaggtgcccgcgcgggcgtactgcgccccgtgcgcggccgagttcgctgtgggcatgccgccgttcttctggtgcccgcactgcgacagtccctcgcaggatctgcgcagcgggcgtgaactggccatcacggcgatcgaaacgacatgatgaccgccctgaattgaccatgtgccaggtgtgagaagtgaggcggcggcccgtcggtgcgcggtgcaccggcgggccgccgtcgtcggggcgggtcagcagatgcggggcaactgctcccccagcggcaggtcgacgacccgggtgccgccgaggccggtggagacgacgaccatgccggggtgttcggccacgcactcgccgatgagcacggcgccggtgccctgcgggtgggcgcgcatcgccgccaggaccgcctcggcctcggcggccggtacgaaggcgacgagcctgccctcgttggcgacgtacagcgggtcgaggccgaggaatccgcaggcgttggcgaccgggtcggggaccggcagggcccgttcctggagccggacgccggtgccggaggcgcgggcgatctcgttcagggaggcggcgagcccgccgcgggtggggtcgcgcagcacgtgcacgtccggggtgacggccagcatggccgcgaccaggtccgcgaggggcgccgtgtcactggcgacctcgacgccgaactccaggccctcccgtacgctcatgatcgccacgccgtgcaggccgatcgggccgctgacgatcaccgcgtcgcccggccgggcgcgctgcggccggatgtccacgccctcggggaccaggccgacgcccgccgtggtgacgtacacgccgtcgccgtgcccggcctccaccaccttcgtgtcgccggtggcgatggtgacgccggccgtctcggccgccgcacccatggcgcgggcgatccggtcgacgacggccagttcgacgccctcctccaggacgaacgccgcggacaggaaggcgggccgggcgccgctcatcgccaggtcgttgacggtgccgttgacggccaggtcgccgaggctgccgccggggaagaacagcgggcgtacgacgtaggagtcggtggagaacgccaggcgcgcaccgccgaggtggaggaccgcggagtcgcccatggcggcgagggtggggttgccgtaggcgggagcgaagatgtcctggatgagttccgcggacagggcgccgcctccgccgtggcccatgaccacgaccggctggtcgcgcagcggggcggggcaggtccagttcgcggggtcgacggccgcgtccggggtagcgaggtcagccaacggtgttcaactcctcctgcgggacgcgcgatccctggggggcggacgctccctggggggcggggccgttcatccggcggtacaggtagtaggccgcgcaggcgccctcgctggagaccatggtggcgcccagcggggtgcgcggggtgcactcggtgccgaacgcggcgcactcggtgggcttgatcagcccctgcagtacctcgcccgcgcggcacacggcgggttcctcggtgcggatgccggtgacgtcgaagcggtgctcggcgtcgtaggcgcggtaggcgtccgacaggcgccagccgctggcggggatgcggccgatgccgcgccaggagcggtcggcgacctcgaagacgtcctggagcatccgcaaggcggccgggttgccgctctcgcgcaccgcgcgcgggtaggcgttgtccacccggtgctcgccgcgctccagttggtggacggtgcgccggatgccctcaaggatgtccagcggttcgaagccggtgacgacgatggggacgcggtgccgttcggccagctccgggtactcgtcggtgcccatgacgctgcacacgtgcccggcggcgaggaagccctgcacccggcaggccggggccgtcatgatcgcctcgatggccggggggacccggacgtgggagacgagcaggctgaagttgtccaggccgagccggcgggcctggtggacggccatggcgttggcgggagcggtggtctcgaagccgatggcgaagaacaccacctgccggtccgggtgctgctgagcgagccggagcgcgtcgagcggcgagtacaccacccgtacgtcgccgccctcgcccttgacgcggaacaggtcccggtcggtgccgggcacccgcagcatgtccccgaaggagcagaagatcacctcgggccgggcggcgatctccagtgccttgtcgatgacttcaagcggcgtcacgcacaccggacaccccggcccgtggatcaactccacctcttcgggcaggagttggtcgatgccgtgccggatgatcgagtgggtctggccgccgcagacctccatgagtgcccaggggcgggtcaccgtcgcacggatctcgtccagcagccgccgggccagggcagggtcgttgaactcgtcgatgtacttcaccgggcctcactcccgctctcgtcgcgcgccgccggggccgcccaggcgggcggggcggcacgtccggcctgctgcgccgcctgctcccaggcgtcgccgaactcctccttcaggagccccagttgctcgaacagctccagggacgcccgggccgattcctcgtccagccgttgcagggcgaagccgacgtggacgatgacgtactcccccacccgcaggtcgggcaggtactccaggcacacctgtttgctcaccccgccgaagtcgaccactccggtgagcgggtccgcgcggtggtcgatggacacgaccttgccgggcactgccaagcacatgggtcactccgtctcgtcgctgtctgagagccgcccggcgatcacgagctgcccgagggccagtccgccgtcgttcggcggcacctcgccgtgccgcaggaccgtgaagccgtcgccggccagcagcacggcgcactcctcctccagcagcccgttggcgaagacgccgccgctgaggacgacggtggtcagtccggtgtcccgtcgggcgcgccggcagatccgggcgacggcccgcgccagcccccggtggaaccgtgccgcgagcaccggcgccgatgctggaggcactgctggccgaccggcggtcagccc

SEQ ID NO: 2100 - DNA, 3123 bp, Unknown
  Kingdom: Bacteria, Phylum: Actinobacteria, Class: Actinobacteria, Order: Streptomycetales, Family: Streptomycetaceae, Genus: Streptomyces
atcggcgccggtacgggcatctccaccgccctcctgcacgagcgcggcgcacaggtcctggccgtcgaacccggcgacggcatggcagcccagctccgcaccgaccaccccggcatcccgatcgtgcgcggcaacggcaacgccctcccgctcgccgacgactccgccgacctcctcacctacgcccagtcctggcactggacggacccgcaccgctccgtccccgaagccctgcgcgtgctgcgccccggcggcgccctcgccctgtggtggaacacggacgccctcgacatcgactggatcgccgaggcgagccgccgcgccggccgcttcttcggcatcgacatccccgccgagaagcagcgcgccgcccgcaccgagctggccgaccccacgggccgcctccgcttcacccgccgcgagctgcgctggagccgccggatccccgtcgacacccacctcgccaacatcggcagccactcgttcttcctggtctgccccgaggaccgccgcaccgccttcttcacccaggagcgcgaccacctcctggacgtcttccccgacggcatcgtcgaggagacctacgacgtcctcctcctcgtggccacgaagccctgaccgaccccgcccggacaccggcagcccggtcgcgcccgcccccccgcggcttcgcccggccgtccggtcccacccggcctccggatgtcccgccagccggacaaccccccgtgcctccgaccgccggtgcgaggatgaaccccatgagccagaaagtcgcagtcctcggcaccggcaagatcggcgaagccctgctcagcggaatgatccgggccggctgggccccctccgacctcctggtcaccgcccgccgccccgagcgggccgaggaactccgcgcccgccacggagtcaccccggtcaccaacgcggaggcggcgaagaccgccgacaccctgatcctcaccgtcaagccccaggacatgggcaccctcctcgacgagctcgccccgcacctgcccgccgaccgcctgatcatcagcggcgcggcaggcatccccacctccttcttcgaggagcgcctggccgcgggcaccccggtcgtccgcgtcatgacgaacacgcccgccctcgtcgacgaggccatgtccgtgatctccgccggcacccacgccaccgccgaccacctcgcccacgccgaggagatcttcggcgccgtcggcaagacactccgcgtccccgagtcccagcaggacgcctgcaccgcgctctccggctcgggacccgcgtacttcttctacctggtcgaggccatgaccgacgcgggcatcctgctcggcctgccccgcgacaaggcgcacgagctgatcgtccagtccgccatcggcgccgccgtcatgctccgtgacagcggcgaacaccccgtcaagctccgcgagaacgtcacctcgccggccggcacgacgatcaacgccatccgcgaactcgagaaccacggggtgcgcgccgcactgatcgccgcgctggaagccgcccgcgaccgcagccgcgagctggcctccggcaacaactgatcccggcgccgctgcccgccggctcagcccctcaggcgggcagcagcccgatcgcccggtacgccgcgtccaccgtcggccgtgccatctccctcgccttcgccgctcccgtccgcaagacgccctccaggtacccgggatccgcgcacagctccctgtgccgctgctgtacgggcctgaggagttcgaccacggcctccgcggtgtccttcttcaaggcgccgtacgactcgtacacaccgctcaggtcctgcgggctgccaccttcgcaggcggccaggatctccagcaggttcgcgaccccgggccgctcctgccggtcgtagacgacgtcctgcccgctgtcggtcaccgcccgcatgaccttcttccgcacgacgtccggctcgtccagcagatagacgatgcccggccccgagtcgtccgacttgcccatcttcgacgtcgggtcctgcaggttcatcacccgcgccgccaccttcggcggcgtcgccttcggcaccgtgaacgtgtgtccgtagcggtggttgaaccgcacggccaggtcccgggccagctccacgtgctgcgtctggtcgtccccgaccggcacctcgtccgtgtcgtacgccaggatgtccgccgccatcagcgccggataggtcagcagcgacagccgtacgctcccgccccggccctgctcgcgcacggacttctccttgtactggatcatccgccgcatctcgccgtcggtggccacgcactccagcagataggacagccgggcgtgctcgtccacgtggctctgcacgaacacggtgcactgctcggggtcgagtccggccgccagcagcagcgtcgccgcctgccggctcagtctgcgcacgcgcgcggggtcgtggtccacggtcagggcgtgcaggtcgacgacgcagaacagcgcgtccgcccggtgctggtcggcttcggcccactgccgcatggcgcccaggtagttcccgagcgtcaggtgcccggtcggcttgaccccactgaagacccgtgtcatctccactccatctctcggtcgaggccgccgtccccggccggccggcccccggagtccctggagggagaaacgagaacggccgccgaggcggcggccgttgtgtgcgtacgtgagcgcggccgccgtcaggcgggccaccactgctggtcacacgtacgcgtagtcatgacgaacacagtacgcccggacgcccctcggagccatgagttgacacgccccgccggggtccgtaaggtacttcgagttgtccgacgtgagagccgactccggtcggtccccgggcagccactccgcaagtactcatgaccactcgacgacagtcgttcagtctgtctgccgtcgtgcattgtcgtgcgtattcgcggaatgaggaatccgcgttcgagaggacgcagcccccgattcgctcgggagcacggaatccgctaaagtctcactcgtcggaacggcccaacagccgggaagacaaaccccgctgaccggggatcagatcgaaaaaggatctgatagagtcggaaccgccgg

SEQ ID NO: 2101 - DNA, 1097 bp, Unknown
  Kingdom: Bacteria, Phylum: Actinobacteria, Class: Actinobacteria, Order: Streptomycetales, Family: Streptomycetaceae, Genus: Streptomyces
cgccgaatggcacgaccgccgggagatcagatgggaggtgctggccgaggcgccgctcgggaacgctgctctcagcgtcccggcgcctgtccgcgccggatccgccacgtagcaggaagcgagctgggggactgcccaccgtgccgcctcgcgcaggagcgaccgtccgacgaatctgcgggccgccgcgggagtcgtcctgggcggggcagcatcaaggcgcggcaccggtgtctgggcggtcgggaaggtgggtgtgggtgccgcggcgcaggcgggctcgtagcctggaggtgctcggggctgatgagagagggctgtccgtatgcctcgaacgatctggtccggcgctatctcgttcggcctggtcacggtgcccatccacgtccagtcggcaaccgaggaccacagcatccgtttccaccagtaccacctggaggacatgggccgggtccgcaaccgcaaggtgtgtgagctggaggaccgcgaggttcagcagtcggagatcggcaagggctacgagtggtcgaaggaccagatcgtcccggtcagcgacgccgaactcggcgccttgcccctgccgaccgcgaaagcggtcgagatcgatgcgttcataccgctcgaccagatcgacccggtgcgcctgggggagggctactacctcactccggacggtcaggtcgccgccaagccctacaagctgctcctgcaggccctgggccggtcctcgcgggtggcggtggcgaagtgggcctggcacggccgcgaacgcctgggcatcctgcgggtcaaggacgacgtcctggtgctccagctgatgcgctggcccgacgagatccgagatccgggcctcgtggatcccccgcacgcggacgtgacgcaggaggagatcgacggcgccctcgccctgatggagaccatggcgcgcgaggacctggccggcgaggagttccgcgacacctacaccgaggccctggaacagatcatcgaggccaaacgggagcaccgcgaaccggccccgacacccgagccgcaggagaagccggcacaggtgctggacctgatggccgcgctgaacgcctccgtgcagaaggcca

SEQ ID NO: 2102 - DNA, 1503 bp, Unknown
  Kingdom: Bacteria, Phylum: Actinobacteria, Class: Actinobacteria, Order: Streptomycetales, Family: Streptomycetaceae, Genus: Streptomyces
ccgaagccccgcatgcccgcgcccgccggaccggccgtcgggatggaaccggtgtgcgccgagttcaccgtgctcagcgtgtacgccgtcggaccggccaggcaggtcaggacgcccgcgccggccacggcgaccgcgagccgcctgccgatccgggagacgaagaccagcccgagggccgcggccaggccgccgaccaggaccagccacctgagccacggcaggtaggagggcgagcggtggagcaggacgtacccccacgcggcggtcgccgtgacgacggcggcgagcacgagcgagacccatgcccgggaccgctcccgccacagcgcggtcacgcccatgcccaccacggcggcgaggtagggcgcgagggcgaccgtgtagtactggtggaagatgcccgccatgtaactgaagacggccagggtcatcagcagcgagccgccccaggccaggaaggcaccgcgggcgaggaaggcctcacgggtggcgtcggtgcgccgtgccttccaggtcaggacgagaccggcgaccagcaggatcagcgcggccggcagcagccaggagatctggccgccgacctcggagttgaacatccggtcccagccggtctcgccccagtggcccatgccgccgccgcgtccgcccgcgccgccaccgccgccgacgctgccggtctcgtcgccgttgatccggccgaggccgttgtagccgaaggtcaggttcaggaagctgttgttctgcgagccgccgatgtacggccgggaggaggccggccacagctcgacgatcgccacccaccagccaccggagacgacgatcgccgccgtcgcgagcgcgagctgccccagccgcctgcgcagcgcgacgggcgcgcagaacccgtagaccagggccagcgcgggcaggatcaggaaggcctggagcgtcttggtcaggaaggcgaagccgaccgcggcgcccgcccacagcagccacttggtgcgcccgtcctccaggccgcgcaccacgaagtacacggtgagcgccatcagcagcgcgagcagcgcgtccgggttgtcgaagcggaacatcagcgccgccaccggggtgagcgcgagcaccgcgcccgcgatcagaccggccgcgggaccgaaccggcggcgtacggaggcgtggaccacggcgaccgtgagcacgcccatcagcgcttccgggacgaggatcgcccacgaactgaggccgaacatccgtactgacagcgccatcggccacagcgcggccggcggcttgtcgaccgtgatggcgttgcccgcgtccagcgagccgaagaagaacgccttccaggacgcgctgcccgcctgcacggccgccgagtagaaggagttggcgtagccggaggcgctcaggtcgtagaggtagagcacggcggtggcgagcagcagggcgaggagggcgggccgggcccagcgcgggtcctgcggcctgccccgccacaggcggcgcgcgaggggctgcctg

SEQ ID NO: 2103 - DNA, 1467 bp, Unknown
  Kingdom: Bacteria, Phylum: Actinobacteria, Class: Actinobacteria, Order: Streptomycetales, Family: Streptomycetaceae, Genus: Streptomyces
cttcacccggtgccggcaccgcgggcaccggccggccgcgtcaccgacctgtccgcgcgacacacctcggcgcactccctcaaggggccgactcccgcagttcggcggtcacggcgcggatggcgtcccggagccagcgctgccccaggtcgccgtcgagccgggggtgccaggccatctggtagtgcagcgggcggatctcctcgggagcctgcaggatccggatcccggggtcggagcgctgctcggcgagcaaccggccgggcagcgtgaggatcagccgggtaccgaggaccgagcgcgcggccagggagtggtagggcacggtcagcccggcccggcggcgtgcgccgaggtcctccaggcgtccttcgatcgcggtctggcgctcgccggtggtgccgacgaccacatgggtggcgtccaggtactcgtccagggtgatctccgggcgctcggccagcgggtggtccgcggagagcaggcacatgaaccggtcgtcgaagagatgctcggtgtgcagcgcggtgagcggcttcgacctggcgtagaagaccaggtcgacgacgccccggtcgaggtcgtcgtagatggcgtcgtgccaggtgcggaagtgcagggtggagcgcggcgactcccggaagacgcgctggaagaccgcgggggcgaacacgcgggcgtagtcggtcccggcgacccggaaggcctcggcggccccggcggggtcgaactcctccggggcgaacaggctctccagccgtggcaggacggcccgcagctgtcgctggacgcgttcggcccgcggggtgagccggtatccgccgggcgtgcgcaccagcagttcgtcaccgagcgtgtcccgcagccgctgcagcgcccggctcatcgccggctggctcattccggcgagttcggcggcgtgcgagacgtgccgctcctccagaagggcggccagcggacccagcagattgaggtcgacgcgttcaatatgcaccatccgaataacctacatattgaagatgcattggacgaatacctggtggtggcggagagttggtcccgtgtccgggcggagcgcacgcggacaccctcgccgggcggctcgcccgccggtacccgccccgctgcacaggcatctccggatgcctgtgcggcaccaggcatccgtccggatgcctccccactaccaggtgtccgtccggatgccggatcaggagcagccatggacgccggatcaggagcagtcatgaaggacgcggaagcggtgagcggacgcgggcggcgccgggtggctgtggtgaccggcggctcgggcggcatcggcggcgcggtcgcgcgccggctggccgcggacggcatggccgtcgtcgtccactacgcgggccgtgcggccggacggacacctggtagtggggaggcatccggacggatgcctggtgccgcacaggcatccggagatgcctgtgc

SEQ ID NO: 2104 - DNA, 1285 bp, Unknown
  Kingdom: Bacteria, Phylum: Actinobacteria, Class: Actinobacteria, Order: Streptomycetales, Family: Streptomycetaceae, Genus: Streptomyces
ccggtggaaggcgtgacgatgaagacgacgggacctggtcgtgccgatcgcgaggacggcggccggaatgacggccaggccggacatcacgcgccggccgccgctgccggccggcccggctccggcgcggccctgcgggagggccgcgccggacatgaccggaggccgatgcgttcacgcacggcccctgaagcgagggtcaggaagtggtgcggccggccggggtcttgccgggggtcagtgtgccgagggccgagtacgcccggcagctgcccgacgcgtcgtagtccgtggtgatctcgaggacccggtgtccgtccggtgaaggcagcagcgcggggctgtagttggggcagggatcgttgcgtacgtcggagacgctgaccggagcctggtgcgcctgccaggtgccccggcctccgctggtgctggtgctggtgaagagggtgccgccggtgcccggggccgccgtgccgctctggtccaccagcatctggccggtcaggaagagggtgccctccctgcccccgcccgcggaccaggccagggtcggggtgtgggcgaaatgctcgcccgcggcgtcggtcggcacggagccgggcgcggccgggtcgccccactgccaggcgtcgcgggaggtccgcaggtgcaccacgcagtcgtcggcccgtccggtcccgcagatctcgtacgtcatgacgtaggtgccggtgggcaggcgccggaccgtcgccatgcccggccgcagcgccgggtcgtcgctgcgcacgacggcccgcgaggccgaccagtggacgccgtcacgggtggacttctcggcgaggaactggctgtgggcgggctggtcggtctcgtcggagtagtacatgaccagccggccgtccgcggccacggtgaactccggttcccacagcccgtgcgtgttcggcgaggcggcggcggtgctcaggtactgccaggtgcgtccggcgtcggtgctgcgccacacccgcagggacatccgccggtcactcgcgccctgacccaccgagcccgcccacagcagtgtgccgcggggcagcgcgccgatgcggcgcggcagttcgtagagcgtggtgcagcacaggccggtgcgggccgcgacagggtcgctcacccgtcccacgcgggcgaaggaccggccgccgtcgtcactgccgtagatgtcgccggccggcccgccgctcgggaaaccggtcacggtggtcaggatgcggccgttggccgcgccgttgtgggcgagccggacgatccgcgggtacatcgc

SEQ ID NO: 2105 - DNA, 1397 bp, Unknown
  Kingdom: Bacteria, Phylum: Actinobacteria, Class: Actinobacteria, Order: Streptomycetales, Family: Streptomycetaceae, Genus: Streptomyces
cgaacggacggactggcaccgaccggggtgagcggtgccagtccgtccgttcgcagcacgtagtagtcgctgccgccgccgggcaccgtcacccggaacacctgccccaccgaggacggctcgccgcccagttccggaccggccccgccgcggccgggcacccggggcggtgccagcgtgggaccgggcgccagcgcgttcaggaacgccgcggagaccgcgaccggggaggcggagccgtacccgagggcgtcacgtgcgtccgaggcggcgtccagcggcagcctgctgccgcgccacaccacgtactccttgccgtccgggcctcgcaccagcagaccgcggtcgccggccaccgcgtcggtccgcaccggagcacccgcgaccacggtggaggctccgggcgcggtgacgggggacggtgcggcgccgtccgtgcccggcagcgcgccctcggggccggtgacgcacacgtgccaggcgccgttgtccagcccgccgttgtccgggacggtgtcgggcgcccccggaatgccgaccggcgcaccgaccggggtcccgcgcagtgaggcgccggagacgtccacggaggacatcgacgcgccgcccatcagccgcgcggaggcgtagttgcgcaccgggtgcagggtgccctgggcgtacaggtagcgcgccccggtgtcacggttgatcaccaggctctcgcccgagcgccaggagtcgttgccgcccggccgcagcagcccgtacacggtggctcccgccgagatcagcaccgtcgccagcaggccgaacaggatcccgcgcgtggtgcgccccagaggactgtcgggcgcgtccgggtcggcgagcagcagccccgaactgagccttcccatcatgaaaccgtgggcctggacctgatcccgtttcgactgcacagcctgtgccccgtccctctcgtccctcagcgttctcggtcgcgtgcccggcgcggcgcggtcagccgaacagcccgcgcagccagccgaagaggccggccacccacagcgccatcggcagcagcgccaccgccaccgcggtgtgcaggatctcggccgcccgcccccagtacggcaggatccggcggcccggcacgacccaggcggccacggtcagtaccgcggcgagggcgagcagcgcgccgaacaccacgggcctgtcccccggtccgctgtccaccgcccaggcccgggccagaagcagcagaccccacacggcggccgacgccagcgccagccgctggcccacgtgcaccaggccgcgggcgtgcagcagcagcagcgccgtgagcgtgcaggcggtgagcgcctcggccgtcccgggccggtgggtcagcgccaccagcgccgcggcggcggtcaccgaggtcgcggtga

SEQ ID NO: 2106 - DNA, 833 bp, Unknown
  Kingdom: Bacteria, Phylum: Actinobacteria, Class: Actinobacteria, Order: Streptomycetales, Family: Streptomycetaceae, Genus: Streptomyces
  misc_feature (407)..(408): n is a, c, g, or t
  misc_feature (653)..(670): n is a, c, g, or t
tggccagttcccagtcgatcgtccacagccggtgttccgcgtcgacgatgaagttctcccggtgcagatcggcgtgcagcaggcagaaagggcgctcgcgcagacccttcaggtgcttgcgcagccgcttgaacgcctcgccgtcgatccgcaggtccgcgaagagctgcccgaagtcagcgaggttgcgggcgtagacctgttcctcggcgaagtggacgagccgctccaggaaggcggcggtgtccccgtcggccggccggtccgcggccgcgcagcggcgctcgacggtgagcatgccgggcgtcacctcgatcaactggccgaagagttcgacgacctgccggaacagcccgcccggtacggcgttcccggacgcgcacagggtcccgagggtgcggccctcnnagtccgatgccgccggcctcgacgaggtccgggatccggcagatccggccctgcagggccgccagcagctgctcctccgaggcgaagcagcgccggtcgaaccacagcaggttgctgcgcggctcacggcacttccaccgcccggggcgcagcacgcccagctcacccgccagcgggaaggcgtacgtcatgtggtggtatcccggcaggggtccctcgaccctgctcgggtcaccgcccgccgnnnnnnnnnnnnnnnnnnccgggccgccccggcgcacccggtcctgagcccggttccgacaaacccggttcagggagatccggctcagatggattccggtcgggtgaatccagtccgagtggagcaagttcgagcggcatcgcgtgtttctttcgccttgaccccccggagggccgcaccc

SEQ ID NO: 2107 - DNA, 847 bp, Unknown
  Kingdom: Bacteria, Phylum: Actinobacteria, Class: Actinobacteria, Order: Streptomycetales, Family: Streptomycetaceae, Genus: Streptomyces
cggcggcagggcacgcgcccaccgtgccgcgtcctcgcgcaggtccgcctcccaccggtcggcgcggtcacgcagccggggcaggccaggcggtgccgggacggccagccggcggctgacacggcccgcgacggccaccagttcgtcgccgtccgcgagttcggccagggacgacgtgccggcccgttccagcagcatcgcgaaacgctcgtcgtcccgcgcgtgcagcaggacggcaccgcgcccgcgccacacggcgaacgcgtccggctcatgcacgttgccgggatgcggaaacgacaccttgagcacggcgggtcgcccgcgcggccgccgtacgggcacgacgaggccgacaccgccgtgcaggaccgcaccgtccggctcgcagccccagcggcgcagcaacccgtccacggtcgccgggagtccggcgatccaggccgctccggccgccgcttcccgcgcgacggtctcccgcgcgaacgcctgaggcaccaccatcatcccggcaccctaccgaccgcgacgacgctgccggagaccggcaacggccgtgcggaatgccgtgcggggcacaggccgtccccggctcggtccgcactctggtcagcgggacggtcgtgcgctataccttcttcgcgtgattgtttctgcttgtttaagtgcactatcaagcacgttcaatcatcttttcaggcatccgccgacgtgtgcgaagggatcgacatgaccgctccaccccgcagacgcaaggcccaccgttccccgggggcagccctggcggccgcggccgtgctcgcggtgctcgcgaccacggccggaccggcgctgccggcccagcccg

SEQ ID NO: 2108 - DNA, 1721 bp, Unknown
  Kingdom: Bacteria, Phylum: Actinobacteria, Class: Actinobacteria, Order: Streptomycetales, Family: Streptomycetaceae, Genus: Streptomyces
tcggcggccgggtcgggggcggcctcgatgacgttcaggtggatgccgttggagaagaagtcgcgggcgccgcccaggaccaggaccgaggtggggcgggtgagggcgtggcggtaggcggcgagcaagcggcggcagtggtcggtgctcatcgcgccgccggggaaggagaacgtcaggaagccggtgtcgccgtgctgccggtagcggatgtcggtccaggtgcggcgttcggcgggcagttcgaacgggacggggtcctcgggcggcgcgtccgggccgagtaccgaggcggccggacgcttgaacggcgcggggtcgcctgagttcttgcggggcctgagttccgggatccacacggcgccgtccgaggtggcccggcacaccgctcccgcgcgggtggcgagcagctcgccggggcgtccgcgcagccggtcctcggggtggccgccgtgcaggaacacctcccggccgaggatctcgtcgagcacgccgggctgggagtcggcaccgcgcagcttgcgcagcacggtggcggtgctgtcctcggcccagtcgatgcgccgccgcgtctggcgcagggcgtcgcgccacagcacgcggaccgacgggtcgctctgcggcagcggcttgaaggatccctcctcgaagcggcgtacggccagcagtacggcggccgtcgccgcgtcggaggcctcgttgcggtacaggtcgctcttgcccacctgtgccgtcctgaagggcatcgacgcccagatgtcgccggcgtccatggcggcctcggcccgcaggaccgtgacgccccagtgcggtgcccgctcggcgatcgcccagtccagggaggacgggccgcggtcgccctcgggtcccgggtgcacgatgaggcaggtgtgctcccgccagagatcttccggcagcgccgtcttcagcatcggcgcgatgatcaggtccgggcgcgcgcgggacacggcggcgcggacggcgtccgggccgtgcgaggcgaggacgacgtccacgcggtgtccgtggtcggtgagttcggcgtagacgcgttgggtgaggctgttgaacgcgctcgcgacgagcaaaatgtccatgacacggcatggtgtccgcttcgccggtcgccgggaaggaccgtgacggcgtttcgtccgcccggccggctcgcgtgccccatccgactcacttgctccgtcgggatcgcgtgctccaccatcatgttcgcctgccccatccggcgcgcgtgcccgaccggtgcgtctgccccgtccggggtgcgtgctccgtccgaagggcgcccgccacgcccggagcgcgtacgcctcgcccggagcgcggtgctcggcgtggcgttgcgttactttctgcttatctgatgtaacagtctgcacatgatttggcagcagaacatcgacagggcccccgtccgtcttgaccgggcccccgttcgtcaccctcgtcgtcgcggactgcgcggggcactgctggtcgcggcgaccaccgccgcactggccggcggccccacggccacggccgcgcccaccggcttcttcaccgccgactgggactcgatcgccgcgtgcgagtccgggggcaactggcaggcgaacaccggcaacggctactacggcggactgcagttcgcccagaccagctggatcgcggccggcggcctgaagtacgcgccccgggcggacctggccacgcgccgggaacag

SEQ ID NO: 2109 - DNA, 1662 bp, Unknown
  Kingdom: Bacteria, Phylum: Actinobacteria, Class: Actinobacteria, Order: Streptomycetales, Family: Streptomycetaceae, Genus: Streptomyces
tcgtccacgacacggctgcggacggcgggcgccgggtcggccgtgtacggggccgcggcgaaggcgccgggacctgcggccggggcggaggagtggggatgcgctgccggggccgcggtggcggcgggcagcgcgatggcggacgcggacacgcaggccagagtgaccgtcatgagccgcgcggctcttcgtatgtccatgggacgggggttcctttcgcctcgtgcaggcggcgcccgccgctgagtcgcacagcggtgagggaggcggcggacacctgcggatgccgtcggccccgctcgcggcgggagcggagccgacgcacgagtgtcgggaacgcgcgaggggagcggccaggcactggggtgagggagaggggtttccctatcgcgtggggccgttcggcggacgttctaggcagcaggcggaatcagcaggtcgacatcagtggtgacgacccgactgcggtcgcgccccgggggcaggaagagcggggagagtgatgccgtacccgcgcggccaactgccttcacgccatgcggagttcggagttccataaataatcgagtgttcaggcgatttatccgtgcatgacatctggtgcggtgctcgtgcccgttcctagactgcggctgcttctccggccctgtccgggcggcagctcatcacctggcccgcgccgtccgtgcggcggcgctccgtgagggaggttccgaccatggtcaagcactacctcaagtacgccctgagcaccctgtccgctgccatgttcgcgcacatggcctgatcccgggccccggcacagtccggggcgggtgggcggacgggcggggaacggaccgcccgtccgcccggtcgggcccgcgtgcgaggaggtgaggccgtacgccccgccggctccggagctctcgcggtcgggcccgcgtgcgcgaggagatcagtgaaggccgccggcccggggttccggggcgggatccggtccaggcgtcaggagggcttcccttgttcggcaccgccctgagtcagctccgctacggcatggccgtgctgcgcaaccgcccgatccggccgcaggacctggagcggatcgcgcgcgacctggtcgccacgctggaggagttcggcgcgcccggcgccgactcggcgctgctgccggggcaggcggggcagatcgatcccgaggtgcggcggacagtgactcggcgcagtctgcgagccacggcgcgggccgcggtccggcacaccgcctactaccggcacgtcttcgagcaggccgggctcgatgccgacgccctcgatccgtacaccgacggttccggcccccgcagttggtcgcgggtgccggtcacgccgaagaaggccctgcgcggcatgcccggggcattcgtgtcggccgcggcgcggcccgcgctgatggccctcaccacggggaccagcggaacacccaccgccgtctggtactcccgtgccgaactcgacgtcaccatcgcgctcagcaccatctcggccgccctcggcatgggactgcgcccgcaccacaccctcgcctacgccggctgctcgcgggccacgctgccgctgctcaacgccgaggagtcgacgacgcgggtcggcgcgtccttcgtccagttcggcacgctcgcgcccgccctggccctggac

SEQ ID NO: 2110 - DNA, 872 bp, Unknown
  Kingdom: Bacteria, Phylum: Actinobacteria, Class: Actinobacteria, Order: Streptomycetales, Family: Streptomycetaceae, Genus: Streptomyces
gatccggtacagcgactcgaactgcagccaggacacgaacccgacaccgaacaggcatcccgccgcgaagagcagccagtaccagcccgggaaccgggcgccggccagcagactcacgccgacgcagccgacgatgccgtaggcgacgaggcccagcaggggattggggaacccgaagacggacgcctgggcgctcttcatcacgctgccgcacgacaccaccgggttcagactgcagcccggagtgaagtgcgggtccttcaggagttcgaactcgtcgagcgtgatgacccaggaggccagcagcccggccgcccccgtgatcaggaccagcagggcgagagcggggccggcgcccgcggtcctgggcacggcgcggactcagctctgcagcggaagcccgccgagcagcggggtggcggtggtgttcaggctcttggtggtgctgttgacggagtggagcagcgagcccttcttctccgtgtcgagcgcgtcggactggtgcctgatcggcatgacgtcgacggggcccttggtgagcgagttcacggcgccgttgaggctggtgggcgtcaggtcggcggcgtcgtgggcgaacgcggggccggcggcaccggcggcgaccagggatccggcgaggacggcggcagccttgagcgacttcatcgtgttcctttccgcggcgacgggcgtcaaccgcaggggacggggtcgccgtgcctaacgagccccggacgggccggaaaccacggtgcgggacattgccgagtcctcatacgagaccttccgcatataagagccccgccgcgcggctgcgtgcggcagccgtcgtgccgcgggccccggggccggctccggagcccgcggcacga

SEQ ID NO: 2111 - DNA, 556 bp, Unknown
  Kingdom: Bacteria, Phylum: Actinobacteria, Class: Actinobacteria, Order: Streptomycetales, Family: Streptomycetaceae, Genus: Streptomyces
cctcggcggcctcgccgcccaccgccggctggtcctgctcgacctgcgcggcaccggcgactcggcggcaccggcggacccgtcgacgtaccgttgcgaccggcaggcggacgacgtggaggcgctccgcgcccacctcggcctggaacgcatggacctcctcgggcactcggcgggcggcagcctcgcggcgctgtacgcggcccgccgcccgcaccgggtggcacggctcgcgctgatcaccaccgccctgcgccccctcggcctgagcgcgacgcccgaggaccggctctccgccgcccggctgcgcaacggcgagccgtggttcgaggaggcgtacccgctgctggaggcctggctggcgggcaggagcgagtactcggcggcgctcgctcccttcttctacggccgctgggacgacgacgtccgggcgcacgccgaggccgacgaggagcagaccaacgacgaggccgccgaccgctacttcgccgaggcggagttcgaccccgcggcgacccgcgccgcgctcggcgcactggccgcgcccgtcctggtc

SEQ ID NO: 2112 - DNA, 1415 bp, Unknown
  Kingdom: Bacteria, Phylum: Actinobacteria, Class: Actinobacteria, Order: Streptomycetales, Family: Streptomycetaceae, Genus: Streptomyces
gggtggtcttgccggacccggcgtcgccgcgcagcaggacgcgggaggcggtgcgcagggcctcctcggcgggcagccggccggcgtcggcgccctcgcggtcgtcgggcgccgggccgggtgcgtcgtcctgcgtgccttcctgtgcgccggtcgcctccaggctgaggtacgccacttcgaggggccagcggtcgggggagtcgcgcaggtcgatgccgtagatggtgatgtggttgtgctgccgggcgacgtgggggaggtagcggcgttcgaaggcggtgtcgcgggcgtcggggcgggggacgcgggtgatgagttcgtcgaccctggcgatcagctcggactgcgcgcgggtctgctccaccagggtccgggccacgaaggtggagcgccgggtgaagaactccaggatctgcaggcaggcccactcggtggcgctgtccaggaagtacgtgccgtcgccggacaggccgtgcgtggccggtgcgtgccgggcgaggtgccgggccagttcccggtgacccagccgcacggcctgcacgtcgtccatgtccagttcgccgagggcgagcaggcggtcggccagcgcgccggtgacggcgtcctcctcccccgggcgggaagggcggctcgcccggtgaggaggacgccgcccggaccagctgcccggcgagcctgcgcacctccttctcgcccaggacgcgcttctcaccgcgaaaggacacgaggtccttcatccgcaccggcctgccgaccagtccggcgcccggtccgtcggccacgaacagcttcctgaccagcggcgcgagcaggctggacgccagtttgccgccgagtaccgtcggctccatccgccgcaccccccgtgttgtcgcgaacggccggagcctatgtcctggcggacgggtcagggcaactggccgtcacgttcggggggtgaacgccttctcgcgggagtggtcggcggtaactccgctgagacggacgccatatgggcccggtcacaggggagcgggggcccggggggtctgccggtgacatggggcacaggcgtttcctccggtactagggcacttagtgggggacaggaatcaataaatcggacatatcgcccgtccgaatggggtggaacggggtttttgcaggggttttgtcccgaatgggtggggtgtcaagagatctgcatcactgcaccctcttactagtttgcgtcgtagtgggggtgtttgagggccggtgaccggccgggttaccaaggtgtggcccgcccggcgaagcaccagcgtccgggaggtcctcatgtcccccaccccccagaggtttcgatgttccagcgcgccaccgcccgttctgcccgtgcgaccaagctccgtacccgtgccgccgtcctggccgcaggcctgggagtcacg

SEQ ID NO: 2113 - DNA, 1667 bp, Unknown
  Kingdom: Bacteria, Phylum: Actinobacteria, Class: Actinobacteria, Order: Streptomycetales, Family: Streptomycetaceae, Genus: Streptomyces
accctgctgtaccgggcccgcagcgccgaggacctggccctgggcggcgaactggaggccatcgcgcgctggcgcggcgcacgggtgctgtactcgctcaacgatccggacggccggcgccccgccctcaccgccgagtcgctgcgcgcggccgtcgccgacctcgccgggcacgacgtgtacctgtgcggtccgcacgccttcgcccaggacgtgtacgcggcgctgcgggccgccggggtgccggaccgccgtatccaccacgagtcgttcgagctgtgaggccgccgtgcaccctttgaggaagaaccgtccgctgcgccgcgtcgtgctggcgagcgccgccaccgtctccggtctcgtgatgctgctgtccctcaagccgcacacaccgccgacgatcgccgcggcgcgggcaccggcgtcggcaccggccgcgtcgggcgccagcggatccaccggcgggcccagcggcggatccaccggcaccaggaacgtcaccggtgagaccgtgcagacccgttggggcccggtccaggtgcggatcacggtcgagaacggccgcatcacggacgtgaccgccgtcgcctaccccacggacaacccacgggaccaggagatcaacagctacgccctgcccgcgttgcgcagggagacgctgaccgcgcagagcgcggacatcgacaccgtctcgggagccacgtacaccagtgacggctaccgccagtcgctgcagtccgcgctggaccgggcccgtggctgagggtgcggctccagccgccgtgcggcacgtggaggaggtcatggggacggtcttctccttcgacgtccgcggcggggcgtccggtgcggtacggaccgcgctggccgaggcggtcgacgggctgcaccgggccgacgagctgttcagcacctaccgtgcggacagccaggtctcccggctggcgcgcggcgaactgaccgagcggcagtgcgcccccgaggtcgccgaggtgctcgcgctgggcgcggaggcggaacgggtcagcggcggctggttcagtctgcgccaccaggggaggctggacccgacgggcatcgtcaagggctgggcggccgaacgggcggcccggcggatctcggcggcgggagcgggcgcggtcagcgtgaacggcggcggggacgtgcaggtgctgggctctcccgggccgggccggccgtggcgggtcggagtgtcggacccgctgcgtccgggcacgctggccgcggtgctctcggcgtccggaacggccgagctggccgtggccacctccggcacggccgagcgcggcgcccacatcaccgacccgcgcaccggcgggcccgcggtgaccgacctggtggcggtcacggtggtggctccacagctgacctgggcggactgctgggccacggccgccttcgccaggggcgcgcgagcgggactcgcctggctggagtcgctgcccggcgtggaggcactgctgatcacatcggacggcgcgacgcggcacacgagcggcctgccggcccacctcggctgaccggccccgcgacctgccgccccacgcggccgaccgaacttgcggcccccgcatgaccgcttcgacccgcacggcccgcctcggccgaccgaacctgcgatcccgcgtgaccgcttcggcccaccc

SEQ ID NO: 2114 - DNA, 2658 bp, Unknown
  Kingdom: Bacteria, Phylum: Actinobacteria, Class: Actinobacteria, Order: Streptomycetales, Family: Streptomycetaceae, Genus: Streptomyces
ccgccgaaaagcccatgccatccccggctccacggcgaaccggaagacacgccgcacgggccgggtgcacagcagggtgacgcaggtcgccgcgagcacggtgacgaggagcgcgcccagcggaccgtgcagccagggcgcctcgaaccagcccgcgtacagcacgcccttgaccacgaagccgtgcagcagatagccgtacagcgtgcccgtgccgagcgcggtgcaccacatccggcgccccggcaccagagccaggaagcagccggtcagcagcaccgcgcccgccgacagcaccagaaccatgaccggcccggcccaccagggcgcgcccaggtcctgcgcggcgccgttgcggtagagccagccggtgttcaggctcggcgcggtccaccagccgaggaccagcgccaccgcgaacaccacgacggccagcacccgtaccggacggcggcgcaccagccggaagtgcgccggttccagacacagccccagcacgaaacagggcagcagctgcaggacacgcggaaggtccagcacaccgcccatggccggggacaccgagcccagcatcgcgatcccgagggacacgagcagggggtggcgcaccagcttccacaccggcgccgtcaaccgccagatgaacagggcgcacaggaaccaggtcaggtaccagggtgagagaaggctgacggcagcgtcaccggagccgccgacgaagacacggaagagtgaatacgccgtctcgaagacgacgtacggcacgacgacaccggtgatcagccgcttcagccggctcggccgcaggtcgaaatcccgggagaagaatccggagatgatgacgaacgccggcatgtggaaggtgtacacgacgttgtacgcgccttcgaggaaccggttcccgctcatcaccggagcccaggaatgccccaacgccaccagcacgatggcgagatacttcgcattgtcgaagaacggatcacgctgcttaccggaccggcccgcaccctcaccgggtctgtgcgcggccggaccgtcggtagccggtgactgagccggggggaggggtgttctgttctggccgggggaggaggcagcgtggaacatctcaggcaccttagcgtcgtccgtgcgtttttcgcggaacctccgacggcgatcccggccttgggggtcggctgccccggattcacccgggaatacacgaccacgaggtggcccacgccacatctaccgcgccacccggaacccgcaacgcccgtacggctcatggcgagttgacagccggcacgccgctcggcgacgccaattcgaattgcctgcgaacgaaatgtaaggacatcgaaacgaaaacaccgaattccccgacgagtcgtcggcggtcaccccgcggcggtcacggcggcgtgccccgggaggaggggcaccggccctgggatgcttgaggtgcgtgtcacggtcatggccgatgatgcgtcaggcctggcatagggcagccgtgttggtggcacgatggttccagcgggggcgtggggttggcaccccgggccgggagagcggaccaaccgaaggtgtgatcagttgtggccatttcactgtcagtggtgctgctgttggcgatcatcctggtggtgttgctccgagggggctccatcaaggccggtccggccatcgtcgccgtcctcttcggcttcttcctcgcctccaccggcatggccccgtcgataaaccgcttcatgaactcgctggcggacacgatcaactcgatccacttctgaggccgacgggacacccggccctggcccagcccgccccggccccggaaacaccgaggggccaggcccgaggatcactccccgggcctggcccctggccgtacagagcgggcgacgggaatcgaacccgcgtagccagtttggaagactggggctctaccattgagctacgcccgcacacaacgcgccgctgatcgaccgaccgcggcacacaggcatcgtagcgggtccacgcccttccccgcacaccccttccgcccgcggcccgcgtgaccggagcggggcccggccgcgccccggacacgggcggcccacccctcgcgcccctcttctgtccggtggccggggcagaacctgcccggcccactggcagaacctgcccggggtcgggggcagaacctgcccggcgtcggggcagagcccgctcagggtcgggggcagagcccgccggggtacagggggcggagcccccgcgtggggtccggggcggagccccgggaggctgattgattcccgaccgagtcgggtgggtgggctggagacgggctctccggggcgcagccccgcggagaggcgccccctcggcccgccgagtcggggtccggggcggagccccggggcggcgcaccctgtcccaccgggacgggacaacgaaccccgccgcctccgccccgccgccccgcgagggaattgcggaggtcgtaccccctgcggccatgtaccctacgtgtcgcaccagacggggtgtggcgcagcttggtagcgcgtccgctttgggagcggaaggccgtgggttcaaatcccgccaccccgaccacccgccggccgccaggccggcgccatcgcacgtgccccggacggtcggcccgcacggtcggcccgc

SEQ ID NO: 2115 - DNA, 1708 bp, Unknown
  Kingdom: Bacteria, Phylum: Actinobacteria, Class: Actinobacteria, Order: Streptomycetales, Family: Streptomycetaceae, Genus: Streptomyces
gctcccgcgcccccgcgccccacaccgccaccaccgccaccaccccgtacacgaccgcccagccccacaccgaaaccgaaaccgacaccgaaaccgacccccacgcccagtccctcggtgagacaggtcgcctacccgcactaccacacccagccgcaccggcacgcgccccggcgcgctccgtcaccgatcacctatgtcctgctcatcgcggtgcccgccctggtcgccgtcgccgcgctccgcccgcgctgaccctggaggcacctgttgtcggaatggcttgttctcgtcctcgcgatgctggccgcctgcgccgtggtcgtcgtcatcaccctcgtacgccaccgcacggcggccgaggacgacgatcccagtcagacgccggacgtcatcgagtacatgacgatgtggatcggcgtggtgtacgccatcgtgctgggcctggccatcgcgggcgtctgggaggcccgggtcgccgcccaggaccacgtccaggcggaggcccaggcgctgcacgagatctcggagcgggtccgggtctatccgcccgcggaacgcgacctcatccgggctgatgtcaacgcctatgtcggacacgtcgtcaccaccgagtggaagagcatggtggagcacggccagatcaccaagcggggcgacgaactgctgcagaagatccgcgccgacgtcaccgactaccagccgaagtcggacttcgaggcgcaggcctaccagccgctcgtcgaccaggtcaccgccgccgaccaggcccgctcggcccgcgcggactccaccggggcgacgatgccgggcgtggtgtggttcgggctgatcgccggggccgtgatcaccgtggggatggtgttcgtgctgcagatccggcgcacgacgcgggaactggtcctcgccgggctgttctccgcgctgatcgccttcctcctcttcctgatctgggacttcgacgcgccctacagccgggggctcgcgtcgtcgacggcgcccttcctggacatgttccccggcatcacccgctgacgggctctcgcctccgcgcgccgcaccggcctgacgtgccttcaccgctcatgtcccccggccgcaggaacgccgtcccctgtgcggcccacacggttgccccgttcgcccgggtacgatcgcgccccggtccacatcttcctagcgtttcgatcatcgaggtgcatttcaggcgcacgcggaagtggtccgcagctgctcctcggggaccggaggattcacgatgcgcgtaatacgcgttgtttcggcggcactgctggggctgagcgccctcaccctctccgcgcccgcggccgtcgccagcggcggcggcgacggctcctacggcggggggagcggtgagagccgctcctacggcggcgggggcggcgacagccgctcgtacggtggtggaggcggtggcggccgctccgacgacggtggtgacgacgaggggggccgcggcggccggggcgggggcaagccggagcacttccagcacggcgtccgcgcgggcgagggcggcaccatcgccggcttcgacctgaaggaggtcggcatgggcacggcgctcatcgccggctcggtcggtgcggcgtactacctgtcgcgccgccgcaccggcgaggaaggcgtcgcctgacgccgccgcaccaccggcacatggcttcgccccggacccgcgcgggtccgg

SEQ ID NO: 2116 - DNA, 499 bp, Unknown
  Kingdom: Bacteria, Phylum: Actinobacteria, Class: Actinobacteria, Order: Streptomycetales, Family: Streptomycetaceae, Genus: Streptomyces
gacgaaggcagcgagcggcccgagccgtccggaccggctgtgctgcccgccgagcggaacgactgacgcctgcgcgtcccgcccgcctcagccgtccgtgcccagcatgccccgcagttcacgcggcaggtgctggtcgcaggactgctgggcctggtgggtgagcgcgtcgttcacgcaggagtagtagtcgcggtagacgaactgcgcggcgaagcccgccgcgaccagggcgagcgccagggacgcggtgaccagaccgctgaccgccgccgtcacctggggccggttgctctcgggagccggggccggtgccgggttgtccgggtcgggcctgcgcggcttggtacgcagggcgctgatgccccagtacagggcgagcgcaccgaggagcagcgagacgggcgcccagccgaagaggacgaagaagacggcccacatgccggcgagcagggagaagcgggcgcggcgctgcgcggggaccccacggaccccgcgc

SEQ ID NO: 2117 - DNA, 1272 bp, Unknown
  Kingdom: Bacteria, Phylum: Actinobacteria, Class: Actinobacteria, Order: Streptomycetales, Family: Streptomycetaceae, Genus: Streptomyces
gccgcactcctcccacgagccgagcagcaccccgcgcaccccctccagccagcccccgcgcaggagttgggtgaggtagcggtccagccggtacgtctcctcgcccacgtcctccaggcacagcagaccaccggccgccgagggtcgcgcgtgcggagtgccgaggtcggcggcgagcagggcgaggcagccgccgagcgtgacgccccgggcccgcccggacaccagggccgtaccacccgaggcgatcacgcggaccgactcgggcgcgaacagggtcgccctgaggtgctcctgcgcgtcggcgttcttgacgaagtcgacgccggccgccatcgggccgtgcagggtgaccaggcccagccgcacggcgaaggcctcgtgcagcgcggtgatgtcgctgaagccgacgaacaccttgggccccgccgcgcgcatcgccgtccagtcgagcaggtcgaccatccgctgcacgccgtagccgccccgcgcgcacagcaccgcgtccaccgccggatcgcaccacgcctgctggaggtcggccgcccggtcggcgtcggcgcccgccagatacccgaactcttcgtggcggtccagcacgtgaggtgccaccacggggtccaggtcccagccgcggagcacgtcgaggccggcctgaaggcgttcctccgggacgggtccgctgggtgcgacgacggcgaccttggcgccgggggcgagccgggcggggcgcaggagttccttcacctgcccagctccagggccggcacgtcggccccgttcaggccgaacacctgggcgtacagggagagttcggcctccagggcgcggaccatcgtcgcggcccgccggaacccgtgcccctcgccctcgaaggtgaggtaggcgtgcggcacgtcgcgccccttgagccgggccaggaaccgctcgcactgcacgggagggcagatcacgtcgtccagcccctggagcagcaggaacggcgccgtgatccggtcggcgtgctcggcgggcgagcgctccgcgtaccggccgggcacctcggcgagcggtccgaccaggctctccaggtactgcgactcgaagtcgtgggtctcccccgagccccacgacgtcaggtcgaggatcgggtagaggatcgtgccgcaggcgtagacgtcggtggcggtcagcgaggccgcggtggtccagccgcccgcgctgccgccgcggatcgccagccggtcccggtcggctgtgccctcgtcggcgagggcgagggcgacggccgcg

SEQ ID NO: 2118 - DNA, 708 bp, Unknown
  Kingdom: Bacteria, Phylum: Actinobacteria, Class: Actinobacteria, Order: Streptomycetales, Family: Streptomycetaceae, Genus: Streptomyces
  misc_feature (339)..(394): n is a, c, g, or t
ggtctccccgggcccccaccgggggttccgacgacagatacgacatgcggcgcgcgggaagggttgcacggcgcggcaagattctttccggtgtttcccgccgggcggcggtcacgccagggccaccggtgacgccggggcgccgttgacgccggcgatcccgctcgcggtcaccggacgacgtgctccacgaaccgtgccgccgtctcctccagcacctcgcggccgtcgcgcgcccacagggcgtcgttgaagagttcgacctcgatgggaccggtgtagccggcggcctccacgtagcccttccactcgcgcatgtcgacggcgccgtcgccgatnnnnnnnnnnnnnnnnnnnnnnnnnnnnnnnnnnnnnnnnnnnnnnnnnnnnnnnncgggcgatctcggcgggggcccggtcgtcccaccagatgtggtaggtgtcgaccgtgacgccgacctggtgggcggggaagcgttcggcgaggtccagggcctgggtgagggtggagaccacgcagcggtccgaggcgaacatggggtgcagcggctcgatggccaggcgtacgccgtgctgttccgcgtacggtcccagttccgcgagcgcgtccgcgatgcgttcccgggccccgcgcaggtccttcgagccggccgggaggccgcccgagaccaggaccagggtgtcggtgccgagcgcggcggcctcgtc

SEQ ID NO: 2119 - DNA, 882 bp, Unknown
  Kingdom: Bacteria, Phylum: Actinobacteria, Class: Actinobacteria, Order: Streptomycetales, Family: Streptomycetaceae, Genus: Streptomyces
actggtcctgcgcggcggccaggtccatgacgtggccgccgccgtctcccaggtactcgccggcaccgtcgagttcaccgaggccgccgcgcaggaccagttcggcgagccggtcgtggacgtcggaggcgcgctcgatgaccgcgctgcggtcacggatgatctcgttggcacgttccagtccggccagggccgcgcgggtctcggtgagcaggtgggcgctgtcgatggcggcggcggccagggccgcgaaggagccgagcagggcgatctgttcccgttcgaagacccgggcccgccggtcggccgcgaacaggacgccgatgacctgcgcgccgagcatgagcggcacgccgaggatggcgaccagtccctcgtcctgcacgccctcgtcgatggtgccggtgtgctggaaacgggcgtccttgaagtagtcgtcggtgacgtacggccgggccgtctgcgcgaccagaccgcccagcccctcccccatgccgaggcgcagctgctggaagcgggccgccaccgatccctcggtgacccgcatgtaggtgtcgccgcgggccgggtcgttcagggtgaggtaggcgacgtcggtgccgaggagcgagcgggcgcgctggacgatggcgggcagcacggcgtccaggtccctgagacccgccaggtcgtgggcggtctcgaacagggccgacagctccgcctcccgtcgtctgcgtccctccagttccgcgcggacgcgcagggcgagcagcttggcgtgttcgagggcggcgatccactcggcggggcggttctccgcgcgggcgagcagcaccggctgttcgaaggcggcggcgggcgcgccccgggccagcagctcgaggaacggggcccccgcgc

SEQ ID NO: 2120 - DNA, 651 bp, Unknown
  Kingdom: Bacteria, Phylum: Actinobacteria, Class: Actinobacteria, Order: Streptomycetales, Family: Streptomycetaceae, Genus: Streptomyces
tgtgtgatcgtcgccgggccgacccggcagcagccgccgatcaggcgtgccccggcggcgcgccaccgctcggcctgggccggggtgagggtgcagcgcccggtccaggagcgggaccgggcgtcccagacctcgccgctgttggggtaggccacgaccggcttgccggtcacccgggcggccacctcgacggcggcttccacgtcctcgggagcacagcagttcacgccgaccgcgatcacctcgtccgcgtcggccgccagaccgaacgcctcctccagcggctgcccggcccgcgtgcgggagccgtcgacggtgtacgacagccacgccggcacgccaaggccgcgcaccgcccgcaacagcgcggtcgcctcgtcggtgtccggaaccgtctccagggccagcacgtcgggcccggcggcggccagcacctccaggcgcggccggtggaaccgctccagctcgccgacggtgagcccgtagcgcccccggtactccgaaccgtccgcgagcatcgcaccgtagggaccggccgaggccgccacccacagcgggcgcgtgactccctgtgcccgggcccgccccacggcctcccgggccagaccgacgctcgacgcgatgagcgccgcggcccgacgcggtcaccga

SEQ ID NO: 2121 - DNA, 1458 bp, Unknown
  Kingdom: Bacteria, Phylum: Actinobacteria, Class: Actinobacteria, Order: Streptomycetales, Family: Streptomycetaceae, Genus: Streptomyces
ccaccgccctgatcgccggcacctcggccgcggcctccgccgcggacccggccggcacccgggtgaccagcctccagcagcgggccgagcaggtcctggccggccacccgaaggcgctgcacgtgtccgccgacgcggtccgctacgacggcctgaccgtcaccgccgcgccccggggcaaggccgccctcaaggacctggcctgcggctacggtcacctctgcatgctcgtcaacggccagaagttcgacttctacaagtgccagacgtggaacctcaccaactggaccggcaacggccccttcaccaacaaccagacgcccggcacggtcgccaggttcttcaacaaggacggcagcgtccgctggacgtccacggcctaccaggccggcacggccacctgggacccgatctggtccctgcgcccctgctgagccgggcccgcctgacggcggtggcctccggcccctcctgggggagggccggaggccaccgtcatgggaggcgttcgtagaccgtcacccgccgtccacgggaccgttcgtccgccacgaccgtgaactgcccgcgcagggccgccagtttcgcgctgtcgcgcgttccgggcgccgaaccgccgggcggggccgcgtccgtgacgagcaggacccgccgttcggccagcgtgcgggcgcggatcgtggccggatccgcctcctccccgcccagcgtcccggactccgcgggactccgctccagcgcgatgtcacgcactccggcgaaggcaccgggcgagaccagcgcggtgtcccgccggaacgcggggacgaagagcaccgcgtccccgtcacggtgcagcctgtgcacgtggcccgccgccgccagtacgtcgtccaccctgctgcccggcgaccgcacggccagggactgcggcagcagcgcggccaccgccgcgacgagcaccgcgggaaccagccacgcggacgccctccgcatcctcggcgccgcagcccgtgccgccgcgtcgagggccgcgccgatcagcagggccagtccgagctggctgaacgcgatgtaccggtccaggaagaccggctggacgaacgacaggccgatcagaccgagttggggcaccgccagcagcggcagcccgacggccgccgccgacacccggccgggcgccggacgggtcagcagggccgccaggccgccgaccgccagcaggacggcggggccgatcaccatgtgccaggtcagcggcggtatccaggccacctgtccggcctggtcccggctgtagaggatcagcggcagcactccggccaccgcacacgccgacgccccggcccagcgcgcccacgtgccgcgcccggcccgggtccacagcagggtcaccgcgtgcgcgggcaggaccagcagggacagccagtgcagcagcccggtcacgaggaccacacccccgtacgcggcccaccgccc

SEQ ID NO: 2122 - DNA, 1522 bp, Unknown
  Kingdom: Bacteria, Phylum: Actinobacteria, Class: Actinobacteria, Order: Streptomycetales, Family: Streptomycetaceae, Genus: Streptomyces
gtgcagtcacaggcaccgcagccgggcgccgcgcacacgcgtacagcgcccgcccgcgccgctgccgccccggtgcacgacgtgagcccgcagaccacgccccagtcccgcgcgggcaccgccgagatgtacacggtggtccgtggcgacaccctctccggcatcgccgacgaccgccatgtccggggcggctggcggcagttgtacgcggccaaccgcaccgtcgtcggggacgacccggacctgatcctgcccggtcagcggctctccctgcacacgacgcggcaggcgccggcccggcgtgaggagtccgcgcccgccacccggcagagaccgaagccggcaccgaagcccgccacccgcaaggagagcagcaggtccggccggccgcacaccagctcgcacaccctcgtcgcccccgtgcacggccccatcggcaccggttaccgggcctccggctcccactggtcgaagggctaccacacgggcgtcgacttcctggtgggcaccggcacctcggtgcacgccgccggcgcgggccgggtggtcaccgcgggctggggcggcgcctacggctaccaggtggtgatccggcacgccgacggccgctacacccagtacgggcacctgtcggcgatctccgtacgggccggccagtcggtcaccgccgggcagcgcatcggccgctcaggggccaccgggaacgtcacgggcccgcatctgcacttcgaggtgcggacggggcccggtttcggctcggacatcgacccggtcggctatctccgggcgggcggcgtcaggatctgacccggggacggtgccggacgagggcgggcgccggaatgtacgcgacgccgtggaccaagccgtggtacgggccgccgtccaacgtcccgccggacaacgcgccggcgtcgagcgacggttcggcccgctccggtccggctcccggctcccttccggttccggacaccgcctcgcgcggtgccgggggagcgggcagcgtgagcacgacgcgaacgggaggcgccgggggagcctcctgcggtgacgcttcccgcccgggcgcggggtgcgccgccgtgcgctcgatgcgctcggtcgtcagcaggatcaggccacccgcggccaccacaccacaacccagggcgagcacggtgcccgtggttccgtagcggaaggtctcgccgaacatggtgatgccgaccgcggccgccgccatcgggttgaccaccgtgagcgtggccagcggtgccgcgaggccaccgccccggtacgacgcctgcgacagcagcatgcccgccgtggccaggacggcgatcgccgccagcgacggcaggtcggccgccgcgatcccgtcggtccagtccaccgcgaccgccttggtgaacaccgaggacatgccgaaggcgatgccggaaccggtggctagcagcacgctgcgcacggccggatgccggtgcgcggcccgccccgccaccgtcagcgcgaccaccgagccgccggtgaaggcggccagggc

SEQ ID NO: 2123 - DNA, 1227 bp, Unknown
  Kingdom: Bacteria, Phylum: Actinobacteria, Class: Actinobacteria, Order: Streptomycetales, Family: Streptomycetaceae, Genus: Streptomyces
agcggcgcgggtctcggtgaccagggcgcccagttcggtgacgaggggccgggcccggctgaggaccgcgtgccccagcggcgtgggccggcatccggtgcgcgcgcggacgaagagctgaccgccgagcaggtgctcgatccggcgcagctgggtgctcaacgagggctgtgccatgccgagttcgcgcgccgctctgtgcagactgccggtgtcggcgatggcgcagagcacgcgcaggtgcctcacctcgagctccatgagggggagcgtagggcggtgcggccggaccgcaccagatgttcaaaccccgacggaaccgtacgagtcggccgccgatagctccgtgctatccccagttgccatcatcccatgggcgttggcctgcccgagactcgtccgcaaccgatcgttcaccccacatcgaacgagtaggagccccccatcatgtcgcgttccacgaccgcgaagtccgccaagtccgcgaagtcctccaggagactcgtggccctcgcgctcggactcggtctggcgtccgccgcgctgggcaccgcgatgccggcgagtgcggcccggagcacggactcggccgccccctcggccccggccgccgtcgcccggtacacgggatccgccgggcacaccgccgacaaccaggcgttcttcgacgccgtgctgcagtcggtcgcgaagaagcaggccgctcacccgaacctcacgtcggtgaccgtctactacaacgcctcccaggcgccgagcttccgctcgcagatatcgagcgcggcctccatctggaacagctccgtctcgaacgtcaagctggcggccacgtcgggcagcggcgacttctcctactacgagggcaacgacccgtcgaacgggtcctacgcctccaccgacggccacggcagcggctacatcttcctggactactcgcagaaccagcagtacgactcgatccgtgtcgtcgcacacgagaccggacacgtgctggggctgccggaccactacagcggcccgtgcagcgagctgatgtcgggcggcggccccggcccgtcctgcaccaaccgctacccgaacgccaccgaacgctcccgtgtgaaccagctgtgggcgtacggcctggccaaggcgctgagcaaggccggcagcgtgcgctgacgcccaggcgaccgcccgggcgcctgcccgacccggcccgcgcggaccgtggccccggccacggtc

SEQ ID NO: 2124 - DNA, 592 bp, Unknown
  Kingdom: Bacteria, Phylum: Actinobacteria, Class: Actinobacteria, Order: Streptomycetales, Family: Streptomycetaceae, Genus: Streptomyces
gccggaccggagtgcggacggtaccggtggcgcccgccgcgctcgtcccgcacggcgcctgcgaccggcccgggtactacctggtccgccctgacggacacatcgccgcccacggtcaccggcgggatctcgaccggctgcgcgcggaactggcggccgtgctgctcggttagggccgccggtgcggggtccgggtcgggttgccagggctattcctggatgtctagtatccagatatgcgcatgagtgaaggagtggagtgggcgctgcacagctgcctcaacctcgcctgggcgcaggacggtggtgcggtgacggtggcccggctcgcggcgtaccacgagttgccgacgacctacctcaacaagcagttgcaggcactgtcccgggccgggatcgtcagttccgtgcccggtccgcgcggcggcttccggctggcacgcgggcccgaggacatcacactcatggacgtggtcacggcgatcgaaggccccgaccaggcgttccgctgcaccgagatccggcagcagggaccgcacggtgaggtgtcgagcaactcccgccacccctgcgccatctcgcaggccatgcg

SEQ ID NO: 2125 - DNA, 1432 bp, Unknown
  Kingdom: Bacteria, Phylum: Actinobacteria, Class: Actinobacteria, Order: Streptomycetales, Family: Streptomycetaceae, Genus: Streptomyces
cgtgtgagcagccagggctcgaccacgccgagcccgcgcaccggccgctgccaggtcggctgcagggcgaagcggtacaccggcggttcggcgccctccttctccgcggcctgggcggcctcggcggcctccgcctcggaggcgggagagtcgcccgtcctgatcagttcctcggcgaaggcgctgtcgacgagcacggcatcgcgcggggctatggacgtcagccgggaggcgaggttgacggtggtgccgaacacatcgcccatccgggtggtcacggtgccgaacgccatcccgacccgcagctccggcatggtctcgtcgttctccatggtctcgaccagccgcagcgcgatgtccgccgccgtgcccgcgtcgtcggcggcgtacagcacctcgtccccgagcgtcttgatcagccgtccaccgcgcgcggccaccaggtcggcggcggtcgtctcgaaggcctcgaccagctcgcccagctcctcctcctccatccggcgggtcagccgggtgaagccgacgaggtcggcgaagccgacggccaggcgccggtcgaccatctcctcgtcgtcggcgacctgcacgacccgcccggcggacgcggcgagctgccgccgccagacgtagaccaggaactcctccagctcgggcaggagcagctcgacgatcgggtacgtcacctcggtgcgcgtcatgcccggctccggcggctcggtcagcccctccaggaaggagtcgatctgccactcggccagccgggcggtggtctgcccggtggagcgggccacctgcacggccatggcctcactgagcagcccggcctcgaccagaccggcgagccggcgcagcgccagtacgtcggcctcggtcagcgccttggcctggccgatgtcggcgaagcccatggcccgccagaagcgcgaggccagctccatggagacaccggcgctgcgggccgcctgaaagggggtgtagcgccgctcggcgcccaggatgagctgttcgaggcggagcgcgagcgggtcctcgccgtcctcgccggagtcggcggcgtgggggtccacccggccgtccgcgtcctgcgcgcccgagcccgtgtcgtcgacggtcacgcctgctgcccttccgatctgtcacggtcaggtatcgaccggcctcaactctacggcaggtgtgcgccagctcactccgtcagaccggcccgcggagtgagctgagctgggccgacgcccgcccgccgacgtgcccgcaggccccgcacgggaggcgcacagaggcacccggaggcacgcggggcgcacgacctgaggaccgtagaaccgcgcccccaaggccgcgcccgtaagcccgcgaccgcacaaccgcgcccgcaagaccgcctgcccgtccgcgctcccttccgctcccttccgctcccttccgctcc

SEQ ID NO: 2126 - DNA, 661 bp, Unknown
  Kingdom: Bacteria, Phylum: Actinobacteria, Class: Actinobacteria, Order: Streptomycetales, Family: Streptomycetaceae, Genus: Streptomyces
ccttccgctcccttccgctccgctcaggcgggccgcagatgcacgatgtcgcccgcgcccaccggctcctgcacaccgttctccgtggcgaggacgagtctgccgtcgccgtccaccgcgaccgcctcaccgatcacggaacggtcgcccggcagctcggcccgcaccttacgtcccagggtcgcgcaccctgccgcgtacgtctcctgcagacccgcggcggccgcgtcgccgcccgcctcccgccagcgcccgtaccactcctccagcgagcgcagcaccgcacgcagcagcgggtcgcggtcggtgctcacggccccggccagggccagggagcccgcctgcggcaccggcagttcgtcctggcgcagggtgacattgatgccgacgccgaggaccacaccgccgtcgccggcgcgttccaagaggatgccgccggccttgcgttcctcaccgccgaccgtcaccagcaggtcgttcggccacttcagcgccgtgtcgaccccggccgagcgggccagcccggtggcgaccgcgaccccggtgagcagcggcagccagccccagcgggccaccggcacctcggccggccgcagcagcaccgagaagaagagcccggagcgggccggggcggtccaccggcggtccaggcgcccgctcc

SEQ ID NO: 2127 - DNA, 1529 bp, Unknown
  Kingdom: Bacteria, Phylum: Actinobacteria, Class: Actinobacteria, Order: Streptomycetales, Family: Streptomycetaceae, Genus: Streptomyces
gggtagaggtgggcgtcgacgaggatccggtaggcccgcgccggggtgatcccggcggtcgtggtgccgcacacgtatcgcgcggcccgctccaccagcgcggcgtcggacagcgcgtggcccgcgtgcgcgagggaacccgccggcgcggcggccccggccgggcccgccgcactcatcgaagccatcgaccccatggaagccatcgaccccatggacatcgcaccgtgctgaccgagcccgaacagcgcgtgcagcacggtctggccgagcgcgagcagcgccgcgatcccgggcagcgagcgtgcgcgtccggccagcggaacgacgaccacgagtgccccgaggaaccccgcgcccagcgtccacagcgggaccgtggcgcacgagcccagcgtgtgaccggccgcggccagcacgacgcagaccgcggcgaacaccgcggcccgcagcagccggataccgcgcccagccggtgccgtgcgcgtgtggggggcagtcatggcgcgctcatcatcccactgggcaccggcactccgtacggcaggtccacaaggtgcggtacctccgggtaggtcacgttctgctgcggatggtcccacgcatacaccgattccttccgcaccacatccgccggacgggcgtttccgcgcccactcggtgcttacggccgggcacgccgggcaatacgtatcggtatgtcgagccgcggccaggaggctggagcatgagcatctggtggtcactccatctgcggcgtgacgtcgcgagcgtgccgctcgcccgccggctcctgctcggcacgatggagaccgcgggcgtcgaccccgacgtctcctacgacctgtccgtcgcgctgagcgaggcctgcgcgaacgccgtcgagcacggcggcgacgccacctgcggggcgtaccgggtgaccgcctacctcgacggggagaagtgccgcatcgaggtgaccgacacgggccccggtttcccggccggcgcgcaccgggcgccggtgcgcgccccgcacgccgagtccgagcacggccgcggcctgtgcctcatccgggaactcgccgaccacgtccacatcggcaacactccggggcggggcggcgcggtggtgagcttcgacaagatcctcaagtggcgcgaggacgcacctttggtcgcggtctaggaccgggtccgtccctcacgagcccggtcccgtgccgcgcacgcccccgccctcacgcaccctccagcaccttcgccagcacgtccagcgcctccggatacacccgctcccgcggcgtgccgtagccgacgacgattccctggggccgtccggcggcgggggtgtgccagtgctcgcccaggcggccgagggcgagtccctccgcctccgcgcgggccagcacggccgcctcgtcctcgacgtcgaccagggcgtgcagcccggcggcgatcccgcgcacccggcggcgcgggcccagccggtccagaagctggtcacggcggcgccggtagcgcagccggcacgcgcgcacgtgccg

SEQ ID NO: 2128 - DNA, 502 bp, Unknown
  Kingdom: Bacteria, Phylum: Actinobacteria, Class: Actinobacteria, Order: Streptomycetales, Family: Streptomycetaceae, Genus: Streptomyces
gctatggcccgggcgcgggcggcggcgcggcgggcggcctggtcggcgggatcctcgtgcagggactgtcgtggcggtgggtgctgctgatcaacgtgccgatcggcgccgtggtcctggcgggctccgcgcggtggctgacggagagccgggcgggcgagcgcaggcgcctcgacctgccgggcgcgctgctggtcacggcgggtctcgccctcctcgcgtacggcatctcgcagaccgaggccaagggctgggccgccgcggccaccctgatcccgctgctcggcggcctcgccctcgtcgccgccttcctcgccgtggaggcgcgtaccgcagccccgctgatgccgctcgtcctgctgcgcgtgcgctcggtcgcgtccgcgaacgcggcgatgctcgtctccggctcggcgatgttctgcatgtggttcttcatgacgctgtacgcgcagaacgtcctcggctactccccgctggacgccggactcgccctcgtccc

SEQ ID NO: 2129 - DNA, 782 bp, Unknown
  Kingdom: Bacteria, Phylum: Actinobacteria, Class: Actinobacteria, Order: Streptomycetales, Family: Streptomycetaceae, Genus: Streptomyces
ccccaccgagagcccccgccgagaccccccaccgagaggaaggccgacccgtgtcggaacggacacagctcccgcgcgccagaacccgcggcatggctgacccgagcgcgctcgacgacgacgcgaccctgcacgcgatgggttatccgaggaaactcacccggcgtttcaaggcgttcgacaatttcgcgatctccttcaccatcatcaacatcatctccgggatcttctcctccttcggattcggcatgaacgcgggcggcccccgcattctcgtattcggctggatcggcgtctccgtcatggtgctgttcatcggggcggcgatgggcgaggtcgcctccgcctatccgacgagcggcgcgctgtatttctccgcggggaaactcgccaggaagcacaaaggcgcctggtcctggttcacgggctggctgaacttcgtcggacaggtcggcggcaccgcggccaccggctacgcggcggccaccttcatccaggccttcgtcgccctccagtggtcctcctaccggccgaccgcgcaccagacggtgctgatcaccgcgctcgtcatcgtgctccagggcctcgccaacacgtacacggtccaactggtcgcggtcctgaaccggatctccgtgtggtggctgctgatcgggatggtggtcatcgtcacggcgctggtcgccgttcccggcgatcaccgtccggtgtccttcgtcacgcatttcgcgaacaacaccggtttcacgagcggactttacggcggactgctcgggctgctg

SEQ ID NO: 2130 - DNA, 583 bp, Unknown
  Kingdom: Bacteria, Phylum: Actinobacteria, Class: Actinobacteria, Order: Streptomycetales, Family: Streptomycetaceae, Genus: Streptomyces
acatcaggctgctgcgccggcagaccaccgccgcggcgtcccgcaccgagagcgcgcccgtcgtccgggcggcggccacctcgcccatgctgtgcccgatgcacaagccgggctcggcccccttggcgcgcagggccgcggccagggagacctgtactgcccacagcagcggttggaccacggccacgtcttcccaggtcctggcctcgtcagcggtgccgtcgtcggtcagggtgtcgatgaccgaccagcccagttccgcgcggacggcggcgtcgcactcggtcagggcgcggcggaagtccgcgtcctgttcgagcagtcggcgtcccatgcccctccactgcgcgccctggccggggaagacgaaggcgatccggcggtccttgtcgaagggggccgagcccagaccgccgtccgcgctctcctcaccgcgggcgagtgcgcgcaaggtggcggccatctcgtcgtgggtggtggcgatcgcccacaggcggtgggggtgcgtgtcgcggcgggtggcggcggcgcggcagacggcggagagggggtgggcgcgccctggcccgcccggttccaggtg

SEQ ID NO: 2131 - DNA, 1265 bp, Unknown
  Kingdom: Bacteria, Phylum: Actinobacteria, Class: Actinobacteria, Order: Streptomycetales, Family: Streptomycetaceae, Genus: Streptomyces
gacgtccacagccggctgtgaccgccacccacctcgcgccaccggcgcgcccggcccgtccggcgtacaccacggaactcgtcaccgacgccgacgcgttcaccgccctcgccccgcagtggacccggctgttcgccaggtgcggtgccgcgaccccgttccagagccacgcctggctgcactcctggtggcactcctacggcaccccgggccggctgcggctggtgctggtgcgcgagggcggcgaactggtcgccgccgcaccgctgatgctgcaccgcgcacccgtgcccgcgctggtcccgctcggcgggacggtctccgactacgccgacgtcctcatcgacgaccggcacgcccatccggcggccaccgccctcaccggggcgctgggcgaggccgcgcggacgacgatcatcgacttccgggaggtacggccgggcagcgccgtcgagcaggtctacgaccgctggcacgggccgcggcaccgcacacccgactcgctctgcctggagctgccggccctgcccctggacgagctggtcgcccggctgccgtccgccaaggcgcagcgggtgcgcgccaaacagcgcaagctgcgcgcgctcggcgtggaacggcacgtcgtacgccccggggagaccgatgccgccctgcaccggctgctcgccctgcaccgcctgcagtggcagggcaggaacgtcacgcccgagcacctgcggccccgcttccgcgagcacctggtgcgggcggcgggcccgatggtgcgcgacggtgaggcggtggtcaccgagttccggctcgacggcgaagtggtggccgtggacctgaccctgcgctcccggcggctgatgggcggctacctctacggcgcccatccgtgcctgcgggaacgcagggccgacgtggcggtgatgctgctggaggcgtgcgccgcgcacaccggcgacggcgcgccggacacactgagcctgctgcgcggcgacgagccctacaagcaccactggcgcccccgcccggtcgtcaacgagcggctgctgctggcccggcggcgcaccgccccgctgctgaccgcggcggccggcgaggcggccctgcgccgccgggccgggcaactgctgcgccgacgcggcccgtcggagggcagggcgagggcctagccaccgtgtgaccagcggtcgaggcgcagacagagcctgccgccgagccagtactccagccagcggccgagatccatcggggaacagccgggggcgacgggtggg

SEQ ID NO: 2132 - DNA, 546 bp, Unknown
  Kingdom: Bacteria, Phylum: Actinobacteria, Class: Actinobacteria, Order: Streptomycetales, Family: Streptomycetaceae, Genus: Streptomyces
accgcggagatcttgaagtcggcgaaggcggagcggaagccggggcggcggcgcaggatggtgatccaggacagcccggactggaaggcttccaggctgaggcgttcgtagagggcgtcgtcgccgtggaccgggcggccccactcctcgtcgtggtaggccacgtactcgggcgccgacagggcccacgggcagcgcggggcgccgtccgggcccgcgagcgcggatccggtggacaccgcctcggtcacggggctctgtgctgtcgcgtcggtcaccgctcgtcctccggttccggcttggtcaggcgtaccggggccgcgtcggagcgggcgccggccagcgcggactccaggtcggcgatccgggcgtcgcgttcggcgagttcggcgccgaggcggccgagggcgtcgtccacgtcggccatgcggtagccgcggacggcgagcgggaagcgcaggctctccacgtcggcgtggtccaccgggcggtccggcggcagcgggtcgtgcagccgctcgggcaccgcctcgggcagcgggccgc

SEQ ID NO: 2133 - DNA, 1604 bp, Unknown
  Kingdom: Bacteria, Phylum: Actinobacteria, Class: Actinobacteria, Order: Streptomycetales, Family: Streptomycetaceae, Genus: Streptomyces
gccgccgcggctgtcgtagcggtcgaggtggctgtggcggtcgaggtggctgtggcggtcgtagcgctggcggcgggctcggggaagcggtgcgggtcgatgccgttcggcacgatgtgccagcgcgcggtgatccccgcgcgcactcctcgcgcgcgctccccctcgctgacgcacaccaccccggtggtccagcgcgccccccaccgctcccaggcccgcgcgagcatcgccgtgctcccgtcgaccgcctcgaacgaccaggcgtgcggctggaagaccgtagggatccgtccgcgcacggccaggcggccggcgagcccggccttggcactgtgcgcgtgcaccagatcgggccgtacgtcgtcgatcaggcgtacgagctgacgtacctcgcgcaggagtgaacgcccgggcgcacgcgccgcgttccaggggcgcacgtccgcgccgagcacccggaggtgctcgccgagcgcgccggccgggcaggccgcggtcacgtcgaagccgtccgcgagttgcgcccgcaccaggtccgtcacgacgcgcgcgaccccgccgtccacgggctgggtgaggtgcaggacccgcggccgaggaaggagccgcatgaccgtcgttgcctctttcgggtggccgtcgaaggggtgggtcgagaggtccgcaactctagtggcgaacgggactaatgccgcgaaaccgggcaagtgtgtcggaactgtgaagcccgtccgatccggagatcactctttcggcggcgcaactccgaagagggcggcgcgttgacacagggccgggcatccctgcccgggtgttcgtgtgtcaactgcaaggagttcctttccatgtcgcgtatcgccaagggcctggtccttacctccgccgccgccttcgcggctgtcgccggcggtgccggcatcgccgccgccgacagcggcgcgagcggtctctccgccggctcgccgggtgtgatctcgggcaacaccatccaggtccccgtccatgtgccggtcaacgtctgcggcaacaccatcaacgtcatcggcctgctgaacccggcgttcggcaacacctgcgccaacggctgacgcgggcgcagcatccttacgggcggcgggggtccgagcgcgcgccgaggcgcatcgcgccaggtcagacggcacgacaacctgattacccgtcaaacaacggatgcatgatcggttgcgtggtgccgcaggcgctctcacggtgggcaccagatccggtgctcatcgaaaggaactcccatgcgaggtctgccagcacggcgtgtcgcgtccaccgctctctgcgccgccttcctggtcggggtcagctccccggccgtcatggcggccgactcggcccgcgagaacggtcctgcggcggcgccccgttcccccgccccggacgccggcgcgctgctcgcccaggtccagaagatcggcggcctcgacggcgtgctcgccccggtccgcgacctggtgaccgccgtcctcaccacggaccagggcgagatgtccgcccccgacgcccagaagctcggcgacgcggcgaaggacgccctcgccaaggcggacgcggcggtcgccgccgcctcg

SEQ ID NO: 2134 - DNA, 884 bp, Unknown
  Kingdom: Bacteria, Phylum: Actinobacteria, Class: Actinobacteria, Order: Streptomycetales, Family: Streptomycetaceae, Genus: Streptomyces
ggccgtcggggtggggacgccggggatcgtcgaagcgggcggcgtcgtacgactgggcaccgcactgcccggctggacggggctgaacctgggcgagcggctcagccggtccttcaggtgcccggtgctggtcgagaacgacgccaacgccgcggcgctcgccgagcactggaagggcgccgccacctcgtccgacgacgtggtgttcgtactggccgggctgagtccgggcgccggttcgctgatcggcgggcggctgcaccggggcttcggcggggccgcgggcgagatcggcgcgctgcacctgctgggccgggacgtcacccccgagacgctcctgtccaccacggaccagccgctgcaccccctggacgaacaagcggtggcggcggtcttcgccctggcccgggagggcgaccagcaggccctggcggccgtggaccgctacatccagcggctcgtgcacgacgtggcggcactggtgctggccctggacccggaactggtggtcatcggcggctgggcggcgggcctggacggcgtgctggagccactgcggcgcgaactggcccgctactgcctgcggacaccgcaggtgaccctgtcggtgctcggcgaggccgccgtggcgacgggcgcgctgcggctggccctggaccatgccgaggaagagctcttcgcggtggagagcacgatgccaacccgccgctgaccccaccgggcccgccccggcggccctcccttgcctcgttcccccggggcggcctgcggccggcgagggggcgcgggcacgtcgtgcccgtcggcgagccgagcaggcggtgaccgacgggacgggcacacggccgccgtcaggacggcactcggcagacggcgggacagac

SEQ ID NO: 2135 - DNA, 2082 bp, Unknown
  Kingdom: Bacteria, Phylum: Actinobacteria, Class: Actinobacteria, Order: Streptomycetales, Family: Streptomycetaceae, Genus: Streptomyces
catgagcagtccgcctccgggtccgcggccccggccaggcacccccgccccgccggccccgcggacccggaggcggactgctcatgggacgccccttcggcgtccccgtgtacgtcgcacccagctggttcctggtcgccgcactgatcacctgggtcttcggcggccagctcgaccgcgtcctgccccagctcggagccgcccgctacctcgtctccctcttcttcgcggtcgccttctacggctccgtactggtccacgaactggcccacaccgtggccgccctgcgcttcaaactcccggtacgccgcatccagctccagttcctcggcggcgtctccgagatcgagaaggaggccgagacccccggccgcgaattcgtcctcgccttcgtgggcccgctgctctccctggtcctctccggcgtcttctacctcgccctccagcccgtggaacgcggcaccgtgctcggagtcctgctggcctccctgatgatctccaacctcatcgtcgccgcgttcaacctgctgcccggcctgcccctcgacggcggccgcatgctccgcgccgtcgtctggaagatcaccggccgtcccatgagcggcacgatcgccgccgcctgggtcggccgcgccctcgccgtctccgtcctcatcggcctgccgctgctcagccagtccggcgcgctcggcaccaccgccgaggacaacgtcggcatgggcaccgtcaccgacgccctgctcgccgccatcgtcgccgcgatcatctggaccggcgccggcaacagcctgcgcatggccaggctgcgcgaacacctccccgaactgcgcgcccgcaccctcacccgccgcgccgtccccgtcgagaccaccacctccctcgccgaggccctgcgccgcgccaacgccgccggggcccgcgccctggtcgtcgtcgacggccacggagagcccctctccctcgtccgtgagtccgccatcgtcggcgtacccgaacaccgccgcccctgggtcgccgccagcgcactcgcccaggacctcaccgagggcatgcgggtctccgcagagctggccggcgaacagctcctggacgtcctgcgcgccacacccgccaccgagtacctcgtcgtcgaggacaccggcgagatctacggcgtcctgtccgccgccgacgtcgagcgcgccttcgtgaaggccatggcccgccccagctgagcgcccgcttccccccagcggtggtcggcggccctcccgggggccggtaggctggtcacatgtccgaaccgaccggtgccgcccgccgccgcgggcccttcaaggtcggggaccaggtacagctgaccgaccccaagggccgccactacacgttcacgctcgaggccgggaagaacttccacacccacaagggttccttcccccacgacgaactgatcggcgcacccgagggcagcgttgtccgcaccaccggcaacgtcgcctacctcgcgctgcgtcccctgctccccgactacgtcctgtccatgccccgcggggcagccgtcgtctaccccaaggacgcgggacagatcctcgccttcgccgacatcttccccggcgcccgcgtcgtcgaggccggcgtcggctccggctcgctcagcagcttcctgctgcgcgccatcggcgaccagggcatgctgcacagctacgaacgccgcgccgacttcgccgagatcgcccaggccaacgtcgagcgctacttcggcggcccgcaccccgcctggcagctcaccgtcggcgacctccaggacaacctgtccgacgccgacgtcgaccgcgtcatcctcgacatgctcgccccctgggaatgcctggaggccgtctccaaggctctcgtccccggcggcatcctgtgctgctacgtcgccaccaccacccagctcgccaggaccgtcgagtccatccgcgagatcggctgcttcaacgagccgaccgcctgggagacgatgatccgcaactggcacatcgaaggcctggccgtccggcccgaccaccgcatgatcggccacaccgggttcctgctcaccgcccgccgcctcgccgacgg

SEQ ID NO: 2136 - DNA, 870 bp, Unknown
  Kingdom: Bacteria, Phylum: Actinobacteria, Class: Actinobacteria, Order: Streptomycetales, Family: Streptomycetaceae, Genus: Streptomyces
gccgggctgcgggccggggacggggtgctgtccggggaacggctgtccggggagcggctgtccggcgccggggtgctgcgggtagggctggccgggtccgggctgcggcggaggcgggaactgtcccggctgccccggctgtcccagggcgccgggctgcgggccgggagacgggctgctgcccggggagcggctgtccggcgccgggctgctgcgggtagggctggccgggtccgggctgcggcggaggcgggaactgtcccggctgccccgcttgccccgcctgcgcctggtacggctgtccggggtgtcccggctgccccgggtagggctgacccggcacgggctggccgggatacggctgctgctggggcaggggctgctgccccggctggggctggccgggcagcggctgtccggacatgggctgacccgggttcggccggcccgggttgggctggccgggatacggctgctgcccgggcatgggctgacctggaaggggctggccgggatacacctgaccgtggcccggtgcgggctggtacggcaggggctggccgggcatcggcggggccgcgaccgggggcgggttgccgtcggacgtccacagcccgtgcgcctgctggtgccggacgaagtcctccgcgaccatcgccgcgaggttgaagtacgcctcccgcaccttgggccgcatcatgtcgaggtcgacctcggcaccggccgccaggtgctcgtcgaacggcacgacgacgaccccccggcagcgcgtctcgaagtgggagacgatgtcctccaccttgatcatcttcccggtctcgcgcacccccgagatcacggtgagggaccgcgcgaccaggtcggcgtacc

SEQ ID NO: 2137 - DNA, 990 bp, Unknown
  Kingdom: Bacteria, Phylum: Actinobacteria, Class: Actinobacteria, Order: Streptomycetales, Family: Streptomycetaceae, Genus: Streptomyces
ggcgtacccgagcgcgaccaggcgctcgcgggccgcctcggtgctgagccggacctcgccgggggcgagctgggcgaccgcgtcgagcagcggccggtagaagatcttctcgtgcagccgccgtacgacaccggtgtgccgtttccactcgcgggtcaggtcggccaccgggtcggcgcgcaggcccagcgagcggccgaggcggcgcagccccgcgtcgtcctcgggcagcaggtgggtgcggcgcagctggtagagctggatgcggtgttccatgaagcgcaggaagcggtacgcctcgtcgagccggccggcgtccgcgcggccgacgtagccgcccgcggcgagggcctggagggcgtccagggtggtgccgctgcgcagggaggcgtcggcgcggccgtgcacgagctggagaagctgcacggcgaactcgacgtcgcgcagcccgccgggaccgagtttcagctcgcgctcgacctcgccgacggggatgttctcgacgacccggcggcgcatcttctgcacgtcggcgacgaagttctcccgctcggccacctgccagaccagcggggagagcgcggcgacgtactcggcgccgagccgctcgtcaccggcgaccgggcgggccttgagcagcgcctggaactcccaggtcttggcccaccgctggtagtaggcgacgtgactgctcagcgtccgtacgagcggcccgttgcgtccctcgggccgcagattggcgtcgacgggccagatggacccctccacggtcgtctcggagcagatccgcatcatgtgggaggcgagccgggtggcggcgcgcagcgcctcggtctcgtcgccgccctcctcggcgctctcccctacgaagatgacgtcgacgtcggagacgtagttcagctcgtggccgccgcacttgcccatggcgatcacggcgagccggcaccgcgcggcgtcctcgggggcgtcggcggcggcgatgcgcagcgc

SEQ ID NO: 2138 - DNA, 2531 bp, Unknown
  Kingdom: Bacteria, Phylum: Actinobacteria, Class: Actinobacteria, Order: Streptomycetales, Family: Streptomycetaceae, Genus: Streptomyces
tctgtccgcgcacaccggcgggcgcctcggtgacgacatcgccctggtcgcggtccgccggtgtgcgcggacagatcgcgccggacgtgatcgagcagcacctcgggcgcgcacccggaccactgggaggtgcgctccgtcagcgggtagaagacgccgcggtggtcgcgcccctcgacgacgccgtcggtgtacagcagcagggtgtcgccggggccgaaggcgagcacgtcgacggcggagccgccggcatcaccggtcagcccgaccccgagcgggggagcggggcacaggtccgcggcgacgacccggccgtcgtccggcgagagcagcagcggcgccacatgcccgcaactggtcatccgcacgaccggttcctcgtccgggacctccagcagcagcgcggtgacgaagcgttccccgctctcctcctccggctcgaagtcggcgaggtggcggctgacaccgcgctccagggacgcggcgagcgccggcagggcggtgtggtgctgggcggcctcgcggaacgcgccgagcacgagagccgcctccccgaccgcgggcaggcccttgccgcgcacctcaccgatcagcagccggcgccgtttccggtacgggcggcggcgtacagatcgcctccgatcgacgcctcgtcctccgcggccagatacagggacgccatctgcaacgaacccagccgcttcggaagcggccacagcaggaggcgctgcgcggcctcggcgaccgagcggacctgcgccggttcgcggcggcgccggtcacggaccacggacagcgccacgatcagcgcggacatcaccgccagggagaccctctgcacgatcacgttgcgctacccgagcaggtgcgagtgccggccggtgaacgcctgcgccgccacggacagcgctccgacgcatcccgtcgtccagggccctcggcccacgcggtgatcgcgggcgcgatcacccaggagcggcccgaggacgatgtccgacggggtcacgatgtcggacacggtgatgaggacgatgaggaccaccgggaccaggagcagcacatgacccgactgccgcgaccgcgcgcgaccgccgaagcgtcctctcccggcactcacgcctccacactgcaccgcggcgacacgcccgcgcacctcgggaaacccgcgggtaccggttttcccggccgtctgccagggtggtggccgtcgttcggcatattcgaccacgcgcggcgcgacctggggaggaccggaatgcgggttcccggctcgggcgtacgacggctcaggcccgtggccgcgatcggggcggcgctggcggtggtgctggtactggtgctgggcgccgcgggggcgctgacgttcacccgcgcgtccggaggcaccggcgccccggccggcggcctgacgcacaccaccgtcgaggtgtcgtccggccgctgcgggcgcggctgggaccggcccgagcccggcgtccaggtcttccaactgcacaacgtctccgaccgggccgccgaggtctacctggaggacccgcgcagccacgccgtgtacggggaggtcgagggcatcggtccgggcaccaccaggacgctgaccgtccgcgtcggcaagggcgcgtacgcgttccggtgcgtgcccgaggacgccgacgcggtgaccggccccacggtccgtgtcgaccgcggcacccccggcccggccgaggcggcgatcacccagcacgacctgatcccaccggcgatcgactaccagaagtgggtggcgggcggcctggacgaggcggtgcggctgaccggcctcctgcgggacgcgatcgacggtggcgacctcggccgggcccgtacggcctggctgcccgcgcacctccagtacgagcggctgggcgcggcctacgacgccttcggtgacgccgacggacggatcaacggcaccgacgcgggactgcccggcggcgtccacgacccgtccttcaccggcttccaccggatcgagtacgggctgtggcacggcgagagcgcgcggacgctgcgggccccggcggcggccctgctgcgggcggtcaccgcgctgcgcgacacctggtcgcaggcccgcatggacccggcccagctcggcctgcgggcacacgagatcctggagaacaccgtgcagttcgagctgaccgggcgcaccgactacggcagcggcaccagcctcgccaccgcccgggccaacctggacggcacccgcgccgtactgtcccggctgcgcccgctgctcgccacccgctacgcagctctgccggacctggaccgcggcatggaacgtgcccgggcactcctcgacggttcgcggcacggcgaccggtggacaccgctgggccggttgagccgcacgcagcgcgagcggaccgacgccgtgctgggcgacctggtggaacggctggcttccgtggccacgctctgcgatccgcggcggacgtcgtgacggaggaccagcggagcgagcagacgcagagcgagcagtcgcagagcgagcagtcgcagag

SEQ ID NO: 2139 - DNA, 1681 bp, Unknown
  Kingdom: Bacteria, Phylum: Actinobacteria, Class: Actinobacteria, Order: Streptomycetales, Family: Streptomycetaceae, Genus: Streptomyces
gctggggctcatcggggctgctccggtgccgagtagagggggaggcgtgggtccacgggctggtcgggccaggtgccgcggatccaggcgtggtcggggtggtcgctgatcagccaggcgcgttcggacccggggcccgccatgacgttgaggtagtacatgtggtggccgggcaccgccatcgacgggccgtgccagccgtccgggatcagcaccacgtcaccgtcgcgcacctcggccagcacgtcggtgtcccggccgggaccggacggcgagacccgctggtagccgaggcccggtgtgccgtcgtggccggcgaactcgaagtagtagatctcctccaggaccgactcctcgcccggccggtgctcgtcgtgcttgtgcggcgggaacgacgaccagttgccgcccggggtgagcacctcgacggcgatcagggcgtcgcagtcccatactcccgcggcggcgaagttgttgacctgacgggagcaggcgccgctgccgcgcagttccaccggtacgccggacgccgcaccgtagcgggcgggcagacaccgggtgcagcgggcgccggtgagcgcgaagcgcccgccgccggcggacgagacggtcgtccgggcgtcccggggcacgtaggcgaagtcgctcacgccgctgaacacgctctcgcggccggtgagcgcgaacgtgtcgtggcccaggtcgtccgcgcaggcgacggcgcagccgccgctcagcggcagcacgatccactcgctgtcgccggtgtcgaaggtgtgcgagccgcccggtgccagttccaggacccggagcgaggagtggccccagccggccgactcgggggtgacgtgcacggcgtaggggccgtcggccgcctgaccggcgcgcaggtggtacgggctcgcggtgccgctcgggcggatcgggcccgggggcgggggcgtacgggtcatcgggtgcggtccctcctcgtcacagcgggcgtcgcagcgggcgtcgcgacaggctcccagcgggcgtcacagcaggctcacggccgtgtcgaccgcgtcctcgacacggcccttcgccggatacagcagcgaacggccgacgaccatgccctggacggtgggcagccgcagggccttgcgccagcgtgcgtaggccccctcctggtccgcaccgatctcaccgcccagcagcacggccggcagggtcgaggtcgccaggacctcggccatgtcgtcagggtccgcggtgaccggcaccttcagccaggtgtacgccgaggtgccgcccagcccggaggcgatggcgatggaacgcgtgacggcctcggcggacaggtcgttgacggccctgccgcccacccggcgcgagatgaacggctcgacgaacaccggcagtcgcgccgcggccatctcgtccacggtgcgcgccgccgactccatggtggccagcgagccgtggtcgtcgtagtcgatgcgcagcagcagtttcccggcgtcgaagcggagccggacgatgtcgcgggcgcggtggccggtgaagcggtcgtccatctcgaaggacgcgcccgccaggccgccgcggttcatggagcccatgaccaccttgccgtcgagtgcaccgaggagcagcaggtcctccagtatgtcggcggaggcgagcactccgtcgacgccgggccgggacaggg

SEQ ID NO: 2140 - DNA, 750 bp, Unknown
  Kingdom: Bacteria, Phylum: Actinobacteria, Class: Actinobacteria, Order: Streptomycetales, Family: Streptomycetaceae, Genus: Streptomyces
gcccggcaccggaggtccgccggtcggtcgtcgccgccgcgctgccgggccgggcggtcaccgccgggccgctcctggtcgccgtggccgacgaggaggagaccacgctgtggaacgccgataccggcgcgcgggtgcccctgcccgtcggcgacgccaccgtgaccgccttcgcgtggaccacggcctgggacggacccgtgctgatcaccgcgcacagcgacgccagtgtccagatgtggtcggtcggcccgcgcgccggtctcgacctcgccggggccccggcgcgcgtcggcaccctgctgagtcacagtctgcccgtgcagaccatggtcgccttcgcggacggcggcggacggaacctgctggccaccggcggcgcggacggcaccctgagcctgtgggacctccgccgccagtgccgcctcgcgtgctgggacgaccacatgctgagcgtcagggacctggccgtgctggacaccgggcgcgggcccctcgtcgtctcggccggtgcggacgggaccctgcggcgatgggatccggccaccgggccggccggtgcgcctgtccactgcgctcagcagggcgtccacgccgtggccgccgtaccggccgcgcccggtgagcgcgcgctcgtggcgtcgggcggcgaggacgggaccgtacgcctgtgggacgcgcggacgctgcggccggacggggccgcgctggacgccgccgacggccccgtcacggccctcacctacttcc

SEQ ID NO: 2141 - DNA, 1901 bp, Unknown
  Kingdom: Bacteria, Phylum: Actinobacteria, Class: Actinobacteria, Order: Streptomycetales, Family: Streptomycetaceae, Genus: Streptomyces
ccacgccggcgtccagaccgggccgcagccgccgcggcggcacgatcctgcccggcgcgcccggaaccgcgccggtgaccagctcgtagccgaccgcgcccaggctgtagacgtcggcccgcgcgtcgatgcccgagcccggctcggcctgctcgggcggccggtacccggccgaacccgcggcgagcgtcagccccgaggcctcggccaggctcttggcgagccccaggtcggccaggagcacccgccgggtgccgtccggcgcggtgcgcagcaggacgttgctcggtttgatgtcccggtgcacgacgcccgcctcgtgcagcgcctgcgcgctccgcgcggccagcgcggtcagccgcagcgcctcgggcagcgggagcggacctgcggcgagcaggtcggcgagcgtgccggcgtcggcgtactccatgacgaagtacggcctgccgtcgggcagttcaccgatgtcgtggacctgcaccacacggggcgaggccgccttgcgcagcagccgcgcctcggaaaggaaccgttcccgcacgtccaggcggtgcgaccagttctcggcgaggaccttgacggcgaccggggcgtccagttcgtcgtcgtgggccagccacaccgtgccgaaggcgccggtccccaggcgccgttcgagccggtagcggccgatccgtccgacggagtgcatggcactatcatgcctgctgcgagatcgactccgaggaggcccgtcgtgcccgatgcggcgccgaccgaagaactcgcccggcgcgccgcggcaggcgacggcggcgcgctggaggaactgctgcgggagatccgtcccgaggtggtgcggcgctgcgggcgtttcctgccctgccgcgaggacgcggaggaggccgcgcaggacgtgctgctccagctcgcccggcggatcaccaccttcgagggccgcagccggttcagcacgtggctctacacggtcgtcgccaactgctgccggcagaagtaccgcgaactcaagcggcgcgcggccgagcagccggcccctatcgaaccggcccagcacgtcgacccgcgcaccaccagcgtcatcgcgggctcccgcgtcgacctcctggaggcgctggaacggctggagcgcgagcatccccacctggtggcgccgctggtctaccgggacatctgccgcctggagtacgccgaggccgccgaacgggccgggatcccgctgggcaccctgaagtcccgcctgcacgaggcccgccgccaggtcagaccctggctctccgacgcgtcctgaagcagtgacggacgacccccgggcgcccgccgccggtctcgcgcggcccctcgccgcaggttccgcccggctcgcccgccctcggtccagggcctgtccggcggatcctcgtccggctcgcccgcgtcggccgccgggccgccctcgtcggtcccggtcggctcactcctcgtcgagcaggcccagttccgcccagatcgtcttgccctcggtggtgtgcctgctgccccagcgctgggtgagctgggcgaccaggagcagtccgcgcccgccctcgtcccaggtcttggcccggcgcaggtgcggagcggtgttgctggtgtcggagacctcgcagatcaggtgtgtgtcgtcatggatgagccgcagcctgatcggcggggtgccgtaccggatggcgttggtgaccagctcgctcaccaccagctcggcggtgaacgccaccatgctcagcccccagatctccagctggtcgatgacctgcttgcggaccggcgccaccagcgacgggtccgccgggatgtcccaggtggccacctgggagggcggcaggccgcgggtgcgggcgagcagcagggccacgtcgtcggacgggctgcccgcgggcagc

SEQ ID NO: 2142 - DNA, 864 bp, Unknown
  Kingdom: Bacteria, Phylum: Actinobacteria, Class: Actinobacteria, Order: Streptomycetales, Family: Streptomycetaceae, Genus: Streptomyces
ctgctcgccgagaccgtcgcgtccgtcctggccacgtccgcgcgcagcacgctgaacggcttgccgccgtcgacgccgtcgaggtgggcgctcagcgcggtctgccgggcgctcgccggtgcctggacctcgttgagggagagggtgagcgggacgttcaccgtcttgttgagcagggacacgtcgaggccggtgcgcaggacggaggcgctcgcgcggccgtggtcggcggtcgcgtgggcggagccggcaccggccagtgtcaccggggcggcgaccaggacggtggccgcggctgcggtgacgaggcggcgtgcgggcatgcggaaggtgtggccgttcacggtggtgggacccccagagaggaatgcttgggacccggaaagaattacgcaccgagagtgaacggtcagcgatccagcgtgacttcactccttagtggggtttccggcctcgttttcgatttgccctgtacgggtgttcgcttccgtcaccctcccggtcctctcctgcggccccggcccccggcacacccgcgcacacgacggagtgcacaacgagccacccgcggcctcggtcacctctcgtcaaccgacgaccgctcctcgtcggccggtgaccgctccgcgtcgggccggtcagccgacgatccggccgttcagcaccacccgccgcggccccgccagcacccgtacgtccgcccgtgggtccgcctcgtacaccacgaggtcggccggcgcgccctcgtccaggccgggccggccgagccatgaccgggcgccccacgccgtcgccgacagggcttcgagcggcgggatgcccgcggtgaccagttccgcgacctcggccggcccggcctggacg

SEQ ID NO: 2143 - DNA, 723 bp, Unknown
  Kingdom: Bacteria, Phylum: Actinobacteria, Class: Actinobacteria, Order: Streptomycetales, Family: Streptomycetaceae, Genus: Streptomyces
catccacgcgacgcgtcggcggcacgcaagccgctcatgcgggaccggcagaccccacggacccggcacccccgggccctggcagacccagcaggtcccgcgggtccagcagccccggcaggcgcggccgggtccagcagcccctgcaggcggggccgggtccggcaggcacggcggagggtggcggaggtggttcgtgcgagggtgccgcgtactctgctcgcgtgtcagcctctcgtctgcggcgcgtcgccgtcctcgtgctcgacggggcgaagcccctcgacgtcggcattccggcgcaggtgttcacgacgcgcgcgagcatgccgtacgaggtgcgtgtgtgcggcgccgtccccgggctggtgaccggtggtgacggtctgtcgtaccacgtcgcccacgggctggaggcgctcgagtgggccgacgtcgtgttcatccccggctaccggtccccggaccgcgacgacccgccccgggcggtcgtcgacgcgctgatcgccgcccaccggcacggcacacgcctggccgccatctccacgggtgccttcgcgctcgccgccacggggctgctcgacggcaggcgggccacgacgcactggcactacacgcgggcgctcgcggcgcggcatccgctcgtccgggtggacgagaacgtcctgttcgtcgacgagggcagcgtgctgacgtcggccggtgcggcctccggtatcgacc

SEQ ID NO: 2144 - DNA, 1220 bp, Unknown
  Kingdom: Bacteria, Phylum: Actinobacteria, Class: Actinobacteria, Order: Streptomycetales, Family: Streptomycetaceae, Genus: Streptomyces
gtgcgggagcagtacgtccgggtgaccgggacggggacgggagcggtgccgggtacgcggtgaggcgggagggggcggggcgggtgcagaggccggtgctgggagtgctgggggggtgctgggggtctgtcacctgtccgggtgagcgagttgtccacaggcgggcggtggtccacaggtctgagcgggcccgtcccggcggcggcagtctggtgccgcggcgatcgcgacggacgcggtcggcgcggcagacgcagccgtacgggacgggcccgtacgcgtgtccgcccggtccggacggccgggcgagggaggggcagacgatgaacgagacgacggtctgcgtggtcgggaacgtggcgacgcagccggtctaccgggagccggtgtcgggcgcgtcggcgcggttccggctggcggtcacctcgcgctactgggaccgcgagaagagcgcctggacggacgggcacaccaacttcttcacggtctgggccaaccgccagctcgccacgaacgcgatggcgtcgctgaacgtgggcgaccccgtgctggtccagggcaggctgaaggtgcgcacggagacccgggacggcaccagccggacgtcggccgacatcgacgccgtggcgatcggccacgacctggcgcgggggacggcggcgttccgccggacgggcaggccggagcccggcgcgaccggtgccccggcacagcccgaaccgacctgggagacaccggagccggccccggcggcctcaccggcgaaccaacaggagcgcgaaccggcagcggtgacgtgacgatgccgtgacgacgagtgcggccggccgaccggtcccgcaggaccggccgcgccccgccgtgcacactccaccgcgtcgcccgccaactcccgcccgacacacccggtcggggcggatttgtcgataacccctgttcaccgcagggccggtcggcgataacgattccgattcggatcagccacctgacggtctgacagcaagtgccgctgcgaggggtccttaggatgccgaggtagctctctgggcttggagattctgctggtgggaccgcacccccacatgaacgggtcctgctcgaaggggaattctgtgtgtgcttcgtactccgcgcggtccgtgcgcgggcggggggcggccggtctcgccgccgtggccctgacggccggactcgtcgccgcgggtgtgctggccgccccc

SEQ ID NO: 2145 - DNA, 1592 bp, Unknown
  Kingdom: Bacteria, Phylum: Actinobacteria, Class: Actinobacteria, Order: Streptomycetales, Family: Streptomycetaceae, Genus: Streptomyces
cccgtgacctgggcggcagcgtccgcatgccggccaccgacatccccggcgtcggccgcgtcgcccggctcgccgacccgtacggcgcccgcttcgcggtgctcaggccggcaccgagacagcaggcctgagcgagggtgccctggccggacccgcgcccgcgccgctcagcggacggccgggggtcaggcggaggcgcggcggatcagggtggtggggaggacgacactgcgcgaggtgtcccccgtccgcctgtcggagccaccggagctgccggagcggcggaagcttgagggccggcggtcgtgcagcaggaggcgggccatcagccggcccatctcctcgatgtcctgacggacggtcgtcagcggcggatcggtctgctcggcaaccggcagcatgtcgtcgaagccgacgacggcgacgtcctcgggcacccgcagtccgcgctcgcgcagcacgcgcagggcgccggcggcggtcaggtcgttcgcggcgaacacggcgtcgagaccgggcacccggtcgaggagttcgcgcatggcgcgctcgcccccggccggcgtgaagtcgctcgccacgacaagccgcgagtcgtccccgcccgtgacctcgcccatgacgtcccggaagccttcgagccggtccgccgccgaggtctggtcgatgggcccggcgatgtgggcgatccgcgtgcggccgaggccggccaggtgccgtacggccgtccgggcgccacccctgttgtcgctgtcgacgtacaccgcctcccccgtgccgtcgctccagccgggccggccgccgaacacggtcggcacaccggcgcgctggatcagcccgggcagcgggtcgtcgaggtggagggagaagaccagcgcgccgtcgacgtgcccgccggcgagatagcggccgacccgggcgtggtcctcgcgcccttccgtcagcagcagcacgagctgggcgtcgtgggccgtcagttccttgctgatgccgcgcagttgcagcgcgaagaaggggtcggcgaagacgcgggtctccggttcggcgatgacgacggcgacggcgtcgtgccgtttggtcaccagactgcgggccgcctggttgggaacgtagccgagttcctccacggcctgccggacccgctcggcgagcggctcgcgcacgccctcgccgccgttcaccacccgggacacggtggcccgggagacccccgcccgcgcggccacggcctccagcgtcggacgcggcgctgtctcactcacttcggggctcctcacaggcggctgcggatcagaatagccccgtccccggcccccggatgagagcgctctctcctccgtccggccagcctcccggcccccagtgacctgtgccagcccggcacccctgggccctcaccccagcagatccacccgttgcccgatccccagccgctcggcgcgttcgtacgcctgccaagccactgcgaggtcctgccagggcaggccgacaggggcgtagaccgtgcggtcggacgggtgggtcctgcccgggtgggcgccggtcaggatctcgccgagggtggcgtcgacggtcgtggcgggccggcccgc

SEQ ID NO: 2146 - DNA, 769 bp, Unknown
  Kingdom: Bacteria, Phylum: Actinobacteria, Class: Actinobacteria, Order: Streptomycetales, Family: Streptomycetaceae, Genus: Streptomyces
gcgcacccactcccgcgcgggacgcgggccgtccgggctatcggctgcccgcggcgcgcaggagcccggcctgaccggcccaccgggaggggcggatcaggggccctacaaagagcccttgcgtgacagatggttgaaggccagccacccgggcagcacgggcagccagagcgtcagcagccggaacatcagcaccgcgggcgccgccacctccttgggcagtcctacggcgatcagacccacggtgagagtggcctcgaccgcgcccacaccgcccggggtcggggcggcggaaccgagcgcgttgccggcgaggaagaccacggccacgctcgcgatgctcagggaggtcgactcgtcgccgaacgcccggatggaggcgtccaggcacatcacgaagcaggcggtcagcagcagcatcccgccgatgccggtgacgagcttctgcggccgctgcagcacgtccagcatgcgcggcaccacaccggcgaagagcgagcgcacgcgcgtgaccacgaacttccgcaggaacggcaccgaagtgaccaccaggacgagcaccgcgaccgtcagcagtccggcgatgaccgtccgggacggcgacagcgacggcgtcttctccgtgcccgtcagatagccgaaggacagcagcatcaggatgtggcagccgagcccgaacagctgggacgcgccgacactcgccaccgcgagcccggggcgcacgccggcgcgctggaggaagcgcgtgttgagggcgacaccgccgacc

SEQ ID NO: 2147 - DNA, 682 bp, Unknown
  Kingdom: Bacteria, Phylum: Actinobacteria, Class: Actinobacteria, Order: Streptomycetales, Family: Streptomycetaceae, Genus: Streptomyces
gtccgcaccccgctgcgcatcccgtccgcgccgacgacgtacgccgcccgcagcgacgcggtccgcccgtcggcgccccgcacctccaccgtcacgccgtccgcgtcctgggacagaccggtcacctcggtctcgtggcggaagtccacaccgtgctcggccgcacgccgctccagcgccttctccacctcgtactgcgggaggacgaggacgtgccggaagcgggacgggaggccggtgaggtcgatggcgagccggccgaagagctggagccggtccaggggccggccgagggcctccaggccgtcggcgagtccgcgggcgtcgagctgttcgagggtgcgggcgtgcagggcgaaggcgcgggagaggttgctgatgtggtgcgggcgcttctcgaccagggtgacggggacaccggcggcggcgaggtcaccggccagcaggagcccggtgggaccggcaccgacgacgatcacgggagtggtcatggggcctcctcaacacgggtgggccaacacgtgtgggccagcaggcctgggacaacactcgtgggccaacgcttgttgactaacgtagacccgtcactgcaggcgagtcaacgcttgttggcccacgggtgttggcctacgcttgttggcatgcctggccccacctcaccgtccccgcccgacccctcctc

SEQ ID NO: 2148 - DNA, 1289 bp, Unknown
  Kingdom: Bacteria, Phylum: Actinobacteria, Class: Actinobacteria, Order: Streptomycetales, Family: Streptomycetaceae, Genus: Streptomyces
ccgcctcaccgggcgcgacgaggccggcgaccgcctgggcgatccgctgtttctccgaggcgcggcgggccgtcttgtagcgcagcggcagctcgtaggagacgccgtgcacgaccgcgccgccccgggtgcgtacgagcatctgctgctcggcgagctggtcgaagtcacgccggatcgtcgcggcggacacctgcaaccgggtcgccgcctcctcgacctccagacggccctgctccacgagcagttccagcagcgccttccagcgggcgtcgcgcgacatccgcagcctccgttcgtccattccccgcgaccttagcgcacccggcgcgcgaggaaatgcttgattctgctcgaaagtggcctgtatcttgcaagaacaatcagatgacccgggagggtgtgccatgagccatgtcgaggacgagctgaccagccagccggagtgctggacccgagtcgcggccgacgccgcggagcacggccgggcgcttccggcaccgggggagcgggtcgcgatcgtcggctgcggaacctcgtacttcatggcgcagtccgccgcggcgctgcgcgagggcgccggacagggcgagacggatgccttcgccgcctccgagttcccgcacggccgttcctacgaccgtgtcgtcgccctgacccgctccggcaccaccactgaagtgctcgacctgctgggccggttgaagggcaccacccgcaccaccgccatcacggcggacccggccaccccggtcatgtcggccgccgacgacgtcgtcgtcctcgactacgccgacgagcgctccgtcgtgcagacccggttcgccactaccgcgctcaccctgctgcgcgcccacctcggcctgcacaccgacgccgtcgtcgccgacgcccgcaccgcactggccgagccgctgcccgaagggctcgtcgactgcacgcagttcaccttcctgggccgcggctggaccgtgggcctggccaacgaggcggcgctcaagatgcgcgaggcctccctgtcgtggaccgaggcgtacccggcgatggagtaccgccacggccccatcagcgtcaccacggagtccaccgccacctgggcgctcgacgaggcaccggaagggctcgccgaacaggtcggcgccacgggcgcgctgtggatccagggcagcctcgacccgctggccgaactcgtgcgcgcccagcgcctcgcggtcgccgtcgccgcctcccgcggcctcgaccccgaccagccgcgccacctcacccgctcggtgatcctcaccccctga

SEQ ID NO: 2149 - DNA, 537 bp, Unknown
  Kingdom: Bacteria, Phylum: Actinobacteria, Class: Actinobacteria, Order: Streptomycetales, Family: Streptomycetaceae, Genus: Streptomyces
gtgagccgggcagctgccgcagcctggccaccgtctgcccggcgaccggagccggcgccgcgacggcgaagggcacgtccttgggcttcgggtggtgcagcgcgcccacgtacgaggcgatgaacagcagttgcaacgccaccacgccgatgacgagcagcgtggcccggggagtgacggcgtccttgacctcctggaggaagggatgccggtgccggcgggcgtgcgggtgggtcatgtcctcacgctgcgtggcgggcggcgtttgcgcaggtgggacacgcccgaacggatgtcgcacagacgttcgggaattggtttatggtgggtggagagagcgatggaactgatgttcgagagtcggcgagagcctgttcgtgcgggctcgtgagtgcgggaggtgcggtgccgggcttcacgcatctgcacaccgtctccgggttctccctgcgctacggcgcctcccacccggagcggctggccgagcgtgccgccgagcggggtatggacgccctcgccctcaccgaccgcgacacc

SEQ ID NO: 2150 - DNA, 1931 bp, Unknown
  Kingdom: Bacteria, Phylum: Actinobacteria, Class: Actinobacteria, Order: Streptomycetales, Family: Streptomycetaceae, Genus: Streptomyces
gtgatgccgtcgtagggccggcgcgccggccctacgacggcatcacctcgcaccgggccgtcgcctccgggcaggtcgcggtcgcgggccgcgccgggtacttcgtgcgctggcgggtccgtaccggcaagggccccggcggctacgtcgagtcgctggccttctcctccagcaccggcgccgaagccccggtcatcgtccgcttcgccttcgacgcgggccccggcgcaccgcccctgaccgacatggaccggatcatcaagggcatccggccggtcggcgacaccagtacgggcggcggtgtcggcagcagcctcggcccgaccggctgacgggcacggacccggctgacgggcacggactcagcggctcacaggaaggtgcggccctcgccccggtacgtcggcacggtcgccgtcacccggtcgccctcgaccaggtgcagcgcgtcgaaccgctcgcacagctcaccggccttcgcgtgccggaaccacaccttgtccccgatcagcaggtcgtcggcgggcgagccgagcagcggcgtctgcacctcgccgggcccctcctgagggtcgtagcgcaggccctcgggaaggtacggcaccggcagccggtcctgaccggccacgccggacgccgggtagccgccgcccagcaccgtgacgaccccgacgcccggacgccgtacgacgggctgggcgaacagcgccgccggccggccgcggaaggacgtgtagttgtcgaagagccgcgggacgtacaggcccgagcccgcggcgatctcggtcaccgccgcctccgccgccgtgtgctgcacactgcccgtgccgccgccgttcacgaactccagctccggcgccaccgcccggaccgcccgcaccaccgcggcccgccgctcggccagttcacggcgcgccgccgcctgcatcagccggatcgcccgtgaccgcaccggccgccccgccaccgcgtcacccacgcccgcgacgtgcccctcgtacgccatgacgccgacgagccggaaccccggccgccgcgccaccgtacgggccatctcggcgacctgggcgggggagtacagcggggaacggcgcgcgccgacgcggacccggccgccgaacagcttcagcgacgtgtccaactccaggcacacccgcaccacttcgcccccgccgtcccgggcggcgtcgacgaggtcgagctgcgcggggtcgtcgaccatcaccgtgacggccgcggccagcttgggatcggcggccagttcggcgtagccggcgcggtcggcggacgggtaggcgagcaggacgtcgtcgaacccggagcgggccagccacagcgactcggcgagcgtgaacgacatgatgccggcgaaaccgtccttcgccagggcccgttcgagcagcgcccggcagcgcacggacttgctggccacccggaccggcttgccggcggcccggcgcacgaggtcgtcggcgttggcgtcgaaggcctggaggtcgacgatcgcgacgggggcgtcgagatgggcggtggcccggtcgtaacgggcccggtctgcggcgcgtgcggtcatggacgcagcctgccagacaggattaccgcggggtagggggacgttccgggcagatgcgcacgcccgccaggtgcggttgccgccgacgcgcgctcagcccgtagagtgacgcgcacgtacggcgcggcggcggcacgttcccggccgttggcttgagccgggatggcccttcgtacgtacgggtatgcgtgtccggtgacgacgagtcggcgccgggcctggcgacgaggccgagcgcgagggcacggcccgggcacggcggaacggggggtgcatgagtacggaagcgcgccacgctccgatacctccgcgcccgtcgcaccgccgccgcccgccagggggcggggcccgtcggggt

SEQ ID NO: 2151 - DNA, 1097 bp, Unknown
  Kingdom: Bacteria, Phylum: Actinobacteria, Class: Actinobacteria, Order: Streptomycetales, Family: Streptomycetaceae, Genus: Streptomyces
ccgggacgggcttgggccgggcgcggcggtacggtacgccgcggcggtcgaagaacggcgtgtccaccacaccgggcaccacgtggctgatgccgacgccggtcccccgcagttcgtagcggacagcttcggcgaacgcgcccagagcggccttggcggccgagtagacggcctcgtcgcgcaccccgacggtcccggccagggaaccgatgatgaccacacggcccgtgccctggcccaccatgtgcggcagcagcagccggaccaggtgcacggtggcgaggacgttgacgtcgaacacctcgtcgatggcgggctgcggcatcgtgctgaaggggccggcccagccgatgcccgcgccggccacgaggaggtccacccggccgacccggtcgagggcgaactgggcgagcctgcgctcggctcccgggccggacaggtccgccgggtaggccagcgcggaggtgccccgggcgacctcttccagccgtgcgcggtcccgcccgttgagcaccatccgccagccgccctccgccgcgagccgccgcgcgacggccgcgccgatcccggaggaggcgccggtcaccagcgcgcccccgcccgtcggcgtgccgccggcgcctctgcggcgctcggcgccctgcgtcgccggtgcgtcgggacggatcccggagccgggccgtacgcgggaaggggcttgggtcatggggcgcacctctggatcgacgggcccggggccgccggtgcggccccggtggtccgggacggccatgccgggcgtggagtatcccgggggccgggtccgaaacgtgtggcgggctggggcgggtccgttcgtttggctgcggtgggtgagggttactcacttccagtgtcgtccgaaacgcccgtgccgccaccgctgcccgccgcccggggccctgcgactgagcccgagcggccccctgtgcccacccctggaagcagcccggcggccggctccgggaccggccccgcggccaccgcagcggccgaccgcgccaccaacccccggacgggccccgcaaccgggcctgccaccggacccgcgtgcggcaccgcggccagccgggccagcg

SEQ ID NO: 2152 - DNA, 746 bp, Unknown
  Kingdom: Bacteria, Phylum: Actinobacteria, Class: Actinobacteria, Order: Streptomycetales, Family: Streptomycetaceae, Genus: Streptomyces
ccggcggccacgcgcgcgtactgctgggacaccgcggacgcggcgaccccccagtggcggccgcagtccgtggccgccgcgggggacgcgacgggcggcggccggtggggcacgcaccgcgtgatcttctccggctggacgcaccgcggcgacgacaccggccgcgggcggctggcccgggtggcgttcgtcgacgccgacgacccggcccgcctcacctacacctgggcgctgctcgcggtgcccgtggacggcggacgcgactaccgcgctctcgcgtcccgcgtgtcgggcatggtccggtaccaggacaagctgctcgtcaccacgtcgggcggcggcgagcgggacgcgctgtacgtctacgacctgcgccgcatccagcgggccaccgtcgcctccgacgcggtcggccgggtgccgggcggctggtcggcgcacggctaccgctgggtcctgccggcggtagcctcctaccgtccggcggtgggcggctgcgacgaggcgtccactccgggcagtacgtcaggcggtgcaccggggcgtgcagcgggccgcgcatcgggggccgcgtccgcgacaccggtcccggacggcggcaccgcaccgccctgccccaccggcctctccctcgacgacagttccgcgcctcagagcctggtcgcgagtcagacggcggccgcggacggcgaccgccacacccgtctgtggcgctactccttcagcacggacccggcgcgcgccgg

SEQ ID NO: 2153 - DNA, 653 bp, Unknown
  Kingdom: Bacteria, Phylum: Actinobacteria, Class: Actinobacteria, Order: Streptomycetales, Family: Streptomycetaceae, Genus: Streptomyces
cagcgcgtcggcgtccaggccctgttgcccgtagcccgcgcggcaggcggggcagaagcagagggacatcaggtactgcccggcgtcgccgaggccgaccccggcggtcttgtcgtgggcgtgcaggtgggcgaggccgtaccagccgagggactccagttcggtgccgcgtgcgccgggccgtacggcggcctcggcggcgaggtcgacgaggtacgcgcgggtggcgggctgggcgatgcacggcgcccacgggtagcggtcgccgtaggcgttgacgacggaggtgtccgggtgctcggcgccgagccgcgagttgtgcgcgaggacgacccaggtgtgcacctccagaccggccgcggtcagcgcctgggccgcctcgccgtacgcgtccccgggcgcccagtcaccggcggggtggggctgcagcgtcctcccgtgccagcggctaccgggcgggtagaggacggccgcgtactcggcggtgaccacgcggtggcgcgggtgacggggggtcagcgcgcgcgtggagtggtaggcggcggcgagggtcgcctgagccacgccgagcgcggcgatgcgctccggcgcggcggggtcgccgtcgacgtccccggggtagacgaacgccgacgccctcacgcgtcaccgcc

SEQ ID NO: 2154 - DNA, 736 bp, Unknown
  Kingdom: Bacteria, Phylum: Actinobacteria, Class: Actinobacteria, Order: Streptomycetales, Family: Streptomycetaceae, Genus: Streptomyces
ccttcatcgtggcgcactggaagccgggcgcgccgcagtcacgccaggtcagcttctgcccgtagtacggcgccagggcggacggcgtggagcgcggcagcgcagccagcaccgcgtccgccgcgggcgccgcctgatgccggggctccttcgcggaacagcccggaaggacgagcagggctgcggccgtgaggagcgcgaggaggccgacgccggtgcgggaacggctcggggggccggcggtgcgggtcggcggtgcggtggtcatggggtcgttcggggggtcgccgggaaggtcgctcggacggagggcgcgcctgaagtacatcgagcgagcgtaactctccgcgatcgcctgcggacgcttcgcgcgcgccgtgccccgtacgagtgacgccgcccttcaggaatcagcacggagagtgacgagggggcctacgcggcggtcggcggggcgggcacgggcgcgtcggctgccgggcggcgtcagcccgctctcagtgccatcgtcatcgcctccaccgccagcagcggggccacgttgcggtcgagggcgtcgcggcaggcggcgatcgcttctatgcggcgcagggtggcctccggggaactgccccgggcgacccggtccagggtgtcctcgacgtccgcgttggcgatcgccacccgggagccgagctggagggccaggacgtcacggtagagggcggtgaggtcggtcagggcgaggtcgaggctg

SEQ ID NO: 2155 - DNA, 1434 bp, Unknown
  Kingdom: Bacteria, Phylum: Actinobacteria, Class: Actinobacteria, Order: Streptomycetales, Family: Streptomycetaceae, Genus: Streptomyces
acccgggcccccgtcgcccggaacacggtccgcccgtcccggacgagcgtcgtgcggtcgggcccggcggagacggcgtacgtgtgcccgcgcagccgcacgttggcgaccgtgttggtgccgggcaggccgaggctgccgaacatgagggccgcggggtcgccgtcccaggggttgtcggagaggagttcgtgcaggccctgcaccgccatcgcgttggaccaggagtaggtgcgccaggccgagtcgacggcggagtccatgacccactggccgggctccgggtcgaaggactcggggaaccagttctccttgtcccacacgtcgaggtacatcgcggcgctccgcgcggcgaactgcccggccgccgcgtcgaagccgtagcgcttgacgccgtcgtacacggtggcgttcatcggcggccacacggcgcccttccactgctcggcggcggagccctcgccgtagcggtcgaagaaccggaagtgctcggaaccggggtgcaccgggccgccggtgcagtaggccgggtcgttgcgcgccacgctcgggaccacgtactcgccccagaactcgcgcgggtcgagcaggtgccgctcgaccaggatccgggcgcgctcgggtgtggcgagcccggcgaacagcgggtagaagacggtcggggtgaccacctcgttccaggtgccgtccaggtagcggctcaggtacagccccttgccggggtgccacaaccggtcgttgagcagccgccggatcgtcgcgtgctgtgcggcgaaccgggccgcctcgcgcggtctgcccagcacatgggccatcttcgcgagcgtctcggcgagcagcgcgtagtacgagttgagggccacgtcggtcaggtcggtgttgtcgcgccggtcaccgctgccgccctgcttggcgatccggtggtagccggcgtagacgggactgtcgtccaggccgaggtggttgccgcggccgccgatccggtccccgaagtaggggctctccagcagcccgtcctcgtcggtgtcccactccggcagcaggtcgtggaaggtgacgagcgcggggtaggccttctccagcaccgaccggtcgccgaacttggtgtacagccgccacaccgcgtacgcgtgcatcgggccggagttctgctggtcgtagcgcgggccgcgcagcgggacctggtggggcggggccggtgcgtcgaagacgtccgtctcgtgctggagtgcgagcgggcggctgaccagggccgcgtccacggcgtcgaacgccgagtcccagccggtgaacagcccgcctccgccgccccagccccacaggacgaaggcgcgccggtggtccttgtcgtagttggtgttgagggacagcgcgtcgcgcaccgcgtccgccgcccggcccaccggccccgaaccggtgaggtgggccgggcgg

SEQ ID NO: 2156 - DNA, 1961 bp, Unknown
  Kingdom: Bacteria, Phylum: Actinobacteria, Class: Actinobacteria, Order: Streptomycetales, Family: Streptomycetaceae, Genus: Streptomyces
gcccccgccgtccgaaccggccgccgggcacggcgttccgcaggggggagcgccgtgcccccggggttctccgccccgcctcggtcacgggtccttgcgtatgccgacgagcagttcctggacggcgtggtccgacaggccgcgggggtcgaggaagcggtagcgttccgcgcgcgcgccccggctggtgaaagccagatcgagccgccaccaccgcagccaggcggcgccgcggtgccagctgacggggtagggcgacgtacaggcccgcagggcgtccgtggcgaccgccgaaagtctggcgatgtcgccctgggagcggctcaggttgaagtcgccggcgaccagcgcgggcaggtcgttgtcccggacgtcgtcgacgagccggtccagttggcggttgcggctggccagccgccggcggaccgcccggtacagcgccgcccggaacgggttctccaggaacacgtggaccggcaggtgcacgttgtacgtggacagcacgggcgcgccgggcaggctgtcgatcctcaggtccacccggaacacctcgggcgccccgatgtcggggaccgccacgacggggaaccgggtcagggtgacgaactggccccggaccaggacctggtggccggggaactcgcgcctgagccggtcgcggaagtcgaccggaacgggcggggcgtgcacaccggcgtcgtagatgtgctcctgaaggaggtagacgtcggcgtccaggccgcgcaggaaggcgtagaaggcttccgtgtcgacctcctcgtcccagtgctgggtgttccagcacaccacgcgcacgccctcaggtcccgggccggtgcgtcgcgcgcgcagcactgcccagggccgcagcccgctgtgccgcatgccgagcaggagggacagcacggcgcatgcggcgtcgaggcggcgtgggccgccggccgaggccgcggtgcccgccagcaggcagacgggcaccgcgacgaagaccggcggcggcagtacgtccgtagtggcccaccaccacacccggtgggtcagcaggcggtcggccgcctggaacagcagccagccgacggcgccgacggtcacggcgaggtggagcgctgtcatgcgggcgtcgtcaccccggcggtgagcgctgagtcgtagaccgcgcggaagcggcgggagaacaagcagcccaggccgccggcgatcacccccatggccacggtgaggttcaccagcacgttgaccgccatgaagtaggcaaggaaaccgcgtcccttgtgccgggctacacagcggtacagaccccgatcgcaggccagggcggccatcagcagcagcagcggggccaccgtccaggcggcgcccagcagcaggggcagcagcagggcggcggcgaacagcagcgtcaccgcgctcgcccaggcgcgcggcccgctggcgtagccgccgggcagcccgcgccgccgcagatacagcgggatggccaggtaggtgcgctggtagaccttgcgcagcaccagccgcagcgtgtcgtcgttgtcgtgccggcccaccacggcggacgtgctcagcgctccgtaccgtgaggagaggcgcagtccgaagtcctggtcctcggtgtggcgcagccgggggttgaagccgcccagttcggcgaagacgtcggcgcggatggcgaaggtgttggtgtgcacggtgctgatgcgcccctcggactcgacgagcgcgtagtactgctgcaggcagcggtactcctccatgcggctgtcccggatgagggggtcggggtcgtagatgccgcagacagcgcccagggtggggtcggagagcagaaggcggacggactgcgacaccgcgtcgggggcgagggccacgtcggagtcgacgaagaccaggatctcgccccgggcgcgctcggcgccgaggttgcgggcgaccgcgacgccgccgttgccgccggtgctgac

SEQ ID NO: 2157 - DNA, 730 bp, Unknown
  Kingdom: Bacteria, Phylum: Actinobacteria, Class: Actinobacteria, Order: Streptomycetales, Family: Streptomycetaceae, Genus: Streptomyces
ggcttcagcaggccgtgggcgagggcgcggtccgcggtggcgcgggccatcgcaaggtagcccgagacggtctgcggggcgtgccggcgcagctctgcgacgtgcgcggcgaccgtgcccgcgtccccgcgcgcgacggggccggtgagcgccgcgtcgccggagcgcagggcgttgtccagggcggcgccgagcagcgggccgagcatccggtcgggggcctcgacaccggcctcgcgcagcagctccatggactgcgcgaccagcgtcaccaggtggttggccccgagggcgagcgccgcgtggtagagcggccgcatgtcctcggcgatccactcgggctcgccgcccatctcgatgaccagggcctcggccgccagtcgcagctcctcgggagcggtgaccccgaaggagcacccggccagccgctgcacgtccacggcggtgccggtgaaggtcatcgccgggtgcagggcgagcggcagcgcgcccgcgcgcagcgccgggtcgagcaccttcgcgccgtaccgcccggaggtgtgcacgagcagttggccgggccggacggcaccggtctcggcgaggcccgcgacgaggccgggcagggtgtcgtcggggacggtcaggagcaccaggtcggcgcgctggagcacctcggcgggcggcaccagggggacgccgggcagcatcaggtcggcccggcgcctggaggcgtcggagacacccgagg

SEQ ID NO: 2158 - DNA, 766 bp, Unknown
  Kingdom: Bacteria, Phylum: Actinobacteria, Class: Actinobacteria, Order: Streptomycetales, Family: Streptomycetaceae, Genus: Streptomyces
  misc_feature (378)..(379): n is a, c, g, or t
ccgaccaccgccggcaccctgaagaacgcctacggccccgacgccatgtcggtcggctccgagtacgccacggagcacggcgtccacgtcggcgacaccctctccgtcgccttcaagggcgggaagacggcccggctgaaggtcgccgcgatcaccagcgacgacaccgccatcgacaagggcgcacgctacctgtccctcaccaccatggagaagtacgtccccgaggaccgcgtcccgccgaacatgatcatgttcgccaaggccaaggacggccaggagaaggaggcgtacgcggccctgaagaagtccctggcgccctacccgcagtaccaggtgcgcgaccagaccgactacaagcaggagctgaaggaccanncgcgctgctcggcctcggcctgggcatgggctggggcgccaccgcccagaagctcctcgccctggagggcctgggcgtcctggacatcccctggccgaccatcaccggcgtcttcgtcggctcggccttcgtgggcctgttcgccgcgctggtaccagccttccgggccggccggatgaacgtgctcaacgcgatcgcgaccgactagcgaccgcgccggacccctcgtgaacgggggtcacggggaaaaccgcctggggcgggaggccatgggggcttcccgccccgggcgcgcttccagcccgtctgggggaaaccggcgaaaaccccagggctcacccacccgtcccgcacgcccgttcgacgctcccgcgttatccacagccc

SEQ ID NO: 2159 - DNA, 536 bp, Unknown
  Kingdom: Bacteria, Phylum: Actinobacteria, Class: Actinobacteria, Order: Streptomycetales, Family: Streptomycetaceae, Genus: Streptomyces
  misc_feature (122)..(236): n is a, c, g, or t
gcgagccgggcggccaccgagccggcgaagcccggggtgtgcacgtcgcgcggcgagacgttgacggcgaccgggacgaacaggccctgcgcgcgccaggcggcgacctggccgagggcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggtcgccgagcagcccgagccggtcgggggtgttggagtcccgcttggactcgtaggcctccacgccggtgcggtcccgcttggcctggtacatcgccacgtccgcccggcgcagcatgccttcggcgtccagggcgtggtcggggaagacggccactccggcgctggcctccaggacgagggtgagtccgtcgaggtcgagcggggagctgagggtggtgaccaggccgcgcgcgatgcgggtcgcggaggtcgtggagtcggcgacgggcagtagcacggcgaactcgtcgccgcc

SEQ ID NO: 2160 - DNA, 808 bp, Unknown
  Kingdom: Bacteria, Phylum: Actinobacteria, Class: Actinobacteria, Order: Streptomycetales, Family: Streptomycetaceae, Genus: Streptomyces
ctgcccgcgtggccgagtcccgccacgggcaggtcccgcacgagtttgccgagcgcgccgtactcggcgctggtgtggtcgtaaccgcgggcgcccaggacggtggcgacctcttccaggttctcgcgcagcaggtcgggcaccacgtacttgacggcggccgcgaagaggtgggcgctggcgggcagcaggctcagggcgcgcagcacgaccgtggccatcgcgtcgcaggcgagcaggtcggcgaagactccggcgagcggtctgtgccaccgtgcggcgacgcggccggcgcggccctcggtggcggcacgcacggcggagtgcagcaccgtgccggcggtggcggtcacgaccccgcagatcaggctgcggttgacctggaaggcgcgcagggcgagcccgacgccgtcgccggtggcgccgacgagcgcgtccgcgggcacggcgcagtcggtgaagcggagtccgccgaagagtgcgccgcgcatcccggtggtctcgacgcgcggcaggtgctcgggccgctgcagggccgggtcgacgagcaggacggagtggctgcgcggtccccgggcggggtcggtgcgggcgtagacgacctggaggtcggcgcggcgggcgttgaggacgacgtccttgcggccgctgagccggtacccgtgcgcgtcgggacgtgcggtgaactcgtcgcgcaggatggcgttggcgtgggcgagttcgtggtgcaggatcgcgacccggccgccgcgcagcagcaggccggcgacgctccggcgctgctcctcgtcgccggcctgctgctgcg

SEQ ID NO: 2161 - DNA, 936 bp, Unknown
  Kingdom: Bacteria, Phylum: Actinobacteria, Class: Actinobacteria, Order: Streptomycetales, Family: Streptomycetaceae, Genus: Streptomyces
accaggagcaggtcggggcggccgacgcggcgggcgagcgcggaggcacggacggccgtctcgatgaggtgccggtcgacggtccagacgtggacggcgttgcgctgcggacggcagcgcacccgttcccagtccggcagcagccgggtgaccagcccttccgcctccagcgcctcccagacctgcacggtgggccggccggaaccgaggagggtgacgagctgttcgcgggcctcggcgggccagggcgtgggcagggggcgcgcggtggcggccaggtggcgtacggcgtgcagggagagcgggagaccggcctgtgcggcggcggccgcggcgcgcagagggagtacgggatcacgttcggggcgcgcggcgcgggcgagcaccacctcgccctcctgctccaccactccttcggcgagcggcgacctctgcgtgcccggcctgccgcctcccggtttgccgccgcccagcagggcgcgcaaccgcggccgcacggcacgtgatccgagcacgcgccccacttcgcgccaggtgacatcgctcgcgtacgagatgacgcgcgccgcctcgtacacctggcgcagcagggtgtcggcgtcgagcaggcccagctcggcggcgacctggtcctgctcctgcaacgcgagccggtcggtggcgcggccggtggacagatgcagcgcgtcgcgtacgtcgagcagccggcggcgcgcgtcggccaggccttcgcgcggggcgtcggccagccaggaggcggcgacggcgcgcagggcggtggcgtcgcgcaggccgccgcgcgcctccttcaggtcgggttccagcaggtactggagttcgccctggcgttcggcgcgcccggcgcacagttcccggagttccgggaggcggcgggcggcctggttgcgccagtcggtgaggacggccgtgcgcagg

SEQ ID NO: 2162 - DNA, 1498 bp, Unknown
  Kingdom: Bacteria, Phylum: Actinobacteria, Class: Actinobacteria, Order: Streptomycetales, Family: Streptomycetaceae, Genus: Streptomyces
cgatgcccgggtagtagaggatgccgtggtggatcgggaacagcagatcgtcgatcggcccgttgatcccgcgcgcggagtccatgcccgcggcgacctcggcggcccagtcgtgggcggccgggaggtgctgggccgcgcggtgtgcgaagggtttcccggcggtgtgcggtgcggccggggtgcggggcagggtgtcggcgacggcgtcgaggaaggcgcgcaggagtgcctccggttccggcagccggagcgggccggggccgggcagcggcacggcatggccctcgtagggcagggcggcggcgatggcgcgcaggtgggcgaggtcctcggggtcgagcgggcccgcgcgccaggcgtcgtgcccggtggcggtcaggccgggcagcaggcgtccgcgtgcggtgagccgcagcgcgtgcagggcggcggcgccccagcaggccgtggcggggtgggcggcggggtcgtggcgggctcgtacgaggtggggcagggccatgtcgagcgggagcgacagcgcgggggcggtcctgcggcgggcgcctgcgccgtgcggacgtaccaccgtgagggtcgtacgcaggggcggggcaccggcgccggccgggacgggatcggccggatcgtcgccttgccggccgtccgggtcccacaggacgatgcggccctcgcgcggcagcggcgcgggcacgaagacggcggggaggcgcagggacacctcctgcgcggtcccggtcgtctccgccacggccatgtcgctcatacgtcctgtcacctcccgctcgtcggtcgagtcagccgtcttcgactctacgggcggggtctgacaatcggctccggaccggtgatcgggggtgcgcggcaggggccggtcgccggtcaggggacggtctgggagacgacgtagaccatcggaagcaccggatcggacaggttcacgatgacgtcctggctgggtgccgggttgtcctggctgtggctgaggccccaccaggggccggggcccttgaagttccagccggtgacgtcgcggtcgcggcggctgaaggtgatgtcgcccttcttgaggtcgctccggttggctcccatggcctccaggaaggtgtcgaggccgggctgcgtggtccggaactggacgtagaggcggctggtcttccagttgttcgtctcgtaggaggcgacccggtcggcggggtgcgggatgggcacctggtagaggcggcgctggaccttggccgggtaggtgggggtcaggccggtcgcggcgtacttggcctccttgtccttgccgctgtcgcggctctgggcggcggagatgaccaggtagccggccgggacgccgatcagcagcatgatgatcagcagggtgagggcccggcggcggttgcggtggcggcggtcctcggtcggccgggacggcggttcgcccggcgccgccgcctggcggggcagggacatcgtcacagtgtctcccgggtctcgcgccacgagc

SEQ ID NO: 2163 - DNA, 2550 bp, Unknown
  Kingdom: Bacteria, Phylum: Actinobacteria, Class: Actinobacteria, Order: Streptomycetales, Family: Streptomycetaceae, Genus: Streptomyces
cgccaccgcacggccgtggtccgcggccgtgcggtggcggtcacgggcgacgacaaggggaccgtacgcgtctgggacctggccacgggcgagccggtcggcgctcccctgtcggacggcgcggcggtccgtgcggtggccacggcggtgatcggccgccgtacggtggcggtcacgggcgaccgggagggaaccgtacggatctgggacctcgccaagggcaggcaggtccagcagccgctcggcctccacaagagcgcgctggagtgtctttcgacggcggtcctggacggccgccaggtcgggatcgcgggcagcttcggcggcgacgtcgtcgtctgggacctggccagcaacgagcaggtgggcgcgacgctcaccggcgaggtcaactgggcccagggggcggccctggcgtggtcgggcggccggccctgcgtggtcaccggcggttccgtccgcgtggcccggatccgtgacctggccaccggcgaggagtggggctccgtcttcaccgggtccgccggctacgtctccgcggtggccgtcgccgaggccgaggggcggctcctggccgtcctcgcctgcgccgacggcaagctgcgggtgtgggaaccgcccgtcggcgcgtcgcggtccgtcccgccgaccggccatgacgactccgtggccgccctcaccacgacggagtcgtccggccgggctctcctggtcagcgtggaccagggcggcacgggccggatctgggacctggccacgggcgagccggtcggcgagccgctcgtcggccacaggaacatgctgcgggcggtggcgacggcggagatcgagggccgcctcaccgtggtcaccggcgcctacaacgagaacgtcagactgtgggacccggccaccggggcccagctcggagagccgctggtgctcgacggcggtgccgacgccctcgcgacgacacggctcgacggccgccccgtcctggtcaccggtggcctgcagggagaaatccacatctgggacctgaccacccgtcagctgcggtacgggccgctgccgggccacgccgacggcgtgaagggcgtggcgttcgcgcggctggacggcaggaccgtcgcggtcaccgccgacgccagtggtgtggtcctggtgtgggacccggcgaccggcaccccggtcggcacgcctttcaccgtcctggagacaccggacgaggacgaagaggcagacgcagaggtggacgaagacgcggacgaaaacgcagacgaccccgaggagttcctcgacgcggtggcgaccgtggtcctggacggcaggcccgtcctggtcaccacctgcgaggtgcgcgacaaggcggtcctgcggatgtgggacctggcgaccggcacggccctcgccgagccactggacgtgcacgacgtgcgggcctccgcgctcacgacggccgtcctcgacggccgcccggtcgcgctcaccggtgacagcgacggcagggtccgggtgtgggacctgaccagccgcgaacagaccggccccgacgtggtggtgacctcctcggtcggcgccgtgacggtcgcacccgacggccggctggccgtggcctacgactcagaggtcacggtgctgggggcggccgacgggacgcgctgaggacgggcgggtcgacggcgagcgcgtcgagggcgggcgcgcctcgccacgtcatgccgggcattggtgcgccggcacatcggtgcgtcgatgcgtcggtacgtcggcgcggtcggcgcggtcggcgcgtcggcgcatcggtgcgtcggcgcatcggtgacacggtgcaccgcgcatcggtgcgccggtgcatcggcgcgtccccggcactgcgccgtccaggggacgcaccggcatcagggtgcccgttcggtggtaggtctggcccgtgtccggacgcgtcagcgtgggttgccggtcacccgggcgacgatcaggagtgagcatgccctcagcccccacgtcccggccctccagcggccggcggcgcctgtctctgcgggaacgctggcgccgggtgctgaacgaccacaccgtgcccacccagcgctcgctcatggcggcctggctcggcttcggctgcaccttcggcacggcacggctgatcacccacggcatccggggcggctggctgccctggggaaacgtctccgccggccagacacacctgcaccactacaacttcggtatcgccacgctcgcgggcgtgggactggtcgccgtccgcggcgacgaggcgtacgtcggccaccccggggtcggcgccctgtacggcgcgggtacggcgctgatcgccgacgagttcgccctgctgctcgacctcaaggacgtgtactgggccagacagggacgcgtcagcgtggacgtctcgctgggcatcctcagcgcactgggtctctacctgaccgccgtgccgttctggcacgagatcaccaaggccacccgcgaccacctcctcggacaccccgcccgtacggcctgagaccgacggtgcgcgggaccggtcccgcgcaccgtcggtctcag

SEQ ID NO: 2164 - DNA, 1515 bp, Unknown
  Kingdom: Bacteria, Phylum: Actinobacteria, Class: Actinobacteria, Order: Streptomycetales, Family: Streptomycetaceae, Genus: Streptomyces
ccgcgaggtcggcgaggcgcacctgcggcgccgcggccagttcgtggtccggcgggagggcgaggtcgagcgggtcggcgagcagcggcacccgggtgaagcgcgggtccaccgcggtcggcgcgtgcgcggccagcgacagcgcgaggtcgacctcgccggcggccagcagctcgtacgcctcgcccgcctccgcctcccgcacccgcacgctcacccccggatgcgtcgcgcgcagcgcccgcgcggccgggacgaccagggccggcaccgcggtcgagaaggccccgacgcgcacctcgccggcctcgccgtgcgcgtacgccgacagttcggcctccgcccgctccaactgttcgaacaccgcctcggcgtggcggagcacgagccgcgccgcgtccgtgagccgcacccggcgtccctgcgcctcgagcagcgggacgccgagctgtgcggcgaggttggtcagctgctgggagacggcggacggggtcatgtgcagggcctcggccgccgcggtcaccgtcccccgctcccccagcgtccgcaggatgcgcagcttccggatctcccactcggccatggcggcaacctatacggcatgggcgcgtacgccgtggtcgcggccggcggcctacttccgggacgcggtcccgaggacgacaccgcccaggatcagcgccatgcacagcgcctgcagcgggccgaccgcctcgccgagcagcgcccaggacagcagggccacgcagaccggctggaggtagtagacgactccggcgcgggtcgggccgatcagggagatcgccttgttccaggcgaagaaggcgacggcggaggacagcacgccgacgtagaggagcggcaggaccgtgccgggccggagttcgaagccgccctggacggcgaggctgactccctgggcgggcagcagcatgacggtgccgaacaggaacgtggtgaacaggaaggcggcgccctccagttcggccgggcggcggcgcagcagggcgctgtaggaaccgaacgagcaggccgcggcgatcatccacaggtcgccggaggagaacgaggccgctcccccgccgccgatgagcagcaccacgcccgcgcaggcgatcagcagtcccgcgacccggcgcgcgccgagccggacgccgcccgcccgttcgaggaccgccatcagcaccggcgaggccgccatgatcatgcccatgttggcggccggggtggtcagtccggcctggttgaccagggtgttgtagacggcgacgccgaggagcgaggccagcagcacgaagcgcaggtggcggcggatcagcgcacgctgccgccaggccgcgcgggcgccgaacggggccacggccaccagcgccaccacccaacgccagaaggcgtgctgcaccggcggcacgctgtcgtgcagcgcgcgcgaggtgacgaagctccccgcccagacgacggtggcgagggcggcgagcccgagcccgagagcggcgggcttcggggtgcgggggg

SEQ ID NO: 2165 - DNA, 612 bp, Unknown
  Kingdom: Bacteria, Phylum: Actinobacteria, Class: Actinobacteria, Order: Streptomycetales, Family: Streptomycetaceae, Genus: Streptomyces
cttcccggactgcggcggcaccaccccgtgccgccgcagtccgggaagcggacatcggcggcccccgctgaggtggagggtggttgcggggctccgttggactgggagaagttgctggccgctcggctgcacgcggtgaaggtgcggccctacctcgccgacgggctcttcgcgctgcacgtcgtcgaggaccgctccgtgcccacgatggcggtggacgcgtactggcgctgctacgtctccccggccttcgtggcacgcacaccggtggaggacctggcgggcgtctgggtgcacgaggtctctcacctgctgcgggaccaccacggccggggcgagcggtatgcgggcctgcacggggcgcgggggcccggcgagcggctgcggcggaacatcgccgccgacttcgagatcaacgacgacatctacggcgacggcctgccccggcccgccggggtggtgctgccgtcactgctgcggctgcccgacgggctgctgatggaggagtacctgcggaccgcctcgatgtccgggctcaccgccgagctggcctggctggactgcggcagcggcgccgacggacacgcccggccgtgggaactggggccggac

SEQ ID NO: 2166 - DNA, 1130 bp, Unknown
  Kingdom: Bacteria, Phylum: Actinobacteria, Class: Actinobacteria, Order: Streptomycetales, Family: Streptomycetaceae, Genus: Streptomyces
acttcgtccggcgcgccgccgccgacccggcgctgatcgcctcgctgccgctcgaccccgagggccgcacctggctccgcctggacgggcccgggggcagcgaggcctggctgatcggctggccgcccggtaccggtacgggctggcacgaccacgccgactcggtcggtgccttcgtcaccgctttcggcgaactcacggagaactcgctcgccgcgcggctgcccaccgacgggtggaagaccctggaactcaccgacgacgtggaccgcgagcggcggctgccggccggtcggggccgtgcgttcggccgacaccacgtccatgaagtgctgaacgagtcgaccgacaggcacgctgtctctgtgcacgcctactacccgccgctgccccggatccgccgctacagccgcaccggaccgacgctgcgcctggagcaggtggagcgccccgaggactggcagtgagcggtgtgagagacgcgaaaggaccggcagtgagcgacgcgagcgaagagcagaccgggatcgacgagttgctggagcgggtacgccgggactacgtgcgcgtcggaccgcacgaggcgtacgccgccgcccgggcgggcgaggccctgctggtggacatccgctatgccgcgctgcgggaccgggacggactggtcccgggcgctctcgtcgtcgagcgcaacgaactggagtggcggctggatccccagggcagccatcgcctccccgaggccaccggccacgacctgcgcgtcgtcgtcatctgcaacgagggctacgcgtcgagtctcgcggccgtctccctgcaccagctcggcctgcgccgggcgaccgacctggtcggcggattccaggcgtggcggtcggccggccttccggtgctgaccccggccgtcccctgagatcccggggcgcgggcatcgggctcgggccccggcctcaggccccctcgccgccttcgtccccgaggaaatcggtgtcctcgccctcttcttccagtgcctggcgcaccacccgcagggccaggccctgggagtaacccttgcgggcgagcatgcccgcgaggcggcgcaggcgcttgtcgcggtcgaggccccgggtggagcgcagcttgcgggcgac

SEQ ID NO: 2167 - DNA, 2391 bp, Unknown
  Kingdom: Bacteria, Phylum: Actinobacteria, Class: Actinobacteria, Order: Streptomycetales, Family: Streptomycetaceae, Genus: Streptomyces
cggtgcctcctgggtgccggccggctggtgcccggcacccaggaggcaccgttccagtaccggacgtatccggggatggacgggtccgggtagtacccctcgcggggcctgtcatcacctggtgccggggttggggcgctcatgtccgtcgtcccgtatctgctcgggggccgtcttggggggctccacatctatcagaccggcgcacccggcaccgcccgtcccgccggacccactcctttccgggcaacctcgcacaggtgctccacctttcacgaggcacccttcacggcgccgcgcgaggcggcgaggagggcgggcagggcggggaaaaaacttccgcggacccgcgtaatgcccggcgtccgcccgcctctgtaccggtgcgggtccgctccgggcccgtacgcggcacgcggcacgcggcccgcgtcagaagcggatcggaagcggagaggacgagaaccatgcggcacaccgtggtggagcgcgagctggagctgaggctgatcctgtcgcccgagcgggggatccccgtaccggcgcggctgacctaccgcaccgaggacccgtacgccgtgcacatcgacttccacgtcgactcggggcagccggtgcactgggcgttcgcgcgggatctgctggtggagggggtgttccggccgtgcgggcacggcgacgtgcgggtgtggccgtcgaaggcggagggccgcagcgtcgtgctgatggcgctcagttcgccgtccggcacggccctgctggaggcaccgtccgcgcaggtgtcgtcgtggctggagcgcacgttgcgggtggtgccgccgggcacggagggcgagcagctcgggatcgacgcggggctggccgggctgctcgcgcagtgagggcagtgagggcggtgagggccggggcctcagaacagtttgccggggttgaggatgcccagcgggtcgaagacctgtttgacggcccgctgcatctcgacgccgaccgggccgatctcgcgcgccagccactccttcttcaggacgcccacgccgtgctcgccggtgatggtgccgccgagccgcaggcccagggccatgatctcgtcgaaggactcgcgtgcgcgccgggactcgtcggggtcctgggcgtcgaagcagacggtcgggtgggtgttgccgtcgcccgcgtgggcgcagacgccgatggtgagctggtacttctcggcgatctgttcgatgccgtcgagcatctcgccgagccgggagcggggcacgcacacgtcgtcgatcatcgtggtgccggtgaccgcctccagtgcggtcagcgccagtcgcctggcctggagcagcagttcggactcggcggggtcgtcggcggggacgacctgggtggcgccggcggcctcgcacagcgcgccgagcgcggcgaggtcggcgcgcgggtcgggcgtgtcgaacgcggcgagcagcagcgcctcggtggtctcgggcaggcccatgtgggcgaggtcgttgacggccttgacggtcgtacggtccatgagttcgaggagggacggtacgtggccgccctccatgatccggcacacggcgtcgcaggcggcgctcgcggaggcgaactcggcggcgagcacgagctgctgcggcggctgcggcttgagcgcgaggacggcccgtacgacgatgccgagcgagccctcggagccgacgaagaggcgggtgaggtcgtacccggcgacgcccttggcggtgcggcggccggtggacatcaggcggccgtcggcgaggacgacgtcgaggccgaggacgtactcggcggtgacgccgtacttgacgcagcacaggccgccggaggcggtgccgatgttgccgccgatggtgcacatctcccagctggaggggtccggcgggtagtacaggccgtgctggttcaccgcgcgggagagcgtggcgttgacgacgcccggctcgacgaccgcgatcctgtcgaccgggttgatctccaggatgcggtccatcttcgtcagggagaggacgatgcagtcctcggaggcgttggccgcgccggacaggccggtgcgggcgccctgcgggacgaccgggacgcgcagttcggtggcggtccgcatgacgtgctggacctgttccacggtgcgcggcaggacgacggcggccggggcgccggacgggcagaagctcgccatgtcgtgggcataggagaccgtgacgtcgggatcggtgaggaccgcttcggccggcaggcccgcgaggagccggtcggtgaggttggcctcggctgcgtcgggtgcggcttggatacggctcacgatcacagcgtcgcacccgcggcgacagctgtgaagccctgctggaggaggcgggttccgtccggcgggtggcggtgggc

SEQ ID NO: 2168 - DNA, 583 bp, Unknown
  Kingdom: Bacteria, Phylum: Actinobacteria, Class: Actinobacteria, Order: Streptomycetales, Family: Streptomycetaceae, Genus: Streptomyces
cgacgtcgatgcggtccagctcgcgcagcacgtcgaggcagacggcgaggcgctccgggtcgatgccgggcccgtacgcggcctcgtcgccgggcgcgtacaccacctcgtccatggccgtggggccctcgtctgtcaccgtcatcgcgctgccgcttcccttggtcgtgcggcgctccgagtcgcgtccgctgtcgaacgggggattttacggcagcgccgggcgcgagggccaaacgcgtgatgatcagcgcccgccggggcggtgcgtcaggggccgcagacggtgatgagggtctccacctcctcggagacggcgcgggccagccggttcaggtccggtacggccttggcgtcggcgacgaggccgtagtggacgtggccgcggtaggtggagatcgcgacggcgagggactggccgcgggcgagcggcgcgaacgggtagacggcggtgagcgggtggccgccgaggcgcagtccgaagccgggcagcgggacgctggtgaccaggatgtcgaaccagagccgggcggcctggccgaccagggggccgccgagccggtggccgagggcgggcacgtgg

SEQ ID NO: 2169 - DNA, 1555 bp, Unknown
  Kingdom: Bacteria, Phylum: Actinobacteria, Class: Actinobacteria, Order: Streptomycetales, Family: Streptomycetaceae, Genus: Streptomyces
gtgcagcggctgctgacggaggcggtgcgcggcgggcactgcgaaccggccgcggtggtgcgggccctgaccgctgcgcggctgctgaaccgcccgcacgtggtcgacgcggtggactcgctgctcgccgagggccgctcgatcgccgaggaccggctgtaccggatggtcgaggagcacggcctgcccgacccggtgtggaacgtggacctgcgcctgcccggcggcccgcacctgggcggcctggacgcctactggcccgaccaggcggtcgccctggaactggacacccgcgcaccgctgcagggccgcccggacgacgacaccctctggtcgcagtacgcccgcaagcgcgagcacctggagcgcctgggcatcacggtcgtccacatcacgcccaggaagctgcgcgacgcgatggaccagcaggcgacggtggtccgcacggccctgatggcggcggccgaccgcgacccggccgcctacgtcgtggtgctgccccggtaggcgggggcggcaccgcaggaggggagagcagggtcccggacggcgtccgggaccctgccgcgtcggccccgtgagcgctcagcgcccgcagtactccgcctccaggaccgcgtcgccgtcgcccgcccagtcgccgttgaagttgaaggccagaccgtggcgtccgtcggccgtgaccgtcgccgacgaggacgaaccgtggatgccgccgtcgtgtccccacacgtgcacgccgcaggagagcctgcggtccatcaggccgaggccgtagccgatgccggggctgccggtttcgtgcaccgtggtcttcatctccgccagttgccgcggcggcagcagccggccgcgcagcagggccgcgtagaagcggttcaggtcggcggagtcggagatcatctcgcccgccgaggaggccatggacgggttgagttcggtgacgtcgtacgtcggacccgtcgtggtgtcggccagcttggagtaggcgcggctgctcgggtgcccgacggtgacccgcgtgccgggcagcgaggtggccgtcaggcgcaggggccgcaggatgcggtcgcggatctcgtgggcgtaggagtgcccggtcacccgctcgatcaccatgccggccaggacgtagttggtgttggagtagttccaggaggtgcccggggcgaagtccgggcggtgggtcatggcgatccgcaccagttcctcgggccgcagcgtgtcgtaacggtgcttcaggaagccgtccttgacgaggtggccgcgggcgaaggtgtcgtccgccgtgtagttgtagacgccgctcgtgtggttgagcagttgccgcagggtgatgcggcggccgtcgtggccgtggccgcgcaccacgccgggcagccaccggtccaccgtgtcgtccagcgacagccgtccctccgcctccagctggagcagcaccgtggccgtgaaggtcttggtgatgctgcccacccggtagcggtcgttggccccgcgcggcgcgccggtgcgcaggtcgccgacgcccgcggtgacgttccaggtgcccgcgcgg

SEQ ID NO: 2170 - DNA, 1046 bp, Unknown
  Kingdom: Bacteria, Phylum: Actinobacteria, Class: Actinobacteria, Order: Streptomycetales, Family: Streptomycetaceae, Genus: Streptomyces
cgcaggtcggcgcgggcccgggcgcgcgggcggtggcggtagaagcgccgggcccagtacgagccgggccgggccaggcggacggcggcgatcagcgcgaggaagggcacgatcgcgccgaagacggccagccgcagcttgcccttgctgagggccaccagggagaagaggaagttgaccgccacgccggcgatgaccgagccgcggtcctggagttcgcccggggtcacgtcgttgacgccgaacggcgagaagccggcgaggaccagaccgaccagggccgcggtgaggaccaccacctcgacgctcttgcggccggcctcggtccagtagacgtcgtccaggtgcaggatgagcgcgaactcgtccaggacgaggcccgcgcccacgccgaagaccaccgcgaagaccgacgtgcccacgccgtgccggctgctggtggcgaccgcgccgaagcctccgacgacggtgaggacgacacccgggacgacgtggtggatgtgcagcccgcccgctttgacgttcccgaagggccccttcccggcgcggatcaggcgggtgatgacccgggtgaccaggaacgtgacgacgaacgcgcccagggcgaggagcaggggcagtttgccgggttcgacgatgttgcggtacagccagtgccccatgtatgcagtctgccccgtccacggcggcaccgcccgtccgtcggcgggtgcgcgcaggtcccgtagtctgcccgcgtgtccgccccctcctcctctccgtcgtcctcagcgccctcgtcggcgtccgcgctgcacgggctccggttcgccttcggtacgttgaccgtgctgccggtccgggtgagccgctgggaccgagcggcggcgcgcggcggcatgctgtgcgcgccgctcgccgggctcgtggcgggtgccgccgcggccggcgtgggcctgctgctgctgttcctcggcgccgctccgctgctcgccgccgtcgccaccgccgccgtgcccgccgcgctgacgcgcggactgcacctggacgggctcgcggacaccgcc

SEQ ID NO: 2171 - DNA, 2854 bp, Unknown
  Kingdom: Bacteria, Phylum: Actinobacteria, Class: Actinobacteria, Order: Streptomycetales, Family: Streptomycetaceae, Genus: Streptomyces
acgcggtcgctgccgcccgtgttccagcagcgcctcgcccgccgaggtcagctcgacgtgccggctggagcggacgaacagcgggacaccgaggcggctctcgatccgccggatcgccttcgacagcgccggctgggcgatcgagagccgggcggcggcccggccgaagtgcagttcctcggcgaccacgatgaagtactccagctcgcgggtctccagttcactcatgcctccaggttatcgccggatgtccaaccggtcttggactccggcggccccgcccgtcgagaattgcagcatgatccagcacaccatgatcgtttccttcggtcagccgctgcccaccgccacactcgaccaatatctcgcggatatcgaacgggccatgctcgacaccggtctcgtggagtcggtcgtcgcccgccaccacatccccgtccccggcgaggagaccattcccgcgctgatcgcatccgcgatcgtgcaggtctgcgtggccgacaccggcacactcgccaaggcgttcaccgcacccggcctgcacgaggtcatcggccgctggcaggaacggcacccgtaccaagtcgcctgggcgaaccacgaggtgctcgcatgagcggggtctccaggaaggcggggctggtcaccggggccggcagcgggatcggccgcgcggcggcgctggagctggcccgtggcggcgccgcggtcgccgtgctcgacatcgacgaggactcggcggccgagaccgccgacatgatcaggacggacggcggtcaggcgctggccgtcaccgtcgacatcgccgacgaacgcgcggtgcgggaagccgtcgagcgcacggtccaggcgtacggcgccctgcatttcgccgtgaacaacgcggggctcgactcgcaccaccggcagctcgaccagatgaccctcgaagagttcgagcgtgtggtgcgggtcaacctgacggggaccttcctgtgcatgaagcacgagctgcccctgctccaggacggcggggcgatcgtcaacgtcgcctccaacggcggcctgtacgcgatcccgaccgcccccgcctacgtcgccgccaagcacggcatcgtcgggctcaccaaggtcgccgcggtcgactacgcgccgcgcggcgtcagggtcaacgccgtctgccccggcccgacgcgaacgcccgggttcgagcgggtggcggccggcaccgacctgatcgcgctgcaggagtcgatcacaccgctcggccggatggcgagcgcggaggaggccgcggcggcggtggtctggctctgctcggacgccgcgtcctacgtcaccgggatcgcgctgtccgtcgacggcggccgacgagcgtgagggccgcgccccccccgcgtcctgggcggtctgggcgccttctgcgcggcgtggtctcaccccccgcgggtgaggtcgcgtggcgggcagccggccgtaggcgaagtaggcgttgacggcgtcgttgacgcaggtgtcgccgtagcgcggagatcgtgatgctgaggctgcggccgtcggggtgggcgtagtcgagggcacgcgcagtgcggcgcagcgggctcccgccccgtcgagggtgttgccgacatcgtccgacgcgcccccgtccgcacttggtcccgtggacgcgctggggggagaccggccggaacgggagccaaggcggcggtgcctgggtgaaggcgagggtgccgcagagcgctggggtggcggcgaggacggtcagcagggcggtacgggggttcggcgcgcgggcggcggggctcaacgcgcttgtgatccacggcggtcggtgccttccggtttccgctgcgggaagcggccggcgcatgcggcgggaggcgtgggggcggtgcagtgccggtgcctgtcgagcatgcccggtcccccgaacggcggccggtggggtacctgtcggtcaggtaccgacgctacgggcggcgccgtggcggcccatgccgacaggcccccggtccgccttcgggctgtcccccggtcggcgtccgctcagccggtacggcggaacgagtcgacgtcgccgccccaactgcccttggcgccgtcccagtcgatggcgagagcgtcgttcttcgcgtccttcagggacaggtggccgaggccccggccgccgtccgtgcttcccttgcacgaggagaaggtcaacgacgccgactccttgccgtcctgcgtgccgggcttgagagtgccttcgcagtcgagcttgcttcccttggcggtgacgtggccgtcctggatggtcagggtgtcgatgtccgacccgctcacgatcgtcttccacgaaccggtggcccgctcgatcaccgtgctcttgctgcctgccgtggccttcgcgccgggccgcggagcggcgtgggtgcctgtgctgtgctcggccgtctttccgtcgtcggacccgcagccactgagcacccccgtcccggccaggaccacggcgcccaccagacaagccttacgcacttcgtctcccttgatcagctttctttccaggtcaacgtagcagcggtgccggcggcacagcgacggcgcccgccgacgggtgactcggtggcgagcaactcggtggcgggcgccggtggtcgcggcgcgtccctacgccgtcgccctcacttccgtgacctccgtgcccagttcgcgtcgggcgcgggcggcggccccgaccggtacggcgtcggaggccagcgccgcccgcaccaggcggacggggtggccgctgaccggggggtcggcggcgagggcggacaggatggcgggttccagcaggggccaggcgcggctgacgccaccgccgacatcaccacggtggtcgtcggcg

SEQ ID NO: 2172 - DNA, 550 bp, Unknown
  Kingdom: Bacteria, Phylum: Actinobacteria, Class: Actinobacteria, Order: Streptomycetales, Family: Streptomycetaceae, Genus: Streptomyces
gggcagcaccggcaggaagacgtccagcagtaccgagagggtcaccgcgacatagatccacggagtgccggtgagcgcccccaccctcgccacactctccagcaccgcgaactccctgaactcccccgtggaccggaccgtgtgccgcgatgtcgcgggggagcggcaggggcggcctgtgaacagccatacagcgtacgcccggggtgtgacacgaggctcacggggggctcaggtgttcgtgaggggaccaggggttcgcgggggcgcccggtgcccgtggtgggggcgcctgccgtggcgtggcggttgccgcgcggtcggcggtcaggcggccaccggcgtctgctcgggggcgggacactgctgcgcggagcgccgggcgagcagcccgtcgacggcgaacgcgccggatccggtgaagaccagcagcaggaaggcccagcagaacatcaccggcatctcgccgccgttctggatcggccacagtgccgccttctggtgcacgtcgaagtaggcgaaggccatggagccggaggcgacgaacgcg

SEQ ID NO: 2173 - DNA, 528 bp, Unknown
  Kingdom: Bacteria, Phylum: Actinobacteria, Class: Actinobacteria, Order: Streptomycetales, Family: Streptomycetaceae, Genus: Streptomyces
tgcgcgcctgaccctcgcagcaccggccccacgtgcacagacgcgcggggcccaggccgccgatccgcacagcgctatccccgtacccccaccacgaagggatcagcccatgcacggcaccagcacgcccagaaccgtccgccgcctgccggccgtcgcgaccaccgtcgccctcgccgccggcatgctcgtcaccctcggtgcgcccgcggcccacgccgccgccggcgccaccctccccttcacctccgtcgaggccgagtccgccaccaccaccggcaccaagatcggccccgactacacccagggcaccctcgcctccgaggcgtcgggccgccaggccgtccggctcgcggcgggacagcgcgtggagttcaccgcaccgcgcgcagccaacgccctgaacgtcgcctacaacgtgcccgacggccagtccggcaccctgaacgtctacgtcaacggcaccaagctcgcgaagaccctcgccgtcacctccaagtactcctacgtcgacaccggctggatcac

SEQ ID NO: 2174 - DNA, 659 bp, Unknown
  Kingdom: Bacteria, Phylum: Actinobacteria, Class: Actinobacteria, Order: Streptomycetales, Family: Streptomycetaceae, Genus: Streptomyces
ggccggcgtcaccgcgctcaccgtcgaccaccaccgcggcagcgaggagcagcagcccggctgggagtaccacgacccggagacggtcgatccggagaccggcctgatggacacgctgcccgccttccggcgcacgctgcaccgggccggcctggaggagcacgtggtggcgctcgtcggacggtcaccgcaggtcgcggccttgtggaacacaccgctcgggctcgtcttcgtcgacggcggccacaccgacgagcacgccggcgccgactacgcgggctgggccccgcatgtcgccgagggcgggttgctggtcatccacgacgtgttcccggacccggcggacgagttcaccggtcaggcgccgtaccgcgtgtacctgcgggcgctggagtccggtgagttcaccgaggtctcggtgacgggctccctgcgcgtcctgcggcgaaccggcccggccggcacgcaccgccgttagagtcgcagtcgtgtcgtacgcaggccccgatttcgagcccccacgtcccgagcggtccgagcgacccggccgggtgcggcgcgggccggccgtcgcccgaagcacccaccgcctcgtacccgagccagcccagcagcgcgcagcacaccagcgcggtgacggcgacggccggcccgcgccg

SEQ ID NO: 2175 - DNA, 843 bp, Unknown
  Kingdom: Bacteria, Phylum: Actinobacteria, Class: Actinobacteria, Order: Streptomycetales, Family: Streptomycetaceae, Genus: Streptomyces
cgcgggcgaggacttcacccccgactggtccgaccggccggccccgcacaccgtgtaccccggcgccccggagaccgcgctcccgatcgccacggcgtcacccgccgacggcaccctcgccgacgcggtggcgcacgcgcgggcggcggacccgcaggagtcccccggcctcacgcttcgcgatttcgccggaatgctccagctggccgccgggaccctggcacggcgctggcagatcgactggaacggcgactcggccgcgcgggcccggctgcgcggcgccgcctggggccgcggcacaccgtccggcggggccaactacccctgggagctgtactgggcggcggcacccggcctgcccgtgctgccgggactgctgcactacgcgagcggccggcacaccctggaacgccttgccacgggcgaccccacccctgcggtccggacggccctggcggcagcggcggccgacgccggaccgcctccctccggcggctacctgatctgcaccctgcggccctggaagaccgccttcaagtacggcaacttcgcctaccacgtcgccacccacgacctcggtgtcctcctcggctccctcggcctgtgccaccacgcggcgggtctgcccttccgtcctcggctgcggttcgacgaggcggccctgaacgccgccctgggactcgaccccgaccaggagtcggcgtacgccgtgatccccctgacctggcacccggccgagcaccgccggccacgggcgggggccgtccccccggcggtggccgcacccggccccgcgcgtccgcgggcgtgggagaagtccgcgaaggtcgctcacttccccac

SEQ ID NO: 2176 - DNA, 995 bp, Unknown
  Kingdom: Bacteria, Phylum: Actinobacteria, Class: Actinobacteria, Order: Streptomycetales, Family: Streptomycetaceae, Genus: Streptomyces
tcggccccaacggcgccggcaagacctcgctgttcaacttgatcagcgggctcaacccggtctcccggggcacgatcgaactcgacggcgccgacgtcacggccgaggccgcctacgcccgcgcccgccggggcctcggccgcaccttccagacctccagcctgtggccgggcatgacggtcgccgaccacgtacggctcgcggcccaggcggccggcggcggctcgtaccgggtctggcgccgcgccgagacgtacccggagcaggtcgcgcgggccctggcgcgcacccagctcacccaccgcgccgacaccggcgccgactccctctcgcacggtgagaaacgcaagctcgaactcgccgtgctgctcgtcgccgaaccccgcctgatgctgctggacgagccgatggccggcgtgagcgccgaggaggtgcccgcgctgaccgaactcatccgctcgctgcaccgggaagagggccgcaccgtcctcatggtcgagcaccacatggacgtcctgctcggcctcgccgaccggctcgccgtgatgcaccacggcacgctgctggccctggacaccccgcagaccgtgatggccgacgccaccgtgcagcaggcgtacctcggggaggagctgtgagcgcggctgccgaacccctgctgtccgtacgcgacttgagagtaatgatcggcggcagacacatcctgcacggcgtcgacctcgacgtcgccgcctacggcaccaccgccctgctgggccgcaacggcgccggcaagaccaccaccgtgcgcggcatcctcggcctcgtcccgcgcaccggcagcgtacggctgggcggtcaggagacggtacgcctggccacccacgccctggtccgccgcggcatcggctacgcccccgaggaccgcggcggaccagggcgtgggtggccaggcgtaccgtctcctgaccgcccagccgtacgctgccgctgctgtctcttataccaatcaccga

SEQ ID NO: 2177 - DNA, 574 bp, Unknown
  Kingdom: Bacteria, Phylum: Actinobacteria, Class: Actinobacteria, Order: Streptomycetales, Family: Streptomycetaceae, Genus: Streptomyces
gccgcgcggggcgtgcagggggcggggaccggtccgtgcccccggccggtggccggctcggggtaagacgtggatgttcgtgcgggcagcctgagccggatcggcggtcggtgccgttagcgtcgggggagtcgggtaggggacagggctggagggcgccgtggcggagcggcaggagcagatcgcggacgacggggtgctgacgcggatcggccagagcgtcatgctgcaccacgccggtgaccgcgaggaggcccgggtgcggttcctcgcgctgtggcgggagatcggcgcggacggcgatcccctgcaccgctgcacgctggcccactacatggccgacacccaggacgacccgtgcgacgaactggcctgggacctcagagcgctgtcggccgccgaggaactcacggacgaccggcgcgccggacacgagggcgcaccggcggtccgcgcgctgtatccgtccctgcatctgaaccttgccgccgactacgtgaagctcggccgctccgaggccgcccggagccatctccgccacgcccgcggcacggtcggcggcaaggttcagatg

SEQ ID NO: 2178 - DNA, 755 bp, Unknown
  Kingdom: Bacteria, Phylum: Actinobacteria, Class: Actinobacteria, Order: Streptomycetales, Family: Streptomycetaceae, Genus: Streptomyces
  misc_feature (137)..(138): n is a, c, g, or t
ccgaagacggcgcccgacggatcgcatgccagcaccagccggccgacctcgcccgcgtcgagcggccccacgcccaccgtgccgccgcacagccgtaccgtttcggctgtcagatcgacgtcgacggaggcgagatnncgacgtgccgtccgtcgagcagggcccgcacgtaggggccgagctgcggcgggccgggctcgaactcccagccgaacagctcaccgtagaaggcctgtgtcgccgtcatgtcgtggaccatcaggctcacccagcagggtgcgccgggcgtgtgccgggcgcgtgtccggccgtaccgttccgccggctccgatgcctgagtcatcgtcacactctccttgggcccctcgcggtggccgcgtcgcttccgctcttctcttctccccggccccggtcgatgaccggagaatgccccctgtgcggtgtcctgtccgttacggcgcccttgccggcggatgccgatcgtccgcacagcatgtggccgatcccgtacgcctcgtgatcagacctgcccggccgagcagagtatcgggacccggacgccacggccaccccgtgcgcaaggatggtgaccatgaacgccatcatctccgcatccgatctggcgactgccctcgcgggcccgaacccgccggtcctgctcgacgtccgctggcagctcagcgtggccaaggccgccggtgagccgcccttcgacgggcgtgccgcccacgcgtcggggcacatccccggcgccg

SEQ ID NO: 2179 - DNA, 691 bp, Unknown
  Kingdom: Bacteria, Phylum: Actinobacteria, Class: Actinobacteria, Order: Streptomycetales, Family: Streptomycetaceae, Genus: Streptomyces
ccgctacccgcagcgcccccaccagctccccggcgcctggagcaggtgatggccgaccaggaccaggacctggtcgacgtcgacccgtacgaccccggcgacggttccttaccggtcgtcctttgcgcgtggaatacctcagcctgaagtttcgcgagtacggccgcctcaacgggcttgccggccgcaacaccgcacgcctggctctggccgcgaacttgccggcatccgtcctcgcggacctcaccggcaccagcgtcgacaacgccgtccggtggtcgaacttcgccaagcgcgactggaccgactacgtcgctgcccgcaaacgggacacacggaactgatcaacgcctacctaggaataccgcacgcccagaataagtggcctgcgccagtaccgctcaagaccctgggctgctgcttggagtgtttcgacggcacgcccgccgaccccgcctcctacatcgctcccccggccaagcacctgctggctgcctgatccgagaggaccaccgcccatgagcaccgcccccctcgccgctttcaccgagcccgaccgccccaagaatctgctgatccggttcatcacggtcggcggcagctacgtggacgtcatcggccccggcgagcactcggacaagaaccgctggaactgccacggctgcggagactcctcgggccggcccgagga

SEQ ID NO: 2180 - DNA, 574 bp, Unknown
  Kingdom: Bacteria, Phylum: Actinobacteria, Class: Actinobacteria, Order: Streptomycetales, Family: Streptomycetaceae, Genus: Streptomyces
gcggccatgaagggggtggccggtgtcttcgcgttcaccacgcccttcgaggccggtgtcgaggcggaggtggaacaggggcgggccatcctcaccgcggcggcgcgcgagcgcgtcccgcatctcgtgttcagctcggtcgccggagccgaccaggacagcggcgtaccgcacttcgagagcaaggcgcgcatcgaggcggaactgaccgcgggcgattttccgtacaccatcctcgggccgacgtacttcttcgacaacgcgctcggcggagcggagcgcatcctcgacggtgttctcgatctgccgctgccgcccgaccggccgttgcagcagctcgcccggcccgacctcggcgcgttcgcggccgaggtgctgctcgaccccgctcggtacatcgggcagcgcatcgaactggccggcgacgcacccaccccggcgcagatggcggctgcgctcggcgcggcgctgggacgggaggtccgccatgagtacgtcccgctgacggccatcggcaatccggacatgcacgcgatgtggacgttcctgaacggacccggctaccgcgtcgaca

SEQ ID NO: 2181 - DNA, 1276 bp, Unknown
  Kingdom: Bacteria, Phylum: Actinobacteria, Class: Actinobacteria, Order: Streptomycetales, Family: Streptomycetaceae, Genus: Streptomyces
gtgcctgggccaggcgggcggacggcccggcgtcaccgtcgaacgcgtcggcatcaacatcgacgacgcgcgcatccccgacaacgccggcgcgcagcccgtcgacgaaccggtcgtgcccggcggccccgccgcctacttctcctcgctgcccgtcaaggcctgcgtcgccgccgtgcgcgcggccggcgtcccggccgccgtctccaacaccgccggaacgttcgtctgcaaccacgtcgcatacggcctcggccacctcatcgccaccgagttcccgcacgtccgcggcggtttcgtgcatgtcccgtgggcgcccgagcaggtcaccgacggcaccgccccggccctggaacccgccaccgtggcccgcggactgcgcgccctgctggtcaccgcggccgccacgcccacggagcaggacctcaagatcaccgagggagccacccactgatgccgctcgcccagtacgcgacgcccttcgcccggctcgccctcgccaacatcacccgcgagtaccccaacttccccgcccacctggtcacctccgccgaacaggacacgcggccgagcaccctgcacccggccttctacggtgcctacgactggcactcctcggtccacatgcactggctgctcgtccgcacgctgcgccgccacggcggcacacccgcgctccccgagaccgcgccctgcgtcgacgtactcgaccggcacctcaccgcgcggaacatcgccgtggaagccgcctacctccaggaccggccctccttcgagcggccgtacggctgggcgtggctggtcgcgctcgccgccgagtgccgggcgtacgcgggtccggagggcgcgcgctgggccgaggccctggcaccgggcgtcgccgccgtcgaacggctgctggccgactggctgccgaaggccacctatccggtacgccacggcaaccatcccaacagcgccttcgcgctcggcctcctcctggactccggagaactctccgccgcgaccgccgacgccgtacgggaacgtctgctggactggttcgccggcgaccacgacgctcccgcgcactgggagccgtcgggccaggacttcctctcgcccgcgctgaccgaggccgacgcgatgcgccgggtgctcgacggtgagcggttcgcgacgtggctcgaccggttcctgcccgcgctgcgctccggcgcgccctgcccgctcctggacgtgcccgtggtctccgaccacgccgatccgcagatcggtcatctgctcggcctcgccc

SEQ ID NO: 2182 - DNA, 823 bp, Unknown
  Kingdom: Bacteria, Phylum: Actinobacteria, Class: Actinobacteria, Order: Streptomycetales, Family: Streptomycetaceae, Genus: Streptomyces
agcagcgcacccgccaccgcgcggaccttcaacggccgccccacccccgcgacctcggcgtccgccagggccgccatcggggagacggccgcggcacggcgggccgggaggtaggccgccacgaacgtcacgccgaccccgatgacgtacgcggcgacgggtgtcatccacccgatcaccatctcggtggtgcgcaggtgcatgccgaaggcgcccaggagacggatgagaccggccgcgaggccgatgccggccgccaggcccagcgtcgagccgaccagaccgagcagcaccgcctcggtcagcaccgagcggcgcacctgccgccggtcggcgcccaggacgcgcagcagccccagctcgcgggtgcgctgggcgatcagcatcgcgaaggtgttgacgatcaggaagacaccgacgaggaccgcgatcccggcgaatccgagcatcacgaacttgatgatcgcgaggaacgggccgaggctctcggcggctgacttggcgtgctcggcggccgtcttcacgtcgtacgcctcgctgccgctgcccagcgccgccacgacccgctgtttcagctcggcgtcggtgacgcccttggccgcgtcgacggagatgctggtcgcgcgggccgtcgagccgagcagccggctctgcgcggtcggcgtgtccaggtacagcagcgccgcgccggggttggtggtggtgaaggtggcgatgccgaccacccgcacccggaacgtgccgggctccgcctggaccctcagcacgtcaccgatccgcacgtgctggtgcgcggccgtgtccgcgtccagcagggcctggc

SEQ ID NO: 2183 - DNA, 749 bp, Unknown
  Kingdom: Bacteria, Phylum: Actinobacteria, Class: Actinobacteria, Order: Streptomycetales, Family: Streptomycetaceae, Genus: Streptomyces
atcctgccccgcccgcgaacccggctcggagaccgcctcctggacgaggccgccgacgccctcctgcgcgaggccccctacgagtcgctgccggactggctctggcggcgcggccgcggccttgcctcggcctacctgtccgcgctcgaggcggaggggcaggtgtcgtgggagcggagccgctggctgcccttccgcggcggacgcaccgtcctcggcgacaccgaggcgcggcggcgggcggcgttccgctgggccgcggacgagccggtgctgctcgccctggccgctgcggccgggatccgcgacgagatcgccccggaggaggcggcggtcaccgacgacgcggtcctcaccgtgctcgccaccgtgcacgacgcggtgatggaactggaggccgtacgccggcgccgcgccatcgaggacgccgccttcgccaacgtctggcgcggtgcgtgagagagcggcggcgccgacaggcggccgggcggggccgctcctatgctgggtcacgtctgcttggtcccgtcggcgtccgccgcggtaaggacgcccccgtctcctggtcccgcgaccgccgccgacggccgccagagtgatcctccgcgcttggagtcggtccatgagtcggtccatgacgcacgcgtgcccacgacggctgcgcaggagcgccgtcaccgcgaccgccgccgggatcctcgtcgtcccgctcgtcgcgtccgccgcgctcacggcgggccccgctgccg

SEQ ID NO: 2184 - DNA, 707 bp, Unknown
  Kingdom: Bacteria, Phylum: Actinobacteria, Class: Actinobacteria, Order: Streptomycetales, Family: Streptomycetaceae, Genus: Streptomyces
  misc_feature (322)..(380): n is a, c, g, or t
gcacacccactcgggcgagccgatgcgggccatcctcaccggcctggagcgcgcgggccgcccgctgccggacctggtggtcgccgaccacggctgggcgggctgcgccggacagctcggcgtggactccgtgggctacgccgactgcaacgacccggcgctcttcctcgccgaggccgagggcaccgtccaggtggcggtgccgctggacgaccacgtggtcagcccgcgcttctacgacccgatgacggcgtacctgctcgaccaggcgggcctgacctcctgacctccctcacggccacgggttgagcccctccgagcnnnnnnnnnnnnnnnnnnnnnnnnnnnnnnnnnnnnnnnnnnnnnnnnnnnnnnnnnnncgcgcagccgctgctcggcctgctcgcacgcccactcgatctgggccgcgctcgacacgtcgcggaagtcgaccttcgccgccaccagggcctccttgggaccctgcacgagcgtggtcagctccagtacggcctcgatgtgctccaccgccagcagctccgcccggatccgctcccgggtggcgcgcggcagcgggcgtccgatgagcagttccacgttcgagcggcccagcacccaggccacgtacaggagcagcgcgccgatgcacagggaggcgatgccgtcccagacgccggagccggtgagctgcccgccgagcaggccgc

SEQ ID NO: 2185 - DNA, 500 bp, Unknown
  Kingdom: Bacteria, Phylum: Actinobacteria, Class: Actinobacteria, Order: Streptomycetales, Family: Streptomycetaceae, Genus: Streptomyces
gagtgcccgacgagcaggacgcgcgacaggtcggcccgcggcccacggcgtacggcgtcgggggccgaggcggggtgcgcggcccagtccgcccagcgcgccaggtgctgccggacgagcgaggaacgggcctgggcaccgccgtcctcggccgcccagtcctgcccgttgatgccgttggccgagatcgacaccgtcacgtagccctgggaggccagcagtctctggtcctggaggtaaccgcggtagctcgggatgggccgcgtcccggccgggcagggccagtcgccgttgacctcctcgctgggcggtgtgtagcacgtggagtggcggccgtgcaggaacagcgcgagcgggcggcggccggtggcgccctgcggcgcgaccaccacggcccgcatctccacgggagcggagaacccgggcagccggaccgacttgagctcgtactcgccgctcgtggtgcggtacgggcccggtctgcccgggttctccgctcc

SEQ ID NO: 2186 - DNA, 1767 bp, Unknown
  Kingdom: Bacteria, Phylum: Actinobacteria, Class: Actinobacteria, Order: Streptomycetales, Family: Streptomycetaceae, Genus: Streptomyces
cccgatgacgggccccgccaagcacgagcgaccacgcccggcgggcgaggccgatcaccccggccagccgctccaccgcctccggcacctcccagtcgtcgcgccgcagcgcggccagtgcggtcgccggggcgaccagcaggtccggggctcctccggtctccagtgcccggaccagcaccgcccagcccgcctcccagcgctcgcgctccgggcgcgccccgaccgcggccaccaccgcctccagcgccgcctgacgcagatcgccgcgcgccggcagctcggcggtggccggatcggccagcagcgactcagggtccggcaggtccatccggtccaggtgggcgaggagttcgagcccgggcccgtcgcccaccgcgccccgtaccagcagcgccagcacgtcccgggagacgcgggccgccgtaccgaaggccagcagggtcagcgcggcctcccagctccggggcgatggccaggcgccgccgcgccgcgtctcggtgttcggcagccggtggatcagggtgggcctggcctgcaggaagccgcagaccgcccgccgggcgaaggtcaccgcctccgccagccgttccggttccagccggggcagctcggcccggggccagacaccgccgagtccgcgcacgaccacctcccggtcgtgcacccagtacagatgcacgaaccggttggccagcggcgggctcagctcccacccgtcggccgccgacgcgcgcgggttggcggcggccacgatacgcacgtccgggggcaactggagcgctccgaccctccgttccaggacgacccggagcagcgcggcctgaaccgccggggtcgcggtggagagttcgtccaggaagagcagcccgcgtcccgcccggaccaggtccacggcccactgcggcggtgccatcggcacgccccgcactgccgggtcgtcgcccacgatcggcagcccggcgaagtcggacggctcgtggacactggcgatcacggtcgtcagcggcaggtcgagggaggtggcgagctgtgtcagggcggcggtcttgccgatgcccggctcgccccagagcagcacgggcaggtcggccgcgacggccagcgtgagtgcttcgagctgctcgtcggggcgcggttcggtggtgctcgtccgcaggagggtcagaaggtcgtcggcgacggcaaggcgggtaccggagctggtgctggttccggtaccggttccccttccggttccggttccccttccggttccggttccggttccggttccccattcggccccaggggtctcggacagggagaggggggtgctgggcgtcgtgggcagggtcgtgtgcatgggcatcacctgaagggtcgtaggagaaggacgcgtggggacttcgagcggggggagggcggaggcagccggtggccaacgcgcgttggcaaacacgcggtggccaacgcgcgttggcaatcggccggtggtcatcaggcgctggccaacgcccgatggcaaaccggacggtggccaacacgcgttggcaaacacgcggtggccgacgcgcgttgacaaacggccggtggtcaccaggcgccggccaacagcaggcggcaaaccggccggtgaccaacaggcgctggccaacagccggtggcaaaccgggcggcagccaacgcgcgttggcaaacggccggtggccaacaggcgctggccgttggctgctcccggtcagcgggacgagccggtgcggggcctggcccggcgcatcgaccacg

SEQ ID NO: 2187 - DNA, 607 bp, Unknown
  Kingdom: Bacteria, Phylum: Actinobacteria, Class: Actinobacteria, Order: Streptomycetales, Family: Streptomycetaceae, Genus: Streptomyces
ccgccgtacggcggcagaagacgaccccgcccacgacgaccgcgcccagcagcaggttgatctggccctggtcgagggtgtggcgcaccggttccagccagggcccggcggccgcccagagcagcgcgcgctcgcggacgcggccggccgggcgcgggaacagcagccggagggcgcccgccgtgatgacgggcacggcggccagggacacggcccgccagagcacgaccgccgccgtccagggcaggtgcgccagcggcagcagggccagcgcggcgaacggcgggtaggtgaagggcagttcggggatgggcggcccggtgcgcaccacctggtcgtagaggccgcccgagagcacgtgcggtgcgagcgtgcggtagacccgcaggtccaggggctcggccggggacaggagcgcggtcagcacgtacagcgcgagggatccggccaggcaccggcccgcgcgggccgtcagccactcccccaccgtccgcccccggcccacgagcgccctcatggcatcagccccatcagccccccagtcccgttccgtctcgcttctcccgtctctcccgtctcctcccaggaacgaccggcagggcacgga

SEQ ID NO: 2188 - DNA, 1275 bp, Unknown
  Kingdom: Bacteria, Phylum: Actinobacteria, Class: Actinobacteria, Order: Streptomycetales, Family: Streptomycetaceae, Genus: Streptomyces
ctcatgagggggtgagccggccgtggccggagagctgggcgggcacctgggcggacgcggacaccgaggaccgggcggacgcggcgggcgaggcaggaccgggcggggtccagtcctgctcgccgaggatcagcgtgcgcaccacccgctccgccgcccagccgtcgtcgaactcgcagtagcgcgcccggaaggccgcccgcagccgcgccgactcggcgtcccgccagcttcccgaggccagcagccacgccagttcccggtaggagcgcgacacgtcgcccggcggctcggcggtgatgtcgacgtacaggccccggctcgccgtgtacgcgccgaggtcgtcggcgtgcaccacgatcggccggtccagtacggcgtagtcgaacatcagggcggagtagtcggtgacgaggacgtcggaggcgatcatgacctcctcgacgaacggctcgtccgtggcgtccacgagcacaccgcgccggtgcagctcggccaggcccagaccgcgcgcgggcccggccgccagggacgggtgcagccggacgacgagggtgtgcccctcgccgaggtccgcggcgagccgggccgcgtcgaagcgctcgacgtatccgccgcgccggtactcgcgcggggtcggcgcgtacagcaccaccctgtggtccgccgggatgccgagccgggcgcgcacggcagcccgcagctcctcgccttccggcgaacacgcccgcgccaggacgtcgttgcgcgggctccccgtgcgcgcggaggcgaagcggcacgggtaggcccgctcccacaccagttcggagtggcggttggcgaccaggctgtggtcccagcggtcggcgcggcgcagcatgcccgggacgtccaggccgtgccgggcgcccggcttggtcagcaggtcggcgcccatgtacttcagcggagtgccctgatgggtgtggatgtgcacgctgccggggcgcttggcgggcacgtcgggccagttgacgttgttgacgaagtacgcggcgcgcgcggccagtcgacggaagcgcagggtaccgggcaggacgtactcgacgtccggaggcagcagcccggcccgccgtgcctgctcggcgtcgcggaccacccacacgccgcgcaggtgcggggcgatctcccgcgccgcgcggtgcacggccgccggatcgccgagcaccccgcggtgcgagaacgccgagtacaggacgaggttctcgtccagcggccggtgggtgtgcagcgcggcccagccgcccttcaccc

SEQ ID NO: 2189 - DNA, 1427 bp, Unknown
  Kingdom: Bacteria, Phylum: Actinobacteria, Class: Actinobacteria, Order: Streptomycetales, Family: Streptomycetaceae, Genus: Streptomyces
gcggcagcccggcgccttcctccgccccttcgtcgacgaacgcgtcgggcgcggcgagtgccttctccaccagcacgcggaaggcgtccgcatccgtgagggcgagcagcgcggaacggtcggtccaggcgaggtgggcgatctggtgcgcgatgctccacccgggcgcaggcgtcgccagcccccaaccctcggaccccagaccggcgaccatccggtccagctcctcgctttcctcacgcagatcgtcgaacacgtcggacacggcggacacgggtgtcggttcgggcatggctgggagcatggcagcgcggggaaaaacaatcaagcatgcttgcatgattttttcccgctactgaatcaggaaccagccgtcaggggaaaccgggggcggcggccaagggtcggcggcccccgggggtcggtggccgtggcggggcggacgccccgggctcaggcgtccactcggggcgcggggggcttcccccggccgacctgcgtgcggaccgcgcccatgctcgccgcgatgaccagggcgatcgcgacgatctccaggggcgcgagggactggctcaggacgaggaaaccggccagggcggcgatcgccggttccaggctcatgaggatcgcgaaggtgggggcgggcaggcggcgcagtgcgaggagttcgagggtgtacgggaggacggaggacagcacggccaccgccgcgcccagcccgaaggtcgtcgggtcggccagcttggtgcccgactcggcgatccccagcggcaggaagaggagcgcgcccaccgccatcgccagcgcgagcccgtcggcctgcgggaagcggcggccggtgcgggcgctgaagacgatgtacgccgcccacatcgcgcccgcgcccagcgcgaaggcgactccggccatgtcgaggctgccgaagcccccgccgccgaggaggaagacaccgccgagggccaggcccgcccagacggcgttgaccgcccggcgcgaggccacgacggacagggcgagcgggccgaggacttccagggtgaccgcggggcccagggggatgcgggcgacggcctggtagaagaggccgttcatcccggccatcgcgataccgaaggcgacgaccgtgccccagtcggcgcgcgagtgtccgcgcagccggggccggcagaccaccagcagcacgatcgcggccaccagcagccgcaggctcaccacaccgagcgcgcccgccctcggcatcagcgtcaccgccagcgcgccgccgaactgcacggagacgcagcccgcgagcaccagcccgacgggaccgaaggagccgaagcggcccgaaccgccggagccgtccgacacgaccggcgccgccgccccttccggtgacaccggagtcactgcgggagccgacaacgtcgggtgcgacgacggggacg

SEQ ID NO: 2190 - DNA, 1416 bp, Unknown
  Kingdom: Bacteria, Phylum: Actinobacteria, Class: Actinobacteria, Order: Streptomycetales, Family: Streptomycetaceae, Genus: Streptomyces
gactgccacggagcgcgacccgcggtggtgcccggccgcgtgcgcggaccgcgccgcgttgcgcggcccgggtgcgcgggccggctgtgccggccgggtacggacggccggggcgccgggcgggggagcgtacagccgggacggaccacggtcggagccgtggcgcgaatcacccgctccactgctcacagcgcggctacctgccggtagattcgaagcctcctgaacgatcaagacgatcaagtctgaaacttgttctagattagcgtcccggcgtaatctcgcgggacggtgcagtcagaagggggcccagagtgaccgctgaggccagtggggccgggtccccggcggacctcgccgcggacggagagcgaccgctcaggatcgcgctcctcacctacaagggaaacccgttctgcggcggccagggcgtctacgtacgccacctctcgcgcgagctggcccgcctcggccaccgcgtcgaggtgatcggcgcccagccctaccccgtcctcgacgaggacgaggactacgccggcgcgctgcgcctgaccgagctgcccagcctcgacctctaccgccagcccgaccccttccgcacccccgggcgcgacgagttccgcgactgggtcgacgcgctggaggtcgccaccatgtggaccggcggcttccccgagccgctgaccttctcgctgcgcgcccgccgccatctgcgcgcccgccgcggcgagttcgacgtcgtccacgacaaccagaccctcggctacggtctcctcggcgacgtcggcgcgcccctggtgaccaccgtccaccacccgatcaccgtggaccggcagctggagctggacgcagccgagacccggcagcggcagtggtcggtgcgccgctggtacgcgttcacgcgcatgcagaagcgggtcgcgcgccgcctgccgtccctgctcaccgtctccggcacctcccggcaggagatcgtcgaccacctcggcgtacgccccgaccgcatccacgtcgtccacatcggtgccgacaccgacctgttctcgcccgacccgtcggtgccgcaggtgccgggccggatcgtgaccacctccagcgcggacgtgccgctcaagggcctggtcttcctcgtggaggcgctggcgaaggtccgcgccgaacaccccggcgcgcacctggtcgtcgtcggcaagcagccgaccgagggcccggtcgcgcaggccgtcgaacgctacggcctgaaggacgccgtcgagttcgtcaagggcatctccgacgccgaactggtcgacctggtccgctcggccgaggtcgcgtgcgtgccgtcgctgtacgagggcttctcgctgccggcggccgaggcgatggccacgggaacgccgctggtcgccacgaccggcggcgcgatccccgagg

SEQ ID NO: 2191 - DNA, 1163 bp, Unknown
  Kingdom: Bacteria, Phylum: Actinobacteria, Class: Actinobacteria, Order: Streptomycetales, Family: Streptomycetaceae, Genus: Streptomyces
tgcgcactccgccggccaccgcccctcccgctcttgggtgggtcggtggccggcggagtgcgcaggacgcactacgcgacgaacccccaggaatgcaactcctgggggttcttgtcgcaggtcacccttcgagagaggacgacccacatgcccagcatgacatccgagcaggcccggcagtctcgccgggacatgcttcaggccgcggtcgacacggccgccgtctgccgcaccatcgacccggacgcgttcttccgcgcggacggcgagcagtacatcacctggcaggcccgccgcgccgaggcgctccgcatgtgcaccgcctgccccgtccgggccgcgtgcgaggagctggcgctgcgcgacggcgacggacgggccgccgaggacgacatggtccgcggcggactgaccggccccgaactcgccgccgtccgcgcccatcacgcggagcgcctggcggccgcggtcgatgccgaccgcgacaccgagggccggcgcctggacgagctgaccgcccagctccagcgggccgccgtcaagaaccccgacaagtgcggcggccaccgcaccgccaaccgcgcccaggccgcacacaacgccgaggtccggcacctggtcgcccagatccgcgaaatccgtaccgcccgccgtgcccgagccggatggaggaccgcagcatgaacccgaccctgacccccctgccccgcaccgccgacgagatcggcccccggcagcccggcgccatctaccagaacgtcgacggccgcttcgaagtcctggccctggtcaccgaccccgcccgcgccgccaagctcctgcgccgcgacagcgcccgatgggcggtcatcgtccgcgacaccctccgccccgacggccagcccttcgccgtcggctcggtctggacgacctccgactacctgctgcggcccgccacgagcgcgtaccggcaagcggcctgacggccagccacggtccccctccaccccacggcacgcccggggtggagacgggccgtggccggccgcccggccgccgtgcgggggcgggggcgtgtcatgctgtcgatcacagggactccttcgcaagttcctgtcactgacggccccggagctccacctccggggccgtcgccctttgaccggccgggcggccggccacgg

SEQ ID NO: 2192 - DNA, 1170 bp, Unknown
  Kingdom: Bacteria, Phylum: Actinobacteria, Class: Actinobacteria, Order: Streptomycetales, Family: Streptomycetaceae, Genus: Streptomyces
gcccggcccgcgagcccaggccgccccggcagcgcagcgcgaacccgatgaagatccccggactcggctgtctgaagggctgcctgttcacgatcgtcatcctggtcgtcgcgggctggctggtgtgggagctgagcccgctgcagggctggatcggcaccggccgggggtactggtcccagctcacccactgggtcgaccaggcggccggctgggtcaagaacctgggcggcggctgacgcggcagccgacgacgcgggcgcgcccctctcctcggcgcgcgccctcgccctcacgccccgcgagccctcaccaccctcccgtcccgcgagttcggagatttgtcgacacctggcgggtgatttccgtctccgcggtgaaggttgcctcgtcggacgcgtagctttgtcggcaacacgcgtctgtaggagcagtcttggcacggaagatcggcagccggtacaccgcgaaccagatccttgggcggggcagcgccggcacggtgtggctgggcgagggaccggacgggcccgtcgccatcaagctgctgcgtgaggacctcgcgtccgaccaggagctggtgggccgcttcgtgcaggagcggacagccctgctgggcctggaacatccgaacgtggtctccgtacgcgacctggtggtcgacggcaacgacctcgccctcgtgatggacctggtccgcggcaccgacctgcgcacccgcctggaacgcgagcgcaggctctctccggaggcggccgtcgcgatcgtggccgacgtggcggacggactggccgcggcgcacgccgccggggtcgtgcaccgcgacgtcaaaccggagaacgtcctgctcgacatgcagggccccctcggccccggcggcgcccaccccgcgctgctcaccgacttcggcgtcgccaagctcatcgactcgcccaagcgcacccgcgcgacgaagatcatcggtactccggactacctcgcgccggagatcgtcgagggcctgccgccgcgcgccgcggtggacatctacgccctggcgacggtgctgtacgagctgctggccggcttcactccgttcggcggcggccacccgggcgcggtcctgcgccgccatgtcacggagagcgtcgtcccgctgcccggcatccccgacgagctgtggcagctcat

SEQ ID NO: 2193 - DNA, 1843 bp, Unknown
  Kingdom: Bacteria, Phylum: Actinobacteria, Class: Actinobacteria, Order: Streptomycetales, Family: Streptomycetaceae, Genus: Streptomyces
ggccgcgcggcccgagaagaggcagccgccgaggaaggtgccctccagcgcgttgtagccgtggacgccgccgccgccgaacccggcgacctcgcccgccgcgtacaggccgtccaccggccgcccgtcggagcccagcgcacgggagtcgaggtcggtctggatgccgccgagggtcttgcgggtcaggatgtgcagcttgactccgatcagcgggccggcctcggggtcgaggatgcggtgcggtgcggcgacccggccgaggcggtcgccgacgtagcggcgggcgttgcggatgccctgcacctgggcgtccttgctgtacggattcgccatctgcaggtcgcgggcggtgacttgacggcgtacctcggcggcgtcgagcagcggccggtcggtcagcttgttcatcttcccgacgagttcttcgagcgtgtcggcgacgacgaagtccgcgccgtgccgcaggaagtcccgtacgggtcccggcgcgcccttcccgagcagccggtcgcgcagcaccgccttgcggtccttggcggtgatgtcggggttctgctcggagcccgacagcgcgaactccttctcgacgatcctgcgggtcagcacgaaccaggagtggtcgtgggcggcgatgtcctcggtggtgcgcaggtgccgcagggtgctcagcgtgtcgtagccgggcaggcaggggtcgggcagccggcggccgagggcgtcgagccagatcgaggacggtccgggcaggatgcggatgccgtggccgggccagacggggttccagttgcgcacgccctcggtgtagtgccacatgcggtcgcggttgaccagccgtacgccggccgcggcgctgatgtcgagcatccggccgtcgacgtaggcggggacgcccgtgaccatgtgcgccggcggggtgccgagccgctcgggccagtaccggcggacgatgtcgtgatcggcgccgatgccgccgctggtgatgatcacggcctgggcggtgagttcgaacgcgccggtctcctcgcggtgggaggcgacaccgcggggcgagtcgtcgggggcgaggacggtgccgcgtacgccgcgcgccgcgccgccctcgacgacgagttcgtccacccggtgccggtggtggaaggtgagcagcccgtccttcgccgcctggagcgcgtaccgcacgaagggttcgacgacgcccgtgccggtgccccaggcgatgtggaagcgcggtacggagttgccgtggccgtcggccctgaggtcgccgcgctcggcccagccgacggtgggcagcagggtgatgccgtgaccctccagccaggactgcttctcgccggcggcgaactcgacgtaggcgcgggcccagcgcatcgcccagctgtcctcgtcgtccgggcggtcgaaccgcgcgctgccctgccagtcgttccaggcgagttcgaaggagtccttgacccccaggcgccgctgctgcggggagtcgacgaggaacagcccgccgaacgaccagtacgcctggccgccgaggttggcggcgttctcctggtcgacgagggcgaccctgcggccccggctggtcagttcgtgcgcggcgaccaggccggcgaggcccgctccgacgacgatgacgtcggcattcgtgccgttcgtggcgttcattggcgtcccttcccttctcggtgcgttcgtacggcggtgccgctgccgtcggtgagcagtgcggtgagcagttgccgcagccaggcgcgggcgccgtcgacgtccttgtccagcagcagttggacggtgacgccgtcgtaggcggcgacgaccgcgtgggcggcgccgtccgcgtcgccga

SEQ ID NO: 2194 - DNA, 737 bp, Unknown
  Kingdom: Bacteria, Phylum: Actinobacteria, Class: Actinobacteria, Order: Streptomycetales, Family: Streptomycetaceae, Genus: Streptomyces
ggcttcctccgctgccccgaggccagcagggtgatcaccacccccgccgccgcccacgccgccagcaccagcagcgcggacgtcatggcgttgctgtggaagtacgcgaccgaacgggccgaccaggttcccgcgcccggcggcagggcgggcccgatcgtctgccagaacggcggcagcagcggcagcgggaaggcaccgccggcgctcgggttgcccccgatcaccaccagcaggatcgccaggccgatgccgatgatgccgaagaccccttgcagtgcgagggtggcggcgcccacggcgaagatcaccagcgccccgagcccccacagggtcgtgacgccgcccggcagtgcgcccaggaccggccccacgatgaccgcgccgccgagtccgccgacggccgcgacgagtgccatggcgcccagccggatcgcggcccgccgcgggtcggcgggccgggccccggtgctgatcgcgaggatcgaggcgcacaggtaaccgccgacgcaccagcccacgaccaggtagaaggacgacaggccgttgaagtcgtcggcggaggcgggtgccacgtccaccgtccgcaccgtccgctgctgggccttctccgccgatccgacgatccgctccagggaggtggcgaggatggtgccgccgccggaggccacgaggagcgtgtcggtggtgccggccggggcgacgaccagggcgccgtcgacgtcccggttcaggat

SEQ ID NO: 2195 - DNA, 1471 bp, Unknown
  Kingdom: Bacteria, Phylum: Actinobacteria, Class: Actinobacteria, Order: Streptomycetales, Family: Streptomycetaceae, Genus: Streptomyces
gcgcgcgcggtcgcgggcggcggcccgcatccgcagcgggcgggcgaactgggtgagcgccgaggccagcgtcccgcccgagaaggccgcgtccacccggacgaacccgtccaccgtcagcggcacaccctcgggcagctcccgcacggtgacgtacacccccaggtcgtgcggcaccgagtcgaacccgcaggcgtgcaccagccgtgacccggtctcccgcgcgcgcgtgtcgtgccggacgtacaccaggtcgacgaactcgggctcaccggtgaggtccagatagtcggtgccgctgtccgcgcaggcggcgaccagttcctcgccgtgggtcacatagggaccgacggtggtggccagcacgcgcgcgtgccgggccagtgcacgcacggaggcagggtcggccacgtccgcccgcagcacccctgcgtccgcgccgccgggcagccgctcccgcagctcctccagccggcgttcgctgcggccggcgatcgcccatctcagcccctccggagcgtgcgcggccaggtagtgcgcggtgagggttccgacgaaaccggtggctccgaagagcacgatgtcgtacggacgttccgtccttttcggcctgctcatgacatccttcgctccgccggacggcatcccgtgccgctgtcggtggccgaggctagcgtgaagggggcaggggctgacggcgcgggtggtgacggccagggaggcccccgcggcggcgcgccggagatcccggcaccgcttggctaagcgcttgctcgttcagggcttgtgcccggtgcggcgcattcttagcatcatcggtgttacatcggttgtgtcacagtgagggggctgggatggcgacggcacaggaggccaccgcacgggcgccggggcgcgacggcccgctcagcggcgtacgcgtggtcgagctggccgggatcggcccgggcccgttcgccgcgatgctgctgggcgacctcggggccgacgtggtccgggtcgaccgccccggcggcgccggcctcggcatcgatccggccgccgacccgacccaccgcaacaagcgttcggtggtcgtcgacctgaagtccccggacggccccgcccgcgtcctcggcctcgccgcccgcgccgacatcctgatcgagggctaccgccccggcgtcgccgaacgcctcggtgtcggccccgaggcctgccacgcccgcaacccgcggctcgtctacggccggatgaccggctggggccaggacggaccgctcgccccgcgcgcgggacacgacctcgcctacatcgccgtcaccggcgccctcggcatgaccggcgaggcggaccggccgcccgtcgcccccgccaacctcctcggcgactacgcgggcggctccctctacctcgtcgtcggcgtcctcgccgccctccaccacgcgcgcgcgaccggcgccggccaggtcgtcgacgccgccatcgtcga

SEQ ID NO: 2196 - DNA, 652 bp, Unknown
  Kingdom: Bacteria, Phylum: Actinobacteria, Class: Actinobacteria, Order: Streptomycetales, Family: Streptomycetaceae, Genus: Streptomyces
cgtactgggaggcggccctccggtacgccggcgcctggagggccgcctcccagtacgactcctccaactcggcgtaactgccgtcgagttcctcctccgcgcgggccacgagcagcagccgtaccccgatcggatcgccctggagcgggcggatggcgagatcggcacgcgggagcgcggtgggctggctgaccgtgaccacctccccggtggcggccagggagtaggcggtgaggtagtccccgtgcagcatgtcgggctgcagccccgccgtgcgcagcacccggcacagggcgtcccactcgccgtcgaccgtcgagtcgaccatccagcggtccgccgccagatcgcgcagcggcacctcgcaccgcgccgccgccggatggtcggcggccaggcagacgaactgcggttcgcgttcgaccagcacccgcacacagagcccgggcggtacccgcagcggactgccctcgacctcgtgcacgaaggccgtgtcgagccggcccgaggcgaccatgcccagcagggagttggcggagacgtccatctgcagcgtcggttcggtcctgggcgtgcgggcgcgcagccggcgcagccagcccggcagggcgcggctcgccgtggcgccgatgcgcagccgggggccgccggc

SEQ ID NO: 2197 - DNA, 831 bp, Unknown
  Kingdom: Bacteria, Phylum: Actinobacteria, Class: Actinobacteria, Order: Streptomycetales, Family: Streptomycetaceae, Genus: Streptomyces
gctgcgctcggtggcccggcgggtcaccgagcgcagcaggcggccggcggtggtgtacgccgccgcgaaggcgcagccgatgagcaggacgcagaaggtgatgcggggggtggtggcggccgtcaggacggcgatcatggcccagcgttcgccgatgggcaggacgatcatgcggcgcagccagaccgtccagccgacgctgtcgagcttgtcggagagggcggcggtggggctggtgttggcgctggcgtcgtggttggcctcgttgaaggagaagtccacgacgtgccggcaggtctgcaggaccatggcgccgagtgcgagggcccatacgtcgtcatggccgccgccgcgggccgcgccgagcgcgagtccggcgtagtacgcgtactccttggcccggtcgaaggtggcgtccagccaggcgccgagggtggagtactgcagcgagtagcgggcgagctgtccgtcggtgcagtccaggacgaacgaggcgatgaggagcacgccggcggcgacgaagccgccgcgggtgccggtggcggcgcagccggccgctatgagcgcggtgagcagggaggcggtggtgacctggttgggggtcaggccgcggcgggcgcaccagcgggcgatgtagcgcgagtacgggctgatgaagaacgtggtgaagaagccgtcgcgggccttgacggccgacttcaggcggatcgcctcgtcgtcgacggcggcgacggcctgccgtgcctcgttgcggctctgcgggtcggcgggcacgacggcgacgaggcggccgaggtcggggtggtgcacgtcggcgccgtcggcgtgcac

SEQ ID NO: 2198 - DNA, 790 bp, Unknown
  Kingdom: Bacteria, Phylum: Actinobacteria, Class: Actinobacteria, Order: Streptomycetales, Family: Streptomycetaceae, Genus: Streptomyces
cccccggcccgcgggccccgtcgtccaactcgcccaggacgaactggccgccacggtcggcgccacccgcgaggccgtcgccaaggccctgcgcctgctgcgcacccagaacatcgtgcgcaccggcaaccggatggtggaagtcctcgacccgggactgctcgcgctcctcgcggacggccaccaggaacagatcccgcccccacgtgtgtaaacggctacagacggcccgccatccgcaggacactctctgaggggacgcaccaccaaggccaccaggacccggcagggacacggcggtcaccaggacgaccaggaccaccacctcttcggcaagcgcacaggacctgcagggggacacgggtgaaccacgacgccaccgaactcaccgaagctcactacgagttggtgatcagtgtcgacgccagacggtcgggccggtacgacgacgtcgacaagcagcggatgcgcgcccggatctaccgcgtgctggagacggccttcacgcacgccgccgtcgcgccggacgccctgcacatggaggaccgcggggacggcgtgctgctggcggtgcagggccgcgtcgcggccggccgcatgctcgggctgtggctggtcgaggtgcacgagaaactgcgggacgagaaccgcggtctgcgggtccccctggggctgcgcatcggcatgcacgtcggcccggtccgccatgacgagcggggcgtcagcggacgcgccgtcgacctcgcctgccggctcgccgactccgccgtcgcccggcagctcctggacg

SEQ ID NO: 2199 - DNA, 1115 bp, Unknown
  Kingdom: Bacteria, Phylum: Actinobacteria, Class: Actinobacteria, Order: Streptomycetales, Family: Streptomycetaceae, Genus: Streptomyces
agacgggtgagggggcggccgtcggccccggcggacgttcctagcgcctacccctcggcctcaccgcgaatccggccgccccctcacccgtctgtgggattcacccctcgctctcgcctcggatgatggccagcacgccgtccagctcgtcggccttcaccagcacgtcccgtgccttggacccctcgctggggccgacgatgttccgcgactccatgaggtccatgagccggccggccttggcgaagccgacgcgcagcttgcgctggagcatggacgtcgacccgaactgtgtggagaccaccagctcggcggcctggcacagcaggtcgaggtcgtcgccgatgtcctcgtcgatctccttcttctgcttggtgccgacgacgacgtcgtcccggaagaccggcgtcatctggtccttgcagtgctggacgacggccgcgacctcggcctcggtgacgaaggcgccctgcagccgggtcggcttgctcgcgcccatcggcaggaacagcccgtcgcccttgccgatcagcttctcggcgccgggctggtcgaggatgacgcggctgtcggcgagcgaggaggtggcgaaggcgagccgggagggcacgttggccttgatcaggccggtgacgacgtccaccgagggccgctgggtggcgagcaccaggtggatgccggccgcgcgcgcgagctgggtgatgcgcacgatcgcgtcctcgacgtcccgcggcgccaccatcatcaggtcggccagctcgtccacgatcaccagcagatacgggtacggctgcagctcgcgctcgctgccctcgggcgacttcaccttgccgctgcgcacggccgcgttgaagtcgtcgatgtgccggaagccgtacgcggccaggtcgtcgtagcggaggtccatctcgcggacgacccactgcagtgcctcggcggcccgcttggggttggtgatgatcggcgtgatcaggtgcgggatgccctcgtacgcggtcagctcgacgcgcttggggtcgaccaggaccatacggacgtcctccggcgtcgcccgcatcatgaccgaggtgatcaggcagttgatgcaggacgacttgccggagccggtggcgccg

SEQ ID NO: 2200 - DNA, 1600 bp, Unknown
  Kingdom: Bacteria, Phylum: Actinobacteria, Class: Actinobacteria, Order: Streptomycetales, Family: Streptomycetaceae, Genus: Streptomyces
tcgacctggtcggcaagctgctgggcgcgcacgggcgcgtgctgcccatgtccgccgtaccgctcgagctgcaggccctggtcaagggccatgacccggaccggcccgaggacgtcgacaccgtccgcggccaggcgaccgtcgcgctcaccccgggcgaggtgcagtccgtgcacctcgtgccgcacgacccgcccgccgtgcccgaggcggtcgaggcggtgctggacgcggactgggtggtgctcggccccggctcctggttctcctcggtcatcccgcacctgctcgtgccccagctcctcgacgcgctcaccgagacgaaggcacgccgggtgctttccttgaacctcgctccgcaaccgggagaaaccgccggcttctccccgcagcgtcatttggaggttttgggacgacacgcccctaaactcgccctggacgtggtgctggccgacgaggccgccgtgcccgaccgcgaagtcctcaccgaggccgccaagcggttcggcgccgcggtcgagctggcgccggtggcccggagggacggaactcctcggcatgacccggagctgctggccgccgcgtacgaccgtatttttcggatgcatggaaggatcggcccatggcgatgacggcagcggtgaaggatgagatctcccggctccccgtcacccggacctgctgcaggaaggcggaggtatccgccatcctgcggttcgccggcggcctccacctggtcagcggacgcatcgtgatcgaggcggaactggacaccgcgatggcggcgcggcgcctgaagcgggacatcctggagatcttcgggcacagctcggagctgatcgtgatggcgccgggcggcctgcgccgcggctcgcgctacgtggtccgggtcgtcgcgggcggcgaccagctggcccgccagaccggcctggtcgacggccggggccgcccgatccgcggcctgcccccgcaggtggtctcgggggccacctgcgacgcggaggccgcctggcgcggggcgttcctggcacacggctcgctcaccgagcccggccgctcctcctccctggaggtgacctgcccggggccggaggccgcgctcgccctggtcggcgccgcgcgcaggctgtccatcgccgccaaggcccgcgaggtgcgcggcgtcgaccgggtggtcgtccgtgacggtgacgcgatcggcgcgctgttgacgcgtctgggcgcacacgagtcggtgctggcctgggaggagcggcggatgcgccgcgaggtccgcgccacggcgaaccggctggccaacttcgacgacgccaacctgcgccgttcggcccgtgcggcggtcgccgccggggcccgggtgcagcgcgcactggagattctcgcggacgacgtccccgagcacctggcggccgcggggcgcctgcgcatggagcacaagcaggcctccctggaggagctgggcgcgctcgccgacccgccgctgaccaaggacgccgtcgcgggccgcatccgccggctgctggccatggccgacaagcgcgccgccgacctgggcattccggggacggaggccaacctcagcgaggaactcgcggacaac

SEQ ID NO: 2201 - DNA, 641 bp, Unknown
  Kingdom: Bacteria, Phylum: Actinobacteria, Class: Actinobacteria, Order: Streptomycetales, Family: Streptomycetaceae, Genus: Streptomyces
gcaccggcaccggcaccggcaaagtggtgcccgtaaccccgtccggcacgccgggcgcaccgacgtactcccttccgcccgccgagtccagcccgccgcccccgtcggcgcccaccgcaccacgctgacctcggaaaacaagcggaacgtcacataccgccacaccgggtccggaatgtgaacagggcatggagtttcccggaccgctggcatagaaagttgtcatgctctgggtccttctcctcctgctggcctgggccgtcgccggtatggcgtgtacgcagctgtgcctggccgccgtgcgggcggccgccgcggacaccccggacgcggccgtgggactggaccacgacctcacgctgtacgaggcggcgttcctgtccggcggccccgcccgggtcgccgacgtcaccctggtctccatggcccgccagcgccggctgctgctcgcgcacacgggctgggccaccgtcgtcgatccgcgcggacgcgacgagatggaacgatccgtcataggagccatcggccccgaaggacagtcccggatcgctccggtacggtccgccgcggcctgcgcggccccggtgcgcagcctcgccgaccgcctggtgagcgccggcctggccgtgccggaggaagcg

SEQ ID NO: 2202 - DNA, 1385 bp, Unknown
  Kingdom: Bacteria, Phylum: Actinobacteria, Class: Actinobacteria, Order: Streptomycetales, Family: Streptomycetaceae, Genus: Streptomyces
cctgaccgtcgccggctgaccaccgccgcgagtggggctctggccgcccgcgctctatggcgtgctgggcgagtgggtgggccgcaggcgtggtggcggcggcagcggcgggggcgctgccgcctccggtgcggcgctgaacgcgtcgatcatgtaggcggcgaagcggcgggaggccgcgatgcgggcggcgtgcggcgcgtcctggagaccccggtgggccatgagcatgaggaccaggtcgtcgatgacgaagccggggcgcagccggccggtcttctgggcgcggcgggccagttcgccgaccgcgcgcaaggcctgctcccggtcggcggcgaagtccatggcctcggggtaggccgtcatgaaggcgtcggcgaatccccggctgtgcgcgtggagttcgcagatccgctcgaccaggctccggaatccgtgccacgggtccgggtccgcgaggccgtcgcggacggcagcctgacaggtccgccgctgctcggcgaaggtcttggcgatcagtgcctgcttggtcgggaagtgccggtacagcgtggcgggtccgacgcccgcatgccgggcgacctcgcgcatgggtgcgctcaggcccgcctcgccgaacaccgcgcgggcggcgtccaggatgcgggcccggttgtcgcgggcgtcggagcgcacggtctgaggcaatcggctggtcatcgcttctcactttagccaggcggacgggggcgtccgttacggtccgatggcggtaccccagccgacccgaggagcagagatgaaagccgttgtgatcaggacgttcggcgaccccgatggcctggaggtcgtcgatgtgcccgtgccggttcctgccccggggcaggtgcggatcgccaccgaggcgatcggggtgggcggcgtggacgccgtgatccgccgcgggacgctcgccgccttcggcttccgggaggggcatctcctcggcagcgaggtcgcggggagggtcaccgcggtgggagagggcgtggacgcctcgtggatcgggcggcgggtgtgggcgttcaccggcctgtccggtgggtatgccgagcaggccgtcgccgcggtggaggacgtccttgtcctgcccgacgatctgaccggcgccgacgcggtgaccctcggcggctccggcgtggtcgcccacttcgctctggaacaggcccgcttcacgccgggagagacggtgctcgtacgcggtgcggccggcagcatcgggatcacggcggtccagctcgcggccgggcgcggcgcgagcgcggtggcggtcaccacctcgtcggcggagcgtggcgcccgcctgcgggacctggccgccacccatgtcctggaccgcaccggcgagggcggcccggacgcgccgg

SEQ ID NO: 2203 - DNA, 2925 bp, Unknown
  Kingdom: Bacteria, Phylum: Actinobacteria, Class: Actinobacteria, Order: Streptomycetales, Family: Streptomycetaceae, Genus: Streptomyces
cgtcggcgcccggctggcaccctggtgccagccgggcgccgacgcggacgcggtggccgaactggtccggctccagggcaccggcggcacgctctggcgggtcgccggggtcaagatgttcatggacggcaccatcgacaacggcaccgcctggctggagcggcccgactgccacggcgagtccgtgcacgccttctggcccgaccccgaccagtaccgctgggtggtcggcgagctgcaccgcgccggggtgcccacggcgacccacgccatcggcgatgccgccgtgcggcacgtcctcgactcggtggagaaggcccaggccgcgggtgggacgccggtacgccaccgggtggagcacatcgagaccgttcccgacgacaccgtgccgcgcttcgcccggctgggcgtgacggcgtcgatgcagcccacgcactgctgcgagtacacccgtgccgaccacaccgacaactggtcgcggcgcctcggtgaggagcgcgcctcccgggcgttccgctgccgcgacctgtgggaggccggcgcccgcgtggtcctcggctccgactggcccatcgcgcccttcccgccgctgggcgtcatggcgggcgcgcgccaccgccgtcccggcgacctctccctgcctccgcacggtcccgagcaggcgctgacgccgctccaggcgctgcggggcatcaccctcaacccggcgtgggtcgcgggggaggaggacacggccgggcggctcgccgtcggacaccgagccgacctcacggtgctcgccgacaacccgctcgacgtggccgacgcggacctggcccggctgccggtgctgctcaccgtggtcgacggccgtcccacccatcgcgccgcacacctctgaatcgcacggctccggcggcggaggcagggcagacgtcggacaccgaggcgccggacggcgcgcctcagtacacgtatcccacgtgggcgagcgcctgcttcagcagcaccccgtgtccgcccggcatctcgctctggaccgcgacggaggccgcctcctgcggtgtgaaccacaccaggtccagggcgtcctgccgcggccggcagtcaccggcgaccgggacgatgtaggcgagcgacacggcgtgctgacgcgggtcgtggtacggcgtgacgcccaccgtcgggaagtactcggccacggtgaacggctggagcgaggccgggacccggggcagtgccaccgggcccaggtccttctccaggtggcgcagcagcgcgtcgcgcacccgttcgtggtgcagcacccggccggagaccagggtccggctgaccgtgccgtccggcccgatgcgcagcagcaggccgatgctggtcacttcgccgctgtcgtcgacgcgcaccggcaccgcctcgacgtacaggatcggcatacgggcgcgcgccgactccagctcatcggtggtcagccaaccgggcgtgatctcggtcatgtcagacattttttgatcatactttcagtggtacgtgagggggagtcagtcgttctcgatggggagttcagcggttcctgaggggcgtccggcgagtccgtagacccgcagggcgttgtcccgtcccgtccagcgggcgatccgcagcgcgtcggcgaggctcagctcgtcggcgtccacccgctcccggagcagcccggccaggccctgccggaaggccaccgcgccgaggtggtggaactcggccagaccgtaggcgtcggagctgtacagcagtttgcggaacggtgtgacctccagggcctcggccagcacggcaccggcccgcgcgggaccgacgtggtgcagggcgaggccgacgtccaggtacacgcgttcgaagacggcggcgaggtaggccgcctgccgctggtagggccagcagtgcagcagcatcaccgggatcgtgccggccgtcaggtgcagccagtcggtgaggagcgccgggtcggcccggtgcagccgcaggtcgtcgtcgccgaacccggtgtgcagctgcagcggcagccccaggtcgacggccgtccacagcaggtgccgtacgaggaccgggtcctccaggcgcccgcgcggacgcccgccgggcccggccagccagccggccgccgcccgcgtgacctcctggcccgaggggcgcgccgggtccaggaggaagccggtgcggtaggcggccaccgacttcaccgccaccactccggcccgccgtacggcggtctgcgcggcggagcgcacggcggcgccgtactcacccgcctccaccccgcccgcggccaccgcctccgcgacgctctccagccgtacgacctcgtacgccgccgcccccgcgggctccgccagccgcgccggtgtggtcagccgctcgggcgcgtagccggtgtcgacgcacaggacggccgtgcccgcggcggtcaggaaacgccggttgacctcgtccgcgcccagttcggcccggcgggcgaggtactgctcggccggggcgtggcgcggcaggtccaggaccggggcgcagtggcggcgcacggccacaccgaccgggctgtcgaaggacgagatgccgctgcccggccacccggcaccctcggtgagcagcgactcgaagccggtccggtccaggtcggcggtgaccacgccgtggcagtggtggtccaccagcggcagcgcgccgagcagttcgtggaccgggtccgcatccgcgcccgtgtccgcctccgccccggtcggcccgcccatcagtacctccagcggtaggccgccgccacctgctcgtcgtccagtccttcgacggccgcgatctctccccggcgcaccgcggtcaccgcgtcggccaggaccggccccagggtgtcgcgcagcagcgagtcccggcggaacgcgtccaccgcttcggccagggacgtcggcagccgccgtacgc

SEQ ID NO: 2204 - DNA, 1074 bp, Unknown
  Kingdom: Bacteria, Phylum: Actinobacteria, Class: Actinobacteria, Order: Streptomycetales, Family: Streptomycetaceae, Genus: Streptomyces
cctggcgctcgacggcccgcctcccggtgaccggcctccgcgggcgcatcgcaggtgaccggccccgggcgcctgcgggctgtcaccagcgcaccggcagcccccgggtgccgcggatgagcgtgcccgggagccactcccccggcgggccgtcgagcgccaggccgggtgcgcgccgcaggagggtctccagggccgtacgcgcctccatccgggccagcggggcgcccacgcagaagtggatgccgtggccgaaggcgaggtggccgcgggtgtcgcggtggaggtcgaagcggtccggcgccggatagcggccggcgtcccggtcggccgccgcgaggccgatcagcaccggctcgccgcgcgcgatggcggtgccgccgatctctaccggctcggccgcgtaccggaaggtggcgttctcgaccgggccctcgtagcgcagggtctcctcgacgacggcgtcgacgaggccggggtcggcccgcacctcggcgagctgtgccgggtgccgaagcagggtgtggacgctgttggtgatgaggttgaccgtggtctcgtggcccgcgatgagcagcaggaacgccatgccgcgcagttccccgtcggagagccggtcaccgtcctccgcggtggtgcggatcagcgcgccgagcaggtcgtcggcggggcctgcgcccctcttctcctcgatcagctcggtgaggtacgcggcgagccggtccacggactgcaggaagccgtcctcgctggcgggtgcgacgaactcgttcgacatctcccggaacgccgtacggtccatctcgggcacgcccagcagctcgcagatgaccgtgatcggcagcggataggcgaacgcctcgacgaggtcggcgcggccgagcggcagcatcgcgtccagcagttcgtccgtgatcgcctggatccggggccgcagcgcctccacgcggcgcgcggtgaacgcgcgcgtgaccagggagcgcagccgcgtgtgctgcggcgggtccgttatcagcaggtgcttgccgatcacctcctcctcgacgggccgcacgtcgaggaggaggtgatcgg

SEQ ID NO: 2205 - DNA, 880 bp, Unknown
  Kingdom: Bacteria, Phylum: Actinobacteria, Class: Actinobacteria, Order: Streptomycetales, Family: Streptomycetaceae, Genus: Streptomyces
tcccgacacagaagggctcacccccgatggacaccatgcgtgaccgtttcgcccccgtcgtctcccgtctcctcgacgaggatccacgggtggcggtcgtcctcgccgagatcggcaaggacgcgttcgccaccgcccggcagcggcatcccgaccgggtgatcaacgtgggcatccgcgagcagctcctcgtcggggccggggcgggtctggcgctgaccggcatgcggccggtggtgcacaccttcgccagcttcctcgtggagcggccgttcgagcaggtgaaactggatctcgggcaccagggggccggcgcggtgctggtgagcgccgcggcctcgttcgactggcccgccggcggctacacccacatggcgcccggtgacgtggccgtgctcgacaccctggacggctggacggtccacgtgcccggacacccggacgaggccgagaccctgctgcggcacgcggtcgccgcgggtgaggacaaggtctacgtgcggctgtccctgcagtcgaacgcgcaggggcggccggtcgacggcgagcgcttcgtgacggtgcgcgaggggcgttccggggtcgtggtcgccgtcggacccctgctcgacgcggtgctcggcgccacggagggcctggacgtcaccgtgctgtacgcgacgaccgtacggcccttcgacgcggcggccctgcgccgggccacccacgcggccggtaccgacgtggtcctcgtcgagccgtacctggcgggcacctcgacggcggcggcgaacgacgcgctgcgcgatgtaccgcaccgggtcctcggcctgggcgtgggccgcgccgaactgcggcgctacggcaccgtcgaggagcacgccgccgcgcacggcctcga

SEQ ID NO: 2206 - DNA, 669 bp, Unknown
  Kingdom: Bacteria, Phylum: Actinobacteria, Class: Actinobacteria, Order: Streptomycetales, Family: Streptomycetaceae, Genus: Streptomyces
cctcggcgctgttcccggtggcgtcgccgcccaccgggaacagcgccgaggcgagctgggagcccggggtggcgagcagttcgctgaccgtgccggactcgacgacgcggccccgctccatgagcgcggcggagtcgcagatcgacttgacgacgtccatctcgtgcgtgatgagcaggacggtcaggccgagctgctcgttgaggtcgcgcagcagctggaggatggagcgggtggtctccgggtcgagcgcgctggtggcctcgtcggacaggagcaccttggggtcgccggccagggcgcgggcgatgccgacgcgctgcttctggccgccggagagctgggcggggtaggcgccggccttgtcggcgaggccgaccaggtcgagcagttcgagcgccctgcgggaacgttccttccccgacttgccgaggatctccaggggcagttcgacgttgtcgcggacggtgcgcgtggacagcaggttgaagtgctggaagaccatgccgatccggctgcgcgcctgccgcaggtccttgcccgcccgggggccgcgtccggcgagggcggtgaggtcctgcccggcgacggtgaccgtgcccgaggtgggccgctccagcaggttgatgcagcggatcagcgaggacttgccggcgccggactggccga

SEQ ID NO: 2207 - DNA, 615 bp, Unknown
  Kingdom: Bacteria, Phylum: Actinobacteria, Class: Actinobacteria, Order: Streptomycetales, Family: Streptomycetaceae, Genus: Streptomyces
ccccggcgccgacgccggccgcgcggcgagggcgccgtggcgttggccacagcccggcccgccaccggtgcgggacactacggcgtccgcaccccgagtggtcctgtcaccgctggtcagcggcttacgcgaggccgcaccgggtcgccgccgagcagcgtccatgaacgtccacgatgcggacagcggtgccgggtcagcaccaggggtctggtttactgatcgcatgaccacgacgagctgccgcatccctgcgaccgaggcgacgatgacgcccggtgctcgttgtatgtgtcctgtgcgtcgaatgtgcgccttctagagggcccctgcaccatctgagcctcgcgccccgaagcgagtgcccgctcatgtccgcgcccgcgtccggcccgtccgccgcaggcgactgagcccgtgcccccgcgcgcgccccttccttccgctctgggacgtgccgcgttccggccgcacccgaccatgaacgccgtgcccggcgcccacgacgcgccgcgcactcgacagtgacggaaacccacgtgatcaccacatcgggcctcaccaaggtctaccgctcgcgcggacgcgaggtcaccgccctcgacggcgtcgacc

SEQ ID NO: 2208 - DNA, 772 bp, Unknown
  Kingdom: Bacteria, Phylum: Actinobacteria, Class: Actinobacteria, Order: Streptomycetales, Family: Streptomycetaceae, Genus: Streptomyces
cgtcaccggtggcgaggagggccgggccgcgcccgccgaccggctgcccgcctcgctcgtcggcatcgagcacaccgccaacctgtactggatcgcgctggcctacctggtcgtcgtgctggccgtcgtgcagtgggcggtgcgctcgcccaccggccgggtgtgggagggcatcaaggagaacgagcgccgggtggaggtgctgggactgcgtccgtacggtttcaaactgaccgccttcgtcctggcgggcaccctggccgcgctcggcggcgtcgtctacctcctgctgaccggcggcgccaccccgcagaccaccacctccgacttcaccctgtccctgctggtgatggtggtgctcggcggttccggcacccgctggggccccatggccggcggcatcctctacacctgggccgatcaccggctcggcgacctggccggctccggcgcggtcgccggcctgcccgccgtggtgcgcgtgccgctctctcagccgctgttcctgctcggcgcgctgttcgtggcggtgatatacctgctgcccggcggcgtggcacggctgccggcccggctgcgcgccgcccgcacgtcccgcgcgtccgacaccgtcaccgaccgcaaggaggccctccagccatgagccgcaccccgcagcacgacacgacggatcagggccgcgggcaggaccgcgctcaggacaggaggcaggacggaaggcaggcggccgacgcggccggtgctggcaaggcggccgcgtcggccgcctgcc

SEQ ID NO: 2209 - DNA, 2014 bp, Unknown
  Kingdom: Bacteria, Phylum: Actinobacteria, Class: Actinobacteria, Order: Streptomycetales, Family: Streptomycetaceae, Genus: Streptomyces
cccgtagccgccgacggaggctacggcggatacggcgcacctggcggcggctaccggggccccggcggctacgggggccccggaggtcccggaggctacggcggtcccggcccgtacggcgcctggggagccggctggggcggacctccgcccgccgccaaacccggagtgatcccgctgcgcccgctcggcctgggcgagatcctcgacggcgcggtgtccacgatgcgcacccactggcgcaccgtgctcggcatctccctcgtgatcgccgtcgtcaccgagatcgccgtcatcctggtgcagcgcctggccctgaacggcgtcgtcgacagcgccgcgctcgacgacccgaacgccagtcccggggaactgctgcgcgccatgggcgacggcctgctcggatccggcatcctcttcgtggtcggcgtcatcggcaccgttctcgccaccgccctgctcaccacggtcaccagccgtgcggtgctcggcaagcccgtcaccgtccgcgaggcctggcgcgacgcccgcccccagctgcccaaactgctcggcctggtcctcctgctgctggtcatctgcctcggcgtcttcgccgtcggcatggtccccggcatcctcatcgccgccgccggatcccccaccggaggcaccgcgatcgccgtcctcggcgccctgggcgccggtgtggtcgccatctggctcgcggtccgctactgcctcgcctcgcccgcgctgatgctcgagaagcagggcgtcaagaaggcgatgagccgctccgccaagctcgtccgcggctcctggtggcggatgttcggcatccagctgctgaccgcgctcatcgtgaacatcatctcggcgatcatcgtcatccccttcagcctcatcgcctccgccttcagcgacggcggcatctccggcctcctggacggcagcacccaactcggctggacgtacctggtcatcaccggcgtcggatcggtgatcggatccatgatcaagttcccgatcacggccggtgtcaccgtgctcctctacatcgaccagcgcatccgccgcgaggccctcgacctcgaactggcccgcgccgcaggagtccagagccagggctcgggcgcgccggcgtcggggagctgatgccgtgagcctgccggggggagttctcacagcgccgcccgccctcccgcgcgcggcggaccacgccgacggagccctgcgcgccctgctgcatgccgggcgcaccgccgccctggcctccactggcccgggcggcgaaccaccggtgaccgtcccacgggaccccgcgcgggaggccgcccgccgcgaactgtccaagcggatgtaccacgagaacgaccccggcctgctgcaacgcgccctcggccatttctgggactggctcggcaacctcttcgactccgcctccggcgccacccccggcggacccgtcggcctcgtggtcgtcatcctggccgtcctcgccgcgctgggcgccctgtggtggcgcctgggcgcaccacgccgtgaacccgtcacggcccccgccctgttcgacgaccgtccccgcaccgccgccgaacaccgcgccgcggccgaggcccacgccgcccagcgccactggaaccaggccgtccaggaacgcatgcgcgccgtggtccgctccctggaagaacgcgccctcctcgacacacgccccggccgcaccgccgacgaggccgccgccgaagccggccgcaccctgcccgcccacagcgaccggctgcgcaccgccgcccgggacttcgacgacgtcacatacggcggccgacaagccaccgaacagtcgtaccaacgcatcgccgaactcgaccacgacctggaacacacccggccccagctcgcccacagcgcacagagcaccacccccgccacccaccagggcaccgaccggaccgaccggggaggcaccggatgacccacgaggccaccgccacggccccgccccccgccaccccggcctcccccaccgcccgcc

SEQ ID NO: 2210 - DNA, 551 bp, Unknown
  Kingdom: Bacteria, Phylum: Actinobacteria, Class: Actinobacteria, Order: Streptomycetales, Family: Streptomycetaceae, Genus: Streptomyces
gtgccagacgcggccggagaagccggtcgccgtgcccgacgcgtgcggttgcggctgctcgccctggcgggcggcggtgaacggcaccggctgccaggtcgtgcccccgtcggccgaggactccaggacgaggacgtccgactgcggctcggtgtcccaccacagcgagcaccgcagccgcgcgccccccgcggaggtgtcgagcgcgggcagcgcgagggtcgcggtggtgctgccggccatcccggagaaccaggccgtacggccctgatccggacggaccgcgacggcccgcgccaggttgttcccggcggcgacccggggtgccgagccggaccgccaggtgcgcaccgggtgcacggagttgccgaggaccacgaggaaggagtcggtcgtcgggtccaggaccagcgacgtcccggtgaaaccggtgtgacccgcggtgctcggagtggccatcgcgcccatgtaccagtgctggtacagctcgaagccgaggccgtgctcgtcgcccgggaaggcggtgttgaagtcggtgaacatcagctcca

SEQ ID NO: 2211 - DNA, 623 bp, Unknown
  Kingdom: Bacteria, Phylum: Actinobacteria, Class: Actinobacteria, Order: Streptomycetales, Family: Streptomycetaceae, Genus: Streptomyces
ccgagcagcgccttgcccgccgtgcgcccggccagggcgagacaggcccactggtagaggaaggcggcgagcaccagcagcgcgaacgcctgctccacgtacaggaccgccttgttccacagcgacagcccgaggtgttcggagctgccgatgacgtctccgcgcgagccgagcaggtccaggccgctgcgggtggccagttccggtacgtcggtgacgagggcggagatccggtggaaggtgaggacggcgagagcggaggccgcggcgaccaccagcgcgaaatcgatcaaccaggccatgacacggcgcagcttcggcacagacgtcccccgatcaccctcactgtctgttcgaccgttcagactaccgagggcgaacgggtggtcgaagggcccggcgggaatcgtttccgcccggtgacacgggaaccgttcagcccagtgacaggacgaccagcgcgcaggtcgccgcggtctcggcgataccgccgaagacgtcaccggtcactccgccgaagcggcgcgtgcagtggcgcagcaggagttcggcggcggcgagggagacgagcacggcgcccgccgagagcagggcggtgcccgtgccgaaggccgcgccggccg

SEQ ID NO: 2212 - DNA, 577 bp, Unknown
  Kingdom: Bacteria, Phylum: Actinobacteria, Class: Actinobacteria, Order: Streptomycetales, Family: Streptomycetaceae, Genus: Streptomyces
gaccccggggcgctggcccgccgcctggccgactgggacctgcccgcgcgggccgccgacgccgggggagtcgtggagatacccgtccgctacgacggacccgacctcgccgacgtggccgccctgtgggggatcggcgccgacgaggtcgccgcccggcactcctcgtacacctaccgcgtcgccttctgcggcttcgcacccgggttcggctacctcaccgggctgcccgcccccctgcacgtaccgcgccgcgacacgccccgcacccgcgtcccggccggcgccgtcgggctcgccggtccctacaccgcggtgtacccgcgcgccactcccggcggctggcagctgatcggcaccatgcccgagcccgcccggctgtgggacctcacctgggaccgcccggcactcctcacaccaggaacacgggtgcggttcgtcaccgaggacttcgacacgggggacttcaccaccgacggctccggcaccgggggcgagacggcatgagctccaagatcaccgtcgtacgccccggcgccctcaccaccgtgcaggacgccggggcgtacgacggtga

SEQ ID NO: 2213 - DNA, 1328 bp, Unknown
  Kingdom: Bacteria, Phylum: Actinobacteria, Class: Actinobacteria, Order: Streptomycetales, Family: Streptomycetaceae, Genus: Streptomyces
ccttctgcgcgggcgcccgcgagcggggagggacgatgccgttccgcggccccccaaccgcggacattccccccaccgccgcacgggcacgtcggccagtactgcaggcatcctcgcacctgccactgacaccgcgcccgccgcccaccggcaagtgatcttgattggtcggctctgcccccaaaagtgcctggcccaggcttcacggatgaccgattgagatcggtcacgtccggttccggcaacctcgcggtccggatcgagcgtcttcccttcgaacgaagacaacgaagaagacaacgaagcagaccacgaagcagaccacgaagaaggcagcgacgtgggccgggcccgcgggcggacgggaatcgacgacagcggtcggggacccgggaacttcggcaagccggtgccgggccggtcggcactacagtgtctcggaacgtaggcaagcgacagggagcgcatgacgtgcggccggtaggcagcaagtacctcctggaggagccgctcggacgcggtgccaccgggaccgtctggcgagcccgccagcaccagaccgcgggagccgaggcggccgtacccggccagcccggggagaccgtcgcgatcaaggtcctcaaggaagagctggcgaacgacgccgacatcgtcatgcggttcctcagggagcggtcggtgctgctccggctgacccacccgaacatcgtccgggtgcgcgacctggtcgtcgagggcgacctgctggcgctggtcatggacctcgtcgacggccctgacctgcaccgctacctgcgcgagaacggtccgctcacccccgtcgccgccgcgctgctcaccgcgcagatcgccgacgcgctcgccgcgagccacgcagacggggtcgtccaccgcgacctgaaaccggccaacgtgctgctgaagcaggacgacgggcagatgcacccgatgctgaccgacttcggcatcgcccgtctggccgactcgcccggtctgacccgtacccacgagttcgtcggcacgcccgcgtacgtcgcgccggagtccgccgagggccgcccgcagacctccgccgtcgacatctacggcgccggcatcctgctctacgagctggtcaccgggcgccccccgttctccggcggctccgcgctggaggtcctgcaccagcacctgagcgccgaaccgcgccgcccctccacggtccccgacccgctgtggacggtgatcgagcgctgcctgcgcaagaaccccgacgaacggccgagcgccgagaacctcgcgcgcgccctgcgcgtcgtcgcccagggcgtcggcgtgcacgcgaacgc

SEQ ID NO: 2214 - DNA, 582 bp, Unknown
  Kingdom: Bacteria, Phylum: Actinobacteria, Class: Actinobacteria, Order: Streptomycetales, Family: Streptomycetaceae, Genus: Streptomyces
gtcgccggcggtggccgggacgaacacggcgccggcgacggcggcgacgacggtggtggcggccagcgtgcggatgcggcgggcggtggtggaacgagcggacatatgggacttcccccccgggagtcgacaaggcgcacggcacgacgggcggcggtgagcctggagatgagcgaaaagacaagcgaaaagacgagcgaagagacgagctgagagatgagagaggtaccgctgcattcctgccggtcttgcgttccccccggcggctcgcggtgcacttatcttcactcagtgttcgttcgtgatcgatctgcacttcgtcaccgcttcgctacagcggacgggaagcgccggttccgctgctgacacccggtcacccggtcacccggacaccccgtccccgaccgcctcgccccgcccgggagctttgcccctcgatgggccgttgatgggcctttcctgaaccaccgtgtgggccgggttcggtgaagggtccgtaaagggcgtttggcgagggttccgcaagcgtccgcaaagcctccacacaggcggcggggcgtggtgttgtcatctcgttaagcg

SEQ ID NO: 2215 - DNA, 1455 bp, Unknown
  Kingdom: Bacteria, Phylum: Actinobacteria, Class: Actinobacteria, Order: Streptomycetales, Family: Streptomycetaceae, Genus: Streptomyces
cccgggcggcccggccgcagcgggcggaactggacttcaccgagtccaccgaccgcatgctcttcgaacgccgcttcggctgggtggacgtcgaggccgactggatgccggccgacgagcccccgctctccttctcccacgccgaactgcgccgcgaggcacgcgacttcctgcacgacctgatcgccgacctgtgcgacctgcacgaggacctcgcggagaacccggccgtgtggaccctccaggcccgcttcccccgcctgccctgaccggtccggcgcgccccgcccgccgttcagtcctccaccctgacccccagctccgccgccagcaccggtgccaggtcgagcagctgccccgtgctgatcaccgctcccgccagccggtccacgccccgcgcgatctccagtgaggcggccccgcgcaggtcgacgtccgtgagcgtcgccccgccgaagtcgacgcccttgagcgcgcagtccacgaactcgacccgctccagccgggcaccaccgaagtccggctcgaccaggacacagccctcgaagacgacgtcccgcagcttcgccttgcgcaggttcaggtagtcgatcttgccgccgcggatccgcacccgctccaggacggcgccgtgcaactgcaccccgccgagccgggcgtcggccagttcgacatcgcgcagggtcgcctccgcgaggctggtgccgacgccccgtacgccggtcaggaccgtgtccagcaggcgcgcgtggcgcagcgacgtgtcgtccaggacacagccccgcagcgcgcagtccatgaaacgggcgcctgcgccgtcctgcccggcgaagtccgtctcccggaactccagtccgtcgtagtcgccgtccggcgccagtcccgcgccgtcgtacgcctccagcgcgggcagccgcacctcgggccgccgcgccgccttcacccggccccagccggcgcccgaaccgccggtcccggtggaaccgcccatcccgccggaaccgcccggcccgcccgtcgctctcctcgtcatgcccccatcgtgcaccccaccactgacagtgctgccggcgacgggcccgacctgcgcggacacccccgatgtcacataccggcgccctcggtccgtcgtaccggaagagccaccggcagtccggaaaccgacagaaggagacccgtgtccatgcaccgcatcaccgtcatcggcggcggcctggccgggctggccgccgccgtcaccgcggccgaggcaggcgccgacgtcaccctgcacgaggcacaccacacgctcggcgggcgggcccgcacggcggacgccccgtaccggaccaacgacggcccgcacgcgctctacgacggcggcccgcactgggcctggctgaagcagcgcgacctgatcggaccgctcgccccgctgcggcccctgacggccgcccggctgcggctgcgccacca

SEQ ID NO: 2216 - DNA, 1310 bp, Unknown
  Kingdom: Bacteria, Phylum: Actinobacteria, Class: Actinobacteria, Order: Streptomycetales, Family: Streptomycetaceae, Genus: Streptomyces
acaccttgtccctggccgggccgagcctggccttcatgttgtccagcagacccatggttcaccttctctggcgggacagttacctgcgggcgccctcttcggccccgtgcccggccagggacaaggtgtcggacctcgcgcagcggcacgggggttcgatcgagcagggactcgacaaggccgcgaaggtggtcgacgagaagaccaagggcaagtacagcgacaagatccacgcgggcactggcaaggccaaggacgccatggaccggctcgcccaccgggaaggccccggcacgggcgggaccggcggtccggccaaggggggcccgactgcggacggaccgggcgcgagtggtccggctccgggtggtccggggacggcgccgggcggcaacgccgggcggacggcaccgcaggaacctccgcagggacctccgcccgtgtcctgagcggcgggtgacgggcggccgggagcaggacctctcccggccgcccgtcacccgtcacccgtcgcccgccgtccgccgcccgctcaggaccaggcggccaccaggtaccccacgccgtacggtgcctcgtcgtacagcagcgctccggagaggcccgcgtcctcggccgcgcccgcgagcacctgccacggcgcacggcccgacgccttgagttcgtacgccagttccgcgtcgagcgcggtgagggccgcgacgtccgccgcaccgagcgcccgtgcggcttcggcgtcgaagggctcggcccgttcgtcgaggtaccccggcgccttcagcgaacggcaggcgctgccgtcgcccatcaccagcatcgccacccgctccggccgtgcggcgatgtcccgcccggccgccacgcaccgttccgtcgtcagcggctcacccacgcccagcccctcgacgggggcggtccagccggtccgttcgagcagccatgcggcgacggcgagcgagggcggcaactcgcgctcgggcgcgccgcccgtgtccccgcccagccgtacgtccaggtccacaccgaacccgcggaacgagccccgggcgccctgcggatgcgggccgcgcccggactgctcggcgggccccacgaccaggagccggtccggccgggcggcggagagcactcccagtgcgtccgtgcacgcggcgcgcgcggcgtccagctcgggcgcggccccctgggcgacggcgggcacgaggaggggcgggcagggacagactgcggcggcgacaagcatgaccggcagactaacccggaacgccggacgaggacggaccgtccccgcccgccgtcctggacgcctc

SEQ ID NO: 2217 - DNA, 535 bp, Unknown
  Kingdom: Bacteria, Phylum: Actinobacteria, Class: Actinobacteria, Order: Streptomycetales, Family: Streptomycetaceae, Genus: Streptomyces
ccacgccgcccgcctcggtgagtcccgttccggtacccgtatccgcgcccgcgcccgcaccgccactcgtacgcgcaccggcgccctccccctcccccggctccgccccgagcagcgcctgcggcaccacgagcaccgcctgtacaccgccgtagatgttggtctgcagccggacggtgatcccgtgccgtctggcgagctgcgagacgacgaacagcccgatgcggccgtccgcgagcaggctggccacgttgacctggtccgggtcggccagcagggcgttcatccgcacctgttcgccgaccggcatgccgagaccccggtcctccacctccacggcgagcccggaggtcacgaggcccgcgcgcagcaggacctgggtgtgcggcgcggagaacaccgtggcgttctcgacgagttcggccagcaggtggatgacgtcggcgacggcgtggccgcgcagccggccgtcgatcggcgggacgagcctgacccgcgagtactgctcgacctcggcgatggcggagcgcagcac

SEQ ID NO: 2218 - DNA, 505 bp, Unknown
  Kingdom: Bacteria, Phylum: Actinobacteria, Class: Actinobacteria, Order: Streptomycetales, Family: Streptomycetaceae, Genus: Streptomyces
gcttctacgagcggctgggctacgtggcgtacggcccggagttcccggacgccggcattccgcaccgggcgatgcggcgcgccctgtagccgctgggcgaagcggccggcagcagggcggcatggcacgctggaggctgccgtgtgaacgtccgacctcccggagcgctgagcgtggatcagttggccctgttgttcgtcgtcctgctcggggccgtgatcagcgtccccgtcggagaccggctcgggctgcccgccccggtgctcatgacgctcctcgggatcgtcctcgcggtcctgaacttcgtaccgaacgtcgacatcccgcccgacctgatcctgcccgccctgctgcccccgctgctctacgcggccgtacggcgcacgtcctggcggcagttcgcggcgaacaaacggccgatcttcctgctggccgtggccctggtgttcgtcacgaccatctgtgtcgcggtcgtcgcccacacgatcgtgccggggctgccgct

SEQ ID NO: 2219 - DNA, 853 bp, Unknown
  Kingdom: Bacteria, Phylum: Actinobacteria, Class: Actinobacteria, Order: Streptomycetales, Family: Streptomycetaceae, Genus: Streptomyces
  misc_feature (251)..(323): n is a, c, g, or t
cggcggggtcaggtcggaggcgggcagcttcggcggggcggtctcctggaacagcacccggtcgtagtcgaccatgccggtgttctccatgaccgtgatgtggtcgagcacggtggcgttggcctggtcggcgagggcgcggaccaggctgttgcgggtggtcgagcggatcttcgcgatcgtgttgaagatctggccgtgcgtcacccgcaggatgttggccatgtcgctgtcgaactgcctgccggagnnnnnnnnnnnnnnnnnnnnnnnnnnnnnnnnnnnnnnnnnnnnnnnnnnnnnnnnnnnnnnnnnnnnnnnnngcccgcggtgacgaccgccttgctggtgcccttctccacggccatctgcccgaccgggtactcccacagcccggccgcccgcaccttgaccacgaagtcccggtccgcctccgtcagcggcccccaccgcgtctgggtgatgacccgggcgggtgaggtcgagacggtctgcaggccgaggatgcccgggtaggcgagcgcggcgagcgtcagaccgagggctccgcccaccaagagcgttcccgtcgcgttccgcgaaaagcgcaccgtgcctccagcccggccgggttcccgcccgcgggcggttcggacacaggccagtacggacgcggacgcgcccggaaccttttggctcggcaaaatcgcgcgcgctccggcacctcggcgcccgggacttcggcctccgggcacccgtactcccgagccccgagcccacgagaccgtactagatctcgtatgccgtcttctgcttgtatccaaaaccacgagaccgtactagacctcgtatgccgtcttcttcttgcaaaaaa

SEQ ID NO: 2220 - DNA, 673 bp, Unknown
  Kingdom: Bacteria, Phylum: Actinobacteria, Class: Actinobacteria, Order: Streptomycetales, Family: Streptomycetaceae, Genus: Streptomyces
ccgccgcgctgacgcccggcgcggcctcacggatggtgcagctgccgccgggcgtggacgagaagaccttccacccgggatcgggcggggacgaggtacgggcgcggctcgggctgaccggccggccggtggtcgtgtgcgtgtcccggctggtcaagcgcaaggggcaggacaccctgatccgggcgatgcccgcgatcctcgccgccgagccggacacggtcctgctgatcgtcggcggcggcccgtacgagaaggacctgcacaggctggcgcgcgagaccggcgtggccgcgtccgtacgcttcaccggaccggtgccctggagcgacctgcccgcccactacggcgccggggacgtcttcgccatgccctgccgcacccggcgcggcggcctcgacgtcgagggcctcggcatcgtctacctggaggcgtccgcgaccggcctgcccgtcgtcgccggtgactcaggcggcgcgcccgacgcggtgctcgacggcgagaccggctgggtcgtacacggcggctccgcagaggagaccgccgaccgcatcgtcaccctgctgtccgacggggaactgcgccgcagcatgggcgagcggggccgccgctgggtcgaggagaaatggcgctgggacctgttggcggaacggctgagagagcttctttgagg

SEQ ID NO: 2221 - DNA, 1240 bp, Unknown
  Kingdom: Bacteria, Phylum: Actinobacteria, Class: Actinobacteria, Order: Streptomycetales, Family: Streptomycetaceae, Genus: Streptomyces
agcgtggtcttgcccgcgccgagttccccgctgagcatcacgaggtcacccgcgcgcaacagctcggcgaggcggcggccccactcccgcgtctgctcggcggaggtcagggtgatctcgacggactcggggtcagccgggctgtgcggtgctgctggtgcttccatgtccacccacggtagcgcctgccgggaccgcgcccgcgcgggtcagcaggtcggcgagccggtcggtgacggcctctgggtgctccagcatcaccagatgccccgcgtccggcacgagcaccagctcggcgtcgggcagcaggtcggcgatggcctcgctgtgctcgctgggcgtgaccaggtcctgcacgccggccaggacgagtaccggcatccgtgtgaacagggccagcgcctccgtcttgtcgtggtcggtgaaggccgggtagaactcggcgaccacgtcgatcggggtgccctcgatcatgcgctcggcgaaccgggcgacggccgggtcgacgtcccgcccggcgaaggagtaccgcttgatgatccccgcgaacaggtcggcggtggcccggcgccccttctccaccagttcggcgcgctgcccgagcgccttgagcacgcccggcagcacccgccgcaccgcgttgaccccggcgaccggcagcccgaagttgacctcgccgagccgtcccgaggaggtgccgacgaaggcggtggcgacgacccggtcccggatcagctccgggtactgggcggcgagcgccatcacggtcatgccgcccatggagtgcccgaccagcacgagcgggccctcgggcgcggcggcgtcgatcacggccttcaggtcgcggcccagctggtcgatgctcagcggcacgtcgtcccggctctgggcgacgccccgcccggagcggccgtggctgcgctggtcccagtgcacggtccgtacgacgccgcgcagcgcggcgcgctggaagtgccaggagtcctggctgaggcagtagccgtggctgaagacgacggtgacgggcgcggggtccttgcgtccgaagaggcggcggcggcgcggggagagggccgcggcggggtcggggtcgaggtcgtcgacctcgtagtacagctcggtgccgtcgtcggcgtacgcccggcccggggtgccgcgcagggttccgtacgggccggcggagtccagcgcgagccgggccttcctgcgcatgccccggccgacggtcatccgctctatg

SEQ ID NO: 2222 - DNA, 2198 bp, Unknown
  Kingdom: Bacteria, Phylum: Actinobacteria, Class: Actinobacteria, Order: Streptomycetales, Family: Streptomycetaceae, Genus: Streptomyces
ccgctgcacggagtgcgacggccgggacccgccgccggagtcctcccccacgctcacgcacccggcggtggcggccagtgcggcgagtgcggcggcgagacggacggatacgtacaaggggcgcacgggagccacctccgggaggacgaagtcgccgtgcccaactccccgcgcccgcaagaggacacgccgcccgcccggccggacctcagccgtagcccagggcgtgcagccgggcgtcgccgatcccgaagtggtgggcgatctcgtgcaccacggtcacctcggtctccgcgaccacgtcctcccggctctcgcacatccgcagcgtcggcccccggtagatcgtgatccggtcgggcagcacacccgcgtaccactccccgcgctcggtcagcggcgtcccctcgtacagcccgagcagctcgggatcgtcggcgggcggctcgtcctccacgaacaccgcgacgttgtccatcagccgcgtcagctccggcgggatccggtcgagggcctcggcgaccagttcctcgaactcctcgcgcgtcatctccagcacagccccattgtccggcacaccgtccgcccggcaccccgcctcccgcggccccggagcactctccggtccccgcgcgcagcgcgcatatccggcggcggaggcgggcatacgcgcccaatggctcgcgtccgccccgctgacctgaacctcctgaagctcccgcgccgcgcccacggcacccggcgcacggcgcgccccctcgccctggccccggagccacgcccctggctgcgcgccctcggcctggtgaccgtcgtggtcgccggcgcctggctcggcctgctgatcgtcggcaacgtacgcgtcccggtcggccccgtgaacaccacgatgaccctgcgcccctccctcagcgggggaacgaagatcggcgtctcaccgctgggctccctgagcctggacagccacaccgccccggtacgcctcgacgtgaacgtcgaccagctcgaccccgaacgcgcccaggccctggtcgaccaccccgaacggctctccggcctccaggacgaggtggtccacgacgtcgaacgcggcaccttcgacctggccgtacgctcctgcgtcgccgtggtctccggcgccaccgccctgggcctcgccgtctaccgccgcccgcgccgcgcgctggcggccggcggactggccctgaccctgctcgccgcgtccggcgccaccgcctacgccacctggaacccgaagtccgtactggaacccaggttctccggactgctctcctcggcgccctcactcgtgggcaacgcgcgcagcatcgtcaccgagttcgacgtctaccagaaggagctggcccgcctggtgacgaacgtgaccaagctctacgacgtcacctccacgctccccgcctaccagcccgacccgacgaccatccgggtcctgcacgtgtccgacatccacctgaacccggcgagctggaagatcatcggctcgctcgtgcagcagtacaaagtggacgtgatcgtcgactccggcgacaccatggaccacggcacggcggcggagaacggcttcctggacccggtggccgacctgggcgtgccctacgtctgggtgcgcggcaaccacgactcgccgaccacccagcgctacctggcccgcatgaagaacgtgcacgtcctggacgacggccgcgccgagacggtcgcgggcctgcgcttcgccggcgtcggcgacccgcagttcacacccgaccgctcgaccgcgcccggcggtgacgcggcggaacggctggccggcgcccgcctggcgtcatccctgcgcgaccagcagtccagggggacacccgtcgacatcgccgtcgcccacgaaccggtggcggcccgcgagaccgacggcgcggtgccgctggtcctgtgcggccacctccaccacgagggcacggagatcctcaagtacggcacgcggctgcgcatggagggctccaccggcggcagcgggctgcgcgcggtcgagggcgagcaccccgcacccatcgaggcctcggtcctctacttcgaccgcgacagccgccgcctccaggcctgggacgcgatcaagctgggcggcctcggacagaccacggcggaggtcagccgccacctccccgaggacaaccacccgggcgccaccccctccccctcggcac

SEQ ID NO: 2223 - DNA, 1034 bp, Unknown
  Kingdom: Bacteria, Phylum: Actinobacteria, Class: Actinobacteria, Order: Streptomycetales, Family: Streptomycetaceae, Genus: Streptomyces
cccctggaagaccgcgtcgagcagatgatcagtgtcgcggaacgtgccgttcccggactccgcgaccggctgctgtggcacgaggtccgcacgcccgccgacatcgagcgggtgacgggcgccgccggcggagccgtgcccgcaccggcgctggccgcggccggagggcggctgctgcacccggcgaacccgacgcggatcgagggcctgtacacggtgggcggctggtcgcaccccgggggcgggctgccgcacgccgggatgtcgggcgcgctggtggccggactcgtcgtggagggcccggagttccgcggctcgcagtgagcccggcgcggactcggtgagccgccggactcggtgagcggtgagcccgtttcagaaacggtactgctcgtcgtagcccgcgccgtgcgcctggccctgcgtctgcccctgtccctgggcgtcgccgccctggccgttgccctggtacgggtacggctgctccgccggcagttccccgctgtagggatcctcgccgcgctgctgcgggacccacacgccgccggccggggtctcgccgctgtaaccgcccgtggcgtacgggtcctgggtgccgtagccctgctggccgtagccgccggtgtaggaggtaccgccgtcgtaggtctgggtgccgatgtacgggtccgagtaggcggcgtactgctgctggcccgtgccgtcgtagccgtaaccctgctgcgtgtacccggagtagtcgtacccgtagcctgcgtcggagccctgggcggtggtggcgtacgggtccggggcggcgccgccgggctggccggagtggccggcctcgccgccgaagccgctgtagacgccgtaggagccggtgtcgtcgggcaggggctggggcgcgtagaccgcggtggactcggcggcggtgggctccagggggcgggccggggtgaagacgtcgtcgtgctcgtcgtcgtcacgcccgtacgccgggccgtcgtgaacggaccgcccgtcggcgacgtccaggccgcccgcgcctccct

SEQ ID NO: 2224 - DNA, 1388 bp, Unknown
  Kingdom: Bacteria, Phylum: Actinobacteria, Class: Actinobacteria, Order: Streptomycetales, Family: Streptomycetaceae, Genus: Streptomyces
gtcgccttcctggtgcaggacgcccaccagggccgcggcgtcgcctccgcgctcctggagcacatcgcggccgtcgcccgcgagcgcggcatccgccgcttcgccgcggaggtgctgccggccaacaacaagatgatcaaggtgttcacggacgccggctacacccagaagcgcagcttcgaggacggcgtcgtacgcctggagttcgacatcgagccgaccgaccgctcgctggccgtgcagcacgcgcgggagcagcgggcggaggcgcggtcggtgcggcggctgctggcgccgggctcggtggccgtcatcggcgtgggccgcgcgcccgggggtgtgggccgtaccctcctcgaccatctgcgcgaggccggtttcccgggtcggctgtacgcggtcaaccgggccttcggaccggagcgcgaggagatcgacggggtgcctgcccggcgctcggtgcgggagatcgacgggccggtcgacctcgccgtcgtcgccgtaccggccgaacaggtgcccgaggtggtcaccgagtgcggtgagcacggcgtgcagggactcgtcgtgatctccgccgggtacgcggagagcggcccggaggggcgtgagcgccagcgtgcgctggtgcggcaggcgcgcatgtacggcatgcggatcgtcggtccgaacgcgttcgggatcgtcaacacctcgcccggagtccggctgaacgcctccctggcccccgagatgccccgccccggccggatcggcctgttcgcgcagtccggcgccatcggcatcgccctgctctcccggctgcaccggcgcggcggcggggtgaccggggtgacgggcgtgtcgacgttcgtctcgtccggcaaccgcgcggacgtctccggcaacgacgtcctccagtactggtacgacgatcccgacaccgacgtcgcgctgatgtacctggagtccatcggcaacccgcgcaagttcacccgcctcgcccggcgcaccgcggcggcgaagccgctcgtcgtcgtccagggcgccggatccgggccgcaggggcacacggtccgggcgacgcggctgccgcacgcgacggtgtccgcgctgctgcggcaggccggggtgatccgggtcgacaccatcacggagctggtcgacaccggactgctgctggcccggcagccgctgcccgcggggccccgggtggcgatcctgggcaactccgagtcgctcggcgtgctcacctacgaccggtgcctggccgagggcctgcgcccgcaaccgccgctggacctgaccacggccgcgtcggcggaggacttccgcgcggcgctgtcccgggcgcccgccgacgagacgagcgacgcggtggtcgtgaccgcgatcccggccctggggga

SEQ ID NO: 2225 - DNA, 1205 bp, Unknown
  Kingdom: Bacteria, Phylum: Actinobacteria, Class: Actinobacteria, Order: Streptomycetales, Family: Streptomycetaceae, Genus: Streptomyces
gcccgagctgggcggcgccgcgttcccctggcggaccatcgagggcgaggagggctcggcgtactggcccgccggcaccgccgccttccacgtcaacgccgacatcgcgcacgcggtggtgcggtacgtggccgccacgggcgacaccgacttcgaacgcgacaccggggtcgaactgctggtggagaccgcccggttgtggcgctcgctcggccaccacgaccaccgcggcaccttccacatcgacggcgtcaccggccccgacgagtacagcgcgatcgccgacgacaacacgtacaccaacctgatggcccgggcgaacctgcgcgccgccgccgacgtcgtcgagcgctacccgaaggaggccgagcagctcggcgccgacgacgaggagagcgccgcctggcgggacgcggccgaggccatgaacatcccgtacaacgcggaactgcgggtgcacgagcagagcgccggcttcacccgttaccagcgctgggacttcgccgccacccgcgccgaccagtacccgctgatgctgcacttcccctacttcgacctgtaccgcaagcaggtgatcaagcaggcggacctggtgctggccatgtacacctgcggcagcgagttcgacgaggagcacatcacccgcaacttcgcctactacgagccgctgacggtgcgcgactcctccctctcggcgtccgtgcaggcggtcatcgccgcgcaggccggcttcctgcgcctcgcctacgactacgcgtccgaggcggccctgatggacctggaggacctggagcacaacacccgcgacgggctgcacatcgcctcgctggccggcacctggatggcgctggtggtgggcttcggcggcacccggcgggcccgcgacaccctggagttcgcgccccgcctgccggagaggttcagccggctggccttcagtctgctgttccgcgaccgccggctgcgcgtggagttcacccaggagaccgccaagtacaccctgctgtccggaccgccgctgacggtccgccaccacggagaggacgtcctgctccagccggacaagcccgcggcccgcccggtcccgcagccccggcacctgccggccccggaccagcccctgcaccgcaggccgggagtgcgctgacccggagtgtgccgagtcggtgcgcgccggcccggtgcgcgcgccgaggcggctgccg

SEQ ID NO: 2226 - DNA, 1670 bp, Unknown
  Kingdom: Bacteria, Phylum: Actinobacteria, Class: Actinobacteria, Order: Streptomycetales, Family: Streptomycetaceae, Genus: Streptomyces
gcagtaccccggttcgccgctgcgcccgcccgtgccgccccggccggcgcacgcccccggcgctcccggcgcgccgcggccgtccgcgtacgagcacgcgcccccgctcccggcgcagcacacctctgccaccgtcgccgagtggctcgacgcgccccgcccggccgcgaaaccggggatctggcggctgggctaccggcagccggcggaggtggaggagaaacagcgactggaccccgccacgctcgtcggcatggcgatccccgcggtcgtcggagtgatcctctggtccttctggctgcagggagcgattccttatcagggagcactcctgcggctgatcactccggacgactggtggtggagcggctcactgtgggcgaaagacgcaccgggggcgcgggacccggtgggattcggctatgaggctctcatcgcctatcgcgacctcgccttcgtggtgcttttcggaggtatggcgcgtatcggtagctggggcaaggggttccgcttctacttcgggcgcagaccccagccccggcgggccctgctcacggctctgtgcgctctcgtggcgctggcgctggtgttccccgaggcagttcccggggccttctggccttccgtgcccatcgtcgacggcctgctcggcctcaccatcgccctctttcggagctacgccctcgtggagtcggcgctgttcgtctacagcctgtacgcggtcgtcgtcctggccgtggtgtggccgttcgcccgggcgggcgactggctgccgtacgcgcgcgaacgattggccgcccgcagggaaccgcagaccgctctcacgtcggcgaccgacgcgcccccctcgcggtggccccggctccggcgcgccgggcagcaccaggcggcagacgtgctgaccgccgaggtggccggcgggcggatgaacgacgtggactgcgcccgcgtggagcacgcctgggaccgggccggccgggaaggcgacgtggtgggcttcaccgacaccgtgctgcgccacggcggcgccgcctggacccacccctccggacagcgcgacctgcccgcccgcaccgcccggcacgacctcctggagggccaggtgcggctcgggcgctgggtggcgggggagcgggcaccgcgcagctaccacgacgccggtgcggcgctcggcccggagatgctgggcacctccctgctcgtggtcgggccgtccggttccggcaagacccggcacgtcgtcgagccggtcaccgaggcgctcacactccaggcgctgaccggccggtgcgcggtcgtcgccgtctgcgccgccggtacgccgctcggccgcgacggcgcctacgacgtcgtcgtgcggatcggcgaccccgcctccgcgcacgacctcgacccgtacgccgagtccgacgaccccgacgaggccgccgcattcctcgccgaggcgctggtcggagacctcgccggcgtgagcacccagagcgccaccacggcgctctcccagctcctcggcccgtaccgcgcggtgcacggccacttccccgcgctgccggtgctgcgcgaactgctggagggcgacccgggggcgctcgccgccctgcggacggggctcgccgacgaggagcacgccgtgatgcgccgcgagctggacgcccggatgcggcaggcgg

SEQ ID NO: 2227 - DNA, 555 bp, Unknown
  Kingdom: Bacteria, Phylum: Actinobacteria, Class: Actinobacteria, Order: Streptomycetales, Family: Streptomycetaceae, Genus: Streptomyces
acgctctgccgactgagctataggggccagtcgccttttcgaggtttccctcgcggcaacggaatagatcataccccgaacatcgccgtgctcccaaccgccaccgccccgcccagcgcattgcagaccgagacgatccgctgcatctcgcgtcgcgtcaacgacgcgtccaccggcagtgccagagtctccccggcggcccgctcggtctccggcaggtgcacgcagcgccggaattcgggcaaccggtgtacgggcgtcttcaccggaacccggcagtcaactcccctggcccgcacggcccccgcgaaagcgtcccggtcgggccggccgttccccggcacccgcaccacgtactgctgataggtgtgcccgtcgcccccgtcgggcgtccatacgccccgcaacttcgcgtccaggtaggcggcccgctccctgcgccgtgccctctcgtcgtgggacgcctcgcactcgccgtgctccagcacgagcagcccgcgccgccgcccgacgccgtgcagccccgcgagatccgcgggccggccgaagcggtgg

SEQ ID NO: 2228 - DNA, 1738 bp, Unknown
  Kingdom: Bacteria, Phylum: Actinobacteria, Class: Actinobacteria, Order: Streptomycetales, Family: Streptomycetaceae, Genus: Streptomyces
gctcctgccccccgccgtggcggcgcgcaaggcgggccgacgcatccgcggatcgctcctgcgcaccggccagctgaaggccgtcatcgcgctgccgccgggctgcgccgcgccgcacagcgtctccctgcacctttggctgctgcgtgcgcccgtaccaggtgaggagccgcacgtgggcggccacctgctggtggccgacggcgtgtcccgctttccccgggaccagggccgcgagtgggcccccgactggacggcgatcggtgacttcgtgcgcgaggccgtcgcggggacggatccggccgaggtctctcccttcgtacgacgcgtaccggtcatcgagctcctcgacgacgaggtcgacctcactccggggcgccacatcaccccgtccccggcggacaacgcgtcccgtctggaggaatcctggcgcgagttcaagggcctggccgccggtgtgaccaggtcggcccggcggctcgcgtcgctcgaactgacctcttccgcgcaggaaacgccgacagcgaccaccgtcgccgaactggcccgggcgggcgcgctcaccctgcgcggaggccagcagccaccggaggcggcggtccgcaccgggccgccgtccgccgaggacattccgctcctgacggttcccgaccttctgtcgggcggcgagcccaggggaagcctcgcggccggcgaccccgcggtgagcgaggccgtgatcgccgaatccggggacatcgtggtggtgggggtggcgcgggcgttctccgcctgggtccacgaagggccgccgaccgccctgggaccccaactgcacgccgtacgggtgcaacccgagcagctcgacgcctggttcctcgccggttcgctgcgcgccccgggcaacgtccggcaagccggtacgcacgcgacaagttcctcccgcatcgatgtccggcggctccaggtccgccagctaccgctgcgtgaacagcggcgttacggggaggcgttccgcgagctcgccgccttcgaacagctgacgcggcgcaccgccgaactcggtgcggacctcgtccacgacctcggcgacgaactggcggccgggcggctcgcggacggggtccaaagcgcctgagaggggcgggagtcgtgcggtgaggtgaggcgcgtcacgtcgctcttccgcggtcaggcacccggcccgccctggtcgtccgcgagccgggccgagagctgggcatcgacctggcgccgcacggactcgacctgtacggcgtgctcgtgcggcaggcccgcggccgtgcgtccggcggcgtcgacagcggagacggcggtgtccagctcaccgaaggcgaggcggcattcggccagccgcagccgcaccaccgcgcgctccgcccgctcggccggactgtcgccgtgcaggagagtgccgtcgatgccctggtagagacgggctgcggagccgaagtccccggccagccggagtccgtccgctgctccccgccacacgcggcgcaccagcgggcggcgcgctccccactccccgcgcacccgctccgccaggtcacgcagacggccggccgcgtcccccggttcgccggcggcgatctccgactcggcccgtgtgcagagcagttccacggcgcgggcatccagccactcatcttcgtctgccaccggggacgtgacaggcggcgcggtgggagcgcggtgcgtgcgcggtgcccggtccgcaggccggcggagcgggcac

SEQ ID NO: 2229 - DNA, 920 bp, Unknown
  Kingdom: Bacteria, Phylum: Actinobacteria, Class: Actinobacteria, Order: Streptomycetales, Family: Streptomycetaceae, Genus: Streptomyces
gtcgtcgtctacgacggcggccagggctgggcggcggcccgtgcctggtggctgctgcgctggaccgggcatcctgacgtacgggtcctcgacggcggtctggcggcctgggagggaccgctggagaagacggtcgtagagccggacgagggtgacttcacgccgtcgcccggcgccctggaactgctcgacgccgatgccgcgggcgccctggcccgctccggagtgctgttcgacgcgcgcgcgggggagcgctaccgcggtgaggtggagcccatcgaccgggtcggcggccacatcccgggcgcggtgtccgcgccgacgaccgggaacgtgggccccgacgggcggttcctgcccgcggccgagctgcgggagcggttccgggcgctgggcgcggccgagggcacgagcgtgggcgtgtactgcggctcgggcgtctccgccgcgcacgaggtgctcgccctggccgtggcgggcattccggcggcgctgtacgtcggttcgtggtcggagtggtcctcggacccgtcccggccggtggcgacgggagccgacccgcagtaggcccgagcaggacgtacggcaggggctgtgccggcccgcgcgggccgggcgagcggaaagcaggagggccgcgccggtccgcgcggccctcttcttcctcgtacgagtccttgtacgagccccccgctactcctgcttcttgcggcgggtgccgaacacgatctcgtcccagctggggacggcggcccggcggcccggccggacgccgtccgcctcggcctggcggtcggtcgcgccgacgaggcggtcgcggtggctgccgaccgagcggggcatgaggacgtccgcgtaggcggagccggcaccggcggacgcggcgggggcgggcggttcctcgaccgccgcctcctggt

SEQ ID NO: 2230 - DNA, 623 bp, Unknown
  Kingdom: Bacteria, Phylum: Actinobacteria, Class: Actinobacteria, Order: Streptomycetales, Family: Streptomycetaceae, Genus: Streptomyces
tcacgcaggcgggaggcgtgcagggccgctcacgcaggcgggacgctggaaggcgcgctcacgcggtcgggagacgccgggggcgggctgctggtccgggcggcgcggaggcggtgtgcggggccgggtgccatggggcgggtctgttgcgggctacgtcgtgctcggccagggggcccacctcccatccggcggcgcggcaggcggcgaccaggccgggcagggcgccgagcgcggcgtgccagcagccgggggccgaggcgcggtccgtgtcgtgcaggaggaccgtgcccccgccgcgcaggtccgccgtcacgctggcgtgcacggagccgggggtggcgtccgccgtccagtcccgtccccacgccgtccacagcacgggccgcaggccgaggcgccgggcggccgtccagcggccgccggtgaggatgccgtagggagggcggtaccacaggggccggcggtcggtgaggtcccgtacgacgcggatcgtccgcgcgatctcccgcaggtcgcggcccggcgtgggcagccacgggcggctgtgggtccagccgtgcacggcgagttcgtgcccgcgcccggtgatggcgcggacgagcgcgggatggcgggcggcg

SEQ ID NO: 2231 - DNA, 1713 bp, Unknown
  Kingdom: Bacteria, Phylum: Actinobacteria, Class: Actinobacteria, Order: Streptomycetales, Family: Streptomycetaceae, Genus: Streptomyces
tggcccggtaccgggccacgggacgctcgcagggctcggtggtgctgaacttcggcggccccggcggctccggcgtgtccgaactggcgctcggcggtaagcagttcatggacctgaccaacggctacgacgtggtcagcttcgatccacggggcgtcggcaggtcctcccccgtcacctgcggcatcgacgcgggctcctccgacccgggcggcggcaccggcgccgcgcgggccgacctgggcaacgcgcaggccgcgcgcaaggcgctcgccgagtggaagaagctggcggccgagtgcaccggccacgccggtccggtcctgcgccacataggcaccgtcgacgcggcccgggacctcgacgtgatccggcaggccctgggcgacgggaaactcgactacctggggttctcctacggcacccggctcggcgcggtctacgccgccgagttcccccacaaggtggggcggatggtcctggacggcgtggacacgctgaccgagccgctgtcggagcagggcctggtcgcggcggagggccagcagacggctctcgacgacttcctcgactggtgcgtgcaggacatcgcctgtccgttcggtcaggaccggcgccaggccggcgaccaggtcgtccagctggtcaggtcgctcgacgagaacccggtgccgacgggtgtcggcggcgagctgaccggccagcagctcgtcggcgcgatcggccaggccctgtacagcaaggcgatgtggccctcgctggagcgggcgatcgcctcactgacgcaggacggcgacacccgccccgtccagtccctcgcctccggcggcatggcacctcccctccgccagggcccgcgggacccgcaggacgcgtccggcccgcgtgacccgcacggcgccgcggcaccgcacggcagcggcgggctggtgaacggcgcggacgtgccgctggacaacgcgccggccgcgatgatggcggtcaactgcgcggacgacccggaccgcccgagcgccgggcagctcaccaaggacctcggacggctcagcgccgagtacacgcaggcctcagcggtcttcggcccgtaccggctcaacgagctgctgatgtgctacggccgccccaagggcaccgactacatccgtacgaaggtccggaacgtcgacacggcgaagatgctcctcgtcggcacccgcggcgaccccgcgaccccctaccgctggaccgtggaaacggcgcagcggctgggctcgtcggccgtggtgctcgacaaccggagcgacggacacaccggctacggctcgtcctcgtgcgtgcaccgcaaggtgaacgacttcctgctgtacggctccctgcccgccgacggcagttcgtgcccggcggaccagcagcccggcacgagcgggtgaacgccgggcacgaacacagggccgaacagacgcaggggccgtgcgagcgtggtgcttgccgtgcgtcccgtacgccccccgtccccgtcccccgtacggagcaatcacgagcgtgcggcgcaaccggcccgccccctcggtggtcacactgaccggacgacccgcacgaccacgaacgccaccctgggggaaccatgcgtatccgtaccgccgtcgccctctcggccgctccggccgcagtcgccgccctgctgctctgcgcctcgcccggacaggcggcctccgcccatgccacgcccgcccc

SEQ ID NO: 2232 - DNA, 626 bp, Unknown
  Kingdom: Bacteria, Phylum: Actinobacteria, Class: Actinobacteria, Order: Streptomycetales, Family: Streptomycetaceae, Genus: Streptomyces
ccgtcccacccctcgacttcccgggagaaaccatgccgcagcagaccccgcccgcggggcgcaccctgtgccgggaggcgccgtgcgtgtgatcggcctgatgtcgggcacctcctacgacgccatcgaagccgccgccgccgacctcaccctggacggcgacacgctgctcctgcggcccctcgggcacctctcggccccctacccggcggacgtacgcgacctgatcgccgccaccctgccgcccgccgccacgacgacccaggcgatctgcgccctcgacaccggggtcggccaggccttcgccgaggccgccgggcgcgccctgcgcgagctgtgcgagggcaccgccgacctcgtggtctcgcacggccagaccatgcaccactgggtcgaggacggcaccgtccgcggcacgctccagctcggccggccggcctggatcgccgaggccaccggcctcccggtcgtctccgacctgcgcagcagggacgtggcggcgggcgggcagggggccccgctggtcggcatgaccgacaccctgctgctgcgcgccctgcccggaacacccgccgcgctgaacctgggcggcatcgccaacgtcaccgtcctcgcacccggcgccg

SEQ ID NO: 2233 - DNA, 518 bp, Unknown
  Kingdom: Bacteria, Phylum: Actinobacteria, Class: Actinobacteria, Order: Streptomycetales, Family: Streptomycetaceae, Genus: Streptomyces
gggggcggcctatggtcaccggactccccggacgcagctcctgcacggtggcggtgacggtcgcctcggtcggcccgtaggtgttgagcatgcgccgtcccggcctgctccagcgttcgaccagcgcggcgggacacgcctcgccgccgacgaagatgctgcgcaggcgtggaaggtcgcgcgggacggtcgccagcaaggtgggcacgcagtacagtgcggtcactccgtgcaggtccaggaagtcggcgagttcgtcccccagccgtccggggcccgacggaccggcgaccagtgtggcgccggccgcccaggtgggccagatctcctcgatcgagaagtcgaaggagatggtcatgccctggtacacgcggtccgaggaacgaatgccgtagaccggggagaccacgcgtacgaaattccggatgctcgaccgggcgatctcgacacccttcggctggccgctggatcccgaggtgtacatcacgtaggctgccggatccgcctcatcgcccggc

SEQ ID NO: 2234 - DNA, 879 bp, Unknown
  Kingdom: Bacteria, Phylum: Actinobacteria, Class: Actinobacteria, Order: Streptomycetales, Family: Streptomycetaceae, Genus: Streptomyces
gccacacctcacgggccgagcggatcgcgggcagggtcagggagatacgggtgggcggcggcttgggcgagccatggacgccgatgaccgtgcgctccgtctcccgcacccccggatgctccgggaacagggacgccacgtgcgtgtccgggccgacacccagcatcagcacgtcgaaggtcgggaccgtgccgtggttcgcggggccggccgcgcgggccagctcctcggcgtaggcctccgccgccgcctccacgtccgtgccgtacgggccgtttgaggcgggcatggcgtgcacccgcttgggatccagcggtacggagtccagcagggcctcgccggcctgcgtgacgttgcgctcggggtccccctccggcaggaaccgctcgtcgccccaccacaggtcgaggcggccccagtcgacggcgtcgcgggcgggcgccgcggccagcgcggccagcacgccgttgccgttgcgcccgccggtcaggaccacggacgcggagcccgtggaggcctgcgcgtccacgatcttcgtgatcagccgggccgcggcggcctgcgccatcagctccttgtcacggtggacgaccagctgcggagtgctcacttcgccgccgccttccgggtcggggacttccgggcggtcttggaggcggcgcgccccgcgggcgccttcaccgcgtcctcctcggccgtggccaccgcgaccggcgccttggcggaggcctcgggcgcggagccgttcagccgctccaccccgaagcgcagcgccgacgcgtaggtgtcgtccgggtcgagccggcgcagctcctccgcgatcagctcggccgtctcccgccgcttcagcgccaccgcacgctccggctggccctggac

SEQ ID NO: 2235 - DNA, 569 bp, Unknown
  Kingdom: Bacteria, Phylum: Actinobacteria, Class: Actinobacteria, Order: Streptomycetales, Family: Streptomycetaceae, Genus: Streptomyces
ggcgttgtcgaggagttcggcgagcgcgtgcatcacgccctcggcggcgtgccccgcgaccgcggtctcgctcgtcgcgtggacccgcacccggcggtaggcgctgatacggcccagcgcgccgcgcaggatcgactccatcgggatgggccgtgcccagcggcgccccgaacgggcgccggtgaggacggcgatcgagtcggccaggcggccggcctgcgccgtgcggtgatccaggtggagcaggtcggcgaggacctcctcgtccgagtggcgctcctccatggcccgcaggtcggcgagcatggcggtggtcagcgcctgcatgcggccggcggcgttggaggtcgcggagaccgccgcgtcccgggcccggccggcccgctccagctcaccggtgaggcgggcgttctcgtccctgagccgctccagctcacgggcgccggcgtcttcgagccgggcccgctcgtgcgcgaaggactgcgcgaactcggcgcgctgccgggccagttcgtcgacgaggtgctgccgttcccgctgcgcctcctcgaccacccggtaccgctcct

SEQ ID NO: 2236 - DNA, 634 bp, Unknown
  Kingdom: Bacteria, Phylum: Actinobacteria, Class: Actinobacteria, Order: Streptomycetales, Family: Streptomycetaceae, Genus: Streptomyces
acatcggtccgtccgtcgccgccgcccgcccggggcggcgacgggatgggcgacggctccggggcgccgactcccggtggcgtcacgaccgggccgtccaccggcgatgcctcggacaccgcacgcgacggagacagcgcggccggccacgattccgcggccgaccacgacggcgacccgggcggccagaacgaccagggcggccagggcggtcgctggggccggctgttcgccgcctgccgggacctgcgggacggcaaggtcctggacaccggccgcaagcacgtgctggacggagcggccggcggctcctcgcgggtctggacgtactgcaagggcatcctgaaggcggccgacgcccacggctcgggccaggggcgcggcaccggccagggcaggaacacggacggcgaccagaacggcaagggcggacagggagaccaggacggtaagggcggcaacgacggccgccaggggcgtggcggcgacggtgagggcgggcagggcggtgacgatgacgccggtcacgcggacagtggtccctccggcggcgcgcgcccggacagcggtcttcccgacggcggtcgtccggacgtcggtcatctgcgcatggggctcctcgcgggtctggacg

SEQ ID NO: 2237 - DNA, 587 bp, Unknown
  Kingdom: Bacteria, Phylum: Actinobacteria, Class: Actinobacteria, Order: Streptomycetales, Family: Streptomycetaceae, Genus: Streptomyces
gcggcggcgatcaccaggacgtcgcccgcgtaggcggagcagtacatccggtccaggtccttgtcggccgacctcggcagcaggaagcagcgcgcgtccttgtggcccttgaccgacgggccggcgcggaagacgccgagggcgtcggcgaactcgccctggaaccgtgcgatgtcccggaccgccgccctgttctccatgcgggtgagcacgacgctcatggtgaaggagaccttcgcgtaggggtagctgaggtcttcggtgctgaggtagctgcgcatcgccatgccggtgacgtgctgccggtcgatctcccgttccagccgttcgcggttgctgcgcggcaggtcgcccagcgactccttgcgcagcgcggtggcctgcgggccgctgaggacggcgtcggacccgtactcgtcgaggtcggggccccggccccagcccttgccgtagggcacgagcagtccggacaggccggacgccgcggccttgcgcggcttcgggcccccagggctcggcagggcccagacaggaggaccggcgtcgcggtccgcctgccggacggtcacgacggtggtcccgacggc

SEQ ID NO: 2238 - DNA, 707 bp, Unknown
  Kingdom: Bacteria, Phylum: Actinobacteria, Class: Actinobacteria, Order: Streptomycetales, Family: Streptomycetaceae, Genus: Streptomyces
  misc_feature (132)..(133): n is a, c, g, or t
tcccgggcgccggagtgctcgtgagcggtcaccccccgagtatgtcccgcccctgagcgcgcggaacacgggcccgggtccggcgccctgccgtcacagggtgcgcagcagcaccgccggttgttccacgcnngcggtgccgccgtcgcacacccggtggtcgaaggtgagcgagagctggacgacctgccggaccgccagttcgccttcgtacacccagggtttggggacgatacggccgaccccgagcatggccgcctcgggatggttgatgatcggcgtggagccgtcgacgccgaacacgccgtagttgttcaacgtgaaggtcccgcccgtgagttcccccggcgtgagggtgccggtgcgcgccgcctcggtgagccgggcgaactcggcggtcagcccctcggcgccgcgcgcgtgcgcgtcccgtacgacgggcacgacgagtccgcgttcggtctgcgccgcgaagcccaggtggacgtggtcgagccggacgatctccctggcctgtgtgtcgaccgtggagttcagctccgggtgacgggcgagcgcggcggtgcagatccgggcgaggagggcgagcagggagatcttcgggccgccggcggcgttcatcgccgcccgggcgcgcaggagttccgtcgcgtcggcgtccacccagcaggtcgcgtcggggatctcgcgacggctgcgggacagct

SEQ ID NO: 2239 - DNA, 1552 bp, Unknown
  Kingdom: Bacteria, Phylum: Actinobacteria, Class: Actinobacteria, Order: Streptomycetales, Family: Streptomycetaceae, Genus: Streptomyces
gtgccggtcggccgccggtgagccgccagccgctggtgagccgccggccgccggtgggcgtcagccccagccgcgcgcgtcctgcttgagcgccgtgtcgacggtcagcgccgtcgccaccaccaggctcagcagcggctcgggcagctggtagtggatctgcaggacgtagttgtcggccgtggtgaacatcgtcttggccagcccctcccacgtcttggtgatccgggccacctcgttgtcggcatggtcgacgatcgcgaagttccaggcgcgccagttctccgccttgatcgcgccgacctgctgcccgttcgcgttcatcgcgaagttgatcttgccgaagacgttctgctggacgatctcgccgacctcggagccgtccggacgcgacacgaccacccgcgacttgaggaacttcgcgggccgggtgagcaccagctgcggctgcccgtaaccgtcgcggatctccagccggtgcgtcatgaactggtcgatgctggagacgaaccgcacggccttgcgcagcgcgctctgcccgacctcggtgacggcgccgatctggttgccgttctggtcgaagaccttgtactcgttggtcagctcgatcagcttggccttctggttcaccacgagaaccggctcgctgaacagggtgccgccgccgacgccgctcggggcgacgccggcctgctgctgcacctgccgctgcacgcgcgcgtcgggtccggccggctggaccggcacctgcggcgccacctgctgggccgcgggggcctgctgcgcggcgggagcctgctgcgcggcgtgggtgtgctcggtccactgcgcgccgtcccagtagcgcagcgtctgcgccgccccgtgcgggtccgggtaccagcctgcaggtgtgttcgaatgcgtggtcaccggggcacactaccgcgagccggccggaaagcaatcgctctctgcgggctggtcagccggtcgcgatcgccggatcgctcacgccgggaaggccgttctcgacatgtccggcgaaccgccgcaggaaggacggatccgcctgggacgtgacggtgaggtcgtaccagcgcccactcgccgccagtacgacccgccggcgcaccgtcgcacccggccggacctggaccgtcgtgctgttcccggcgtagccgtcggccaccaccagccccaccgttcccgaccccttgttggtgaaggtcagttcgatgtcgtcgccggccggccgtgcggtgacctcgggaccggccgtcttgcccggccccttgaaggcgcgcaggaagccgttggggccgtgcacggtcaggtcgtacttgccgccggagtacaccgagttccaggtgtcggagacggtcttgccggcctcggtggtgtaggtccaggggccgtcggagcggctgtccgaggtgaccaggaaggcggccccggcctcggcgccggaggcgaaggtgagggcgtacttcccggccgccacatccgccgaaccgtccacgacgggcgcgtacttgagcgggcgggtgggccgcccgctcaagtacgcgcc

SEQ ID NO: 2240 - DNA, 637 bp, Unknown
  Kingdom: Bacteria, Phylum: Actinobacteria, Class: Actinobacteria, Order: Streptomycetales, Family: Streptomycetaceae, Genus: Streptomyces
accctgccggacggcacggtgatggacgcctacgactggagttacgaccaggagatcggcgacctggccgcgaccctgacccgggccgagtcgctcgccgacgacccggcggcccgccggcccgtgcgggcggcgagcgagtcggtgaagacctggaagtcccgccacgcgctggcccgcagggccgacgactccggggactaccggagcgcccgcgaccaggtcatcggcggcggcgcggaggctcggacgacgggcgagtgcttcgacgccgtcgacgcctccctcgcgacggcactcgcccacgagacacagcagttcgagagcgccgcgaaggacgggctggccgcgatgagctacctgccggccggctccgcggcgctcgccctcctcggcgccgccggtgccctgctgggcatcgggcgccggctgtcggagtaccggtgagagagggcgtgagcggggtggaaggaggcgtgcggatgcgagtgcggcacctgcggtccggtctgaagggctggggcggtgtcggcgcgatggcggtcgtctgcgtcctggcgctggcgttcgtcctggtgctgcccagcacccagacgcacggcggccgcaccccggtggccgccgtgcgtctgggtgc

SEQ ID NO: 2241 - DNA, 826 bp, Unknown
  Kingdom: Bacteria, Phylum: Actinobacteria, Class: Actinobacteria, Order: Streptomycetales, Family: Streptomycetaceae, Genus: Streptomyces
gcctccccctccgcccccgccaagccctcggcgaccgcgccctccaagccgccgaagctcacccccggtcccggcggactgacccccgtgttcaccaacggcccgcggaacaagggcaagacggtcgcgttcaccttcgacgccgacatgaccgccgacgagggggcgcgcgcggcgtcgggcgagcacttcgacaacccgcagctcatcgccacgctccgcgcgctcaaggtgcccgccacggtgttcatgacgggcaagtgggcgcagacgtacccggacgaggcccgctccatcggcacggacccgctgttcgaactcgccaaccactcctacagccactacgcgttcaccggtgactgctacggcctgccgaccgtctccgaggaccaggtccggtcggacgtggaacgcgcgtacacggcgttcgccaaggccggagtcccgcatccgatgccgtacctccgcttccccggcggctgctacgacacccaggtgctgcgcaccctcgcgcccctcggcgtcaccgccgtccagtgggacgtggtgagcggggacgcgttcgccaccgacgcggacgccgtggtccgccaggtcctggccggtgtgaagcccgggtcggtcgtggtcatgcactgcacgcgcagcgccgccccgacgaccgagcgcgtggtgcgcaccgtcgtaccggagctgcgcaagcagggctaccgcttcgtgaaggtgtccgacatgatcggcgccacggcgggccgctcgtgagcccgcgcacctgaaccgccgggcccccacggggccccgcaagggcgtcctacgctgggaccat

SEQ ID NO: 2242 - DNA, 1165 bp, Unknown
  Kingdom: Bacteria, Phylum: Actinobacteria, Class: Actinobacteria, Order: Streptomycetales, Family: Streptomycetaceae, Genus: Streptomyces
ctgctcgccgagtccctgtccggcgagcagcgcggtgtcctcctgcggggcgtagacgcccggaagcacaagtcgactcacgccacgcgagtaccccggtgaccggctgtcagtgctgttcaccgacgaggtcgccgctccgcgtgtcgagcgggacccgcagcgacgagcggcccgcgcgccagtcggtgagcagccggtcgccgagccggtcctccaggtggccggtcgcgtcgatgccgaaggcgacgtcggccgccagctgcggctcctcctccagcagcccggcgatcacctcgtgccgcacgacctgctcgtgcacggcgtccgcctcgacgtgctcgtcgtagaagaactcggcggccggcccggcgccggtgcggcgcatcgcttcggcaaggcgccgcgagccgggtgacgaggtgatctccacggcggcgaaatggcccaccagcgcgccgcgcagctcgcggtgcagcccgagcagggacatcaggttcacggtggccaggacctccgccggggccgcgtccagatagcggccgtacgtcgtgtccaggtcgaggtcccgcatcaggtccgcgaacagccgggcgtgcacgcgctcggcgcgtccgccgccgtactcgtcgaactccacggccgccatcgccgccttggcccggccccacaggcgcggcagcacccaggcgtgcgggtcggcctccttgaggtggtagagggagcgctgggccgcgtactcgcggatctgccacagctcgccctcgtcccgcaggtagtacgagacgccggtgccgtccaccggctcggccagcaggtccccgagcgcgtcgtcgagaccggcgtggaccgtggcgtcggcgcgcagcgcggtgaggaaacggtgctcgagggcggcgcggacgccgaggagagcggggtcccactcgagcccggcggcgacgccggcgaagcctcggtagtgcagctcgtagcagaggtacagcgcgagctgcaggtcgtcgctgtacgccgccgcgccgcccgtgacctcggcgcgggggagcgggccggtgccgcgcaggtactcccgcacggccgcgctgaccggtccgcgggcgctcggcagcccgggttcccgacaaaggtgatccatggcccgcgggtacccggcacacccccggcc

SEQ ID NO: 2243 - DNA, 817 bp, Unknown
  Kingdom: Bacteria, Phylum: Actinobacteria, Class: Actinobacteria, Order: Streptomycetales, Family: Streptomycetaceae, Genus: Streptomyces
tcgatgcggctgcgccacgcggggtcgctggcagcggccatcgccgccgatctcggcctgccgcgccccacaacggcgtgtcggacgatcgcgaggttcgtggtcgacgccttctcgctggcgcgcgaggacgccttttcaccgacccgcgaggacgccgtctcgccggcccgggagacggccgatccgcacgccacggtggacgaggtgttccagatgatcgaggcggcctgggaggcgaccggccctgctccgggcacggccgcccgccggtagggccgcggcggagccccccccccgctccccggcgcctcgccgcgccgtcccacggtgccggcaaggcccgtaacggctcatgctgaggggagtcggcaaccccacccgtgatttcgtctgccgtgcgaagtggtcgtggtcggcatgcccggggtaccggcgggagaacgtggagccgcggcggacgaggcggcggcctggtgggggctgctgccggtcgcgctgaccgtcaccgacggcgccggacgcaccgtccagtgggcgatggccgcccccgagctgctcggctgcagcgccgatgacgtcctgggccgggacgtgatggacctggtggtcccgcagagccggcctgcggcccgcctgctgcgcagggcgctcacggaaggccgaagcgcgaccgggtcgttcccttttctgcacaagaacggctccgcggtggagttggaggtgtgggcgtgcccggtggccggccgggtgggcgacggctgggggatgctggggccggccgccggcgcccgtgccgcgcggcgggccccagcat

SEQ ID NO: 2244 - DNA, 863 bp, Unknown
  Kingdom: Bacteria, Phylum: Actinobacteria, Class: Actinobacteria, Order: Streptomycetales, Family: Streptomycetaceae, Genus: Streptomyces
cccctggaccgcggtgccgactgcgtcggcggcctggccgagcgccagggcggcgatccgccggttgaggtcctcctggccgccgacgtgtttgtacagggagggggtgcgcacgcccagccgttcggccagcaggcccatggtcaggcgggcgaggccgacctcgtcggcgagggcggcgccggcctcgaccacggcggccgggtccagtccggccctaggcacgggcggcctcgctgccgaggaaggcgagcacgagcgcgaccacctggtcggggaactggtcgtgcgggtagtgcccggcgccttcgatcatctccaggcggccgaggccgacgggcagggcgtcgacgacggccgtgccctcggcgtgcgggtcggcccagtcggggtcgagcgtgcccatgacgaccaggaccgggctgcggacctcggcgaggtgcgccccggcgtcggccggggtggtgcggcccatggcctgcagggccttcatgcggcccggctcgcgcagcagggagtcgatgcggccgagccgctcggcccagtcggccggtctgacgccggggtaggcgatgtcgaggtaggagcgccacagcggcacgctgccgagcacgcccgcgccgagcagccgcagcatgccctggcggaagcgcttcacccgcaggtcgccgaggcgcagggactgcttgcgggtgaacggtgccagttcgacgaccgcggtgatcagcgcgggttcgcgggcggcggcgatggtggcggcgccgccggagatcgagtggccgacgagcacggccgggccgcccaggtgccggatcacggcgagcaggtcgcccgcgatcgcggtgcggctgaagtccgggaag

SEQ ID NO: 2245 - DNA, 972 bp, Unknown
  Kingdom: Bacteria, Phylum: Actinobacteria, Class: Actinobacteria, Order: Streptomycetales, Family: Streptomycetaceae, Genus: Streptomyces
cgccgctcggtccggcggcgatctcctcctcgaaggtcgccgccggaccgagcggcggcggccccaggaagtccgggctgtgcccgcgccgcggcatgagcagccacagcggcgccagatccagcccgcgagcggcctcccggatgcgccgcagccactgcgggtggtacccgtgccggtccggccgccccagcgtccgcaccgcctcctgcgcctcccacaacggcgacagggcgaaccggcaccgcagcaggtcgtcgtcgccgaaacgcagacggaacggcatgcgcacccccgaggacggtccggtggccgaggaagattcggctgtcgccgaaacactaggacccgcgccggaccgcccgcacgctgccctccatgcaccagcgctacgcccgggtcttcgccgtccccgagttccgggcggtcgtcgccgcccacgccctctccctgctcggcgtgatcgtcagcgagatcgccctgtccgtcctcgtctacgacctcacccgctccgccctgctcagcgccctcaccttcgcgctcggcttcctgccctacgtcgtcggcggcacgctcctggccggactcgccgaccgcttcccggcgcgcagggtcctggtgacgtgcgacctggtgtgcgcggcctgcgtggcgcccatggtcgcgccgggggcgcacatcggcgtcctgctcgcactgcgatgcgccctcgccgtcgtctcgccggtgttccagggcacgcgcatggcgaccctcgccgacatcctcggcgacggggacctcttcgtcctcggccgttccctgctgcggatcgtctcgcagagcgcgctgctcgtcggctacggcctcggcggcctgctgctgaccgtggtgagcccccggcacgccctgctgatcaccgcggccaccttcctcgcctcggccgccctgctgcgcctcggcacccggcaccgcccggcgcgcgcccagaag

SEQ ID NO: 2246 - DNA, 643 bp, Unknown
  Kingdom: Bacteria, Phylum: Actinobacteria, Class: Actinobacteria, Order: Streptomycetales, Family: Streptomycetaceae, Genus: Streptomyces
gccctgtgggacgtgacgagcctgcgcaccggcccgcagcgcctcttccgcccccgcaccctcctcgacgtggcctgcggccccctgctgcccccgctgtccggccccccgctgacggcgtccgagcgcaagatcctggagggactggaacggacgggggcgcggtccggggcagtgcggtaaggccggtgacaccggtgaggccaatggcacgggggtgaggcccccgctcctcagcccgcgaacgccggctgcgccaggccggtgcccgcgtccggtaccaccaggagggcgcccgcgagcgggtgcggcgcgctcaggccggtgcgggccgtggtgacgtacaggtcgcccatcccggtgccgccgaacgcacaggccgtgggacgcgggacgggaagggcgacgacgcggtccagcgtgccatcgggggtgtagcgccgtaccgcgccaccgtcccacagggccacccacacgcacccgtccgcgtcgacggtcagcccgtccggatagccggcgccctcctcgacctgcgccaacggccgcctgttcacagcctgccggccgccgtccgggacatcggcgacgtcgaagacgtcgatgcggcgggtcggcgtgtccacgtagtacatccggcggccgt

SEQ ID NO: 2247 - DNA, 784 bp, Unknown
  Kingdom: Bacteria, Phylum: Actinobacteria, Class: Actinobacteria, Order: Streptomycetales, Family: Streptomycetaceae, Genus: Streptomyces
gaggccgtcctcatggtcgtggacgaacccgccacggaggaactgctggccaagacgctccagcggccccggcgccaggtcgcggacgcgctgcgcgaactggccgacgagtacaccgtgcagcagcgcggcttcgaactgcggcgggtcgccggaggctggcgcttctacacccgtcccgagtacgccgccgccgtcgagggcttcgtcctggacgggcagcaggcccggctcacccaggccgccctggagaccctggccgtggtcgcctaccgccagccggtcagccgcagccgcgtctccgccgtccgcggagtcaactgcgacggcgtgatgcgcaccctgctccagcgcggactggtcgaggaggcgggcacggaacccgaaacaggtgcgatcctgtacacgacgacgaactacttcctggagcggatgggcctgcgcggcctggacgagctcccggagctggcgcccttcctcccggaggcggaggcgatcgaggccgagacccaggaagccgtaccgtcgttcgacccggacgccccggacccggacgagggtcacgggacgcacatgactgacacgacgacgacggaactttgatgcgaagcagcggcagcggcaagaacggcgggcgcggtaaccaccgcggtgccggcaacgacagggaccagaagcaggggcagggccgccccagcaagccccgccccgaggagcgccgctacgacgtgggccccggcgccaccaaggacggtccgaaggccgggcgcggcggggcccacgt

SEQ ID NO: 2248 - DNA, 519 bp, Unknown
  Kingdom: Bacteria, Phylum: Actinobacteria, Class: Actinobacteria, Order: Streptomycetales, Family: Streptomycetaceae, Genus: Streptomyces
  misc_feature (140)..(141): n is a, c, g, or t
gctcggtgtccatcaggcggcggacctcggtctcgtccgagtggtcggacaggaacttgcgcaccgttgtgcgcagttcgtcctgctcctcggtgaactccctgatcatcgtgtgtctctctcgttctcggactgtcgtnncggaaggggacgcccttgtcgggctcgtagcccttcgggaggcccaggacgcgctcgctgatgatgttgcgctggatctggtcggagccgccgccgatggagttgatgaaggcgaacatcagatcgcggtcgaccgggcaggacagcggcttgtcgtagtcgtagacgagggactcctcgccctgcatccggtaggtgaagtcggcgccggcgtgcaggatccgggacatcgccagcttgccgagcgaggccagggacgaggggccgcgcctgatctcggccatcgcgcgctgtccggtccagcggttggtgaggcgccacgacatgatcttcacgatctcctggcgggtctgcgggtcgtcgagccggccggcctgc

SEQ ID NO: 2249 - DNA, 918 bp, Unknown
  Kingdom: Bacteria, Phylum: Actinobacteria, Class: Actinobacteria, Order: Streptomycetales, Family: Streptomycetaceae, Genus: Streptomyces
gtccacgggacggtgtatccggtgcagcccgtgaccccgcccagcgtcgaggggctcggcgtcgtcgtgcaccgcacccaggtgccggtgtggatgccctcgggacccagcccgctcggcggcatgggcgagctgatcctggtcgccgaggaactcggcgtcggactcggcgcccgctacgccggcatcgagggccccgaccccggaccctgcctgaacgtcgagaagccgccggacgccaaggtcctggccggcggccggcccaccccgctgtggcacgtctccggcgccccggtcgaccgtgccgtcttcgcgggcgaggcccgcgggctgtggctgtgggcggtcgtctggcccgagcagtcgggcctgctcatgtacgacgaactggtcctggccgacctgcgggacgcgggcgccgagatcgacctggtgccgtccggggcgctgtcaccgcggttgctgcagccgtaggggctcttctggtcgcaggacctctcgtgcagggcctggggcggctctgcgggggccggacagggcggctcgtgtaggggccggaagaggccagcgggtgtgacaaggcatcccttgtctcccgttatccttgagtgtccccttccgtcccgtcgcgcctggagtccgtgtcgtgcgtatcgacctgcacacccactccaccgcctccgacggcacggacaccccggccgaactggtgcgcaatgccgccgcggccggactggacgtcgtcgcgctgaccgaccacgacaccacgcgcgggcacgcggaggccgtcgcggcgctgcccgaggggctcaccctcgtcaccggcgccgaactgtcctgccgcctcgacggcgtcagcatgcacctgctggcgtacctcttcgacccggaggagccggccctgctcgccgagcggga

SEQ ID NO: 2250 - DNA, 1293 bp, Unknown
  Kingdom: Bacteria, Phylum: Actinobacteria, Class: Actinobacteria, Order: Streptomycetales, Family: Streptomycetaceae, Genus: Streptomyces
ccgaccgcgcccggctgctgcgccgcttcgccgacgaagtcgacggccacatcgaggaactggcccagctggaggtccgcgaggccggccacctcctcggcgacgcacgctgggaggcaggcaacgcccgcgacctgctgctgtacgcggccggcggcgtcgaacggctgctcggccggcagatcccggcccccggcggctgggacgtcaccttcctcgaacccctcggcgtcgtcggcgtcatcgccccgtggaacttcccgatgccgatcgcctcctggggttccttcccggccctcgccgccggcaacgccgtcctcctcaagcccgccgagaccaccccgctcaccgcactccgcctggcggaactcgccctccaggcaggcctgcccgagcacctcttccaggtcctgcccggccacggccgcaccacgggccgcgccctgaccgaccaccccggcgtcgccaagatcgtcttcaccggctccacccgcaccggccgcgagatcatggaacgctgcgcccggcacctcaagcccgtcaccctcgaactcggcggcaagagcccgaacatcgtcttcgcggacgccgacctcagggccgccgccgacccgtcctccttcctggacaacgccggccaggactgctgcgcccgcacccgcgtcctcgtccaggaatccgtgtacgacgaggtacgcgaactgctcgccgaggcgctcgccgccgtcgtggtcggcgacccggccgacgagaagacccgcatgggcccgctgatctcccaccggcaacgcgagcgcgtacggtcctacgtccgcccggacgcaccggccctgcgcggcaccgcgcccgacgggcccggcttctggttcccgccgaccgtgctcaccggggagcgtccggactccgccgccgcccgcgaggagatcttcggacccgtggccgtcctgctgcccttcaccgacgaacaggacgcggtccgcctcgccaacgacaccccgtacggtctgtccggctccgtctggacccgcgacgtgggccgcgccctgcgcgtctcccaggcggtccgggccgggaacctgtccgtcaactcccatgccagcgtccgctactggaccccgttcggcggcgccaagcagtccggcgtcggccgcgaactcggacccgacgccctgaccgccttcaccgagaccaagaacgtcttcatcagcacggaggggcccgcacagtgaccgcatccaccgaagagaccgtctgccgccggctgaccggccgtaccgccgtcgtcaccggcgc

SEQ ID NO: 2251 - DNA, 1949 bp, Unknown
  Kingdom: Bacteria, Phylum: Actinobacteria, Class: Actinobacteria, Order: Streptomycetales, Family: Streptomycetaceae, Genus: Streptomyces
ttccagcccgcctccgcgcccgcgctcctcgtcgacagccgcgaggcccggcacgagcgcacccgctcccggctcgcccgcgagcaggagggcggtctgtggggcgacatcctcggccacctcagccggcaggagccacgcgcccagctgatcctcaaccagctcaacccgctggtccgcgccgccgtcgccatcgacgagcccgaactcgcccgcaccagcgcggaagccctctacggacaggccgcgatgctgtcccggcgcccgctcaggcccgccgagtcgagcctcatcaaccgctccttcctcgacctcctcgcccacgccctccgcaaggacagctgacgatgccgaccgcaccccagaccaccgacgagctgtaccaggcgctccaggacaacgaccgccgcccctacggtcgcacccgcaccgtcaccgccgaggaactggccgaggccgccgaacagttcgcgcagcccgagccgctcatcgacgcgctcctcgaactccaggaggcgtacacctacggctccgaaccgcggaagtcgcccgtcgtcttcgcccgcctgctcaccctgttcgacgaacagcccgacgtcttcgacgaacggcagcgcaaccagctcctctggcggttcaagtgggtggcgaacgccttgcgcgcactgcccgaggtcccgctgtccggcctgcgccagtggctgacggagatgcgcgaccggtacgagaaggccggtctcggcctccagccctactacgggcaggcctaccagctggccgaccatctggggcaggacaccaccgccgcctacgaactgtgggcggcccgcgcccgcaccccgttcagcgactgcgaggcctgcgagatctgcgagcgggcccgccaccacctcacggccggcgacgacgagcgggcgctgcggacctgggaacccgtcctcgccgggaagcagtcctgccaggaggagccggcccgctccgcctcgtacgcgctgctgcctctgctgcgcaccggccgcgccgacgaggcccgcgaagtgcatctcgccgggtaccgcgcctgccgtcgcaaccccgccatgtcagcggaggtcggccggcacctggagttctgcgcactgaccggcaacgaggcgcgcgggctggaactgctcgcggagaaccggaacctgttcgacgaggtcgactcgccgctcgacctgctcagcttcctcaccggcgtcgaggtcctcctccagcgtgtcgagttcctgggccgcggcgaactgcccgccgccggctacgcgggccgcacctggacggtgaccgccctgtgcgccgaggtctgcggccgcgccgacgacctcgccgcccgcttcgacagccgtaacggaaccacggcccacgccgaccgccgccgggcccgcctggagcgcgccccgctcctgagggcgctcgaactgaccctgcgcgtccgcaccctcgacgacgtgacgccggtccccgccgcacccgcgtccaccgcgtccgcgtccaccgcccgcacggccgccgcacttcccgattcgctcaccgaactcatcgtccaggcaagggcgttggaagagcagggacacccggacgccacggcccgctggacccggctgcgcaccctgctcgacgcccccgactacagccatcccgacgacccggccgtgggcccgctcgcgcagctgcgcgccgacctgctggccgacgaggcaggcacagcgggggagcgggacgacttcgccaggtccacggccctgtacgagcaggccgccgccctctacgcggaagcgggcctgccgggcgacgccgcgctcgcccgcgccggggcgctgctcgccaccgccgagaaccccggcaaggacgccgacccggccgagagccccggcgaggacgccgacccggccgagagccccggcgagggcgccgacacggccgagaac

SEQ ID NO: 2252 - DNA, 837 bp, Unknown
  Kingdom: Bacteria, Phylum: Actinobacteria, Class: Actinobacteria, Order: Streptomycetales, Family: Streptomycetaceae, Genus: Streptomyces
gtcgctgggcggcgcggtggggctgcagctggccgtggaccatcccgagcggctgacgtccctggcggtgatctgctcctcggcccacttcggcggccagcaggcgtggcgggagcgggccgagcgggtgcgccgcgagggactccagtggctggtggagagcgcgaactcccgctggttcgccggggacttcaccgtgccggggctggtccgcgaccaccgggaggccgacccggaggcgtacgcggcctgctgtgacgcgctggccgccttcgacctgaccgaccggctccgcgagatcgaggcgcccacgctgctgatcgcgggccgccaggacctggcgacgccgcccgcgcacctgagggagatcgcggacgcggtgcccggggcggccctggtggagatcccgggcgcctcgcacctggcgcccgcgcagtgccccgaggccgtcctgaccgcgctgcgcacccagctggacggtccggcccgccggggcatgaaggtgcggcgcgaggtgctgggcgacgcccacgtggaccgggcgcaggcccggcagacgccgttcaccgcacggttccaggacttcatctcccgctacgcctggggcgggatctggacggacccgacgctgacccggcgcgagcgcagcatgatcaccatgacggcgctggtggcgcacggccactacgacgagctggcgatgcacgtacgggcggcgcggcgcaacgggctgacaccggacgagatcggcgcggtgctgctgcagagcgccgtgtactgcggggtgccggcggcgaactcggcgttcgcggtggcgcagcgggtgctggcggagga

SEQ ID NO: 2253 - DNA, 694 bp, Unknown
  Kingdom: Bacteria, Phylum: Actinobacteria, Class: Actinobacteria, Order: Streptomycetales, Family: Streptomycetaceae, Genus: Streptomyces
ggcgtggcggtggccgcggcgggcgtggtcctggtgggcgggctcggcgtgggcacggcgctgctggagcagcggttcgacagcatcacgcaggtcgcgggcgcgcccgaccagtcggtccgcgaccgctacgcgctgtggacggccgccctcggcatctggcgtgaacatccgctgacgggagtgggtttgaagaacttcccggagtaccgcgacgggcacgccccgatggcgctgtccgcggcgagcgacaccgagggcgcgggcgccgcgttccgcaggcagccgctgctgtcgccgcacgacatgtatctgctggtactgagcgagcaggggctgtgcggtctggtggccgtcgccgggagctggctggcgctgctggtgtgcggactgcggaggctgctgcgcgagcggcgcaggccggcgtccgcggcgggcggcctcggcggtgcgctggtcaccccccggccgcagtccgtcgctggcgggctcgactgcgcgctggtcgcgtgcgggctgctgctctggcagctcaccgacttcgtctacggcgacatcggcggcccctcgaccgtgctgaccgcggtctccttcgggctggtggcctggtgggccctggcccggcacaccggtcccggcgcggccgcgtacccctcggccggcccgtccgcgaccgccacgcactcctcggccc

SEQ ID NO: 2254 - DNA, 805 bp, Unknown
  Kingdom: Bacteria, Phylum: Actinobacteria, Class: Actinobacteria, Order: Streptomycetales, Family: Streptomycetaceae, Genus: Streptomyces
atgcggaccgcggcccgcatcgccgccctgcgcgccgccgacagcccaccggacctgcccgcccagcgacccgaactggccggcctcaccgaacacccgcgccccgtcagcgagttcctcgccgacagactgcccgccgaacacccgcagccaccgccccgccaccccaccggatgggcgcccgcccgcgacaccaccagcgcctacgcccgcctcctgcaccacctggacaccgccgcccggaccggcgccgcacacatcgacgtcgacgacgacctcctggacgacctgggcgcaccaccgcccgaagccgccctgccctgctggccggtcgactgcctgctgcgccccctcggcccgcccgacgggcgaggcccggtcgccgtcctggagacggcctcggccgcgggcgtgctggacgcccggttcgccgacggcctgcgcacgctgtacggcacctacggcaacaccgacgcctaccgcgacttcctcaccgccgtcgaacgccgtaccggagtcagattcgtcgacctgctcgtaccaccgctgaacgagcggtccgcgaacgccgtacgccggcccgtcaccacccgctggtggaccggcgaccccgaccccacgccgtactacggaccggccacccggcacgcccgctacctcccgctggaccgcatcagcctgcgtcgcgccggcgggcggatcatcgccgaggccgacggccgccgcatcgtccccgtctaccacgccacccggtcaccggccccgccctacgacacgctcgtccgcctgctgctcgccgcgagcc

SEQ ID NO: 2255 - DNA, 742 bp, Unknown
  Kingdom: Bacteria, Phylum: Actinobacteria, Class: Actinobacteria, Order: Streptomycetales, Family: Streptomycetaceae, Genus: Streptomyces
tggctggacggcctcgtcgcgctgcccctgctgtgcctggtcggcgaatgggcgctcagcgggcggcgcaggctgctgggcgtggtgatcgtggcgctcgcctggatcgccaacttctacaccgcctacatggccgcagcgggccgggccgcggtcaccgtcgtcctcggcgtggggctggccgcgccgctggtgacggtgatctacctcggcaccaagcacgcctacccgggccgggtcacccacttcacgccggtgcccaccgaggacgtcctggcccgcctgctgcccaccacgtacggcttcggcagccccgccctcttcgtgggcaccacggccctgctgctcgcgctcgccctgcccttccaccgggcggccccgaagcgggtgcgcgccggctggcccctgctggtggccgccgtgacgctgtccctgcagtggacgccgacccacctggcctggcacgccttcgccacgccgaacggcagcccgtaccgccaggccttcgtcctgtgcgcgctgctcgtgatcgccgcctggcacaccctctcctacggcgcgccgagcccgcgcgcgctgggcgcggcggccacgctgctcgccctgatcgccgccgccgcgagcggcagcggcctggtgcgctccttcgcctggcccgtactgctcctggccgcggtggccgccgccggcggcctgctcctcctcggccacgcggagcgcggggagcgcggggcacgcgggg

SEQ ID NO: 2256 - DNA, 1571 bp, Unknown
  Kingdom: Bacteria, Phylum: Actinobacteria, Class: Actinobacteria, Order: Streptomycetales, Family: Streptomycetaceae, Genus: Streptomyces
tcgccggccgccgaaggcaccgcgagccccgccggcgatgccggggacgatcgggcccgcgacgccgcaggcggtgcgctgctgcgccgcagcctcaagctgcgccacatcgtcttcctcggcctcgccttcatggcaccgctggcggtgttcgacaccttcggcctggtctccgaggcgaccgacggccatgtgccgctcgcctacctggccgtcctcgtcgcggtcggactcaccgcgctcagctacgcccgcatggcgcgccgcatcacctccgccggatccgtgtacacctacgccggcaaggcgctcggggcgcccgtgggcttcctggtgggctggtccgccaccctggactacgtcctgctgcccatgctcaacgccctgctcgccgcgatctacatgggcgccgtgctccccggtgtcccggcgtgggtgtgggtgctgtccaccgtcgtggtctgcaccgcgctgaacctggtgggcgtgaaactggccgccaaggtgaacgtggcgctcgtcgtcatccaggccggcgtggccatcgcgttcctcgtgttcgccgtacgtgccatcgccacccacggcgagtccttcgggaccaccgggttcggcgtgaccacggtgtcgctgcccgacctgctgagcggggcgtcgctgctggccctgtccttcctggggttcgacgccgtctccacgctctccgaggaggccgagcggccacgccgggacatcccgcgggccatcctgatcatcgtggccgccgccggggtgttcttcctggccatcacgtacgccatgcagacgctcttcccggacgtgtccgccgtgggcgacatcgtgggcgcctcaccgcagatcgccaagtacatcggcggtgccgcgttccaggccgtcttcgtgggcggctacctcaccgcggtgctcggctgcggtctgacccagcagatgagcgcggcacggctgctgttcgccatgggccgcgacggcatgctgccgcgcgcggtcttcggacgcgtcgatccgcgcaccggcgtccccgccgtgaacgtcctcatcgtgggcctcgtcgccgcctccgccgtcttcctcgacctcggcagcgccgcctcgctgatcaacttcggcgcctacgtcgccttcgccgcggtcaacgtggcggtgatcgggttctgggtgcgcgaccggcgcgcggggcgggcggacgcccggggagccgtcgccgccgtgctgcaagtgctgctgccggccctcgggttcgtcgtgaacgtggccctgtggatcagcctggacaccccggccaagatcgtgggcatcgtctgggcggtgctgggcgtggggatcctcgccctgcgcacgggcggattccgccgcccggtgcggacggtcaacctggaggaatgatccgtgcgggccggcggccgggggcgacagaccggtggccggccgggggcggcgagggaccggtggccggccgggggacgacggccgccggggaaggggacggacgtgaggtggcggtcttgcgccggccgatccgcctgtagtgggctgtcgcccatgacaaggag

SEQ ID NO: 2257 - DNA, 957 bp, Unknown
  Kingdom: Bacteria, Phylum: Actinobacteria, Class: Actinobacteria, Order: Streptomycetales, Family: Streptomycetaceae, Genus: Streptomyces
gcagacctcgcaggtcacgcctcgccgagcggggcgtgacctgcgaggtctgcccggcctccaacgtggccctcggtgtctacgagaagcccgcggacgtcccgctgcggaccctgtacgacgccggtgtcccgatggcactgggcgccgacgacccgctgctcttcggctcccgcctggcggcccagtacgacatcgcccgccgccaccacgccttcacggacgccgaactggccgagctggcccgccagtcgatccgcggctcggccgcgccggagggcgtacgggccaagctgctgtcgggcgtggacgactggctggccgcctgagaggggcggggcggcgccgaagaggcgccggggcgggctcggagcgggtcaggactgggacagcgccgcgatgaccatgggcagggccgtcttgtcgtagagggcgtcgctcatcgactgcgggaccgtcttgccgttgaccttcacggtgggcgtgccggtcgcccccgaggtgtcgaaggcgcgctcggaggcggccacgaagccgcggtacttcatgcccttgaccgccgcgtcgaactcctggccgcgcaggcccttcacgcgggaggccatgtccagcaggaacgcgtcggtgtagccgtcgacgctctcctcgggctggtgggcgaagaggacctggtggaactcggcgaacttgccctcgttcagcgcggcccgcagggcgttcgccgccttcttggagccctgaccgccgcggccgtcgaggaaggacgccagggtgtactccacccggacctcgcccgcgccgaccaggtcacgcagcgcctccccgccgccctgcgtctcgaacctcttgcagatcgggcagcgcatgtcctcgtagacgtggacgacggtcttcgcctgcggggagccgacgcggacggtggtgccgtcgggcgcgagcgactcggtggccgccgcc

SEQ ID NO: 2258 - DNA, 699 bp, Unknown
  Kingdom: Bacteria, Phylum: Actinobacteria, Class: Actinobacteria, Order: Streptomycetales, Family: Streptomycetaceae, Genus: Streptomyces
gggcgaccacggcgccgacgggcagggccgcgccgacgttgcgggcggcgtcggtgacgatgcccatgtccttgtggtgcaggtcgatgcggaagcccggcttgaagtcccggttcaggaagttgtccttcttgcgggtcagcacggtggagccggccagcccgccgttgaggacgtccagggcggcctgcaggttcacgccggacttctcaaggaaaaccacggcctcggcgcacgcctggatgttcacggcgacgatgagctggttggcggccttcacggtctggcccgagccgtgcggaccgcacagcacgatggtcttgccgagcgcgtcgaagatcggcttggcctcgtcgaagtcggcctgctcgccgccgaccatgatcgacagtacggcctcgatggcgccggcctcgccgccggagaccggggcgtccaggacgcggatgcccttgtccttggcggccttggccaggtcgaccgaggtctgcggggtgatcgaggacatgtcgatcagcagcgcgccggacttcgcgttctccaggatgccgtccgggccgtaggcgatggcctcgacctgcggggaggcgggcaccatcgtgatgacgacgtcggcgtccttgacggcctcggcgatcgagccggccgcggtgccgccggccgcggcgaggcgctccagcttctcctgctccagggtga

SEQ ID NO: 2259 - DNA, 573 bp, Unknown
  Kingdom: Bacteria, Phylum: Actinobacteria, Class: Actinobacteria, Order: Streptomycetales, Family: Streptomycetaceae, Genus: Streptomyces
cgcggagacggcgcagcgggcggcgcgcaccggccggtcgctggcgatccgcagaccgtccgacgtgctcgcgctgatctcgcagtcggtgagctgggcggccgagcctggcccgacgagcacgccgtgaccccggctgcccgtgatccggccgcgcaccgcggtgaactcggcgccctccagcacgctcacgccgtcggcgcccgcgtccgccacgctcacgtcgaccacctcgagcgtgctctcaccgcgaacggcgatcccggtggaccggctggcacgcaccaccgtgccctgcagcgcgggccgggcgccctcgacctggacaccgcactgccccgcctccaccaccttgccgtcctcgacccggccgcgcgcgccctcccggaagacgagcccgtgcccgccgcacccgctcacctcgggctcccgcagcgtcggatcgccctcgccggccaccaccacgccgtgcccggcggggccgtccaccgtgagccggtcgaagcggggcgcggccgcgtcattgaggacgacgccctccgcgcggcccccggtcacccggcagcccagcac

SEQ ID NO: 2260 - DNA, 553 bp, Unknown
  Kingdom: Bacteria, Phylum: Actinobacteria, Class: Actinobacteria, Order: Streptomycetales, Family: Streptomycetaceae, Genus: Streptomyces
tgccgcccgacccgccggagcggttcgggcaggcgcagggggccgtggccgggcgtgatgctgcccagcagcgtggcccggcgggcgccggtgcccgaagggaacgtgccgggcaggccgttgacggtgaggtagccgaggacggcgaaggcgagggcctccttggcgtcggagggcaggcccaggtcgtcgctggggcgcagccgcacgccgggcagttcctcggcgatcatgcgcatcagcaccgggttgcggacgccgccgccggagacgacgagttcggtgaccccgtgggcgcggcaggcgtcggcgaccgtgacggcggtcagccgggtcagggtggccaggacgtcgtcggtgccgggcgtgggcgccgccgccagtgcgcgctggaggtagggcaggtgaaagtgttccttgccggtggtcttcggggcgggcctgcggtagtaggggtcgtcgaggaggacgcggagcagttcggggctggtgcggccggcggcggcccggcgtccgtcctcgtcgtaggcggcggcgccgtcggtgacgtggc

SEQ ID NO: 2261 - DNA, 521 bp, Unknown
  Kingdom: Bacteria, Phylum: Actinobacteria, Class: Actinobacteria, Order: Streptomycetales, Family: Streptomycetaceae, Genus: Streptomyces
ggcggtcgcggccggggcgccctgccagcgcagccggtggcggccggtgttgatgtgccagacgccgtcgtcgtcgcggtgcggggtggcggcgggggcgcggccgtagtcggcgtgcgcgtcgaggacgacacggacgtgcgcggcgttgtcgacggccatcagccggcgcagcaggacgaggcggttggcctcgccggggaaggcgagggcctctcggcactcgatgacgccgtcggtggtgatccagcggctgcgccggatcagggtgccctcctcgtagtagccgccggggacgtagcggccgcgcggggtgacggcgtagacgccccggccgccgatgagggaggcgaagacggcgtcgtcgtgccaggcgggcgcgcacagccagttgatcgcgccgtcctgcccgatgagggcaccgcgctcgccgtcggccagcagcgcgtagtcgtgcagcgcgtgcggggggaagggtgtgacgctcatgtccggggggcctcaccgtgtgtctcctgggt

SEQ ID NO: 2262 - DNA, 915 bp, Unknown
  Kingdom: Bacteria, Phylum: Actinobacteria, Class: Actinobacteria, Order: Streptomycetales, Family: Streptomycetaceae, Genus: Streptomyces
gggcggcgaagtcgacgaagccggtggcctccagggccttgatgtggtcgaggaccgtcgtgttcgcgtcgtcggcgaggtcgcgcaccagcgcgttctgtgtgctcgcccgcacctcggcggccagcgcgaacacccggccctgcgccgaccgcgccaggtcggcgaacctgcggtcgtagtcctcgccgcgcgccgcgtccagggcggtgagccactgcttctgctgggtggtcggcgcgttggacagcgacaggccgagcctggccgccacgtcgcgcacgcgccggtcgaggaaggtgtgcccctgcaccaggtgccgcccggccgtccgcacggcgccggtggtgcccttctcctccgcctgctgtcccgcgggcagctcccacagtcccgccagccggagctgggtgacgaagtcatggtcgagtgcggacagcggcccgtactgcgtcgccgtggtcccggcgctgagcagatccgtgggcggggcgggccggtgggcgtacgaccagagcgggacgagcagggccaccacggttccggccagcaccgagatgatgatgccggtcccgctgaggatgcctcggctctggacggggcgtcgcggtcgcatgggtgcctcctgtcacggcaccgcacgtcagtgcgcttcggggtgagtgggtgagtggggggagtgggagtgcgtgagcctgaaggcttggcatgctactggagccgacatggcggtgcggagggcagtgcgtaccgcacgaaaaggcgcatatgaccctcgaaggcgtcgcgccgcagaggcccgtatgcctgcaaaacggctgataaaggcagcgcgcggaggccttgtcggcaggcggtgttaaaccgggcacaccggcacgcgcgtacgggcgggtacgcgcgtgccggtgtgcc

SEQ ID NO: 2263 - DNA, 1790 bp, Unknown
  Kingdom: Bacteria, Phylum: Actinobacteria, Class: Actinobacteria, Order: Streptomycetales, Family: Streptomycetaceae, Genus: Streptomyces
gtccaggggtacgccggccgcgacgccctggccgccgcggcgcgcgccttccgcgccttcgtcctggagcaccccggccggtacgccgcgacgatcggcatggaaccgtccggcgccgacgacccgctggccaccgccggagcgcgactgctcgacgccttcacggcggtcctgcgcggctacgacatcgccgggcccgacgtggaccacgcgctgcgcatgctccgcagcctctgccacggcttcgccaccctgcagtcggcgggcggcttccagtggagcgccgacatcgacgagagcttcgagtggctgatcgcattcgccgaccggggcctgcgcacgctctgagcggtgcgcacggcaccgggcccggcgcctcccggcgcgcgcccccgcgcacgggtggctagcgtgagcatgcggacatgccaccgaccggaagagggccgcaaccatggcggtacgacctgagggaacaccctgctgggccgacgcgatgttcaccgacgtcgagcaggcgaagaccttctacggcgaggtcctcggctggaccttcggcgagtcgtcctcggagtacggcaactacaccgaggcccaggtgaacggcaaggcggtcgccgccgtcgtaccgccgatgcccgggcaggagggacagtcccagtggtgcctgtacttcgcctcgcccgacgcggcggccaccgcgcgccggatccgcgaccacggcggcgaggtgctcatggagccgatgcgggtcggcgacttcggcaccatgtgcctggcccgcgaacccagcggcgccgtgttcggcgtgtggcagggcggcacccacgagggtttcgaggtcaccggccgccccggcgcgtactgctgggccgaactcctcacccgcgagcccgggacggcggacaccttcctcacctcggtgttcggctacaccgccaagcagctccaggacgacgccatcgacttccgcacgttcgacctcggcggcgacacggtgctcggccggctgcgcatgaccgacgacttcccgcgcgaggtgccctcctacttcaacgtgtacttcatggtggccgactgcgacaccgcggccgccgccgcgatccgcctcggcggcgcggtgcgcttcggcccggccgacagtcccttcggccggacggcggtgctcggcgacccgcagggcgcccacttctccgtgatcgacatcaccaccaccaagggggagaagccgcaggtcaaggacgtctcctgaggccccttcgggcgggggcacgggcaccggccgggccgtggcatcatcgagcccatgcgcgaacgagtggtggccgcctgtgacggggcctcgaagggaaatccgggtccggccggctgggcctgggtcgtctcggacgacgacgcccggaccgcgacccgctgggaggccggtgcgctcggcaccgccaccaacaacgtcgccgagctgaccgcactggaacggctgctcgccgcgaccgacccggacacgccgctcgaggtccgcatggactcccagtacgcgatgaaggccgtcaccacctggctgcccggctggaagcgcaacggctggaagacggccgccggcaagcccgtcgccaaccaggaactcgtcgtgcggatcgacgaactcctcgacggccgctgtgtcgacttccgttacgtgcccgcccaccaggtggacggcgacccgctcaacgacttcgccgaccgcgccgccagccaggccgcccgggtgcaggaaccggccggcagcgcgctcggctccccggaacccc

SEQ ID NO: 2264 - DNA, 620 bp, Unknown
  Kingdom: Bacteria, Phylum: Actinobacteria, Class: Actinobacteria, Order: Streptomycetales, Family: Streptomycetaceae, Genus: Streptomyces
tggccgaccgctggggctggagcaccgacggcgcgggcaagcgcatctggtgcgaactggaccgctgtccgccgccgtcccccgcggcgacggcgatgcccgcggcctgcggcggccacgtgccggtgtgcggcgggaccgggctggagacggcggcctaccggggtaccggcttcactggtcatccgggcgcgagccgcgaagcgtcgcggtacgaggaagtgttgcggtacgaggtggtgtaggtcccgtagggcctggtgcggccgggagttgacgggtgtggccgggtgcgggcgggaggccgtgcgccgggggtgcttctgtgcgcgcccgttgcgatcccggcacaacgggcaaatcggcggacggctgttgacgtgctgtgtccggttgatcacgcttgtggcagcgattcgctgtgaggggacgccgagggcgcccggattcgggtccggagccctcgacgagggtgagtcgtgaggtcggcgtcggccggccccttcaggggcaaggggggtggggtcggtgcgccggagccggatggcggcgcgcggtgtcgtgctcggggcgggcatgggcgcgccgccacccggaacccgttcgtccacagcctgtgg

SEQ ID NO: 2265 - DNA, 628 bp, Unknown
  Kingdom: Bacteria, Phylum: Actinobacteria, Class: Actinobacteria, Order: Streptomycetales, Family: Streptomycetaceae, Genus: Streptomyces
gggctgctgcgggcggaggacacgatgcggtcctcctcccgcagcagccccgccaccctcgtcagccaccgctcgaccggacggtccggcgcaccgaacagatgggcgtaccagcccggcgcgtccacgcccgccccgtagccgctgaaccgggacagcctgcggtgcgtccacggcacccacgtcatgtccgccttgaccttgggcagtcccttcagcagcgcccggtccgcggtgacggtggccctgtgccgcagggcgggcacgtgccaggcgccgcacaccacggccacgccgtccgcgaactcccgctgcgccgcccgtacctggagccgcatgtgggcctcccgtacgagatcacggtcgctgctcccgtacgtctcgcgcagcgcgcccatggcctcctccagcaccaggaacggggcgaacgcgtccttccgcccggggccccggtgctcgacgacgtcctcccaccagcgctcgggatcgtcgtacccggcggtctcggccagcacggcgagcgggtcgatccgcacctcggcgccgcccgagggcgccgagggctccgcggtcccctcctcggcggtctcctccgcgctcccctcctgcgcggaggagaccgccgagg

SEQ ID NO: 2266 - DNA, 658 bp, Unknown
  Kingdom: Bacteria, Phylum: Actinobacteria, Class: Actinobacteria, Order: Streptomycetales, Family: Streptomycetaceae, Genus: Streptomyces
gcgccagcgcgacccgctcgcccgtgcaagtgcgcgccgcctccagcgtgtccggcccgctgaccaccacgtcggccgccgccgggtccccgcccacatccgcgaccgcgcccaccgacgcgcacgccagcagccacaccgccgtctgccagtgcgccggcagcagcagcgcgacccggtccccgggccccgcggcgaggtccccctggaggaggttcgcggtcttggccacccaattggcgaaggtggccacggacaattcgacgcgttcgcccgtggcgtcgtcgtagaaggtcaccagggggcgtcccgggtccgcggcgagcgcggaacgcagcaggtcggcaggggtgcgttcggtggcgttcacccgcgcaagcgtacgcggcggcgcgcacgcgcacccgggggcggcggccacggcgccgctgtccggccaccggttcgggggaacgacacccgacgcaccgtcagttcgtagatggacatatatgtctgactatgtccaagatcaggggcatgcgtcgatacggattccttgcgtcctcgatcggtgtcggctgcgcggccggcctcgctctcgtgcccgctctccccgcgtccgccgccacggccacggcggcgggggcggtgaagccgcggacggcggcagcggcag

SEQ ID NO: 2267 - DNA, 1440 bp, Unknown
  Kingdom: Bacteria, Phylum: Actinobacteria, Class: Actinobacteria, Order: Streptomycetales, Family: Streptomycetaceae, Genus: Streptomyces
gatcgacgtgcgcaacgccgtcggaggcaccatctactcgggcagcaacgagatccagtacaaccgcatcgccggcgagctgggcctgggccgatgacccgggcaccggcgtccgccggacgccgcaccctcaaggtctgcggcgccacgagccggcgggacatcgaggtgctcgccggcgccggcgccggcctcgtcggcctgtggcacggcgtacccggcgggccggccgaactgccggagcacgaggtggccgccctcgcggcggccgcccgtgccaccggcgccctgcaccccgtcctggtcaccttcctcggcgacgcggacgccctggccggcgtcctgcgccgcaccggcatcgacaccgtccagctccacgcctaccagcggccggccacggtcagcgccctgcgggccgccctcccggacgccgtcatcatcaaggtgctgcacgtcctcgacggcacctgcctggagcgccccctgctcggcgcctacgagcgggcgggcaccgacctcttcctcatcgacgccaccaccgccgacggccgcgtcggcagcaccggacagcgcctggacgaggacaccgtcctcgacctggccgaccgcttcaccctgccgttctggctggccggcgggctgacccgggccaaccggcccgcctacgaccgcgtcctgcgccacccccggctgcgcggcatcgacgtcgacaccgcggcgcgcgccgccgacggccgcttcgccggcccagccgtgaccgggctcgcccgtgcctggggcacctgacaccttacggagcgcaccatgagccattccttcatcgaatccctgctgacggccgagcggcctttggtgatggaggtcaagcggcgcgacgcgcacggcttcgacctcatcgcgggccacaccccggccaagatcgtgaccgcgtacgagaaggccggcgcaccctgcatctcggtggtcaccggccgctggttcggcggcaccgtcgagctgctgcgcgatgtggcacggctgaccgaactcccgctgctgcagaaggacttcatcacccgcaaggaccagctggagaccgcccgcgcactgggcgcgtcggcggtcctgctcaccgcgggcctgctgccgtcctcggcgctgcgctcgctggtcgtcgccgcgctgcgcacggggctgaccccgttcgtggaggtcaccaccgagtccgagatcgcggcggtaccgcatgccgacgagtgcgtcatcgccgtcaacaacaaggacatcaagaccaaggaacgcgaccggggcgacctggcccgcagcttcgacctgctccccgccctgcgggcggcgggaacgccctgcccggtcagcgccagcgccatcgacaccccccagacggcagccggcctgctcgacgccggcttcgcgggcctcctcgtcggcacggccctgctg

SEQ ID NO: 2268 - DNA, 648 bp, Unknown
  Kingdom: Bacteria, Phylum: Actinobacteria, Class: Actinobacteria, Order: Streptomycetales, Family: Streptomycetaceae, Genus: Streptomyces
cgcgcgggggtccgcgctgtgcatcgggcggccggcgcccaggtcggccaggatcgccgccgcggcacggtgcgccgagcgcagggcgccctggagcgtgctggtgtcacggtggtcgccgcagacgtagaggcccgccaggagccgtaccgggcgccgcaggtcgtgcggggcacgcatcgccgggaccgcctccgcgctgtggtgcacggcgagcgtctcccagcggtcggtggaggtgccgtacaggcgggccagatgacggcgtacggcggtgtcggcgtcggccgggggctcgcccaggacggtcgaggagaccaggtgccggccggccggagcccgggacgggtcgacctggctgaccaccgccgtgtgcgcgaccggaccgccccgctccgcgtcgagcagcaggtggccgccggtccgcggcggctcgtccgtcgtgtggtggacgaccgtcacggggtggaactccggcacgcgcagcccgggcagcagctcggcggcggtccgcgcgccggtcgcgaccagcaccgcgtggcagcggatctcaccgtgctcggcggtggtcaccgcgttggtggacaccgaggtgacgcggacgccggtgtgcacggtgcccggcggcagcgtgctcgcgagcacgct

SEQ ID NO: 2269 - DNA, 952 bp, Unknown
  Kingdom: Bacteria, Phylum: Actinobacteria, Class: Actinobacteria, Order: Streptomycetales, Family: Streptomycetaceae, Genus: Streptomyces
cccaccaggagtcgtcgtcgcagaaggccacgtagggggtgtggacccggcgcacggccaggttgcggccgacggcgccgaggttgcggccggggcgcagcagccgtacctgcgggtggtggcgggccacggcggcggaggtgccgtcggtggagccgttgtcggtgacgatcacctcgggccgctcggggagttcggcgagccggtcgagggtgcgcaggagttcggggcggcggttgtgggtgatgacgacgacggtgacgcgggggtcggtcacggggtgcctccctggtccagcagccgggccgcgcgttcgacgtgcggtgggagggggcggcgggcgctcagcgcgccgcgcaggcgggcgagtgcctcgcgcagggcgcgccgggcgtgcgggtcgtggcgggcgtcggcggccaggtcgcgggtgcgggcgagggcgtacggcagcgggcggcgcagccaggcggtgaggagtgcgttgcggcgtacgacggcggggcgatcggtgcgcggggcggggtccgggtggtggtgggcgaccacctcggggcagtgggtgacgccccagccacgggcggcgaggtcgtaggcgagcagggtctcctcggcgccgaagaagagcagcgggtggaaaccgccggcgtcgaggtaggcggtgcggcgggtgactccggcacaggcgaggaagccgaggacctgggtgccgggcaggtcggtggcggtgcccagcggcgagtcggcgagcaccttgtcgagcgggtcgggttcctgcccggggccgacgagggtgcgggcggcgagcagtccgagccgggggtggcggtcgaggaggcgggcggcttcggcgagcgcgcccggcgcccaccaggagtcgtcgtcgctgaaagccacgtagggggtgcgcagggcccggacgccgtgggtgcgggccctgcgcaccccctac

SEQ ID NO: 2270 - DNA, 1985 bp, Unknown
  Kingdom: Bacteria, Phylum: Actinobacteria, Class: Actinobacteria, Order: Streptomycetales, Family: Streptomycetaceae, Genus: Streptomyces
ttgcaggccaggcagaggtcgagggcgtccttgacctcggtggagcgccagccgtcggtgatcgtggagtccgcgtggccgtcgagcatctcgaacagcagccgggcccggccccgggtggagtgctcctcctcccgggtggcccggtaggaggggcacatcacgccgccttcgtggctgcggcagttgccgatgccgacgcagcgcatcaccgcgcgggtgaaggagtggtcgtcctccgggtagccgaagtgcgtcttcggggtggcgggccgccagtcggcgccgaggcggagctggccgtcgaccgggttggggtcgacgatcttgcccgggttcatccggttgcccgggtcgaacagcgtcttcagctcgccgaacgcggtcaccaggcgcggcccgaacatccgtaccagcagctcgccgcgggactggccgtcgccgtgctcgcccgacagggacccgccgtaggaggagacgaggtcggcggcgcgctccaggaaccgccggaagtcggcgacgccctcggcggtcttcagggcgaacgggatccgggtgtgcacacagccctgcccgaagtgcccgtacagcgacgggtggtcgtagtcgaactcctcgaacagcttcttcaggtcgcgcaggtagtcgcccaggcgttcgggcggcaccgcggagtcctcccagccctcccaggtctcccggtcgtccggcggccgcgcggtcacgccgagtccggcctcgcgggccttgagcatctcctgctcgcggtccgggtcgtcggagaaggccacgtccgggtccttctcgctgcggccgagagcgcgcagcagggcgtgggcctgctcgtcgacgtcctcctggctgtcgccgctgtactgcacgagcagccagctgtcgccctgcggcaggacgttcagcgagtccaggtaggcgccctcctcgcgcatcagctgcgccatccgcccgtccagcgcctccagctggctgggcgagcagtgttcgagcacccgggagacgtcgtcgccggcctggcagatgtcctcgtagccgaggaccaggatcgactggtacggcggcaccggcacgagttccagttcggcccgcaggacggtgaccagggtgccctcgctgccgaccagggcgcgggcgacgtcgaagccgttctcgggcagcagcgagtcgaggttgtagccggagacgcggcgcgggatcttcgggtagccgcgccggatgtcggccaggtactcggtggcgatgcggtcgagtccggcgtagatctcggccttccggccgccctcggcggcgatgcgggcccgctcggcctcggacgtcgggccgacccacgtccgcaggccgtcgtaggtgaggatctccagccggcgcaggttgtcgacggtcttcccgtacgcctgcgcggacgagccgcacgagttgttgccgatcatgccgccgagcgcgcagtggctgtgcgtggagggcttcgggccgaactggaggcggtggtcggcgagccgccggttcagctcgtcgaggacgatgccgggttcgacgacgcaggtgcgggcgtcgggatcgacggagatcagggcgtggcagtacttggtccagtcgatgacgacggcggtgttcgtggactgcccggccaggctggtgccgccgccgcgcgagaggaccggggcgccgaaccgggcgcacaccgcgaccgcctcggcgcccgcctccacggtgcgcggcaggaccacgccgagcggtacctggcggtagttggagccgtccgtgacgtacgcgcctctgctcccggcgtcgaaccggacctcggcgtccacggattcgcgcagggccgcctccagggcggccacgtccaccgcgggggcgtcgagagggggtgtacgactcatcagcggcaaccgccttcctggaccgtgcgggacgtcccggcgaccggccacgccgtccccgtggccggtcgccgggacgtcccgcac

SEQ ID NO: 2271 - DNA, 615 bp, Unknown
  Kingdom: Bacteria, Phylum: Actinobacteria, Class: Actinobacteria, Order: Streptomycetales, Family: Streptomycetaceae, Genus: Streptomyces
gatggacaaccacgggcgcggcccgtccccgcgcccgtggttgtccatcgtccggtcgccaccctcgcgctcgattgtcaccacacgacgagtgttggtaccgcggcgcgcggccccaaggactgaccgcaagacagcctgtttccggcactttccgagcgtctcagtcgccctaggccctaaatgggaccgtttctgcccggtcggcgccacgtttgcgaacttttcgggttgtacgggttccaccgcgagtttccctcgcgggttccaccggcggccccggtcgtgatcgaacgcccgatcgggccgatagcatccggtccatggagccgcagctgctgcacgacgtcaccgacgcggtcgccaccgtcgtcgtccaccacccggccaagcgcaacgcgatgacggccggcatgtggcgtgcgctgccgccgctcctggaccggctggcggccgacccgggcgtacggacgctggtgctgacgggcgcggacggcacgttcagcgccggcgcggacatctccacgctgcgcgagtcgcccgaggaggcgcagcgcctcgccgtgctcgccgaggaggcgctcgccgccttccccaagccgaccctggccgccg

SEQ ID NO: 2272 - DNA, 988 bp, Unknown
  Kingdom: Bacteria, Phylum: Actinobacteria, Class: Actinobacteria, Order: Streptomycetales, Family: Streptomycetaceae, Genus: Streptomyces
cggccttctcggccggcgcctcggccgccttcttgcccgcggcgctgtcgtcgcccgtgcgggtgcgggaggtggcgcggcgcttcggcttggcctcggtggcgtcgccggcggcggccgcggccttcgcgggcgcggcaccccccgcggcctgcgcctccttgatgacctcgatcagctggcccttgcgcatccgcgcggtgcccttgatgccgaggcccgaggcgacctgctgcagctcggccagcaccatgccctcgaggccggtaccgcggcgccgccgggagccggcaccggtagcaggcgcggaggcgtccgtggcgggcgcggcagcggtctcctcgacacgtgcgcccatcagatcggtggtgtcgctcacgaagggtccttccctggagcggacgtcggcctgtctggctcggcgaccggttgtgctgtccggcttcggtccttgctgtgtggaccgtgccggggcggtggtccgccaaagcggcggaagagatatctggtgagtggcgctgccgcgacgaaccgtggcacccggtgtcacggtgtcacgtggcgtggtagcaccgtttccggagcgtgccctctggaccgctcagcgtccgcgtacgacgtactgcccggatacggcgtacggaacacagagtggcttggggagctcccggaagaatgttggtcccggactgggacacgaagcacctcgccatggtggggtcgggtgcagacttgagattaacactaccggatccaacaaacattccccctctccacatccggcaatcgcgtgtcagcccgccagcggcagcacgcacgcgccctgcgcgtcgagactcagccggttggcggcccagccggtacccgcgagccgttccaccttgtcggcggtgcccgcgtcggccagcgccatgaccgtcggtccggcgccggagatgaccgcggggacgccgtccccgcgcagccgctccaccagcgcggtgctctc

SEQ ID NO: 2273 - DNA, 508 bp, Unknown
  Kingdom: Bacteria, Phylum: Actinobacteria, Class: Actinobacteria, Order: Streptomycetales, Family: Streptomycetaceae, Genus: Streptomyces
gcgcgaacgccgggcggggcgccgccccgcccggcgttcgcgcggctcacttcgtcgacgtcaggtgggcgaagacgacgacgttgctggagtagccggtccggcgggtgtaaaggccgccgcaggtgatgacgtgcagctcgggcctgcgggcggggccgtacacctccttgtcggggaagcgggccttgttgaagacccgtaccttgtccacggtgtagacggcggtacggccgtccgcgcgccgcacctcgatgtggcggcccggggccacctggccgagcgcggcgaagacggcggcgcccgtcttcgtgtcgcggtgcccgaccgcgagggccgtgccggactcccccggcgtggggccgtcccgccaccagccgaccagcttgggcttgtcgaccggtggcgtctgcagctgacggtcggcgtcgaggccgatcccgatgacgggtgcgtcgatgcctagggaggggatgcgcagggaggtcgccggggagcggggcagcgg

SEQ ID NO: 2274 - DNA, 1770 bp, Unknown
  Kingdom: Bacteria, Phylum: Actinobacteria, Class: Actinobacteria, Order: Streptomycetales, Family: Streptomycetaceae, Genus: Streptomyces
gctcgtcacccggtcgggggcgtgagccggcccccgggcggcatccgtcagtggccgagcgtggcgcgcagcgcgggctggaggaggtccgcgtgggcgcggaccatgtcgtcgcacaggtcccagatgcgttccaccggcagggccgcggccgtcgccgggtcggtcatcgccgcctgccggatcgagcgggggtcgtcctcgagggccgcccgtacgacgaggtcgttcatgctcaggtaggtgcggttgagcgccgcgcactgggcgggcagggcgccgacccgggtgggctgcacgcccagcgcgtccacgaggcaggggacctccacggttcccgaggcgggcaggttgtcgatcagaccgtggttggggacgttgccgtagaccgtgcgcggcgtgcccgtcgtgatgctgtggatgatctgcggggcgtactccatcgtgccctcgacggtgagcggggcgccctgggcgagggcgtcgcgggtgtgctcgtaggcggcgatgttctcgtcgacgatgtccaggtaggccccgaccggcaggcgcaggcgctccacctcctcggcgtggtgcaggtaccaggggacgtactcggaggagtgctcgctggtctcggtcgggtagtagccgagcctgcggtacatgtcgacccttacgcggcgccgcagttgggggtcgtccgcgatcagggcgtccaggcgggggtagaggtccacgccctcgtgctccaggcgcaggacccaggcctggtggttgaccccggcggcccggtaggtgacctcctcgtgcgggaccttgaggagttcggccaggtcgtggacggtccagtacacggagtggcacagccccaccacgcgggtcagtccggtcgcccgggtgaggtactggacgttcatcgccatggggttggtgtagttgagcagccaggcgtcggggcagacctcggcgatgtcctcgccgagcgacttgagcagcgggaaggtgcgcagcgcccggaagatgccgccgacgccgagggtgtcgccgatcgtctggcgcaggccgtagcgggcggggatctcgaagtcggtgcgggtggcggcgcgcatgccgacctggacgatgttgatgacgaagtcggcgccctccagggccgcgcgccgctcggcatgggcggtgacccgcacccgggaagcaccggaggcggcgcgctcgtcggcgatgtaccgggcggctccgtgcgcggtcgcgagccgctcggcgtcgatgtcgtgcagggcgatgtgcgcgccctggagttcggggaaggccagcaggtcggcgagcaggccctgggtgaagacgacgctgcccgcgccgatgaaggcgatcttcggagagccggaggaggcggcggagccggagggaacggaggtggtgggggcagtggcggtcttggtggtcatcacaggtgctttccgttgcgggtgacggcggccgtggcctcgtcccaggtgggctgggccggcgttccgccgtgggcccgggtggacagggcgccgcaggccgcggcgagttcgattgcgtgcgcggtggacagaccgcgcagacgggcggcgacgaaaccggcgtcgaagctgtccccggcgccgacggtgtccagcggccggacggggacggcgggagtgcgcagcagtgtgcggccgtcgtgcgcgacggcgcccctggcgccgtccttgacgatcacgtgcgggccgagggccgccagggctgcggccgcggcctccagggaggcgtccgcgggag

SEQ ID NO: 2275 - DNA, 1518 bp, Unknown
  Kingdom: Bacteria, Phylum: Actinobacteria, Class: Actinobacteria, Order: Streptomycetales, Family: Streptomycetaceae, Genus: Streptomyces
cgtcgccgatcgcgccggagtaggcggtgagcgtcgccagtaccgccgtggtcagcaggaccgagagcaccgcggcggccaggagcagccggtgcgcgcgcgcccgcgacaggacgaatcccgtgaatccccccacccggctcccccagaagttgtccagacctgccggtgatgctgtcagaggtgaaggggctccggtaagcgcttgtagacctagcttgatcggattgtgaccggaattcggcgacgaacgaccggaatgcgggactccgagcggccggtccgtccgcgtgggcgggcggaccgggtgaggacgggcgcgcggggtgaagacgggcgggcgagcgggcccgggcgggggctctgccggctcagcccggagtgttgaccatcgaggccgccgcgtacgtcaggtagttccacagcgtgcgctcgtgttcctcggacaggcccagctcgtccacggcgacgcgcatgtgccgcagccacgcgtcgtgcgccgcgcggtccaccgtgaagggcgcgtgccgcatgcgcagccgcgggtgaccgcgccgctcgctgtacgtcgtcgggccgccccagtactggatcaggaacagccgcagccgctcctccgccggaccgaggtcctcctccgggtacatcgcccgcagctcgggatcgtcggcgaccccctcgtagaagcggtggacgagtcggcggaaggtctcctccccaccgacctgctcgtagaaggtctgctcctgaagcgtgccgcgccgaatctcattcacccgttcatcgtctcagacgggcggacggaggaccgcggactcaggactccgtcgcgccgacgtgggggctcgcctcgcgcgggatcgcgcagcacagtggagtcatgggcgcgcacgccgtcgacaccggcaccgacgacaaggactgggccggcctcgccgccgcggcgcgggccgcgctggtgcgggagatcgaggagagcggggcctgggcgtccgacccggtgtggcgggaggcgttcgcggcggtgccgcggcacctcttcgtgccgtactactacgtcgccggcccccgcggctacgaacggcgctggtgcgagagccccgaccgcgcggcacgggagcggtggctgcggggcgcctacgccgacgtaccgctggccacgcggctgcgcgacggcgaactcgtctcctccagcagccagccctcgctcatggcgcagatgctggccgagctgcgggtgagcgacggcgaccgggtcctggagatcggcgccggcaccggctacaacgcggccctgctcgcccaccggctcggcgacgacggcctcgtcaccaccgtcgacctggaaccggagatcaccgaggcggcgcggcgccacctggccgccgccggccaccacccggtcgtcgtcacgggcgacggcgcccgcggagtccccgaacgcgccccgttcgaccggatcatcgccacctgcgcgctgcccgccgttccgcccgcctggctcgcccagtgcgtccc

SEQ ID NO: 2276 - DNA, 668 bp, Unknown
  Kingdom: Bacteria, Phylum: Actinobacteria, Class: Actinobacteria, Order: Streptomycetales, Family: Streptomycetaceae, Genus: Streptomyces
gcccaccccggcgcacaaaccgtcgccgaagcccgcgccgacccctactcccacgcccactccgcacccgaccccgccgcccgctccgtccgtctaccagtggagcgaactggactacgacctcaccggagaaggcaccggcccgcagatgcggatcggccggagcagttgggtgtggcagcgcgacggcgtgtcggtcgccgggaagcggtacacgcacggagtgagcgtccacggcgagtcctccgtcaccgtcgacctcaaccgcaggtgttccgcctacgacgccgtggccggtgtcgacgacctggcggccgggctgggcaaggtcaccttctcggtgtacgcggacggtgtccggctgtggaactccagcacggtcgccggtggtgaggccgccgtcccggtccatgtgagcctcgtcggacgccggaccgtccagctggtcgtcgagccgcgcagcgccttcgacgcggtgaccctcgccgactgggccgagtcgcggttcacctgcgggtagcgggtccgccttccggcagcagttccatctcccggcagcgggttcacctgagggcagcggggtgggtcctgacggcctcgtccagttcggccaggacaccgtccgcggagagggcggtgccccggtcgcgctcggcgctcacacggtc

SEQ ID NO: 2277 - DNA, 1140 bp, Unknown
  Kingdom: Bacteria, Phylum: Actinobacteria, Class: Actinobacteria, Order: Streptomycetales, Family: Streptomycetaceae, Genus: Streptomyces
taggcggacgcgggcgggacgtcggcgaggtccagctcgcgcaggaccgacacgacccggtggatgtggtcggcggtggccgccaccgccgcgtgatgctcctccgccagccgcagcccggagcgcgcggcccagccggcggcctccggtggggtgagcgcgtcggcgcacgtggggttcatggggctctcctgatcgaagggtcggcgtcttcggtgcgttcggcctgttcagcgcgggtgcgagtgggcaccgcgacacacccgtccgccaaacgcaatttgtttgcgttagtggactgtagagcctacgatcgcttaacgcaaacaaatcgctttaagcgggagccccctcatgcgcacgccctccggccacacgccccacgacatggaatccgccgtccccacctggaccctgggcgacgacctcaccgtccaccgcatcgacgagacggccctgccgcccgcgaccggaccctggctgctgcccggcgccacccccgacctggtcgcgggccaggagtggctgcggccccacttcgccggcgacgacggcgtgctgcggctgcacagccacagcttcgccgtgcgcgcgggcgggctgcgcgtcctcgtcgacaccggcatcggcaacggcaagccccgggccaacccggcctggcacgacctgcgcacggactacccggcccggctggccgcggccggcttcgcaccggaccgcgtcgacctggtcgtcctgacccacctgcacaccgaccacgtcggctggaacaccatccgcggggacgacggcgcctggcggcccgccttcccccgcgcccgctacgtcacctcgcgcgccgagcgcgccttctgggccgggcaggacatggacgaggcgcgccggcagatgttccgcgactccgtccaccccgtcgaggaggccgggctgctcgacctcgtggacgtccccgccgagggcaccgaggtcgccccgggagtgcgcctgctgccgacccccgggcacacccccggccatgtcgccgtcgagctgcgcggccggggcggcaccgcgctgatcaccggcgactgcgtccaccaccccgtccagttcgcccacccggccctcggcagctgcgtggacaccgaccccggacaggcg

SEQ ID NO: 2278 - DNA, 664 bp, Unknown
  Kingdom: Bacteria, Phylum: Actinobacteria, Class: Actinobacteria, Order: Streptomycetales, Family: Streptomycetaceae, Genus: Streptomyces
cggcccaggcgaggacggcgacgagcaggacgacggagagtgtctctgcgaacggggtgttcagggctcggtcctccggacgcgatcagcggtgcccgcacatcaaagcaaacgcccgcgggagttccgcgcgcacgtgcgagttccgggtggcgccaggggccgcggacggtggctcaggggccggtgccggggctgaggacggtcaggaacaccgaggaggagttcccgccgaccgggacctggccggcggtccaccgcaccgtgaggtgagcgcgctcgtcgggcggggtgacgatcagcgccgccggtgtcgcggccttcgcctcgctcacctcggggttggagaacgtcaggcccgcccaggcgctctggccggggcgcagcgtcacggtggcgggcgaacccgtctcgcgcttggggtccgcacccagctgccggccggaggcgtccacgaaggcggcgccggggtagccgtgcaccgtgcaggtgcggccggaggtgttggtgagcaccacggggaagttctcctgtccggcgcccgggtcgttgcggcccaccgtcgccctcaggtcagaggtgtgacagcgggtgctgcgcgccgtcgtaccgctgccgctcccgtcgcccgtgcccttgcccttgcccgggccggtggtggacg

SEQ ID NO: 2279 - DNA, 675 bp, Unknown
  Kingdom: Bacteria, Phylum: Actinobacteria, Class: Actinobacteria, Order: Streptomycetales, Family: Streptomycetaceae, Genus: Streptomyces
aggcgccgcgcctcggcctcgtcggtgaaggcgccgccggaccgcgcggagcggccgctgtcgatccacaggccgcgctccagcggcagccggaccagcatgggaacgcgcagggacggcgcctcgggcagatggaggtcgccgagccgcacggccatcgggatctccatcggcacccggtacccgtgccagacgggattgtcccagcccgcgtacgccggtggcagcgcgggctcgaccacctcggactcggcggtgagctgggcgaggtcgcggtcgagggcggccctggcctggtcgaccagctcggcgtgccggacgcgcgccgcctcccgagcggcgtcgccctggccgccgatgcggctgcgcgggtcggacagggcctggtccagctccttctccctgcgcgcgtcggcgaagtcgacggcactgcggtaggcggccgcggtgcgggccaggtcctcgaacatgccccagacctggttgtagagccgttcctccatggaccacccggtcgcgtcgcccgcgacgggccgcgcgggctgtccgggtgcggcgggtgccgcggcaggcgccggtggtggcggggccgtcgtctgccgccggggatggctgtagtcgatgggtccgctcgtgggggccgtcggctggggggcggcccccacgagcggaccc

SEQ ID NO: 2280 - DNA, 601 bp, Unknown
  Kingdom: Bacteria, Phylum: Actinobacteria, Class: Actinobacteria, Order: Streptomycetales, Family: Streptomycetaceae, Genus: Streptomyces
cctggagggcccccttcccgttgccgtgtgcgcgctacgcgatgtggtcctcctccagttccgcgttgaagcggttggagaagcggctcaccatgcgcttggcctcgtggtccggcagcgccgtgccgtacgtcgcctcgaccccgtccgcgaactcgcggggcgtcggcaggctgccgttgatcgactgccggaacacctggtacaggccctcctcgtccgggacctgcggggcggtgccgccgccgtcgcccagctcacgggtgcggtgggggcccgcggggacggggaaggtgcccgtgtccccgggagagggctgcggggcgggctgctgcggcgcctgctgctccgggcgctgttccgggtgctgcggcgcgtgctcgaactggtccgggtgctgctcctcgtaccactcctcgtacggcggctcggggccgtacgtcggctcaggctcgtacgtcgggtcgtagccgccgtggtagtcgacctgctgcggcgcctggaaccacgggctctgctcggggtcgggcacgtacgcctgctgctccggctccgggccgcgctcggccaccagcgcgggccggagccggagcagaaggcg

SEQ ID NO: 2281 - DNA, 1488 bp, Unknown
  Kingdom: Bacteria, Phylum: Actinobacteria, Class: Actinobacteria, Order: Streptomycetales, Family: Streptomycetaceae, Genus: Streptomyces
ggcctggccgccgctgacggcctgctcgaccgagcccaccgtgcgccactgcgccccggaggtgatcctgtcgtacgtggcggccgtgccgccgggcaggtccgaggcggccaggccttcccggacggctgtctggaccgcggcgtactggccgaaccgggcgcggtcggcggccggtatgcggcggccgggcagggccgcggagaccagggcgtcctcgcgtgacagcagctcggtgatccgggccaccgccaccgtcgcggagccggcccggtccagcccggtgtcctcgccgcgtacggccgcggtgagcagggccagcccctgggaagcggcgtcggtgaagtaggcgaaggcgtcgccgggggacagcttgcgcgcgtcgatcgccgcccggcggtccgtcagcgacttcagcgcgccgtcgaacgctccggcgccgcgccggagcgcggccgtgtccgccgcggaggcgtgccgcgtgtactcggcgagggcggtgtcggtcctggcgcgggccgagtcgaggttcgcgcgtgccgggtccgtgtggctcgcctgccacagggcggtgagccggcgttcgtcctgcagccgagcgagcagctcctgcgcgggccgggcgacggacgagacgtggccggcgtcggtgtgcaggccgacctggtcgtccaccagcccggcggccgtgtatccccacagtccggtgacgcagaccgcggggatgacgaaggggaggacgaacgaggatcgcagtgatctcggggtaccggcgcggtgacgtgtccgccggtcgcgggtgcctggcatctgattcctcgtacagcagcggtacagcggtgcgggcagggaacgcgacgtccgacgatccccgccccccgtggcctggtggcccaccgtgatcgaagccgcgcgagctgcaccgtatcaggatcatcgcgcagcgtcatgtgtcgtccacggcaactggcctgtgatgtcaggagagttgaaagaaccgccggggggacgggtggagcacagcggcgccggggccgtgggccacggatcacagcagcgccagcagccgcggggtgtacagcgcttcggccgaggcgataccggccaccatgtcgaggtatatcgcggtcagttcggggtccgactgcacggcccgcagcagggagagccgctgctcgtgcgggtcgagccgggcgacgccgagcgtggcctcgtatcccggcgccagatgttccgcgcagtcctcggcgtagcgggcgagcgtggcgtcgagccggcccgggtcgccgtccagcacgcccgacaccgcctccacgagccgctcgacctgccagaaggcgtcgctgataccgcgggccgtgatggagtccttgtggtgcgcggcgtcgccgacgaggacccagccgggcccggccgcccgccggaagaagttctgctggtcgccgctgccgtgcagccgttccacgggctcgcggccggccagccgtt

SEQ ID NO: 2282 - DNA, 598 bp, Unknown
  Kingdom: Bacteria, Phylum: Actinobacteria, Class: Actinobacteria, Order: Streptomycetales, Family: Streptomycetaceae, Genus: Streptomyces
ctgcgggacgtggcccacgccgatctggacgcggccctggcccggctcggcgacgaggaggagatccgccgcctggtccgccacgtggtgacggaggacgcccgcgtcgaacgcgtcatcgccctcctcgaatccaccggcgcccgcgcgatcggaccggtcctcaccgagggccacgcctccctgcgggacgacttccgcatctcctgcccggagctggacctggtcgtcgacacggcgctggccgccggcgcgctgggcgcccgtatgacgggcggcggcttcggcggatcggcgatcgtcctcgccgaggagagcgacgtcccctcggtcaccaaggcgatcgaagaggccttcgcatccgccgatttcaccaccccgcgcgtcttcgaggcggtgccttcggcgggggcgcggcgggtggcatgacgtaggggctctgcttcactccccgccggcgccgtccgggcgttggctccggcgggggggcgaagtcccttcggacgccgggctcttctcccccgaccgggctccggggggagcaggcgcatacgatcggccggtccccaccccgaggagccccgccggtgaccaccgc

SEQ ID NO: 2283 - DNA, 1050 bp, Unknown
  Kingdom: Bacteria, Phylum: Actinobacteria, Class: Actinobacteria, Order: Streptomycetales, Family: Streptomycetaceae, Genus: Streptomyces
gcggtggcgagcgcggcggcgtcgttgaccccgtcgccgaccatggccacggtccggccctcggcctgcagccgccgtacggcctcgaccttgtcctcgggcagcacctcggcgatcacgtcaccggcgtcgataccgaccgcccgcgccaccgactcggccaccggccggttgtcaccggtcagcagcaccggccgcagtcccagcgcgcgcagctgtcccacggcctcggcgctggtttccttgaccgcgtccgccacggcgacgacaccccgtgccacgccgtcccagccgaccacgacggccgtacgcccgttcgcctcggcctcgcgccgcgcccggtccacctcctcgggcaggcccccgggcagctcgtcgaacagccggccgacggcgacctcgtggccctccacgcgcccgcgtacgccccgcccgggcacgttctcgaagtgctcggccgccggcagcgctccgacgcgctcctcggcgccggccgcgaccgcgcgggccaccgggtgctcggaggcgtgctccagggcgcccgcgagccgcagcagctgcttctcgtcggtgccctcggccgcgtacacctcctgcagggtcatccggccggtggtcaccgtcccggtcttgtccaggacgacggtgtcgacgcggcgggtggactccagcacctcggggcccttgatgaggatgccgagctgggcgccgcgtccggtgccgaccatcagcgcggtcggcgtggccaggcccagcgcgcaggggcaggcgatgatcaggaccgcgaccgccgccgtgaacgaggcggtgacgtcgccggtggtcagcagccaggccagcagcgtgccgacggcgatgagcaggaccacgggcacgaagaccgccgagatccggtcggccagccgctgcacctgggccttgccgttctgcgcgtcctcgaccagcttcgccatccgggcgagctgggtgtcggcgccgacccgggtggcctcgacgacgaggcggccgcccgcgttgaccgtggcgcccgtgaccgcgtcgcccgcgccc

SEQ ID NO: 2284 - DNA, 872 bp, Unknown
  Kingdom: Bacteria, Phylum: Actinobacteria, Class: Actinobacteria, Order: Streptomycetales, Family: Streptomycetaceae, Genus: Streptomyces
cctcgcccgcgcccagctccacgaccacgtcgagcgggcgcccggcaccggcctcgcgcagcaccgcgtccatcagttcgacaccgcgcacggagtcgacgtagcagacgaaccggaaggcggggtcggcggcgagttcggcggcgacccagcgcagggctgccgggtcgaccagctcgttggccaggaagatccgcccgaagccgaacgcgcgcgccacccgcacctggtgcggtaccgccagggtgatgccccacgcgccgtgctcgatctgccgctggaagagctgcggcgccatggacgtcttgccgtgcggcgcgaaggcgaggccgtgccgcgccgcgtaggtctccatcagcttcaggttgtgctccaggcgctcggcggacagtgcgagcacgggcgtggtgaagccgccggtgaacaggttgcggcgctcggccgccagcttgccgacggtcagcccgtccgcgtccggcgggagccccttgaaccggtggtcgacgcgttcctcggccagacgtgcgagcgcctcgctacccatggagcctccctgatcagttgcgttgcatatcttgcaacgctcattgcacagaccgcttaatgctgtctaacatctcggccacgtgaggtcaacgaaacgcctccgcgccccgcaccccccgcaccgaggagctacgagcatcgtgaccgccaccggaccccgcaatggcaccggcgacgtggacgtcgtcgcgctcggcgagtccatggtcaccttcctgccctcccggcccggccgcctcgccgacgtgcccgccttcacccgcgccatcggcggcgccgagtccaacgtcgcctgcatgctcgccgccgccggacacccggcgcgc

SEQ ID NO: 2285 - DNA, 865 bp, Unknown
  Kingdom: Bacteria, Phylum: Actinobacteria, Class: Actinobacteria, Order: Streptomycetales, Family: Streptomycetaceae, Genus: Streptomyces
gcccatgccgccggtgcgccgcgcacggcgtccgcgcttccggtgcggaacaccggggaggcgaccggagcgcaggggaccggagtgcgggcgaccggtgcgagcgccgcggaaggggccgatgaggccgccgaggaggaagtcgaagagaccgtcgccgtctgagggttggggtagggtgacctgcggccgtggacggtcccggccgtgggacaccgaggaggtgagacccattaccgctgtgtcagctcgggtgctctcctcccaccggggcgcggatcaccgtcggtaggtgaccgcgggagcacccttcggctcccgaaaggtctcggctctccatgcccgaacttcccgaacttcctctctcttccaccgactcctctcccgccctgttctcctcggccgtacgcgccgaggccgtcgcggcgctgcgcgcggccggctgcgtgttcgccgaggacgaggcggagctgatcctcaccgccgcccgcacaccccatgaggtcaccgccctcgtcgaacggcgcgccgccggcctccctctcgaacacgtcctgggctgggccgagttccacggcctgcgcatcgccgtggagccgggcgtgttcgtgccccgccgccgtaccgagttcctcgtcgaccaggccctggcccaggcaccggacgcgtccgtcgtggtggacctgtgctgcggctcgggcgcggtgcccaccgcgcccgagccgcagcacaggtccaccacgacggacgcgtccggtgcctgggccagggcctggtcgacgaggaactcggtacggcggcggggcacgaacacgcccggctccacggcgatgcgcaggccgtggaactcggcccagcccaggac

SEQ ID NO: 2286 - DNA, 518 bp, Unknown
  Kingdom: Bacteria, Phylum: Actinobacteria, Class: Actinobacteria, Order: Streptomycetales, Family: Streptomycetaceae, Genus: Streptomyces
gtggcggtgcgcgtggcgccctcggcggcgaaggtgtccacctcgtcgctggtccgtacgaccttgccggtgcgggcgtcgacgaagacgtgcaggcggctcggcgtctggtccgggcgtacgccgctgacgacggtctcccagaccagcgcggcgcgggtgcccttcatctggacggcgaggtgcgaggcggacaccgactcgacgcggccgtcgaacgcggccctcgacaccttcgcggcgcgggatgcgggcagggcgggctcggtggagaccgacccggacgtccgcgagccggtggccagcgacgcatacgtgccgtccttcttcaggtgcacgatgacgtcaccgccgtaagccggcagccccttgtacgtccggtcgaagcggacggcggcggagccgtcccggtcgaccaccaggttccggaccgagaaggcgtccccggcggcctggtgggcggcgcccgcgtgggccgccagggccttccgcgcgtcgtccacgacacggctgcggac

SEQ ID NO: 2287 - DNA, 834 bp, Unknown
  Kingdom: Bacteria, Phylum: Actinobacteria, Class: Actinobacteria, Order: Streptomycetales, Family: Streptomycetaceae, Genus: Streptomyces
ggcgttctcccgcaccagcgtcccgccggctccgggcagtcgggccggcagccaggcgatcagccggaccagcggccgcaccagcaccggcgcgagcagcgcgaccgcggtgatcagcagcatgggccggctcgcataggtcttgcggtggagcaggtcgcccgggtccgtcatcagggccagggccagggtcagcgcggcggtgatcagcagggccgcgccggacagcagacggccccgggtgatcggccgggtgtccacggacgcctcgcgcagcgcctcggcgggaccggtgcgcccggcccgccaggacgcggccagcacaccgcacaggaccacgaacaggccggtccagaaggccagttggtagggccaggtgtggtcgccgacggtgaaccagcggggcgcgaggctctcggcgaccgcccacgcggcgagcctcggagccccgtaggagccgagcacacagccggtggcggaggagaggacaccgaccgcgagcgcctcgcagaccaccatgcggcggatctggcccggggtcgccccggcggtgcgcagcagcccgaactcgcggcgccgctgggccaccgcgaacgcgaaggtggaggccaccacgaacaccgagacgaaggcggtgacaccgccggccgtgccgaacatggcgttcatcgcggtgagggccttggcgtcccggccggggtcggcgtcggcgtaccggcgcgcggtaccggtgaggacccggacgcccgcgctgccgcgcaccgcctcgcgcacggccgaagcgtcggcgtcgaccaccgactggaggctgcgcggcgacagttcggcggcgcg

SEQ ID NO: 2288 - DNA, 884 bp, Unknown
  Kingdom: Bacteria, Phylum: Actinobacteria, Class: Actinobacteria, Order: Streptomycetales, Family: Streptomycetaceae, Genus: Streptomyces
cgtcgaacgtgtccggccagctggccctgtgggcggcggcacgccatgtcctgcccgccgactcgccctggcgcaccgaccgcccggccctgctgcgcggcgtggtcgccctcgctccgatcgccgacttcgaggccgccggaaagctgaacgtgtgcgggggagcggcgctgcaactgctcggcggacccgaggagttcgacgcgcgccgaccgtacgcggatcctgccctgctgctgccgaccggtatcgcgacgacggtggtgcaggggcgtgcggacgtggacgtcccgtacgccgtggcggaggcgtacacggcggcggcggcgaaggccggcgaggtggtgggcctgaccctgctggaggaggtcggccacttcccgctgatcgacccggccgcggacgcctgcgcggtggtggcggaggagatcgcacaactggcgtggtgacgacgtcccgtggtccggggggctgtggctcgggcccgtcggccgggcccgtggttcgggtccgtggttcgggtccggtcatacccgtagtacctgagagctacggccgagaacagctctgcggcgggacgcgaacgacgttcccggatccgtaatttcccttccagacgagcccggcgagcgggccggacggagggggacgcgagccatgcggcttgagcggacgaagcacgcgacggcagcacgcccgtcgacggcagcacgcccggcgacgagggcccgctcggcgaggaaggggcgctcggcgaggaagggttgctcggccgcaacgaagtaccgtccgccccacagatggcgccgtgccttcctcgccgtgctcgtcatcgcggcggtggtggtgccgctgtcggcggcggcccgccctcggatccccgc

SEQ ID NO: 2289 - DNA, 1467 bp, Unknown
  Kingdom: Bacteria, Phylum: Actinobacteria, Class: Actinobacteria, Order: Streptomycetales, Family: Streptomycetaceae, Genus: Streptomyces
ggcacggcggcccgcgccccccgtccccacgctcggcgctcggtggcccgcggcgcgcatggtcgtgaccgtcgcggggaagggccgttccgacgaacttctgccacatcttcgacgtcccttcacacaggcggtgcagattgaagaagagagtgtgcggtgcgggtgtcgtgctcggtgtcctcgtcatgttcggcgccctgcccgcgcaggcgtccacggccgcgcccccgggaccgcagcaaggacggcagcagggcagaaacgttctgcctctgggtgccgcggacctgacggagacccggaccacgacgaccctgcagcccggcgtcaccctcacccgcatcgtgcgcggtgaggacgccccggcgctgccctggacggtcgaggtgacgatccccggcggacccgcctcgcccgacccggacgcaccgcccgccgtcctcaaggacgaggccagcgcgcaggagctggccgccgacctcgtgcggcacggtttccaggcccgcgcggaggaggtgcgcacgccgcggacggccgactacgccggaggcaccctcggatggcgggtgcgcgtcggctcgttcggctcgcagtccgccgcgacatccgaacgcacccgcctgcgggccgccgggtacacgggttcggccgtgtacaccggctgggacggcgactcctcggtcaggggaccgtggcacatcgacgtgctcaccatcgacccgtggcggttccgcggcagcctccaggcgtcgtacggcccggacctggagagccgcgagaccaccagtcagttgtcgcaggcggccggcgcgatcgcgggggtgaacgccggcttcttcgtcctggaccccgctgcgggcgcaccgggcgacccggcgggcgtgggcgtgtacgacgggcggctgctgagcgagccggtgagcgggcgccccagcctggtggtgcacgacgacggccggcggacggaggtcacccggctcacctggcagggaagcgtcagcggcgggaacacctcgctgcggctgaacggcatcaaccgggtgcccggcctgatccggaactgcggcggcagcccgggtgacgccccgacctccgcgccgctgcacgacgtcacctgcaccaaccccgacgaactcgtcgccttcacaccggacttcgggccgagtactccgaagggcgagggcgtggaggccgtgctggacgtccatgaccgggtcgtcgaggtgcgctcgccgcgcggtggaccgctcccgtccggcggcagctccgtccaggcgaccggccggcgcgtcgccgaactgaccgggctcgcccacgtcggcggccacctgcgcgtctcgacgaccctgcgggacggccaggggcaccgcgtctcgccctcgcccaggaccgacatcgtcaacgccggtcccgaactggtccgtgacggcaggatccacatcactcccgccaccgacggcatgg

SEQ ID NO: 2290 - DNA, 2017 bp, Unknown
  Kingdom: Bacteria, Phylum: Actinobacteria, Class: Actinobacteria, Order: Streptomycetales, Family: Streptomycetaceae, Genus: Streptomyces
ctggagctgcggcagcaggtacagccagccgacgccgacgacgaaggcgcccgcgagccgccgcacgccctgggaggcgagccgggcctcggcgaagtcgggcagcgtgtaggcgccggagcggcgcagcggggcggcgacgaacaggagcaggacgaggtagccggcggtgtagccgaccgggtaccacagcatgtcggggccctggacgaggaccagtcccgcgatgccgaggaaggaggcggcggagaggtactcaccgctgatggcggcggcgttcaggcgggggccgacggtgcgggaggcgacgtagaagtcggaggtggtccgggatatgcgcaggccgaaggcgccgacgaggacggtggccacgacgacgagggcgacggcggggacggtgtaggcggagttcacggggtgcggcctcagcggtcctcggtcaggcggacgaagtcgcgttcgttgcgttcggcgcggcgtacgtaccagcgggcgagcaggacgaagggggcgtagaggcagcagccgaggacggcccagcgcaggcggcgggcgtcgggggcggcggcgaacaccagcggcagcgggccgacgagcaggacgagcacgccgaaggcggtgagggcggtgcgcagttgggtgcgcatgagggagcggacgtaggtgtggccgagggtggtctgttcgtcgatctcggtgcgtggccggtagtggccggtggccctgcgggtgcggcggggcgggccggtgacggtgacgcggcgttcggcgggatcctgcggcatggtgtgcgtccccctagccggtggtgcggcgcatgaggaggtcccgcagctcgcgcgcgtggcggcggctgacctggagttcctcggtgccgatcaggacgctcaccgagcccgcgtcgagccggagttcgccgatgtggcgcagggcgacgaggtggcggcggtggatgcggacgaagccgcgcgagcgccagcgctcctccagtacggacagcgggatgcgcacgaggtggctgccgtcggcggtgtgcagccgggcgtagtcgccccgcgcctcgacgtgggtgatgtcgtcgacggcgacgaagcgggtcacaccgccgagttccacgggcagctggtcggggtcgggttcgctgacggggatccgtacggcggtgcggcgcagctcgtccgcgcggcggacggcctccgcgaggcgttccgcgcggacgggtttgaggacgtagtcgacggccttgaggtcgaaggcctgtacggcgaagtcctcgtgggcggtgacgaacacgatcagcggcgggtcggcgaaaccggtgagcagccgggccaggtcgaggccgtcgaggccgggcatctggatgtcgaggaagacgacgtcgatcgcgtcgggtccgtcgggtccgcaccgcagggcccggttgacgcggcgcagggcctcggtcgcgtccccggcgccttcgacgcccgcgatcctcggatcggcgccgagcaggtagagcagttcctccagggaggggcgttcgtcgtcgacggcgagggcgcgcagcatgaacgtggagtgtaggggccggcggcgggcctggacatgcggcgggcgcgggcgttcgtgccggacggcgccggtggtgggggcgtgggcgttcgcgctggatacagtgcggacatgaacagcaggcccacgccgttcgacgagctggaccgcaagatcctgaccgctctgatggcgaacgcgcggacgagtttcgcggagatcggggcggccgtcgggctgtccgcgacggccgtcaagcgccgggtggaccggctgcgggacacgggcgtgatcaccgggttcacggcgacggtgaaaccgtcggcgctgggctggcgcaccgaggcgtacgtcgaggtgtactgcgagggcgcggcgccgccgaggcggctggccgaggtggtgcgcaaccatccggagatcacggcggcgatgacggtgaccggcggcgcggacgcgctgctgcacgtgcgggcgcggg

SEQ ID NO: 2291 - DNA, 1026 bp, Unknown
  Kingdom: Bacteria, Phylum: Actinobacteria, Class: Actinobacteria, Order: Streptomycetales, Family: Streptomycetaceae, Genus: Streptomyces
ggtgcgcgcggtcgtcgagggccgcaagtcgctgctcccggcgggcatcgccgccgtcgagggcgacttcagcgcgggtgacccggtcgaactgcgcgacgaccggggccacgccgtcgcccgcggcctcgtcaacttcgacgccaaggagatcccgcggctgatcggccgctccacccgggaactcgcccgcgaactgggaccggcgtacgaacgcgaggtcgtacacagggacgacctggtgatcctggagccgtaatgggccgaaacgtccggccgtccggtccctgaaggtggggcaccttccccaaaaccgccccacggagccgtagggcctgctgcactttgtcccagggacacattcggcacgagcactgggtgaaggaggccgtcgtgagacgagtgcgccctggggcggcggcctcccgcggtggtgccggcgggtccgcctcccgcgcacccggtgaggagcgggccctgaccagcgtcgccgccggcgaccggtacgcgcgcgaacagcaggcgcaggagcacgcaggggagcgcggggcgcggcaggcgcacgacgggcgcgaggaaccggcggaactgccccggctgtggcacatcaccctccgggtctccggcgccggaaccccgctgcaggaggtccggcgcggcctggaacagctcgcccacgaccaccccttcctgctgaccagccgctacgccgacgaccacgccgagatccgctactgggaggaggcccgcgacctgcacgacgcggccgccgtcgccctgcgcctgtggggcgagcaccggcagagcgcccagctgccgccgtgggagatcgtcggcctggaggtcatcgaccgcgagacctaccaccagcgcctcgccgagggctacggcccgcccccggcgaccccggtcggcgtccaccccttctgaccgtcccttccgtcctctccgggcccttccgttccgtcctctccggcccctgcgtccggaccgtctcgcggccggccgcgagacggtccggacgca

SEQ ID NO: 2292 - DNA, 597 bp, Unknown
  Kingdom: Bacteria, Phylum: Actinobacteria, Class: Actinobacteria, Order: Streptomycetales, Family: Streptomycetaceae, Genus: Streptomyces
cgagcagccgctcggcctgggcgcgctggtgggcggccccggccgcgagggtgacgcccgccagggacatgaggatgtcgggcgcggacacgtcctcgcggaccgacccctgggtgacggcggcgaggcggaactcctcgaccgcgccggtcagttgctcgcgcgtctgcgaacccagccgctcatcgctccgcaggagtgtcttgagggtgtccgccatgccgtgtttggcggcgaggtagtccagcacctcggacatccacgcccgaagggcccggtcggccggcagttcgcgcaggagcggggcggtccgggcgcagagccgggccgtttcgtagcggtaggtggcgtcgacgagctgttcgcgggtcgggaagcgccggtacagggtggcgatcccgacgcccgcgcccttcgcgatctgcttcagggtcgcggctgtgccgtcccgcgcgaacgcctgcgctgcggcggcgagggtgatgtgctgcccacctgcgagacgtaccggatgggcgtgctggcctggagcccgctggccgggggctggctctccggacgccggcaccgcgacgcggccggcccggccagccaccg

SEQ ID NO: 2293 - DNA, 1398 bp, Unknown
  Kingdom: Bacteria, Phylum: Actinobacteria, Class: Actinobacteria, Order: Streptomycetales, Family: Streptomycetaceae, Genus: Streptomyces
cggacggctggccgaccggcggcccgggcgggtcgtcacggtcgccggtccggcactggccgtcggctggccggtcctcgccgtgtcggcggccgagccggccgctctgctcgtcctcgtgttcctgctgggcgcgttgtcgttcgcgctgggcggcacgctgatcgcgcgggtcctctacgaggcgccgcgggcgcccacgatgtccggtgcgtacgcgacggcggccctcaacgtcggcgccaccgccggaccgctcatcgccgcgaccgccctcggcagcgcggccggggacctcggaccgctctgggcgagcggactgctcgtcggggcggcgctgctggtcgcctacccgttccgcacagtgctcgctgcggcggacggccgcgcgggagagggccgatgaccggaacgcacccgctcccgctactcggcttctgctactcggcgggcccagcggccctggcgggcccggcgccctcggacccgcccacgcgcgcgcctgtgtccgcgtccgggtccgtctcggtccggctgacgagtcgctcgtagcgctgcctgaccgcctgcggggtggccaggccgaggccgaaggcgatctccggccaggtcataccgcgccccccgggccatcccgaggagccccacctgcagttcgtccatctcggcgcggcccagcggaacgaggctcagcgcggcggtgatgtcggcacggtcgacctcgggctcaccgtcctccgccagagccgcaccgctgagcaggaacgacacgagcctgatcgcctcgtgcgggcccagcagccgcgggtggacctggcagcggcgctgctcgtcggtggccgtttcaaggccccccggggaggcgggacggggactacggtggtcgccgtggactccgccctctccgggaccgaccgcgccgcgctcgccgcgcgggtgcgcgccgcgctggaagcatgctgcccggcgtcccgtacggagctgaccggttcgctgggggcgggcacggcggacgccttcagtgacatcgacatcatgtgggtggtgccggacgcgcggttcccggcctgcctgtcggacgcggtcaccgcgctggggcgcgtccagccggtcgagagtgtgcgcagcgacccggacttccatcattccgaccgccggcgcctgctgttcgtccgcttcgccgacgtgccgcttccctggcggctggacctggacgtccgtacggcctcggtggccggcgatccgcgctacgacgtcggcaacccggcggcccgcgcccgggacgacgagtggtcgcggcccgccagcgccctcgccaatgcgctcggtgcggtcaaggccgccgcgcgccggcgcgacgaagaggcccgcggcctgctggaccgcggtttcgcccgg

SEQ ID NO: 2294 - DNA, 1243 bp, Unknown
  Kingdom: Bacteria, Phylum: Actinobacteria, Class: Actinobacteria, Order: Streptomycetales, Family: Streptomycetaceae, Genus: Streptomyces
ggccgacgcgtgcccggcgaggcccatgcgctccagcagggcgccggcctgggcgcgggcctcggccttgccgacgccgtggcagcgcggcccgaaggccacgttgtccagggcggacaggtgcgggaagagcaggtagtcctggaagacgacgccgaccgggcgggcctcgggcgcggtgccgtcccactcggtcccgtccaggcgcaggtggccggcggtgagcgggacgagtccggcgagggcccgcagggcggtcgtcttgcccgcgccgttcgggccgagcagggccaccacgtcgccgggcgcggcggtcagcgacacgtccaggcggaaggtgccgcggtcgaccgtcagacgggcgtcgaggccctcaccggcggtgtcggtggcctgtgcgggccgggcggtgtcggtcatggggcgctcatccagcgtcgtccggcgtcatgatgcggtcatccagcggtcgcgcagcccggccagtacggcgatcgacacggccagcaggaccaggctcagcgcgatcgccgactccgggtcgttctgcagggcgaggtagacggccagcggcatggtctgcgtgcggccggggaagttcccggcgaaggtgatcgtcgcaccgaactcgccgagcgcgcgggcccaggccagtacggcaccggcggcgatgccgggcgcgatgagcggcagggtgacccggcggaacgcggtgaagcgggaggcgcccagggtctgggcggcctcctcgtagcgcgggtcggcggcccgcagcgtgccctcgacgctgatgacgaggaacggcatcgccacgaacgcctcggcgaggatcacgcccgtggtggtgaacggcagcgtgatcccgaaccaggagtccagccagcgtccgacgacgccgttgcgcccgagcgccatgagcagtgccacgccgcccaccaccggcggcagcaccagcggcagcgtcaccagggcccgtacgagaccgcgccccgggaactcgacccgcgccagcagccaggccagcggcaccccgatcaccaggctcaccgcggtcgccgccgtggcgcacaccagggacagctggagtgcctgccacacctcggtgctggtcagcagtccgggcatgccgcgccagggggcccggatcagcagcgccagcagcggcaggaccaggaaggcgaggccgagcacggcgggcaccaggagcggcaggggcgcgcccgccgaggactcggtgtactcg

SEQ ID NO: 2295 - DNA, 631 bp, Unknown
  Kingdom: Bacteria, Phylum: Actinobacteria, Class: Actinobacteria, Order: Streptomycetales, Family: Streptomycetaceae, Genus: Streptomyces
ggcgcctggagcagcttgtacgtggcgtccgcgcgcgtacggaagccgccgaaggtggtgtccatcgccgccacgaacgtctgtacgtccttgagcagctgaccgccgagcagtttgccgagcgtgccggtcatcatcgacatgccgacgttcaggaacttcatgcccgcgcgtccgcccagcttcgccggggcggtcagcagccggatcagccggccgtcgaggaaggaaccgagccgcttcggcgcgtccaggaagtccagcgccgagcgcgagggcggcgtgtcgacgacgatcaggtcccactcgtcgcgcgcccgcagctggcccagcttctccatcgccatgtactcctgcgtgcccgcgaagcccgccgagagtgactggtagaagggattggccaggatcgcggcggcccgctcggggtccgcgtgcgcctcgacgacctcgtcgaaggtgcgcttcatgtcgagcatcatggcgtgcagctcgccgtcgccctcggtgcccttcacccggcgcgggacgttgtcgagggagtcgatgcccatggactgggcgagccggcgggccgggtcgatcgtcaggacgaccaccttgcggccccgctcggcggcccgcagccccagcg

SEQ ID NO: 2296 - DNA, 740 bp, Unknown
  Kingdom: Bacteria, Phylum: Actinobacteria, Class: Actinobacteria, Order: Streptomycetales, Family: Streptomycetaceae, Genus: Streptomyces
ctgccaccgcccgtgccgcgccggcccggcgggcggtgcgggaggaggacgtggtcgtcgtcgcggcgcggcgggggacgcctctgtggcaggtcgtgcgggagatcgagacggcgttcgccgaggacggtccggccgggaccggcacgagatgatggtacgcagtgcctttacgtctggcactgagtgccataacctgtcgccgtgcacggtggcaccgcggaccgcgcacgggcgtgcacgggttcgccgcgcgcgcgggattccggcccagtgcagggagttgaccagcgtgtaccactcttcaggaaacgcgacgcgtccggcagccggctccgcgaccggccttctcgaacccgggtccggtgaccgggaggcgctctgcttccagcgctgcacctggtgcggcacggccatgtaccagcggctgctgtgtccggtgtgccggggcagcgagctgcgctccgagcgcagcgagggcaccggcacggtccggcacgccacggtggtgcaccgcaacacacccgccgcgcgcaatgtgtcgctgatagagatgagtgaggggttcgtcgtgcggggcagggtcacgggcccgctcatcggcatccacggcggcgaccgggtccggctgaccaccgcgcacgatccggtccgcggcgagccggtcttccacctgctggacgagccgttccgcgcctgccgagcggaccccagcccggcaggcgcggaacggctcgtcc

SEQ ID NO: 2297 - DNA, 988 bp, Unknown
  Kingdom: Bacteria, Phylum: Actinobacteria, Class: Actinobacteria, Order: Streptomycetales, Family: Streptomycetaceae, Genus: Streptomyces
gcctccgacaaggccgccgggagcggggcacagcgcggcgcccccgccacggcgaacgggggcggcggcgggcccgagggcagcggcacggcgtccggctccagggccaccgctcagccgaaggtcacggcgagccacatcgtccgcaccgcctcggtgaccgtggaggtcaaggacgtggcgagagccctcgacgaggcccgcacggccgccgagaacgcgggcggttacgtcggcgacgagaacaccagccgcgacgcggagggccacgagcggacccgggtcgtactgcgcgtgccctccgggaagtacgacgaggtcctgagcggtctggaaggcaccggcaagctcgtcgaacgctcggcgaaggccgaggacgtcaccggccaggtcgtcgacgtcgacagccgcatcacgtcgcagcgggccagcgtggcccgggtccgcgacctgatggacaaggcgggcagcctcagtgacgtcgtcaccctggagagcgagctgagccgccgcgaggccgacctggaggcactgctcgcgcagcaggcgtccctgaaggaccggacgagcctcgccaccatcaccctgtcgctgtccgcgacgcccacgccggtgaagaaggccgccgacgaggatgatccgggcttcacggacgccctggcgggcggctggcacgtgttcgtgaccatggtccgctggatcgccctggcactgggcgcgacactccccttcgccgccgcggcggcccttctcgtcgtggtgtggctgcgcctcgtacgcccccggctcccgcaccgccgggccgtcgcgccggcgatgaccgcgctgggaccgcccgggccggtggcgcccggcatcacggcaggaaccgggaccgaaacccccgaaggctccggggagacagaccaccgcgaaggcaccgctcccgctcagccgtagcgtgggtgcatgaccatgagcaagagcaccggtacggacacgagcgggg

SEQ ID NO: 2298 - DNA, 863 bp, Unknown
  Kingdom: Bacteria, Phylum: Actinobacteria, Class: Actinobacteria, Order: Streptomycetales, Family: Streptomycetaceae, Genus: Streptomyces
ccgactacgcggcctggcagcgcgccgagctcgcaggtccgggcgctgacgcccacctggactactggcgcgaccggctggcggatgccgaggccaccgacctgcccaccgaccggccccgccccgccgtccgcgaccacgcgggcgccgacctcgacttcgaactgcccgacggcctcgccgaccgggtccgtgagacggcacgcgcccacgacaccacaccgttcaccgtgctgctcaccgcctaccaggcgctgatcgcccggtacaccggcaggcgggacgtgcccgtcggcaccgtcgtctccgggcgcgggcgaccggaactgcagcagctcatcggctactgcatcaacaccctcgtcctgcgcgcccgatgggacgagaacgcgaccttcggcgggctcctcgccgccggccgccaggacatcctggacgccttcgaccaccagcaggtgccgttcgcccagctcgtcgacgagctccagcccgagcgggaccagtcccgcacgccgctctaccaggtcgccttcaccctgcacgagtggcgcctggactccttcacgctgccggggctgcgggccgagccgttcggcgacagcgacggcatcgccaagtgcgacctcaccctccaggtgcaggagctgcccggcggctcgctcaaggcgcgcctccagtacgccaccgccctgttcgaccggtcgacggtgcgccgtatcgccgacaacttcgtgcgcctgctcgaccaggtgctgagcacgcccgacgcccccctcgccgccctcgacgtcctgggtgacgccgagcgcgccatcgtcaccggtgccctcgacggcacccgcccggccgagcccgtcaccgtg

SEQ ID NO: 2299 - DNA, 652 bp, Unknown
  Kingdom: Bacteria, Phylum: Actinobacteria, Class: Actinobacteria, Order: Streptomycetales, Family: Streptomycetaceae, Genus: Streptomyces
cgccgcccagatcgccatgcgccaggtccccgaccgtccgttcgctctgttcggccagatgacgaccgcggacccctcccgctccccgcgcggcaccgagtccgcctgggcctacacgcacgtcccccgggaggtcaccggggacgcggcggacgagggcctgaccggcgcctgggacccccgggaacaggagatcatggccgaccggatggaacggcaggtcgaacggttcgcgcccggcttccgcgcgacgatccgcgcccgccggatcctggccccgcccacgctccaggcgctcgacagcaatctcgacaccggctccatcaacggcggcaccaccgcgctgcaccagcagctcgtgttccgtcccgtgcccggcaccggacgccccgagacaccggtggccggcctctacctcgcctccgccggagcccatcccggcggcggtgtccacggcgcgccgggcgccaacgccgcacgcgccgcgctgcgccgcaggctcccgccagggctctcgcgggcccagcgcgccctggcgcaccgcgaccgcgcgggccactggacgacaacggccggcggctgacccgcgggcggaccggacggaccgggccgggcggagtgggccgggcggagtgggcggctggggccggac

SEQ ID NO: 2300 - DNA, 565 bp, Unknown
  Kingdom: Bacteria, Phylum: Actinobacteria, Class: Actinobacteria, Order: Streptomycetales, Family: Streptomycetaceae, Genus: Streptomyces
ccgggacgcgcagcctgccggacgcgtcgatgtcggcggtgcggatcaggatgggggagtccagggtctgcgcgccgcccgcgtcccggccgagcagcgccagcgcgcccgcgtagtagccgcgcccgccgacctcgtgccgttcgatgacccggcaggcgttctgcaccggcgacccggtgaccgtcgccgcgaacatggtctccctgagcacctcgcgcacgtcgagcgaggaccggccgcgcagctcgtactcggtgtgcgcgaggtgcgccatctccttcagccgcggcccgaccacgaccccgcccatgtcgccgacggtgcacatcatcttcagttcctcgtcgacgaccatcgacagctcctcgatctccttgccgtcgtcgaggaaaccgagcaggtgctcgggggtcggcccctcggcggggtagcggtacgtgccgctgatcgggttcatgacgaccgtgccgccggacatgcgcacatgcacctcggggctcgcgcccaccagcgtccgcccacccgtctcccgcccccgcccttccggggaaggcccttcggg

SEQ ID NO: 2301 - DNA, 702 bp, Unknown
  Kingdom: Bacteria, Phylum: Actinobacteria, Class: Actinobacteria, Order: Streptomycetales, Family: Streptomycetaceae, Genus: Streptomyces
  misc_feature (291)..(437): n is a, c, g, or t
gtgcgcaccgccttccgcccccggccgaccacctccagcgcgacggcgagctgggccgggacgatcgcggccggcagggcccggccccaggagtagtggccgctgacgaagcccgccgtacacaccagcgcgcccagcgcgaagaacagcgccagcggatcccaccggtcgcgccgccagcgcaggaccagcgcggccacaccgagcagcaccagccagtaccggcccgcgaagtccgtgtacagcgcgcggtgcacgccctccaggtcacgtccggcggcgaacagcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccatggcgagcgcgcccagggtcgcgacgatcccggtgaactggtggcagagcaggatcaccgcccacagcaccccgagcccgagccacacatcccacccggccggcgcgcgcagtgaccgggtgagccacgcccagtggtggaaggccatgccgagcgcgaacacactcgggtaggagaccgtcagcgcgagcgagttgagggagacgaagccgctccagttgatgagggcggtgccccacagcagcaccaggctcagcgcg

SEQ ID NO: 2302 - DNA, 1400 bp, Unknown
  Kingdom: Bacteria, Phylum: Actinobacteria, Class: Actinobacteria, Order: Streptomycetales, Family: Streptomycetaceae, Genus: Streptomyces
tccggtgtggtggttgcggcggccgtgggggtgtggggcgggcgcggggtcctggtgcgcagggcggtgggccgcgcgggcggtttccccggccgggcagggcccctgcccgggacggccgccgcctcggcgtcgaccagttcgccgatacgggtcccggcccggcggccctccaggtggaggcggcccacgttgacacggtcctcggcgagcagcgtcagtacggcgccgcggcccgccgcgtacgtggcgacgtagccctgcacgccccgtacgagcagttcgcgcagctcgccccggccggtcacgtccgccagccggacggccacgcccagcgcggtcgcggtgagggccgccacgccctccggttccacgcccggggtgtcgtgggccaggacgagaccgtcgacgctcgcggcgagggcgccggtgagctgggggacgcgggccctcaaccgccgcagttcctccaggatctcgggctcggctgccatccggtgtctcctctcaaagggcctccagcgcatccctgagcctcttcagcagcgtgatgtgggggtcggtgccggttcccggcggcgtgagccaggggtccgccggaccgccgggcgtgggggacgtggaaggcaggggcactgtgtccgcccgtccggtgtccatcggttcaccggccaccggcgccgcgtacggatccggtgggccgggcggtgggtccggccgcggctgcggtgcgacgaggcccgcggcggccaggcgccgcacgtccaccagcgtgtggaacgcctgacgtcccagttccctggccagctcggtggcggtgcggatgccgtcgacacggtccagcagtgcctgctggcgaccggtgagccgcggtgcggcggtggcggacgtccgcagcagcggggcgctgtccggccgcgcgtcgggccagatgcggtccagcagttggcgccggcgcagggtctcgcgttccaggacgtcgaccgggaccgtcgggacggtgccgggccggtgggcggcgccgtagcggaaacggcccggcgtgctgctcggcgcgaggacgaagtaggcggcgtcgtagagcgtgccgaggtggcacaggtgcagggcgccctcggtgaggcggccgtcggccagcaggacctgcgcggctcccggatggtggccgccggcccgggcgacggcgtcctgccagacctcggggcgcagtgtgccgtgggtggtgagcaggatgtccaggccgggggccagcgggctctcggcgtgtgtcactcgcccctcgtcgaggtggagcgtgccgcgttcgcggacgaggaggccggtggcccgctcggccgcgaggcgggtcagcatcggtgagacgccgccccaggcccgctcggtgtccgccctgtcccgca

SEQ ID NO: 2303 - DNA, 950 bp, Unknown
  Kingdom: Bacteria, Phylum: Actinobacteria, Class: Actinobacteria, Order: Streptomycetales, Family: Streptomycetaceae, Genus: Streptomyces
ggttcgccgcgcccgccggccagccgccgcgcccacgcgccgagcccgccgcgccagcgcaggccctgcggcacgtcggtcccgcggacgggcgtgcctttgcggccgccgccgtcgaacgtgccgtcctggtccgcgtaggcaccgaggtgttccgcgaccccggaccggcccgcgtgcgtgtccccgtcccggctctcgatccgcggtgcgcggccctgcgggggcacggtgtgcggatcggcggcctccacgggcccgcgctgccaggtgtgcggggctgctccccgggcgtttccggagccccaggcggcggtgccggtcaccgatgcggtcgccgccgtccccgtgtccgcacctctttccgctcccgtacggccccgggaccgcgcctccgtaccgtgcgcgcccggccgtacgtccgtgtccgccgagtccgccacgcgcgcgtggccctcgccgtccggtgccgtccccaggcgtgccgccggtcccgcggacggggtcagacgcagcacggactcgccgatgcgcagcagcgcgcccggggcgaagcggaccgggcgcgggtccacgggccggccgtccagcaccgtgccgttggtggagccgaggtcggcgaccgagacgcggccgtcgggggcgacggtcacggcgcagtgcacgcgggagacgtcggggtcgtcgagcgggacgtcggcgtcggcggaccggccgaccgtgatctgcccgccgtgcagcagatggacaccgcccgcgtccgggcccgcgatcacgtgcagctgggtcggggcctcgtccagctcggggtgcggctcgggctgggcgggggcgcccagggacagcaccgcgccgtcgaggagcgggggctcgccgagcgtgcagcgctgggcgtcgagccgctccgtgcccgcgtacagcaccaccgggccggcgccgggctcccggcc

SEQ ID NO: 2304 - DNA, 2186 bp, Unknown
  Kingdom: Bacteria, Phylum: Actinobacteria, Class: Actinobacteria, Order: Streptomycetales, Family: Streptomycetaceae, Genus: Streptomyces
caccagcaccgacagcacgtgccgcccgccggtgcgcagccgctccggcacggcgaggacggcggtgtccgtccaggtgccccggccggccgtgtccgccttcggcaccggcatgcggtgcgtgcccagcggctccccgtccagccacgccatcagcagcccctgcgtgcccgtgctgtgcgccagcgacaccgactcgatgccggacgcgtccgtgaaggtgccccggtaccagacgtcgccgtaatggaagccgtagtcgtcggcgaacagcaccggctgcccctcgggcacggacgtggtgctggacgaggacgttctgtccgctttcggccaggacgagtcgtcgaaaccgggcgcggactcggggttctccgtgcgcgcccgccagccgcccagcgcgggcagctccaccttcggcgcgccctccagcggcgcgagcgagcgcaggctgccggtgccggtcggggcggtgcgcaccggacggccgttccacgtcagcgccgtcacgccctgcggcgcccagacctccagcttcgcggcctccacggtgtcaccggtgaggtgcagcacggcgccctccacggtcgcggtgcgcagcaggctcggcccgcacaccagcaaggaccccgacggagtctcgtacggccacagccgcgaggacgtccggtcgtcggcgaacagcatcagcaccgcccggtcgacggtctcgccggcctccacccgcgccccggccagcccggcgccgaacggcacggtgatccgcaccagttggcgctcgtacacgtacgcgacctgctggctcagccggctgaccatcggctcaccggccgcctccagggcgacgcgcgccgagtcgccgcgccgcccgcagaacaccacgatgtcctgccggccgacggtgaggtaggtcatgggctgtgcggtggagtaccgcagcttcagcagccccagccgcatccgggtgaccgcgagccgcgcgtccccggccgccacgctcaccggcaggtcctcgcccgccgcgggcagcgtggtggtgacgtccttgccggtgtcgttgcgcaggacgtgcacccgggcgcccgtgtccgggttgcgcaggtggtacgtggtgagcccgcgcgcggtgccgccgctcgcccggtccagcttggcgaggtcggggacgtagcgcagcatgtggccggtctggtgcgtcgccaccgccttgtcggtgacctgccgtccctcgtcgatcgcggcaccgtagtcgtacgacgtgtacacgtccggcgcgggcagccagccccaggaggtgccgccgaaggccatgtacgtggtgtgcagggcggtgccgcgggcgaggtcggtcagcagggcacgccgctcgtacgccgcgtcgtgggtgcgccgcgcctcggcgtaccccttgccgccgaaagcggccccgccccacgggtcggccccgccgccggacgccgccaggaaccccgacggccgcgggaaggacgccggaacccactgtccgctgccgtcgccgtggaagagcggcacgtcgatgccgtcggcgcggactttctggtacacacgggacacggtgccggcgctctgagcggccccgtcggccccatcctccagctggtacagcagcacggtcccgtcacccttggtgaacaggtgccgggcggcgatggcgttcacccgtccgagccactcgtcggcgtgcgcgcggtaggcggggccggcggtgtccgcggtgccgtcggccgcgctcagccagccgggcagcccgccgccgtcgacgtcggcgccgatgtacggacccggccgcaggacgacgtacagccccgtctcggcggccgtgcgcaggaagagaccgaggtcccgcactcccgtgaagtcgtacgaccccggcgcgggcgagtgcaggttccaggccaggcgcacgctgaccgcgttgtggccgtgggcccgcatcttctgcagcacgtcccgccacagcgaggggctgggcagccggaacgggtgcatctcaccggcccacagcaccagccgcctgccgtccaccagcagcgagtagtggtcgtagccgacggtgtggcgccgcccgtcggcggccgggacgggcggcggcggacccgtcggcaccccgcgcgccgcgaacgccgccggggcccccggcccgccgctgccgcccagcgcgagac

SEQ ID NO: 2305 - DNA, 1144 bp, Unknown
  Kingdom: Bacteria, Phylum: Actinobacteria, Class: Actinobacteria, Order: Streptomycetales, Family: Streptomycetaceae, Genus: Streptomyces
ccgccggccgcgccgctcgcgccgacccggccgccggacgctcggccgtccgtacgctgctgcgcctgtggccgtacgtacgaccggtgcgcacgcggctgtccgccgccgcgtccgtcgcgatcgtcgcctcctgcgtggggctggtgatcccgctcgtcctgaagtggctggtggacggaccggtcgccgaccgggaccagggcggtgtgtggctgggcgcgctgtacctgctgctgctcggcatcgcggaagcactgctgttcgggctgcgacggtggctggtggcgcgcccgctggcgagcgtcgaggcggagatgcgggccggactctacgggcatctgcaacggctgccggtcgccttccacgaccgctggtcctcgggccagttgctgtcccggggcacgaccgacctgatgctgctgcgccagttcctggccttcccgctgacgttcctgctcgtcaacggcgtgacgatcctggtgggcgtcgtcatcatgctgctccaggactggacgctgggcctggtgatgctggcccccgccctgccgctgatcgtgctgagcgcgctcttcgagacgcggtacgcgcgggtggcgcggctggcgcaggaccaggtcggcgacctgaccacggtggtcgaggagagcgtgctcggcatccgcatcatcaaggggttcggacggcaccgcagccaggcgcgtgcgttccgcgagctgtcggccaccctgcgcggcaccgaactgcgcaaggcacggctgctggcgaccatctgggcggtcatcatgtcgctgcccgaggtggccatcggggccacgctggtggtcggtgccgtacaggtctcggacggctcgctgtcggcgggcacgctggtcgccttcctgtccacggcgctcgccctgcggtggccggtggagtcgatcggcttcctgctcgcgatgagccaggaggcggcgacggccaccgagcggtacttcgaggtgatggacgcggaaccggagaccaccgggccggacgccgtgcccacgggcgacacgaacgacggcgccgagccggacgaagcgcccgcaggcggcaccaccgaccccgggccgggcggtaccaccgccgacgccgagcccgtgggcctgagcatgtacgggac

SEQ ID NO: 2306 - DNA, 573 bp, Unknown
  Kingdom: Bacteria, Phylum: Actinobacteria, Class: Actinobacteria, Order: Streptomycetales, Family: Streptomycetaceae, Genus: Streptomyces
gcctcgcggcgggcccgctcgacctccgcgtcccaatggtcccgggtagcgccgggtggcttgcgcagggcgtggaaggacacccactgtcggcgcatgaggtcgtggaaggagccgtaccgctccggtccctcgccggaccaggaggcgagccagtacgccgcccactcgccgtcctcgtccacgtcgtccgggtcgagcagcatgaccgccgcgtcaccctcgagggacaggcgcagggagcgcgcgaggatcttcgcctcctggaccccgaacgcctcctcaccgtcctcgtcctccgcgaggtcgtcctccgcgaggtcttcccagacctcgatccaggtgcggtcgtcggtgtcgcgcagccattgcagctccgcggtgcccgccagccggtagatgaagtgacccgcgtcccgccacccgtcggtgacgagcaggaactcccgcagcgaaggcggcagccggtgcccgagccgggcctcggccgcggcgacctcggcctcgctcgccggcgcgaaccccagccaggtatcacgcacgacctccggcgcgagcggcgcgtccttctcc

SEQ ID NO: 2307 - DNA, 1637 bp, Unknown
  Kingdom: Bacteria, Phylum: Actinobacteria, Class: Actinobacteria, Order: Streptomycetales, Family: Streptomycetaceae, Genus: Streptomyces
cccgagctcttcgagcagggggcccagagcacgcacctgacgccgcgcggcccgccctgagggggcggcgggaatccgacgacaggcccctgcccgcgaccgcacccgagtcaccgctcccacggcagcagccgcccgaccgcaggggccaccgctcccgtggcagccgctcctcccacggccgctcaccggaccccggtcggcaagccccggctgcccgtgcgcccctcgcgctggccggatccgaaccgtcgtcatcacgccacgcgcccgaaggatccgctgccgactcgcggtcagcgccgcaagacgtccctctggaaccgcttctgacaccgtgttctccggtgtgtccggtgcgcgccgctcgccccatcttggccgaaggccggaaaagccctatattgcggatacctctgccgggtcgtgcggcgccgtgtcgccgtggacgggggctgcccgcggaggtgcggccgaatgtgcagcggaggccccggtgagcgtcacccagcgaatcgagcgcggcacgcggcacggcccgtacgccccgtccggcatccgcttcgccacggatccggccatgaactggcgcgagcacggcgcgtgccgcttcgaggaccccgagctgttcttcccgctcggcgaaggcgtcctgtcgttgcgccagatacgccaggcccgcgcggtgtgcctccggtgtcccgtgctgcgcgagtgcagggcctacgccgtgcgccacagcgagtacgacggtgtctggggcggcatgaccgcgggggagcgccgggccgcggcgcgcggcaggagcgggaacggcggccggtgaaggccggcggcccgccgtcgatctccgggtgatccaccggaaatcgactgaatctggtcaatcatgtctcgcgcggcggtcggcatgcatggcacggcgtgcctggggcatacgcagcaaaaaatcgagagaggggcgctccgtgctggttccggacccgaagatcgtcaggacgttgctgacccggtacgcatcactgaagatcgcacaggcggagagggagcgggccgagacggcccgtgaactggaggacgtgagctacaccttgtgcgtcatgatgggcgcgaccagcatccacgaggcgatcgtccgggcggacgcgctgctgctcgccaccggccgggcagcggacgtcgccacggacacggacggcgacagcggcctgtcactggccgtctgaccgcccggatcacccgggagcggggacgcccgcggcactccttggcaccgcgtgccgacatgcgaggcggtcacgcgggtcacgaggcggccacggacgcccccggccgggccagccactcggcgatggtccgggctatcggctggccggtctccacctcgacgaacccgaactgcccggactggttgcactccaggaaccaccacacgccgtcggcgtcctcggcgaagtcgaaagctccgtaggagagttcggcttcctggagatagcgccggacggccgcggccacccgtggcggcacctcggccggcagccacggcgtcccggccggtgcgaagcggacgtcgacatcgtccgggtccgcgtccgcgggcgtcgccttgcgggcggccagcagcgtgtcacccacgg

SEQ ID NO: 2308 - DNA, 629 bp, Unknown
  Kingdom: Bacteria, Phylum: Actinobacteria, Class: Actinobacteria, Order: Streptomycetales, Family: Streptomycetaceae, Genus: Streptomyces
acgccgatgcgcaggccgggacgggccgcgtcggcgctgcggtccggctgcttcccggccgaggtgcgcacggtcaggcggggcacggtgtagacacgggcgccgagcaccagttcctggttgcggtacggcgacgggccgaacgcggagacaccggcgcgcgcgggcccggcggcgccggaggggcggacggtcaccagcgcggggacgtcctggcgggagacggtgagcgggctgtggtcgcgcgggttccagtgctggtgctggtcgggcggtgagtgcacgcgggcgccgacggagaagatcgcgtccgtgacggcgttgtccaggctttgcaggttgcggccgcgggaggtccagccgtcgccgagtgcggtcagcatgcggctgaggacgtcggcggtgaggctgctgtagtactgggcaccctggccgccgaccatcatcgggtcgttgcccacggtctgctcccggcccgggtcggtgcggtagcggggccagtcctcggcccgcgcgatcgcgtccgcctgccgctgctgccgcgctccccagggcgcgtagtcgtccaggtgggccagccgcagccgcgtcgccacggcggaggtggcggtggcctcgcccagctggac

SEQ ID NO: 2309 - DNA, 622 bp, Unknown
  Kingdom: Bacteria, Phylum: Actinobacteria, Class: Actinobacteria, Order: Streptomycetales, Family: Streptomycetaceae, Genus: Streptomyces
cggcagcacgatcgtgtcgcccgcctgggcgccggtgacaccgggggtgtccggcagcgcgaaggtggcgacgcccgagccggcggcggcgagcagcgagtcgacgtggccgtggtagcagccggcgaacttgaccaccttggtgcgctgcgtgaacccgcgggcgagccggatcgcggacatggtggcctcggtcccgctggacacgagccgcacctgctccagcggtccgacccggccggtcatctcctcggcgagcgcgacctcgccctcaccgggcgtgccgaaggacgtaccgcgcgcgacggcgtcctgcacggccgcgatcacctcggggtggctgtgcccgaggatcatcggcccccaggagcagacgaggtcgacgtactcccgcccgtcggcgtccgtcaggtacggcccgctgccggacaccatgaaccggggcgtaccgcccacggcacggaaggcacgcaccggcgagttcacgccgccgggcgtgacggccgccgcacggtcgaacagcgcctgggaggcgggggcttcgtatgggtatggcagttcgctcatgacctgcgacttctccgacttctcggttctctcggggctcggggctcgggctttt

SEQ ID NO: 2310 - DNA, 538 bp, Unknown
  Kingdom: Bacteria, Phylum: Actinobacteria, Class: Actinobacteria, Order: Streptomycetales, Family: Streptomycetaceae, Genus: Streptomyces
cctgggcggtcaggcgcagggagaacagcttctggctgaccgcgtcgtgcagttcgtgggcgaggcgggagcgctcctcggcgatggtcagctcgcggctgcgctcgtagagacgtgcgttggtgagggcgatggccgcgtgctgggcgaggatggcgagcagttcctcgtcctcctcggtgaagccgcagctgccctccggtttggggcagcgtttgttggccaggaacagggcgccgatgacctcgtcgccgtcgcggatgggcagcccgaggaagtcggacatctcggggtgggcggccggccagccctcgaagcgggggtccttgcgcacgtcggccaggcgctcggccttcgcctcgtggagcatggcggcgaggatgccgtgctggcgcgggagcgggccgatggcgcgccactgctcgtcgctgactccgtcgaccacgaactgtgcgaagccgccgtggtcgtcggggacgccgagcgcggcgtactgcgcgtcgagcagttcgcgggcggaggcgacgatcgtcttgag

SEQ ID NO: 2311 - DNA, 504 bp, Unknown
  Kingdom: Bacteria, Phylum: Actinobacteria, Class: Actinobacteria, Order: Streptomycetales, Family: Streptomycetaceae, Genus: Streptomyces
acacggcccatgtcgacggcaggaactgcatcggccccaccgcccggtcgtacaccttgtcgccgtcgtacacaccgccgtcggtgtcccggaccagcgcgaagcccttgccgtcgagcgccgggccggtgatgcggcccagcgtcgtgccctgccggtcgaccgcgccgccgcgcgcatggccggactccaccttgccgatcgcggcgagcagttgccagggcagccggcagccggggtcggtccgggcgacggaccgctcggccgtccggtaggcgcgcagcacggtgcccgggatgccggactcggccttcacctcggtcacctgatagggcgtcagaggcgcgccgccggtggtgatcaggggcgggagttcggtgtggtacgagccgtcgccgggcgacccgggtgcggggatgtacgggaaggcggcgggcggggtgcgctccttgtcggccgccgggcggccgggaccgctcttggcggccgccgcccccatggcgc

SEQ ID NO: 2312 - DNA, 715 bp, Unknown
  Kingdom: Bacteria, Phylum: Actinobacteria, Class: Actinobacteria, Order: Streptomycetales, Family: Streptomycetaceae, Genus: Streptomyces
ccgtgccgccgtactcgtcgacgacgaccgcgatgggctgctcgctgcgcaactgggcgagcagcggctgcacgggcagggtctcggggaccagcagtgcgggccgggcgatgcggccgaccggggtgcgcagccgttcgtgcgcggggacggcgagggcgtccttgagatgggccatgccgaccacctcgtcgatcttctcctggtagacggggaagcgggacaggccggtggcccgggtgaggttgaccacgtcctcggcggtcgcggagaactgcagggcgctgaccttcacgcgcggtgtcatgacgtgctgcgcggtcaggtcgcccagggacagggtgcggacgaacaggtccgccgtgtcctgttccagggcgccggcctgggcggagtgccgggccagcgagaccagctcgccgggggtgcgggcggaggccagctcgtcggcgggctcgacgccgagagcccgcaccagccggttggccaccgtgttcagggcggcgatcaccgggcggaacaggcgcgagaagtggtgctgcgggccggccacgaagcgggcgacctgcagcggccgggagaccgcccagttcttggggaccagctcgccgaccaccatctgcagggcggaggcgagcagcatgccgacgaccacggcgacgccggagacggcgccggcgggcaggccggtcgcggtgagcgggccgtgcagcag

SEQ ID NO: 2313 - DNA, 1716 bp, Unknown
  Kingdom: Bacteria, Phylum: Actinobacteria, Class: Actinobacteria, Order: Streptomycetales, Family: Streptomycetaceae, Genus: Streptomyces
cccgtgccgggcgaggagttccgggtggaggtcaccggcccctccgggcaggtgtgggcgtacggcccgggggacgccgcccagcgggtcaccggggccgccctcgacttctgcctgctggtcacccagcgcgcccaccgcgccgacctcgccgtacgcgccgaggggccggacgccgacctgtggctggacatcgcgcaggcgttcgccggaccgccgggcgccgggcgcgcgccacgggcgggtgacggggaggcgacggcatgaccctgcgcataggcaacgcctccggcttctacggcgaccgcttcgacgcgctgcgcgagatgctcaccggcggggaactggacgtcctcaccggtgactacctcgccgagctgaccatgctgatcctgggccgggaccggctcaaggacccggacgccgggtacgcccggaccttcctgcggcagctggaggagtgcctggggctcgcgcacgagcggggcgtgcggatcgtggccaacgcgggcgggctgaaccccgccgggctggccgggcgggtgcgggagctggccgggcggctcgggctgccggtgcgggtggcgcacgtcgagggcgacgatctcacggcccgccaccccggcagcctcgccgcccacgcctacctcggcggcttcgggatcgccgcgtgtctgcgcgcgggtgccgacgtcgtcgtcaccggccgggtcaccgacgcgtccctggtcaccggcccggccgccgcgcacttcggctggcagccgggggagtacgaccggctcgcgggtgccgtcgtcgccgggcacgtgctggagtgcggcgcgcaggccaccggcggcaactacgccttcttcaccgaccacgccctcgaacgcctcaggcgtcccgggttcccgctcgccgagatccacgccgacggcagctgcgtcatcaccaagcaccccggcaccggcggcgtcgtcgacgtcggcaccgtgacagcccagctcctctacgagaccggcggcgcccgctacgccggtcccgacgtcaccgcgcggctggacaccgtacggctgagccaggacggggcggaccgggtgcgtgtcgacggcgtgcgaggcgaggcgccgccgcccaccctcaaggtgggtctcaaccggctcggcggattccgcaacgaggtcaccttcgtcctcaccggcctcgacatcgaacgcaaggccgacctcgtgcggcagcagatggacgacgcgctcggcgccgccaagccccggccggccgaggtgcgctgggacctcgtgcgcaccgaccggaccgacgccgacaccgaggagagggcgagcgcgctgctccggctcgtcgtacgggacccggatccgcaggcggtcgggcgggcgttcagcggggccgccgtggagctggcgctcgccggataccccggcttccacgtgctcgcaccgcccggcaagggcgcgccctacggcgtcttcgaggccgcgtacgtcccccaggacaccgtccagcacgtggccgtcctccacgacggccggcgtatccccgcgccgccggcgcacgacacgcgcgccctggaggacgtacccgagccgcccctgccgaagccgcttcccgcagggccgacccggcgcgcgccgctcggtctggtcgccggggcccgcagcggggacaagggcggggacgcgaacgtcggcgtgtgggcgagccaccgccagg

SEQ ID NO: 2314 - DNA, 691 bp, Unknown
  Kingdom: Bacteria, Phylum: Actinobacteria, Class: Actinobacteria, Order: Streptomycetales, Family: Streptomycetaceae, Genus: Streptomyces
ggtcggtccgcgcgggccggtcttcgcggcgcggtgcgggctccacggcccgcgcggaccgaccagcgccgtgcggcgtccgcgccacaacccgcggggacctgtcatcgctgtgcggtgacgtccgccgcccgccgcgcggaccgggtccgccgcggaggggagccgcgaccgctggacggcggtccggctcggacgggagtcgaggtagcggcgggcgccccagccgagcaccgtctcggcgagcaggacgtccaggccgccgtcgaagtggccgagctgctccacggcgtcgcggcagtgccggcacgcccgcagatggtgctggacttcgggcagcagcgcggtgccccggcgcagggggacgtcgaggagacggttgtgcaaacggcattctctggtcggcgcgagttcccggtgcgcctggacgcagcccgcccggaattgttcccgcgcctgttccagcaaagccgccgcgctctcgggatcgacggccagcagaccggccggtacggttatgggttcggcctcgacctcggtatgccacaacaggcattggaaggaaccgggaaggctttggaaagccctttcggcgaggtgtcgcttttcgggcgtcacggacctcaccgcacgcagaccacggcctcccgagggcctgttcagttccggcagcacggcgcaggccgcggcg

SEQ ID NO: 2315 - DNA, 509 bp, Unknown
  Kingdom: Bacteria, Phylum: Actinobacteria, Class: Actinobacteria, Order: Streptomycetales, Family: Streptomycetaceae, Genus: Streptomyces
gcgtcctccagtgcctggcaggcgccctgggccgcgtagtgcagcatgggatgggccgcgtcgcccagcagggccacccggccgtccgtccagtcgtccaccgggtcccggtcgacgagcatccaggacttccagtcctcgccgagccgcaggaggcgctgcggggcgtctccggcgagccccgcgagccgggcgagcacctgctcgccgggcacaggcacgccggcgaacgcctcggtcaggccgccgtcccagctggcggcgaggttgaggctggtgccgcccgcgatcggatagtgcacgaaatggcatccggggccggcccaccaggtgacgttgtttccgcggaactcgcgcggcacctggtccatgggcaggacggcgcggtacacgctgatgccggacacgcgcggcgggccgtcgccgacgagcctgcgccgcagcgccgagtggatgccgtcggcgccgacgacggcgtcggccgcgatccgccggccgtcctccaggac

SEQ ID NO: 2316 - DNA, 1083 bp, Unknown
  Kingdom: Bacteria, Phylum: Actinobacteria, Class: Actinobacteria, Order: Streptomycetales, Family: Streptomycetaceae, Genus: Streptomyces
gggcatcggcggatcactcctttactcgggcggggtcttggcggcgcgctcggcctgctccaccagttccgtcagatacgtcgcgatgtcggcggcggcgggacggttccacagcagggtgggcggcagcgggactgccagacggcgttcgaggtcggtgcggaaggcaacggcgcgcagggagtccagacccagatcggacagggcgtgatgggcggctatgccggcgggttcgccgccgaggacgcgggcggccgagctcctgacttccctgagcaggacgtcgtaccgacgccctgcgggcagctgtcgccacgacgggccggggacggctcccccggcggggcccgccgcctgtgcggcccgtgcccgcacctctcgcaggagcggcggcgtcaacggcgggatcccgtccgaagctcctggttcggccaggcggaacacagccagctcgccgtgcctgccggcatcggcgccgccccatgcttccagggcctcctccccgtcgagggcgtccgtgccccggacccgtagctcggcggtcacggtttcggcgtcggcgtcggccgccatccccagtccgcgccagctcgtccatgccagcgacaacgtgtcgcggtgtccggcggcccggcggtgcctggcgagcgcgtcgaggaaggcgttggccgcggcgtaagggccctgccccggcaggtgcagcagttggccggcggacgagtacagaacgaggaagtccacgctgccgggagggaagaggcggtgcagggcgagcgcgccggttgtcttggcgcgcatcacttgctcccacaccggcgcgtcggcgtcgggcagggggccgccggcggcgacgcccgccgcgtggacgaccccgcggaccggtggcaggccgagcgcatcggggtccagggcccggcgcagggccgcctcgtcgcacacgtcggcggccaccacccgtaccgtcgtcccggtctgctccagcgcccgtacggcggcgacgcgttcggcctccgctccgggcggcaggccgtcccagccccggcgcggaggcagccccgtgcggccgagaaggaccagtcggcg

SEQ ID NO: 2317 - DNA, 633 bp, Unknown
  Kingdom: Bacteria, Phylum: Actinobacteria, Class: Actinobacteria, Order: Streptomycetales, Family: Streptomycetaceae, Genus: Streptomyces
tcggggtggcgcagcagcgccgcggccgagcggacccgctcgtcgggggtgagcaggcgccggaactcgaccggcaggtgcgccgcacggccgtcgtcggtgagcgcggccaccgcccggccggccagcgcggggtcggtgagcaggcaggccgcccagctcgccacgacctcgtccacccaggtgcgccaggcgtacgtgtccgggtcctcggacccggcgccgtccgcgccggtgacccagtccaggcgggcggaaccgccggggcccgacatgccgaccagggcggcgtccatgggggtcgggtagcgcagccaggccgcgaccgccaccgcctggcgtgcctgcatctcgcacagggcggacgcgagcgcgccgcctgatgccgggtaggcggcggtcagccactgggcggtcgccgcgatgaggggggagagatcttcgagcactgccgggccgttcgcactggttcacggacacagggactacctggaaccgtagtgcgcggcccgtgccccgcctatggcgcaggcctcctccagggcgtggccttggccacagcgtgagcatgcggcgggggccggccgggaggaggcccggtcatggcggggcaggtgcgggtcgggctcccgc

SEQ ID NO: 2318 - DNA, 2868 bp, Unknown
  Kingdom: Bacteria, Phylum: Actinobacteria, Class: Actinobacteria, Order: Streptomycetales, Family: Streptomycetaceae, Genus: Streptomyces
ttccccgtggcccggccgccagccgcggtccacggccagcagcaggtcggcgtccagcagcgcgtcgcccgccccgagcaccaggtccgccccggtgcgacgggcgacctcgcggacggcggcgcccttggtgagcggcttgggaacggcgtagaccttgcggccctggagcgagaccgtccagccgcgctgctcggcccactccaccagctccttcacccactgctcgggcagcagctcgcgctccacgacgaggtaggcgaacaggtcctcggcggtccggtgcttgcgcacccaggcggggtcggcggtccgcagcaggtgctcgcgcacctcctccagcggcgcgcactcctcggcgagccggccggtcacccgccggtgccagtcggcgtcggacacgccgtcgaccagcaggtggccgccgttggcgcagaccgcgtaggccggggccgggccgggcaggctgacgcgcaggtactgctcgcgggtccgggtcgtggccggcacgaacagcgccgcgtcaccgccgggtccaccgagaccgcctggttcgccgggtccgccgagttcgccgagcagtcgcgcggccgtctccgtcatgaacgacagcggcctgccctcgtacacctccacgcacagcaggcgcggtgcccgctcgtccggcacggtcagtgccagcgcgccggcggagtagatgagcgtgcggtcgaggtcgctggccaccagcaccggcatcagagcgccaccgccctgccgtcggcgccggtcgccccgcgagtgaagcgcgggtggatcagcccgacgcaggtgtacggcaggtcgtccacctcctcgaccggaaccccgcgctgtccggccagcagccgcacgtggtcgaggtccgcgccggcccccgcccgcgccaggatcttccacggcacccggcgcagcagcacgcgggtggtctcgccgacgcccggcttgaccaggttcacgtcgtggatgccgtactcctcgctgatccgctcgaccgccgcccagcccgcccaggtcggtgcgcggtcaccggccagcagttccttgacggtcacctcgacggcgtcggtgacctcgccgaagcgggccgtgacggcgtcgaggaaggcgttcgacaggtcggcgccggccaggtcgcggtagaacttcgcgccgtggaagtcgtgcggtccgaccaggtcggcgcggagcaccgtgcgcgagatgagcccggagacggtggagttgaggcaggcggacgggatgaggaagtcctcccgggtgccgtacgtccgcacgcacgagcccgggtcggcgagcaccgcgatctccgggtcgaagccggtggcaccgccctgctcctcgaactcgcggacggcttcggcgagttcgcgggtgatggcgcccttgccggtccagccgtcgacgaagacgacgtcggccgggtcgtggtgggcggccagccagcgcagcgcgttggcgtcgatgccccggccgcgcacgatcgagacggcgtagtgcggcagttcgaggccgtgccggaacgcggcccagcggcgcatcagcacgccgacgggcgttccggcgcgggccagggagaccagcaccgggcgcggtgagcgctcggcgaggacgagtccggtgaccgcgccgacggcctgggcgagccggccggccgaggcgtcgagggccgcgtggaagagttcctggtactgggcgctgggctggtactccaccggcagggactcggcgtagtgggcgccgccgctctggatggcctcctcgcgttcctcggtcggtgcctccagcgtgacgtcggagaggtcctggagcagccagccgacctcctcgggcgcgtacgaggagaaggcggggccgcgcaggggctcgggcagcatggaggggctttcctgactttctcgaagttcccggagttcccgccgttcccgcagttcccgaggggcggcggggacatacgacggcacgaccgcgagcaggacgtgcggggtgtgggcggcgaggcgcgccagcaggccctcgggggcgtgcaggtgcggggtgtcggcggcggagtcgacgacgacgaggacggcgtcgaagccggcacccgccacgttgtaggcgtagcgctcgccggggccgtcggccgggtcgtcgtgggcggggaagaccaggcggctgcggatggcgtagcccgggtcgtcgacggcgaggacgggtgagcgggtggtggtggaggtgcgcacctcggcgccggtggtccgctccagttcgtgggcgagccgcagcggcgcgtacatcagttcctcgcagccgagcaccaggatccggcgggcgtctgcgggcagggcgcgggcgagccggtccgccatggcgggcagggcgtgctccagccgttcgcggtgtgccggggtgaagccgtgccgggcgccgtcgggcaggccgcggggccagttcagtccgacccgcgcgacctggccgcgcgcgtgccgctcggggggcccgacgggatcttgcagggcggtccgctcctcgtaccgggcgaccagttcccggcccttctccaggacgccgtcggggaggcggaccgtgcccgaggcggcggcgatcaggtcgacgcgggcgccgatgcttcgggcgaagtcctcgaggcgggcggtgtcggccggggagcgcatgtccaccagggcgaccacgacgtaccgctcgcgcgggtggcgggcgtgcaggtcgcggatggtgttcaggacggtgctgccggtggagaactcgtcgtccacgaggaccagcgggccgctcgtggccagcagcgccgggtcctcgggcagcagcagcaccgtgccggaaggcgtgttggaggcgtcgacgccg

SEQ ID NO: 2319 - DNA, 831 bp, Unknown
  Kingdom: Bacteria, Phylum: Actinobacteria, Class: Actinobacteria, Order: Streptomycetales, Family: Streptomycetaceae, Genus: Streptomyces
cgcccggccgcacctctacgacccgcactggactctgcacgccgccgccgagcagggctaccagggccccggcgccgtatggcctgccccctaccgcgcgggcagcagacccccgcagaccggccgcacggacgcacccaagccgcgcctcggcctctccacgtgaggccgcgtcagttgttcaggcccgcgaactcggcgcccgcgtcccgcaaccgctcgtgcaggccgcggaagacggcggccgaacggaccccgggccagtcggcgggcagcaggcgggcgggcaggccggggtcggcgtagggcaggtggcgccaggagtccagggcgagcaggtagtcgcggtacgcctcctcgggcggcgtgtcgccgcgccgctcccaggacgccagcacgcccgcgtgccgtgcgaggaacgcctcgtgctccgcggcgaccgcagccaggtcccaccagcggcccaccgcctcggccgtaggcgtgaaacccaggtgctcgccgcggaagaagtccacgtaggcgtccagccgcaggcggcgcagcgtgtgccgggtctcctcgtacagccgggccggcgcgatccacacccccggggccgccgtgccgaaacccagcccggccagccgcgagcgcagcacgtgccgcttctgccgctccgactccggcacggagaacacggccagcacccagccctcgtcggcaggcggcgcgcccgcgtagacacggcggtcgccgtcctccagcaactgccgggcctcggcggacagttcgtagccggcggcgccctgcgggggtcgcgccgggagcagcagcccgcgccgtttgagc

SEQ ID NO: 2320 - DNA, 1262 bp, Unknown
  Kingdom: Bacteria, Phylum: Actinobacteria, Class: Actinobacteria, Order: Streptomycetales, Family: Streptomycetaceae, Genus: Streptomyces
ggacgtcccggtcgcggcatgggcgccctgaccgacgccctcgcggacgcggcgcgcacggcgggcgcccgcctcctcaccgggcacgaggccgtccgcgtggactccgacgggcgaagcgccgaggtcacctaccggaccccggacggcgagggcacgatcggcgcccggcacgtcctggtgaacgcctccccgcaggcactggccgctctcaccggccaggagccgcccgagcccgccgagggtgcccagctcaaggtgaacatgctgctcaggcggctgccacggctgcgcgacagctccgtcgacccgcgcgaggcgttcgccggcaccttccacatcgcggagggctaccgcgcgctggcggcggcccacgcccaggccgccgccggccacctgcccgccgcgccgccctccgagatctactgccactccctgaccgaccccaccatcctcggccccgagctggtcgaacggggctaccagacgctcaccctgttcggtctgcacaccccggcccggctgttcgcccgggacaacgacgccgtacgggacgaactgctgaagtcgacgctcgcgcagctcgacgcccacctcgccgaaccgctcgccgactgcctggcgaccgacgccgagggccggccgtgcatcgaggccaagacgccgctcgacctggaacgggacctcggcctgcccggcggcaacatcttccaccgggcgctgagctggccgtacgcgcacgaaggcgccggccgctggggcgtggagacccggcacgccaacgtgctgctgtgcggcgcgggcgcggtgcgcggcggcggggtcagcggcgttccgggacacaacgcggccatggcggtgctggagggcacgcggggtcacgatgggcaccaggacggctgaatggcgtggtcgtgcgggggcactccgacaaggcgaaggaaatacagcacgaccaaccccccaccggaggctcccatggccgacctcagcccgatcgacctgcagaaagctctccgcggcgcggactaccccacggacaagcagcacctggtggactgcgcccgcaagaacaaggcgaacgacaaggtcgtcagccggctcgacggcctcaggcaggaccacttcgacggtcccaacgaggtgcagaaggccatcttcaacgagtgacgccccctgcggtacgaccgtgaaccgggcgccaccgtgaacccggccgtgggcccgccgtccccgtgggaggcgggcccacggccgggttc

SEQ ID NO: 2321 - DNA, 1254 bp, Unknown
  Kingdom: Bacteria, Phylum: Actinobacteria, Class: Actinobacteria, Order: Streptomycetales, Family: Streptomycetaceae, Genus: Streptomyces
cggacgtcgcgggcgccgacgccctggaggtcctgccgggccgcgaggacgcggggctcggccgggtgctggaactgtgcgcgtccccggacggcgcgtcgctggccgtcgccgcccacgacgggcgcgtcctggtggtcgacgtggcttccggcggtgtcaccgaactggaccgcagcacacgcgaagaggccgacgggctcgtcttctcgcccgactccgcgtggctcgcctggtcgcacccgggtcccgagggactgcgccagatcaggctcgcccgtgcggtgggcggcgaaccggtcatcgaggcgacggaagggcggttcagggacgagtcgcccgcgttcaccccggacggcacgcatctggccttcgtctcggacggggtgttcgaccccgagtaccagacgcacgtcctggacctgtcgttcgtcgccgccaaacgcccgcagttgctgagcctgcgggccgacacgccgtcactcctggccgacggcggtggggacggcgagacggcgcgtgcggcgccggcgcgtacgcgggtggacgtcgaggggctgcacgagaggatcgtcgccttcccggtgccggccgccgattacggcggtctgcgcgccgtcgacggggcgctgctgtgggtccgcacccctccccgcggcactctcggcgacacctgggcgggtgccggtgccgtgccgcctcgtccctgcgtcgaacgctgggacctggccgccaggaccctgggcgtcctgcgcgagggcaccgacgggtacgcggtggcggtcgacggcagtcaggtcatgatccgggacgggaaagcgctgctggcgcgcgccgctctgcccggctccgacgagcggcccgtcgatccggcccggatacggatcaccgtggacccggtggccgagtggcgccaggcgttcgccgaggacgagcggctgatgcgggacaacgtctggcggtccggactaccggagctggccggtggcggcccctggtcacggcaccggccgctgcttgaacaggtcggctgcgccgaggagttcacggatctgctgtgggagacccacggtgacctgggctggtcccacacctacgtctggccgcgcgccgccgaagcggaccgggagcgtccggggctgctcggtgccgacctggccccggacggtgacggcggctggcggatcgcgcgcatcgtgccgggcgagagctccgcgccgcaggcccggtcaccgctggccgccccgggcacgg

SEQ ID NO: 2322 - DNA, 504 bp, Unknown
  Kingdom: Bacteria, Phylum: Actinobacteria, Class: Actinobacteria, Order: Streptomycetales, Family: Streptomycetaceae, Genus: Streptomyces
gggccaggacggtcgcggcggcggcgcggcggcgtgccagggccgtctcgtccagcggcaggggccagacctggtcggcggcggcccggtgcagggccgggttctcctcgtcctcccccggtgcctgagcccagacctcggtctcgccgtacccggccgcgcagtggtcgtgcagggccagcaggaagtcggaggggccgcgcggcttcttctggctcggtccccaccagtggccggagccgagcagcagggagcgcgggcgggtgaaagtgacgtagccgaggcgcagttcctcggtgtgctggtggtccttcatggcctcgtggaaggccttcatgccgcgtgcgtcccagttgccgacgtcgggcagggtgtcggcgtcgccgcgcagggcgtgcggcaggaccttgccctggctggtccacttctcgcggccctgcccgctcgggaaggcgccggcgaccaggccggggacggcgacgacgtcccattccaggcccttgg

SEQ ID NO: 2323 - DNA, 646 bp, Unknown
  Kingdom: Bacteria, Phylum: Actinobacteria, Class: Actinobacteria, Order: Streptomycetales, Family: Streptomycetaceae, Genus: Streptomyces
accacggccgacatggcgacccgcgcgccccggtcgccatgtcggccgtggtcgccctgttcaccgtcgccgccgccaccgaccgccccaccacctggcgcgtcggcctgtccaccatgaccgtgctgaccggcgccgccatgctcggcggacccgaaccctggtacgcccaggagaacctcgccatcttcgcctggaccggtatggccgccgccggcggagacgccgtccgcagccgccgtgccttcgtccgcgccatccgcgaacgcgccgaacgcgccgaacgcacccgcgaggaggaggcccgccgccgcgtcgtcgaggaacgcctgcgcatcgcccgcgacctgcacgacgtcgtcgcccaccacatcgcgctggtcaacgtgcaggccggagtcgccgcccacgtcatggacaaacgccccgaccaggccaaggaggccctcgcccacgtccgcgaggccggccgctccgcgctgaacgagctgcgcgccaccgtcggcctgctgcgccagtccgacgaccccgaggcccccaccgagccggctcccggactggaccggctcgacgacctcgtcggcaccttccgcagcgcgggactgcacgtcgaggtcgcccgcgccgacggcggcaccgccctgcc

SEQ ID NO: 2324 - DNA, 639 bp, Unknown
  Kingdom: Bacteria, Phylum: Actinobacteria, Class: Actinobacteria, Order: Streptomycetales, Family: Streptomycetaceae, Genus: Streptomyces
cggcgcgggggtggcgttgaggacggactggagggtggccggggtgttgctccggcggaagggtgagacgccttccgtggccgcgtacaggaccacgccgagggaccacaggtcgctggccggaccggggcgctgccccagcacccgttccggcgcgatgtactccggggatccgacgaagccgccggtgtcggtcaggctggtctcgccgtcgatctgggcgatgccgaagtcggtgaggacggtccggccgtaccggccgagcaggatgttgtcgggcttgacgtcgcggtgcaggacgcccgcggcgtgcgccgcctccagggcgccgagcacctccagaccgacccgggccgcctcgcgcgcgtccagggtgccctcctgcagggcggcgccgagcgagcggccctggaccagctccatcacgatccacggctgtccgtcgacgacggccacgtcatggacgttgacgacggccgggtgatcgagcctcgccgcggcgcgcgcctcgcggcgcatccgctcgaaggcgttggcacgctcgcgttcgggcaggtgttcggggacccggggttccttgacggcgacctcgcggtccaccgtctcgtcccgggcgcgccacaccgtgcccatgccgcc

SEQ ID NO: 2325 - DNA, 503 bp, Unknown
  Kingdom: Bacteria, Phylum: Actinobacteria, Class: Actinobacteria, Order: Streptomycetales, Family: Streptomycetaceae, Genus: Streptomyces
gctcggcgaaggcgtcccggccgagcggactgtgcgcggcggcccaggcgcgcagcccgaggccgtgggccgcgtggagcagccgcgcggcctcgacccgggaggcctccccgcccgtgtgcagcaccaggccgtgccccgcgaccgcacggatcagctcggccgtggaactcccggccgcggcggcgacccgctcccagccctcggccgggccgtcctccttcgggacggagttgaccagccgggccagcccgtcggcgaggctctcctcggcgagcgcgtaccgctccaggccgaccaggatccgcaccgggcgctcctcgtcgggctcgccctcctccgcgtcaccggcctcggcgggggccggcgcggccggtgcccccggctcgtccagggcgtcctggaacaccagcgcctcaccctccgcgagcgcgccctgcagggcctcgtccgggtcggggacgccccgctgggccagggccgcggtgagcgccggcgcgtcg

SEQ ID NO: 2326 - DNA, 1106 bp, Unknown
  Kingdom: Bacteria, Phylum: Actinobacteria, Class: Actinobacteria, Order: Streptomycetales, Family: Streptomycetaceae, Genus: Streptomyces
gctcgtcgagctgggcggtccagcgccggccgcgcggccggtcgtgcggggcctgcgcgcggatcaggcaggccgcgagtcctctgtgcgcgtcgcccagctcgacgagctgcccaccgaggcgccgccccggaccgaccgcttcacctacgccaccaccgtgctggagctgtaccgcctgctgttgcggctgcccaccctcgaacatctggacgcgcccgtcgagcgcccgtccgccgcggcgccggccggtgagtcccgcatgctcggccgcatccgcgcgctgctcgccaaggcggaggccaccgggttcccggaggaggcggaggcgctgagcgcgaaggcgcaggaactgatggcccggcacagcgtcgacgaggcgctgctcgccgcccgcgcctcctcgcccgacgcccccggcgcctgccggatcggcgtcgaaccgccgtacgagcaggccaaggccgtgctgctggacgccctcgccaccgcgaaccactgccgcgccgtgtggaacgagcccctcggcttctccaccgtcgtcggcttcgaggccgaactggatgcggtcgaactgctgtacacctcactcctcgtgcaggccacgaccgcgatgacgcgggccgaggcggcccagagagccggcgggcgcaaacggaccaagacgttccggcagtccttcctcgcggcctacgcccaccgcatcggcacccgcctcgcggctgccgccgggacccaggtgaccgaggacctgctgcccgtcctggcgagccgtgacgtcgcggtcaccgaccggctggaccgcatgttcccgcagacgacctcgaccaggctgcgtggtgtgagcgacgcggcgggctggacagaaggggcccaggcggccgaccgggcgcaggtgagaccccgccacaggctggagtgaggccaacgcgtcgggctggccccggagccccgtgtcccgctggccccggagccctctgtcccgccggtcccggagcccggtgtcacgtcggtcccggagctctgtgtcccgccggtcccggagccccgtgtcccgccagcccccgagcccggtgtcacaccggccgcccaagcccggtgtcccg

SEQ ID NO: 2327 - DNA, 597 bp, Unknown
  Kingdom: Bacteria, Phylum: Actinobacteria, Class: Actinobacteria, Order: Streptomycetales, Family: Streptomycetaceae, Genus: Streptomyces
agacgatctccaggccgcgcggctgcccgccgagcacgtcgaaggcggtgcgcaacgaccgtacgagcaggtgcttctcgtcgcgcggcagggtctcgctgccctcgccggcgatgtcgatgtgcagcccggagtcggccacccggacgacgacgtcgtcgtagagccccagcgcgaggccgaaggcatcgaagcccgggccgagattggcgctggtggcggggacgcgcacccggacggcggcggcgcggaacgctggaccggccatcgctcgttgactctccttgagctgcgtgacggccgagtggcattcgagtgacattcgaccgggattcgacggatacgtgaggaccctcggggccgcagggacggcgcggcaccgcgacatgcgacggcatatgcggtgggcgggttccttacagcctatcgaaggaaggttctgtggcgacatagggcgcacaggaggcgcacgatgcgtgtcgcgtgcctttccatgcaccctgccgggcggcccgtggcgaagacgcctcgggaggtcgcggggttgcgcggtcgcggggttgcgcggttgcgcggtcgcggggttgcgcggttgcg

SEQ ID NO: 2328 - DNA, 888 bp, Unknown
  Kingdom: Bacteria, Phylum: Actinobacteria, Class: Actinobacteria, Order: Streptomycetales, Family: Streptomycetaceae, Genus: Streptomyces
cgccacgtcgtcgaggacgagcgtgagtggtgggtcgagccgaccggaggatgaccgttcggccatgcgccggccgcgctcgaccacgcttgcggcgagtgccgtcagaaggggcatcgcgcctgggcgggtgcggggatcctcgatggattcccccaccacgtaaagcgttcccccttcgtccacgaaggaatccaaggcgagggcatcatttcggtgcggagtgcacgcctcgcggatgttcactgtgaagagcgaggccagggcgcggcctgtcagttcctgcgcgatgtcgcggcgctccgggtgcgcggtgagcgcggcctccagttcgcccgcggatcccggcgccgccttcgggttggtcctcagggtccgtacggcctcctgcagttgggtgccctgcgaccagcggtggacgtggcggatcgtgcggccgtcgatggctgcggcgtgcaggtagctgcgcaggagcgtctgcgcggtgtcgttgaccgcctggtcgatcttggcggtggggcggaccggggcgaggagcgcggcggctcgtgccaccgccgtgtccttgtcggcgcagccggcgacgggggaccagtgcaggcgggccggtgtgtcgcacaggtgcgcgggatcgtagaggagtaccgggcccagtttcgaacgggcgtccttggtttcctgccagagtgccgggtcggaggtgacgacgagcgcggggccggcggcgtcgaggaccgcctgggcggctgtcggacggcggctctccctgggggccacgacgagtgtgggccgcgcggtgcccggcagcgagggctgcggtcccgtggggcccgccgggaccgtgacgggcgctgtgggcgccatgggggcggtctgggcctgctgggg

SEQ ID NO: 2329 - DNA, 1720 bp, Unknown
  Kingdom: Bacteria, Phylum: Actinobacteria, Class: Actinobacteria, Order: Streptomycetales, Family: Streptomycetaceae, Genus: Streptomyces
cgtggtcgatgcgccgggccaccgccgactccagtgcctcccgcagaggcccgtcgcgcaggaccgcacgtggtccgagcagcccctcgaccacggccagcgcaccggcgacatcaccgtgaccgagccgctcccggaccgcgggcagcgcgtggggatcgcggtgcaccgcgtcgatcgcccgcaggcagggcagccccggcccgccgagcgccaccagcagctcctcgcggcgcagttgggccggatcgtggtcgaccgccgtcagcacaccgtcccgcagcgcgatccggtgcacctcaccacggcattccacccggtgcggatcaccggtcgggccaaccgccctggccgccgttgcccggtcgggcgccgacgccaggccggacgccggttccggtccggtcgccggcgccagagcggacctcgccagcaccacgccgatgagcggatgcagctgcccggcggagaccagcccggcccgcagcagttccaggtccgggaggacgcgggccgccgcctccggcagcaccggaagcgccgcgacctcctggggcggcagcgtctgccgcagcggccgcaacgccgggacgtgactgtcgtcgggggcgaagagttcgagtgcggaacggtcgcgcgtgccgagccgcacggtgaacgcaccacgagagcgcccctcggcccgcagcagcaactcggcctcggcggcccagcccgcctccgcccacggcatgtcgtggacctgcgacgccctggacggcgtgccacccgcaccgcaccgcgccgcgagttcaccgctgcgcccggcatcccagagatgccggtgcaggtcgagccggaaacgccggtcggggtgcggatgcgggtgatgtgcgcgggcgctgtcgccgggcccgtcccacagggcgagggacatccgctgtcccgcgtccgcccaggccggcggtgtccgcaccaccaactgcggcgctggggcgccgtggcccgcgtagcgggccagggagacggtgaggccgggccgcagcagcccgtcgggggcgatcctgggcatgtgccagcggagcaggtccggcgccagccggcgcaggtccgcacggaggcgggcggcgagatcggtgccgtggcggtctcgcacggcgcgcagatcgagatcgacgtcgatccgggcggcggcgcaggccccggcccagtcgccggccgcacgccgtgcggtcgcggtctcgatcatggacggtggcacggcgtactcgcgtacgcgctgccacatcagcaggcggggtggaatcccgttcgcgaggtgatgtgccatcagcattcaccttgcacgaacgattcccccaatccgtacgaggaggagttcatcatcggcggcatcctaaccacgccggtgacgatctgtcattctcctttggacgagccgcccgcggccacggccttcagctcgtccagcgactcccgcagcaactgcgccatgccgcgttcctcgccggggccgatccagcgctcgaagccgatcttgaagacggcgacgccggcctcggcggtcaggctcgcggccggctccggcacgccgcgtcggcgcagggtgcccgcgagtacggccgagatcgaggcgagcttgatcagctcgcgctcgcgcagttcggcgttggccgtgatcacggcatggcgcgtgcgcgcgaactcgcgccggccggcgaagaccgcaccgaccgcggcg

SEQ ID NO: 2330 - DNA, 519 bp, Unknown
  Kingdom: Bacteria, Phylum: Actinobacteria, Class: Actinobacteria, Order: Streptomycetales, Family: Streptomycetaceae, Genus: Streptomyces
cgccgccgcggcggcgcccaccaggaacgtgcgggccgcgtcggggctccagttgtgcagccgccggctcgcggtgtcggctatgccgtccaccagatcgtccagacgcgcctcgggcagtgcctgggtgtgcggccgcagaagaagcaccgaaccgtcggtcaggtccgcctgggcgagggtggcgtcctcgtcgaggggcgcgtcaccgagtcgctgcaggacccagcccgcgtgttccagacccgcctcctccgcgtcctcgcccacgtaacgcagcagcgtcggcagcaggtcggagacgggcacgtccgaggggacggccagatcgatcgatacggcaggcgcacgtacggtcaggtggcacagtccggccaccgcgctgtcggtcatgttcggaactctcgtctcccggtacgggtgcggtcggctgctgcgggtgccctgccgggcccacgcgggcccggaggcccgtgacgcccggtcgtgcgctcgtgcgccgggcggcgacgaccggtc

SEQ ID NO: 2331 - DNA, 1034 bp, Unknown
  Kingdom: Bacteria, Phylum: Actinobacteria, Class: Actinobacteria, Order: Streptomycetales, Family: Streptomycetaceae, Genus: Streptomyces
gtctgcgtgctcgacggcgttgggcacggtggacgtcatggggtacggactccttgcgcgtgaaaaaggtggggggcggggtggggcgggcttcagcccagggccccgtagaggccggggcggcggtcgaggaggtacgggttcgtctcgcgggagcgggcgaggaaggcggggtcggcgtccgcgaggaggaggtcctcgtcgcggccggcgcgggcgcgggcgactccgtcgggtcctgcgaggacggagaggccgacgaactcgaactcgccctcccggccggtccggttgacgtacgcgacgtacatctggttctcgaaggcgcgcaccggcacgagcgactcggcgacgaactggtacgggtgcatctgcgcggtcggcaccagcaggaggtcggtgccggcgagggcgtgggcgcggacgttctccgggaactcgacgtcgtagcagatcatcatgccgacggtcaggccgcccagctcggcctggaccacgggctgctcgccgggggtgaagtgatcgcgttcgaagcggccgaagaggtgggtcttgcggtagttcgccagacgcgtgccgtcggccgagaccagctgggccgagttgaagacggcctcgccgtcccgctccgggtagccgtaggcgaccgccagcccgtgccgcccggcgaggtcggcgacggcgtccgcgaagtcgccgtcggcgggctctgcgaggcggccgatgccgtcgccgatcgcgtagccggtcaggaacagctccggcgtgaccagcaggtccgccccggccgcggcggcacgggccgcggccgcgtcgaggaccttgaggttctccgcgacggagccggggcggccggagctctggagcagggcggtgcgcatgcgggatccttgccggtcaaggggggaatcggggtcgtttagacggtacgggcggggggttctgcgcaacaagcgggaggcgttgcgcggcgccgcgtggtttgttgcgtacggggcgcggtgcgcggtgattcgttgcgcggacgcttgcac

SEQ ID NO: 2332 - DNA, 747 bp, Unknown
  Kingdom: Bacteria, Phylum: Actinobacteria, Class: Actinobacteria, Order: Streptomycetales, Family: Streptomycetaceae, Genus: Streptomyces
gcggcccgcgaggcctggagcgacgccgggtacgccgagggcggcacgcgtgagagcgggctcgatccggagcgggtcggcgtcagcctcggggccatcctcggcgacgcctcggtcctcgtcggcggggaccgcaagctgcgcgagaaggggccgcgctgtgtgtccccgctcaccacgcccatgaccgtgccctcgcaggccgcctcgcaggtctcgctcgacctgcacatcaccggcgaggccaggaccgtgaccagcgcctgcgcctccggcaccgaggctatcgggcaggccatcgaccgcatacggtacggccgtgtcgacgtcgcgctcgccgggggcgccgaggccgtcgtcacgcccgcgatcatggcgtccttcgccgccatgcgggccctgtccgacctgggactggcggacggcacctcgccctcacggcccttcgccaaggaccgcgccggattcgtcaacggggagggtgccggagtcctcgtcctggaggccgaggagcacgcccgtgcgcggggcgcccggatctactgcgaggccgcaggctggggcctctccgccgacgcgcaccacatggcggcgccggacccgtccggcagcggggtcgcgctcgcgctgcggcgggcggtacgggacgccggcgggcacgtcgtcgacgtcgtccacgtcaacgcgcacgccaccgccaccacggagggcgacctcgccgaggccggggcgctgcgtgccgtactc

SEQ ID NO: 2333 - DNA, 850 bp, Unknown
  Kingdom: Bacteria, Phylum: Actinobacteria, Class: Actinobacteria, Order: Streptomycetales, Family: Streptomycetaceae, Genus: Streptomyces
cggcgaggcggtcgccgggacaagtcctggcatacaccttcgcggcaccgccgggcggagccgccagcagggagatgtccccgttgacggccgtcgccgtggtcaccttccagccgtggcgccgcagttccgtacgggctcgccgcagcgcctcctgccccgcgccgtgcgcgacgcccttcaacgcccacccgctgctcaccgtgagcacaccgggcgcgctcggcggcgagtcgctcagctggtccgccaggtggctcaggccggtgtacgggcagtcggcctccgtcttgcggccctggcccagccactggtcgtccagtgcggcatccggcagcccgagggccgcgtagacctcccgggtacgggcgtcgagccggtcggcggtgacgtacgggtcggcgaccgggtacgagtcgccgacccaccactgccgggccttcacgcccgctcccaggcacacggcggcggcggtcgccgtcagcgcgacggtgaccggcacgcggaccctgcggcgggagccggccggacgcgggcggcggacgtcgcgggaaggacgggccttgtctcatggacagcatgctgctgcggacgggcgggcacccgactgagcgcccgtactcaaagcgtgtactcacccttcacgtgcgtgctcactcctcaggagggcgatgagttccgcccggaccgccggtctaccgtacgtggatgccaggacacccgccgtgctcgtgctgcccggccccgtcgcgcgtgacgaggtggccgggcagcacgagcacggcgggtgtcctggcatccacgtacggtagaccggcggtccgggcggaactcatcgccctcctgcggc

SEQ ID NO: 2334 - DNA, 704 bp, Unknown
  Kingdom: Bacteria, Phylum: Actinobacteria, Class: Actinobacteria, Order: Streptomycetales, Family: Streptomycetaceae, Genus: Streptomyces
gccctggaagccaccgggcgagcacctgttccaggccgcggcccggcggcaggcggcggcccggcccgccggcctgggcaagcggctggccgcccgtctggtcgacaccgtggtcctcgccgccgtcaccgccgtggccgccgtaccgctcggcaccaaggcggccgaccacgtcgacgagaagatcgacgcggccaagctctccggccgtacggtcaccgtctggctgctggacggcacgacgacggcgtacctcggcatcgtcctcgccgtcctgctgctcttcggggtcctctacgaggtgctgcccaccgccaagtggggccgcaccctgggcaagaagctgtgcggtctccaggtgcgggacatcgaggggcacgagccgccgtcgttcggtcccgcgctgcgccgctggctggtgtacagcgtgccggggctgctgtgcgtcggggtcgtgggcgtcctgtggtgcgtgttcgaccggccctggcgccagtgctggcacgacaaggcggcgcacaccttcgtggcggggtgaccgggatgtcccggtagtcccgtcggcccctcgccgtcattccggcgggtgcccgctgtcctccgtacggaggcgcgccggatgcgggcccggccggttcgagatccactcggcgcatgagcagcgaaccgccccccggctccgaaccgcccgccggctccggacc

SEQ ID NO: 2335 - DNA, 653 bp, Unknown
  Kingdom: Bacteria, Phylum: Actinobacteria, Class: Actinobacteria, Order: Streptomycetales, Family: Streptomycetaceae, Genus: Streptomyces
ggcctggtgccggccgtcacgaccgcgcacaccgaaccgcgcgacgtccacgcgtccgtgacggccggcaccaggccgatgcggtgggtggcggtcgcgacctgggacaggacggcgaacgcgtccgggcccgggtgcgcgaggctgtcgtcgagcgtcacgaagtcgagggccccgctctcggcgagccgcgcggactccacgcagaacctcaggcagggctccccacaggtcgccgcgtcgtgcggcgggtgccggtcgagtgcggcggccaggtgcagtggcccccggccgggcggtgcggtcatcgcggaggttccttcctgggcgcgggtcacaggaccttggagaggaacgcccgggtccgttcgtgccggggccggtcgagcacctcgccgggcggcccctgctcgacgatccgcccggcgtccatgaacaccaccgtgtcggcgacctcccgcgcgaagccgatctcgtgggtgacgacgatcatggtcgtgccctgccgggccagatccttgatgacgtcgaggacttcgcccaccagttccgggtcgagtgccgaggtgggttcgtcgaagagcagcaggctgggctccagggcgagcgcgcgggcgatggcgacgcgctgctgctggccgccggagagccgg

SEQ ID NO: 2336 - DNA, 1182 bp, Unknown
  Kingdom: Bacteria, Phylum: Actinobacteria, Class: Actinobacteria, Order: Streptomycetales, Family: Streptomycetaceae, Genus: Streptomyces
gaccccggccggggtcccgtgaggcattggggtgacggatggcggagacacaaggcggggagccgggcgacggcgccgctgaggtgctcgaccgcccgctgcccgacggcgtgcgccgccgggtcgtgcagatcgtggccgacgccttcggccggctgaccgtcgccgagctgcccgcgcagctgcgccagtacgcccggttcgcgcccaaccgccgggccaagttcgccggcaacgcgatggcggcggcactggagaccgacacgctgttccggcagcgggtcggggagaagttccgcgaggcgcaggcggagctgtgcggcgccctcgactccggctcgccgccgccggccgcggacccgctcgacgtggccgccgcggcctacgtgctgcgcccggcgggctgggtgaagctggtgaccgccgccggcgaggaggcgctgcgggcgcacgccgagcgcgccgacgaggagaaccgggccgagctggagcggctgcggcagcaggtggccgacgcccgtgagcagacccgcgccgagaccgagcggctgcgcgccgaactggacgcggcccgcaaggaggccgattcgctgcaccgcaagctgcgtgccgcgctcagcgacgtcaagcgcggtgaggcggcgctgcgcaagacgcgcggcgagaccgacgcggtgcgtgccgaggcgcaggtgcaggtgtcggccgccgagagcgagaaccggcggctgaaggcgcgcctgggggaggcggaggcggccctggaggccacccgcaaggcggcccgtgaggggcgcagcgtcgaggacatgcgggtgcggctgctcctggacaccgtgctcgacgccgcccaggggctccggcgcgaactcgcgctgccgccggtgtccgtacggcccgccgagaccgtcgacgcggtggaaccgggccggatgacgccgaaggacatcgccgcgcgggcgctgtccgagcacgacccggcggtcctcgaccagttgctcgcgctgccgcaggcccatctggtcgtcgacggctacaacgtcaccaagaccggctatccgcagatgccgctggagaagcagcgcctcaggctcctcgggcagctctcccagctcgccgcgcagaccggcgcggccagttcggcgccgtcgaagacacaggtgacctccgcgccggtgctgc

SEQ ID NO: 2337 - DNA, 1121 bp, Unknown
  Kingdom: Bacteria, Phylum: Actinobacteria, Class: Actinobacteria, Order: Streptomycetales, Family: Streptomycetaceae, Genus: Streptomyces
gtcggtgctggtgcggccgatggcacacgagcaggacggcgcgaagcccggcatcggccgggcggcgcgcgggctgacggcggtgacgttccgcgggggcgcgccgcgggtccggtggcgtatccagggcgcgggcgcgcccgacccggtgcgcggaccgctgaacaacggcgggctgtacggggagcgggagggctggcacctgcccggtttcgccgacggcgactgggagaaggtggcgttcccgcgtgccgtgcggcggcagggcgtgacctggtaccggacgacgttccggctgtcggtggacgcgggcgtggacgcctcggtggggctgaccctccaggacgaggcgcaccgctcctaccgggcgcagatcttcctgaacggctggaacctgggccagtacgtcaacgacgtgggcccgcagcacacgttcgtgctgcccagcggcatcctgcgcacccgggacaccaacacgctggccctcgccgtgctgtccggggatacgggcgaggcgggtcccgggcaggtgcggctcacgctgctgggcgccgcggccggaggagtaccggtcaccccggtgtcctcccccggccgctgagcccacccgctccgcggagcccgcgcgtcgccgccttgaggacggcgaaccagtcgtcggtgctggtggcggccggcagccggccgtgctcgtcgagcaggcccgccttcgcgcagacgtccttgcggtggaagcagagctggacgtggatgtccaggcgcagcgcgtagagcttgccgtcgacgacgccgcgcttcacagcaccgggttgaagtccgcctccttcacgccgtaccgggtcaacaggtccatgtcgaaggggtccaggaggcggccgggtgcgaagcccgggatgcggccctggtgcatgacggccaggtccggcgcgcggttgccggcggcggccatggcgagcttggtgcagtacgggccgccccaggtgagggtggagtccttgacggccacgtgggggtgggaggcgcggaaggcgtccaccatggtggccgtgttggcgccgtcgccgccctggaagaggttccagtaccgcacccgggtgcgggcgctcgcggcgagcgcgtcg

SEQ ID NO: 2338 - DNA, 574 bp, Unknown
  Kingdom: Bacteria, Phylum: Actinobacteria, Class: Actinobacteria, Order: Streptomycetales, Family: Streptomycetaceae, Genus: Streptomyces
ccggcgccgccaccgccgggctggcgctggccgccggggtggtgaccgccgccggtccctgggactccaccggtcagcgtacggccgagcgggaacgggcagccgccctggagcacgcgggtggcgcagatcacggccgtgattccgatatgtccggcggtggcaccgcctccgcttcccggcccgcgcccagcgccgcccccgtgctggtcggtctcggcggcaccggcggcgccgtggaaccggccgccggcgcaccggccctcgccggtgtcctggacccgctcctgaagaaccaggcactcggcacccaccgctccgccgtggtcgtggacgtcgccaccggccggcagttgtacgggcaggccggcggcgacggcctcacccccgcctccaccaccaagatcgccaccgccgtcgccgccctgtccgccctcggccccgaccaccgcttcaccacccgcgccgccctggaggccgacaccggggaactcgtcctggtcggcggcggcgaccccacgctcaccgcccgcgagaacgcccggggcgcggcgagcctgcgcaccctcgccga

SEQ ID NO: 2339 - DNA, 595 bp, Unknown
  Kingdom: Bacteria, Phylum: Actinobacteria, Class: Actinobacteria, Order: Streptomycetales, Family: Streptomycetaceae, Genus: Streptomyces
tccacacgggtcgctcgcgcagcgtgcgcaggcccttgcgcggcatgctgcccggatgcccgccggtgcgggcgcacccgcaccgggatggggtccttctgcgggggcggacgctcggcgcgggacgagtgcgcccggtcgcggtcgtccgggcccgggctcagttcgcctgcggttgcggctgggcgcggctcacgtcgtagacgcccgggacgttgcgcatcgcccgcatgagggcgggcagacgcgcggcgtcggggagctgcagggtgtacgtgtggtggacgcgctgctgggtcggcggagccacggtggccgagacgatctcgacgccttccagggcgatggcctcggtcagatcggccagcagatgagggcggccgaacgattcggcgagcagcgtgacacggcatgcggcggtgtcgccccagcgcacgccgatctccgcgcgccccgcgctcttcatccgcgcgaccgtggcgcactccacgcggtgcacggtcaccgcgccgccgcgcacggcgaaggcggtgatgtggtcgggcggcacgggcgtacagcagccggcgagccgtacggaggcgcggggccggtc

SEQ ID NO: 2340 - DNA, 1365 bp, Unknown
  Kingdom: Bacteria, Phylum: Actinobacteria, Class: Actinobacteria, Order: Streptomycetales, Family: Streptomycetaceae, Genus: Streptomyces
gacgagcagggcgggtgcggccagccaggtcagggccccggccggggccacacgcaggatcagcgcggtcgcaccgagccccgccaccaccgccaccagaccgcagacggtgagcagccggcccagccgttccaccagccgtcccgatatgacggcggcggcggccgagccgatcgcgaagggcgtcaccgcgaggcccgagcgcagcggtgcgtagccgaggccgttctggaagaacagcgcgaacaccagccacacaccgctgaaccccacgaaatacagcgcgcccagcgccgtgcccagcccatagccgcgcgtgccggtgagcagtcgcggatccagcaggggctgcccgtcgcgcgccgccacccgcgcctcccaccggacgaagcagacgaggaggaccagcccgagcgggaacagccaccagagcctgtccagcccgccgctctccgcgaagacgagcggcagcatcagggcgagcacgcccacgccgagcagggccacgccgggcaggtcgagccgttccctgcggcccggcgccaccctgggcagcagccgcaggcccagcaggagcgcgagggcgccgacggggacgttgacgtagaagatccagcgccagccctgggtgccgtgcgccagggccaggatcaggccgccggtgatcggtcccaccgcgctggagacgcccacgacggcgccgaagaggccgaaggcccggccgcgttcggccccgcggaacatctgctggatcagcgcggagttctgcggggccagacagccggcgcaggcgccctgcgcgaggcgtgccacgaccagccaggtgatggtgggcgcggcgccggcggcggcgctgcacaccacgaaggcggccagggcgcacaggaagatccggcgccggcccatcgcgtcgcccagccggcccgcggggaccaggacgagggcgaaggcgagggcgtacccggacaccacccactgtacggaggacgccgaagcccccaggtcgcgctgcatcgacggcagcgccacggccacgatggtcacgtcgagcaggctcatgaaaccggtcgccagggtgacccacagggccttccagcgcctggggtcgggcgtgcccggcggatcgccgcggcgtccggccggccgcacttgcctgttcacgcacgctcctcccggtcgcggctcgtcgagcgcgcaccggccgtcgtcgtcctgcgcgccccaggggcgcgttccccgcggacggagcggaacaccctcacggacacgatcgccgcttcccgccggcggggccactcaagcgcccgcgacggacgcgccgtcctccggcgcacacgacgcacacagcggccggtgcccgcggcg

SEQ ID NO: 2341 - DNA, 680 bp, Unknown
  Kingdom: Bacteria, Phylum: Actinobacteria, Class: Actinobacteria, Order: Streptomycetales, Family: Streptomycetaceae, Genus: Streptomyces
cggcactcgtggcggtgagccccaccagcagggccaccgccacgagtgccgtccgccgggcgcgcatcagcccgccttcttcccgttgtcgtgggccttgcaccaggtctgcaccgacgccaggtccttctgccgctgctccaggctgttccgcagcgacgtgcgctggttcaggcggtcctggagatagatggcgatcgcggtgtggcccgccttcttcgcgttgtcgacccgcttctgcagccgggccaccgagccgcgcgtgccggccccggcgtccagccgctccagggccttcccgatccgccggtcgagcctgggcacccgcttgcacagggcgtgggccccgtcgcccttcggggcgtgcgcgggggtggtggcggcctcggccgccccggtggtgcccgcgaggaccgccgtcacggcgagccccgtgagcagcatgcgcgtgcgtcgtcgtgcgtacatctgcctctccgttcgtgtccgggacgggtggtggcccgtccgtcgcgacggaggctagggacggtctttggggaaactctgtgaccgcgtcgccccggctgtccgtcccgtccgcgccgtgccgatcagccagtcccgccgaccgggcaggtccccgccgcccgagggcagcagcacctcgaagcgggccccggtgccgccggggcccgctt

SEQ ID NO: 2342 - DNA, 510 bp, Unknown
  Kingdom: Bacteria, Phylum: Actinobacteria, Class: Actinobacteria, Order: Streptomycetales, Family: Streptomycetaceae, Genus: Streptomyces
tcgcggccggcggcgaggcgcagggcggctgggagaacgggcggatcgccgcgctcgtaccggagagccggcgcgcgctcgccccgaggatcgcccggcacggggccgacgaggacaagcacgggcggatcttccgcgcgctgctgaaaaagcgcggcctcgaccccgtcgaggtgcccgccgacaccgactacaccatgctcctggagcggcggggcatcggcctcgcgcacgaccggctgaggtcggaggagccgctcaccgagcaggacatcatcgtctacctggcgcacagcagggtcaccgagcagcgcgccgccgagcagatggacctgctgcgccggtacttcggcgaccacccggacctgggccgcgccgtgcggatgatcgcccaggacgaggacaaccacctcgcctactgccacgaggaactgctgcgcctggccgccgccgggcacggccgcgccatccagcgcaccctgcgccgctgcgcgctcgccgagatccgcg

SEQ ID NO: 2343 - DNA, 584 bp, Unknown
  Kingdom: Bacteria, Phylum: Actinobacteria, Class: Actinobacteria, Order: Streptomycetales, Family: Streptomycetaceae, Genus: Streptomyces
cggcgagtcggtgcgctactggtcggcgctcgtgacggacacgcggcgcgtcggtccggtgtggtcggtgcgcaaccagtccctgcggggcgcgctcaccaggctgctcggtccggacgtcacggcctccgcgctctggtgggcggcgctcgccctcgtcaccctggccgcggtcggcgcgctgcgcgcggccctgcggcgcgacgatccgctcggtgtcctcgtcacggtggagctgtacgggctgctggtgtgccccgtctcctggagccaccactggatctggtgcctgcccgccatgatctggctggcgcacggaccgcaccggaggcgggcactgagccgcatgacgcttctcctgtgggcggctgccaccggcgcccggctggtgccgcgactgatcggcgtcgaggaccggctggtccggcccgacccgtacccgctgccgctggcctggcccggctgcgtctacgccgtctgcgcggtgctcacgttcctcgcgctcgctctcccggcgcgggccgccgggcaaccggagcggcacgaccgcgtcccggcggcggagcgggccccggcccggccgg

SEQ ID NO: 2344 - DNA, 568 bp, Unknown
  Kingdom: Bacteria, Phylum: Actinobacteria, Class: Actinobacteria, Order: Streptomycetales, Family: Streptomycetaceae, Genus: Streptomyces
gaccgtgctgcgcaccgacgcgttccgccgtgcgggcggcttccacccccggctgtggctgggcggcgaggaggaactgctcgccgccgacctcgcggcggacggctggtggctgacgtacgcggaggatctgacgatccatcaccatccgtcgcgcgtacgggactccacgcgccgccgccgggacggcatccgcaacaccctgtggttcacctggctgcgcaggccgctttggcccgccctgcgccgcaccctgcacctggcgcgcacggtgccgcgcgacaccacctccctgcacgccttcgccgaagcggccggcgccctgccctggatcctgcgcgagcggcgcgtgctcccgcccgaggtggaagcgcggctgaggctcctggaggccggccagcgcagctcgaaggcccgccgctacaccggatgacgtgcgcgacaatgggggccatgagcacggcatccgacccccgtgaactcggggccttcctgaaggcccgccgggccgaactggccccggaggacttcgggctgcccgggacgggctcgcgccgcaaggtcgccg

SEQ ID NO: 2345 - DNA, 1096 bp, Unknown
  Kingdom: Bacteria, Phylum: Actinobacteria, Class: Actinobacteria, Order: Streptomycetales, Family: Streptomycetaceae, Genus: Streptomyces
ccgggcgcgggaggtggcgtgcgatgacgcgaccggtgttcatcgtcgaccaactcgaagcgatcggctcggaattcgttctcgacggtcccgaagggcggcacgcggtctccgtgaagcggctgcggcccggcgaggacgtcgtcctcacggacgggcggggacgctggagcgagggcgtggtcaaggctgccgagggcaaggaccgcctcgtcgtcacggacctggagtccgtgcacgaggaaccccccgggagcccccgcatcaccgtcgtccaggccctccccaaaggcgatcgcggcgaactcgccgtggagaccatgaccgaggtcggcgtcgacgcgatcgtgccctggaccgcctcccgctgcatcacgcagtggaagggcgagcgcggtctgaaggcgctcggcaagtggcgggccaccgcccgcgaggccggcaagcagtcccgccgggtccgcttccccgaggtcgccgacgccgccaccaccaagcaggtcgccgcgctcctcgccgccgcggacttcgccgccgtactccacgaaagcggcgaggaacggctggccaccgccgaactccccgcccacggagagatcgtgctggtcgtcggccccgaaggcggcgtctctccggaggagttggcgcagttcgccgaggccggcgccaagccctacgtgctggggcctactgtgttgcgcacatcgaccgccggcaccgccgccgcggccctgctcctgggccgcaccggccgctggtcctgaccgcgccagggggaaagcaccgtggaactcgcccaagtacggctcctcgtcaccgacttcgccgcctgctaccgcttctacgccgacgtcctcggcctcaaaccgcagtccggcgcggtgcaggggccgtacgagaagttcagccccgccaccggctccgcgggcatcgcgctgcaggaccgggcgatgatggccgaggtgctggacgagctgggcgacaccgccaccgggcaccgctcgctggtggtgctccgcgtggacgacctggacctctactgcgcacagatcaccgagcgcggcgcggccgtgctgcgctcggtgatctgtgcgca

SEQ ID NO: 2346 - DNA, 1361 bp, Unknown
  Kingdom: Bacteria, Phylum: Actinobacteria, Class: Actinobacteria, Order: Streptomycetales, Family: Streptomycetaceae, Genus: Streptomyces
cgtctccgtggcccgtctccgcggcccgtctccgtggcccggctacaacaccgcgatcccgagcggacggtggccgaccggcagccgcgtcacccggcccgtgccgaggtcgacgacgctgaggcggtcccagtaaccggcgcgggtgaagccgcccgacacgtacgcggtgcgtccgtccgccgacacggcgacgtcctcgtgcggcccgtcgagcgggatgacgcgctcgcggccgtcgggcgagcggacggtcagggacgggccgtcgtcccgggacggatcgatcggcccggtgccgaccacgtacagcgtgccgtcggcatcggccgtgaccccgtgctggtgggtgttggcggtcatcggctcgatgcgcacctgaccggtgcgggggtcggcgaccgcgaggcgttcgccctcgaagggcagcagcagcgcgccatcggaggggcgtacggcggcgtagtgcggcttgagccaggagccgaggccgccctcggtgccgtacggggccacctcgacacggcgtccggtccaggtgccggtgtcgacgaccgtcacgtcgaacgagtcgtggccggtgacgtagacgctgcggccgtcggcggagacgtcgacgtcgaagggacggcgtcccaccggcacggaccgcaccaccgcgcgacgccgtgcgtcgatcacctccaggatgccgtcgccgccggggacgttcacgccgacgtacacgcgcgcgccgtccggggacagcgcgatgcccatgccgccgccccggtactcaccggtggtcaccgggccggtgtccgtggtgtacgggatcagcgcgacgcgccgccgggtccgggtgtccaccgccgccaccccctcggccgtcgccacccaggccgtgccgtcgccgccgagcgcgatgccgtacggggccgtaccgaccgtcaccgagccgaggccggccgcgtgaccgcgccgcgccgggtcgacgaacgtcaccgtgtcggcgccgaagtcggtcaccagcagggcgcctcccggcagcggtgcggccggggcggcgttgcgttccggtgcgctcgtggagcccggtcgcggtgcggcggagcggccggagtgggcggtcacggccggggagccggcgtcgccgtccggcgcacacccggtggccaggaccgccacggccgcgagcgccgcgcacccgaggaccgccgagtgccgccgcttcaccggccggtctcctcgccgcccagagatcccgtccgcccgtcagtccggccgtccgtccgcgcatccgtccggccatcggtccggccgtccgtccgcgcatccgtccggccatcggtccggccgcccgtccggcccccggccgccgc

SEQ ID NO: 2347 - DNA, 1103 bp, Unknown
  Kingdom: Bacteria, Phylum: Actinobacteria, Class: Actinobacteria, Order: Streptomycetales, Family: Streptomycetaceae, Genus: Streptomyces
cggccggaccgccgaggccgcacgcgaactgttcgccgccgacgacgcggacatggggtccaacgcggtcgccttcagcggcgccaccaccgccaacggccgcggcctgctgctgggcaacccgcactacccctggcaggggggccggcgtttctggcaggtgcagcagaccatccccggcaggctggacgtggcgggcgcctcgctgctcggccaaccgaccgtctccatcggccacaccgcgcacatcgcctggagccacaccgtcgccaccggcgtcaccctgaacctccaccagctcaccctggacgcggccgaccccacggtctatgtcgtcgacggcaggcgcgagcggatgacacggcgcagcgtcaccgtcgcggtgaagggcggcgcgcccgtgacccgcgtccagtggtggacccgctacggtcccgtcgtcacctccctgggcgcctcgctgccgctgccctggacgaccacgacggcgtacgccctcaacgacccgaacgcggccgacctgcgcggcgccgacaccgccctcggcctcgccgccgcgcgcggcaccgccgggatcctggacgcgctgcgccgcacccagggcctgccgtgggtgaacaccgtcgccgccgactcctcgggccacacgctgttcgcccaggcgcaggtgctgccgcggatcaccgacgagctggcccggcgctgctccacaccgctgggcgaggccacctacccggtctccgggctggcggtgctggacggctcgcgcggtgactgcgcgctcggctccgacccggacgccctgcagccggggatcttcggcccggcgcgactgccggtgctgaaggacgcaccgtacgcggagaattccaacgacagcgcctggctgaccaacgccgaccggccgctgaccgggtacgagcgggtcttcggaacgatcggcaccgagcgctcgatgcgcacgcgcggcgccctggaggacgtctccgcgatggcgcgcaagggccgtctgacggtacgggacctgcaacagcagcagttcgcggaccgggtgcccgccgctggcctggcggcggccgacgccgcgaaggcgtgcgccgcgc

SEQ ID NO: 2348 - DNA, 846 bp, Unknown
  Kingdom: Bacteria, Phylum: Actinobacteria, Class: Actinobacteria, Order: Streptomycetales, Family: Streptomycetaceae, Genus: Streptomyces
gggtgagggcggaccggtccggcaggccgggccggccggcgctctcgaagctgtgctcgcgcagatcggcgcgcagcgggccggtgggcggcatcgccgaccggtcgtcgtacagcaccagcccggccagcggcaggccggccgccgccgcacgctcctccagccgggcccgcagggcggtcgcgggcagggaggtcacgagcagatgcaacagcgcaccgccaccggcctgttcggtcaccgagtaccgggcaggcagcggaacctcgggctccgcctcaatgaggtcgagcaggtcgcgggtggtcagggcggcgctgagcgggccggtccagcggccgaggatctcggaggtggcgggcaggtgggccagctcgcaggcgggcgcggcggggagcatacgcaccaggtcgccggtggcgtagcgcagcagcagggtgcactcccggtaggggaagtagggggtgtgcacgatcactccggtctctccgggcggtgtcggctcccagctctgcgggtcgaggacttcgaggtggccgaactcggtggtgtggtgcaggtggccctgggtgcagggcgtgcccccggagggcagcgtctcggtcatcaggtacgaggtgccgacggaggcaccgaacacggcctcggcgcgctcgcgcagcggacgggacagcacctcgccgcccacgccgatgctcagcagcccgaagtccgcgggccgccagccgtcccgctcggcccggtgcaccagcgcggagaggtacgaggccgaggtgctgaggtgggtgacctgcgcggccttgcccggcagcccgagcggggcggcgagccggtccagggccaggg

SEQ ID NO: 2349 - DNA, 513 bp, Unknown
  Kingdom: Bacteria, Phylum: Actinobacteria, Class: Actinobacteria, Order: Streptomycetales, Family: Streptomycetaceae, Genus: Streptomyces
agcggtcacccgcgccgcccggggcgcctcaccgctcctcgatgaacgtcccggcgtcccgctcagcgcggggcttcggcggctcggcggggtgaccgaccgccaccgcccccatcgggtcccagtccgccggcagttccagcacctcgcgcaccacgtcgcggcagaacatcgtcgaggacacccacgccgagccgagccgctccccggccagcgcgaccaggaagttctgcacaccggcgcccgcggcgaccacgaacatctcccgctcggcaccgtcgcgccgcgcgtcgccgtaggtgtgcgaaccgtccatgaccaggcagggcaccaccaggtacggggcgtggcgcaggacgtcgccgcggcggacccgcttggcgatcgactcctcgctcttgccgtcccgtcgcaggtcggcgatccaggcgtcgcgcatcgcgtccagcagccgcgtccgcgactgctcggactccagcagcacgaaccgccacggcgtggtgtggtgcggcg

SEQ ID NO: 2350 - DNA, 1362 bp, Unknown
  Kingdom: Bacteria, Phylum: Actinobacteria, Class: Actinobacteria, Order: Streptomycetales, Family: Streptomycetaceae, Genus: Streptomyces
ggagccgttcgaggccgcgcgccaggtgctggaagggcgaccggccggagggagaagccggtctgcggcccggcagggcgctctcgccggcggactcgcggtagaccgcgagtgcctcgttggcacgctcggccgcgtcgcggtacaggtcccgggacttcgtcatcgcgtcgagcgcctcggcgtacatggccaccagctcgcgcgcgtgggcgagctcctcctcgagggtcctgaggtgccactgctcccgcaacgcggtcaacgcctggtcaccgccgtccggcagcggcctgggcagcgcgtcgaaacgccggagggcgtcgaggacctccgtcggttcgttgccgtcgaggaagacgctgcgcaccgagaaccgctcggcgtcgtagccgggggccaccggagcaccgggcaggacgacggcgccaccgcgcggcacccgggacccgtagtcgtccagcacccagttgacggcccgcagccgctgcggcgcggcacggtgttccacgacccggtgccgcagcccctcgggcagcagccgcaccagcgccgaccggccgcgctcgtcgggtgtcatggcctcgtgcacgaccacgtggacgcaccaggtgtcgcgcaccgcgtgccgcaggacgcgccggagttccttgtcgtcctcgggcagcgcgttgacgtcacccagccgcagcccggtgacggcctcgtgggcccagccgtccgcgccggactcctgcggccagaacatggacacgggtgacggccagcgcgggtcccagggctgctccgcctccgccaccaggacccactgctgtccctcggcgccgcgcagcggcgacagcgcgagccgggcccgcacggtcacctcgcccggggcgagccagcgggcctcgaagacgtgctcgcggaagcggtcgacgtcgtccggctcggcgtggctgtgcaggacgccgccggccttgagctgctccaggtggcgccgcacggcatccgcggcggcaggaccgggatgacggccgcgggcgaaccacagggtgggcggtgccgcggggcgggaggcggaagagttcgacatgggccaatctgcgggcggggacggcggtcgctccccagtatcaccgctgcggatcatgatcggtgcgccgggtcccgcgaccggtgcggcgcggactctctccccggtgccaccgggcccgccgcgaccggctccgccggaggtcaggccgcccgagcgcgtccgtccgcctctgccgccggtcccgcccgggccacccgggcacctgtggcgcgcgggggcgcgacgttgacgcggtggcgcgacggcggcggtcgcagggtgatgagggtggcgccggtggtgac

SEQ ID NO: 2351 - DNA, 771 bp, Unknown
  Kingdom: Bacteria, Phylum: Actinobacteria, Class: Actinobacteria, Order: Streptomycetales, Family: Streptomycetaceae, Genus: Streptomyces
ttgctggaggacgtctcctccccggtcgtcgaccagttgcagtcggccgccgtcgccgcgggccgcgccgtgggcagcccggccggcgcccagttgacggacggcgggcagcacgggtccgccgcggggcaggaaacactggtgggagccggtcagggggccctcaccggtgcggccggcctcgcggccggtgcggacgaaatgatcgtccacgcaccggtgcccgaccacaacggctttcccgagtacggaggtgccggcctgttgccccccgccgcagcggaccaccccgcgccgtcgtccgacttcgggccgcccccggccacaccgggcacgacaccgggcgcaacgccgggccaggtcccgcccgcaccacacccgtcggccgagcagccgcagccttccgtcccgccggccccgtccgctcccccggcgcccttcacaccgccggtcgcctccgcgccgccggagccgtacataccagccgagcagtacacgccgaacaccccgtacccggccatggacccgtccgcgccggccgacccgtaccggccggtggacccgtacactcccccggcgtcttccgtgccaccggccgccgacgcatccgtacggcggagcgcggtgccgcgtcagggccgtcccgcacccgccgcggaccaccccttcgggccggccgtggcgccgacgcctgcgacggcggccacggctccggcctccgctccggacgacgtgccggacgcctcccgcccgctgacgacccccacggtc

SEQ ID NO: 2352 - DNA, 709 bp, Unknown
  Kingdom: Bacteria, Phylum: Actinobacteria, Class: Actinobacteria, Order: Streptomycetales, Family: Streptomycetaceae, Genus: Streptomyces
cagaggtcacggcccggcgggaccccgccggcggcggagccgcccagcggccacgggaccggacccgaagccgcccggcggccacgggagcgggcccgtcggcacaagatccatcatagatttcgagacaagagaacggcggcgacgagatgcggctgcgcgcactgctggacaccgatgcgctgggcctgaggctgctcggcggcgaggacgagctggaccgcaccgtccggggcgtcatgaccaccgacctgcgcgaccccagccgctacctctccggcggcgagctggtgctgaccggtctggcctggcgccgtgacgcctccgacgccgagccgttcgttcgggtcctcgtgcaggccggggtcgtcgcgctggccgcgggcgaggcggagctgggcgccgtgcccgaggacctggtggtggcctgcgcccggcaccggctgccgctgttcgcggtgcacgagtcggtggcgttcgccacgatcaccgagcacgtggtgcggcaggtgtccggcgagcgcgccggcgacctggcggccgtggtggaccggcaccgccggatgatgacctccggcccggccggcggcggcccggacgtggtcctggacctgctcggctccgacctcgacctgcgcgcctggctgctctcccccaccggacggctgatcgccgggccgaaggtgggcggcccggcgatcagccgtcc

SEQ ID NO: 2353 - DNA, 1763 bp, Unknown
  Kingdom: Bacteria, Phylum: Actinobacteria, Class: Actinobacteria, Order: Streptomycetales, Family: Streptomycetaceae, Genus: Streptomyces
cgccgggcgccggagcgcccgaaggcgtcctgagctgtccggcgggcggacctcacccggccgccgtgcgcgccccctgtccccgtacctccaggcccgcgaggagttcctccgtggccgccgcgatcgcctcgaccgcgtggtcgaagacctcgcggttgtgcgcggcgggcgcgcggaaccccgagaccttacggacgtactgcagggcggcggcgcggatctcgtcacccgtcgcctcctcgggcagggcgggcggacgcagcgtcttgatactccggcacatgactccagtctccccgctgtgggcctccgccgtccggcggaggaaacatgcgtgcccgcctcggacgtcggcgggcgtcagcgtgcgcccggcacccccgccaggtcgacgcgcgccaggtcggtccgcaccaggtcggtccgtgtcaggtcgcggtccgtgtcactccgccggtgccgtcaggtcgaggcgccagtcgttcgacgtgatccagtggcccttgggatactcgaactcgaccgcccccagcagcgtgaaaccggcccggcggcagacaccgttggaggcggcgtggtccgcgctcggatacgcgtgcagccagcggtgcgtaccttcggcacgcgccttcgccgccaccgccgacgccgcgcgcgccgccagtcccctcccctggaacgccggcgatatcgcccaccccgtctcccacacggtcccgccccgccaggaccgctcccagaagccgatcgcgcccacggtgcgcccgtcgcccgccgacaccacgcggaacatccgccccgcaggcagctccaggtagcgccggtggcgctcggcgagtttctcctcgctctccgggccgcccaggtgggcggtcatctcggggctgttgtgcagccgcagcagccagaagtcgccctcgccccacggctccaggcgtaccgtcgtcccgtccgtcccgtcgtccgtcttctccattccgtcaccgtagggcaggggtctgacaacgggccgcgaccggcgggttcttcgaacgcatgaacccaccgaagcaactcgcgactcaaaatcgaacaggcgtagcattgccgcgtggctacgccctatgacttcccgagtgacctcctcgccggccaggaggaactgcatcaggtccgggccgagctgtccgacctgctcagacggctgccgtggtcggtggaaccgctggacggcttcagcgacgacggcggctggcgcaaggtggagcgccccgcctcgccgggctggtccgccgacgaacaggccgaggtggagaagctccgccgccgcgagcacgagctggcggtgttcgtcaccactcaccgctactggtccgaggtcaccggcgccgacgccgtcaccgcccgcagccggctcaagcacgcccacgagaaccccgacaacgcgcggggggaggacgggggcgggagcggcagcgcctgatccggtacccggccccggcgcacaacgggtttgcggggcagtccccctggcagggtaggctgtccactcgtcccgggtgcgtagctcaggggtagagcgcctgccttacaagcaggatgtcggcggttcgaaaccgtccgcgcccaccggtcgcgacacgcgagcgaaggcccaggtccacgggtgtcccgaggacctgggccttcggcgtccctgcgatcgagcgcccggggcaggcgcgtacgggggttttccccaccccgcttccggcagtgcgccgcattctccgcccccgccc

SEQ ID NO: 2354 - DNA, 654 bp, Unknown
  Kingdom: Bacteria, Phylum: Actinobacteria, Class: Actinobacteria, Order: Streptomycetales, Family: Streptomycetaceae, Genus: Streptomyces
ccgccggggtgcacgccgacggcgaggtcgtgcacgatcccgatcggcatgccggcttcgcgggcggtgcgctgggcggcggtgagctgttcgtcggtgagccaggcgaggcgggagtggaagtcgacgcggtcggagagttcggcgcgggcgcgggcggtctcggccgagcgcgggtccctgagcccctcgggccaccggctccagtccgtgccgtgcacctcggccagtgcgcaccaggtcgcgtggtcctccagtgcccggccctcgcgggtgaggaaggcggcgtaggcggcggcgcggccggggccgagcggtacccggcgcagcacttccagggcctggcgcttgaggtcccacacggcgtcccggtcgatcagcgcgccctcgccgaggacgtcggcgcgcaggtgcgcggcctgttcccgcagggcgtgcagccgctcgcggtccgcctggccggtggcgtaggggaactcggggacgtcctcgacgcgcaggtggacggggtcggggaagcggcgggaggagggacggtagggcgaggggtcggtgggcgtgcccaggacggccgcgtgcagcgggttgacctgtacgaacccggctcccagcgcgcgcccggcccagccgctcagctcggcgaggtcgccgagg

SEQ ID NO: 2355 - DNA, 956 bp, Unknown
  Kingdom: Bacteria, Phylum: Actinobacteria, Class: Actinobacteria, Order: Streptomycetales, Family: Streptomycetaceae, Genus: Streptomyces
  misc_feature (684)..(777): n is a, c, g, or t
acctgcgcaccgagatgtacgggtcgatcacgaagctggacggccgccgccaggacgacctgtccaccgggcaggtcatcggccgcgccaccagcgacctccagctcatccagggcctgctgttcatgctgccgatgaccatcggcaacgtcctgctcttcgtcatctccctggtgatcatggcctggctgtcgtggccgctgacgctggtcgcgctcgccgtcgcccccgcgctcggctggatcgccaagcgcagccgcagccggctgcacccggccacctggtacgcgcaggcgcaggcggcggccgtcgccggcgtggtggacggcgcggtcagcggcgtccgcgtggtgaagggcttcgggcaggaggagcaggagaccgccaagctgcgcgcggtcggccggcggctgttcgcgggccggctgcgtacgatccggctgaacgcgaagttcaccccggccctccagtcggtgcccgcgctcggccaggtcgcgatgctggccctcggcggctggctggcggtgaaggggcacatcacgctcggcacgttcgtcgccttctccacctacctcgcccagctcgtcggcccggtccgcatgctcgccgtggtgctcacggtcgggcagcaggcccgcgccggcaccgaacgcgtgctggagctgatcgacaccgagcccacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctccggcaagtccaccgtctccctgctcctgccgcgcttctacgacgtcacccacggcgccgtcctgatcggcggccacgacgtgcgcgaactgaccctggactcgctcagggccgccatcggcctggtccccgaggactcgttcctcttctccgacacggtccgcgccaacatcgc

SEQ ID NO: 2356 - DNA, 513 bp, Unknown
  Kingdom: Bacteria, Phylum: Actinobacteria, Class: Actinobacteria, Order: Streptomycetales, Family: Streptomycetaceae, Genus: Streptomyces
ccacgacccgccggctccagtccgtgccccaggcgtccgacacggcgggcaccgcgtggtcggcgaggcccgcgtagccgcgcagcgcgcccgtgttctgtccgacgccgaggacgatgctgctgcggccccgcaccaccgacacgctgccctggtcccacagttgctgtgtggcgccgcgcgcgggccggtcggagtcgacgtaccacgtgccgccgacggtggtggacagggtcagggtgcgcgcgacggtgacgggggccgtgtcgtaaccggtgacccggtagctcaggtcggcgtcggcggtggcgcggtcgccgctgcggtgcagggcggtcacgcggtaggaccaggaggtgaacggcacggcgtcgagccgggtgtacggcgcccgggtgccggtggtggcgtacgtcgccgggtcgtggtggagcaccgctgccgcacgcgtgtcgagcagccgttgcacctggtcacgggcggtggcggtggcggagtgcccgccgcacgccg

SEQ ID NO: 2357 - DNA, 703 bp, Unknown
  Kingdom: Bacteria, Phylum: Actinobacteria, Class: Actinobacteria, Order: Streptomycetales, Family: Streptomycetaceae, Genus: Streptomyces
ccgcgcaggaccgcagcggcccgacggagagcgccgcgcaaggccgcagcggccggacgggaagggccacccatggccgcgacgaccggacgcggaacgccgcacaggaacgcagcggccccacgggaccggccccgcaggaccgcgacgaccggacgggaagggccgcccatggccgcgacgaccggacggggagcgccgcacaggaacgcagcgaccggacgggcaggccgcgcaggaccgcagcggcccgacgggaagggccgcgcaggaccgcggcggccggacgcggagtgccgtgcagcgccgcgcagggccgcgggctactcggtcgtcgtcgccttcagggccagccacagctccatccggacgtccgggtcgtccagggagcggccgaggatctcctccacgcgccgcatccggtagcgcagggtgtggcggtgcacgccgaggtcggctgccgccgcgtcccactggccgtgcctcgacagccaggcccgcaggctggccaccaggtccccgcggccgatcgcgtcgtgctcgtacagcgcccgcagcagcccgtccgcgaacgcgcgcaccgcgtcgtcggccagcagcggcagtacggaccccgacgccagttgctcgtgctcgaccagcacccgtccgcgccgtcgcgccacggacagcgcctgctcggcctgcttgtacgcggccgcgg

SEQ ID NO: 2358 - DNA, 884 bp, Unknown
  Kingdom: Bacteria, Phylum: Actinobacteria, Class: Actinobacteria, Order: Streptomycetales, Family: Streptomycetaceae, Genus: Streptomyces
cggagcgccggagcgccggaggagtgtgtcctgcggggactgaccgcggtgacgagacgacgttctcccgttcctctcctcacctcacctcggggtcgctcgatgcctctcgctctgtacctgctcgccatggcggtcttcgccatgggcacctccgaattcatgctcgccggactccttccggacatcgcgtccgacctccacgtaccggtgggcacggcgggcgcgctcacctcggccttcgcgatcggcatggccgtcggcgcgccgctcatggccgtcctcacccggaaccgctccggacggaccggactgctcgcgttcgtcctggcgttctcggcggcgcacgccgtgggcgccaccacgacgagtttcccggtcctgtgcgccacccgggtcgtcgcggcgttcgcgtacgccgggttcctcgccgtggcggtgacgacggcggccacgctggtcggacccgaccggaagggacgggcgctggccgtgctgctgtccggcacgacggtggccacgatcgccggtgtcccgggcggctcggcgctgggcacgctgctcggctggcgtgccgccttctgggcggtcgccgccctgtgcctgcccgcggcggccggcgtcctcaaggggctgccggcgcggcccgggagggcggacgcggagggctgcgggccggaactgcgctcggaactggggcagttgcgcagtccgcgcctggtcttggtgctgctgctcggcgcgttggtgaacgccgcgaccttcgcgagcttcaccttcctcgcccccgtagtgaccggtacggcggggctgggcgcgctgtgggtcccggtcgtgctggtgctgttcggcgcggggtccttcgtgggggtcaccgtcgccgg

SEQ ID NO: 2359 - DNA, 1037 bp, Unknown
  Kingdom: Bacteria, Phylum: Actinobacteria, Class: Actinobacteria, Order: Streptomycetales, Family: Streptomycetaceae, Genus: Streptomyces
acgaccaggcccacccgccgatcacccggccgacgaccaggcccacccgccgatcacccggccggcgaccaggcccacccgccggtcaccggaagcgcggcaggtcagtgcgccgctcgccgtggcccgccgccgcgtcgctcatcgggttcgcggtctgccgtggaccagccgtcgggccagtcgttcgccctgtgccacggccgccgcgtggtcctcgatgcggtcgatccgggagttctcgaacacgatgtaggtgacgcccgagcgcgcgccgccgccgcgcgggtcggcggggatgccgagctgccgggcggcggcgtaggaggcctcgccgatgacgtcctggggccccgtgtcgccgacgaccgcgtagcgcacccggccccggtagacgacggcggcgaccgatccgccgcgcaggccgtgggcgcggtggttccagatgcggctcggggcgggcagcacgatgtagggcaggcgttcggcgttcagccggcggccgtcggactgcgcgtaggcggcggcgggtgagaactgcgggtcggtgcgccggttgcagcggcgggtgggccgtccgtcgcagtcgatgtccaggtcggccttccagtagacggcgccggacagcccgcagaccgggatggtggcccgaaggcccgcgtcggagcggtagcggccgtgggacacctggtcgcagtggcgcgtcctggccagcaggtcggcggcgccgacgtggccctcgtcgtcgctccgggccgccggctccgtgggcggccggtacgggacgggagcggcgggcagtgtcgtcggagccagcagggcggcgctcgccgcgacaagggtcaacgactggacacgcacgatgagcaaccctctcctcggggacattgactgactttcatctcatcggtgatgaaggtgatcgtgcggcacacgttaggggaccggacggcgcgtggcgcgtaatcgccgcctggcggccgggggccgggccggagggcctcggccgccccggccgccaggcggcgattacgcgc

SEQ ID NO: 2360 - DNA, 672 bp, Unknown
  Kingdom: Bacteria, Phylum: Actinobacteria, Class: Actinobacteria, Order: Streptomycetales, Family: Streptomycetaceae, Genus: Streptomyces
ccctgcgcgccgacgcggccgacccgggcgaggcggcggacgtcgtcggacgtgcggccgacgcgctggactcgctcgacgtactggtgaacaacgcgggggtcggcctgctgggtcccgtggagagcctgaccctcgccgacgccgaccgggtgctcgccgtgaacgtgcgcgccgtcttcctggcctgccaggccgctgccgcgcggatgcgggacggcggccggatcgtcaccatcggcacctgcatgacccagcgcgtgccgggtcctggcgggaccctctacgcgaccggcaagtccgccctgatcggtctgaccaaggcgctcgcccgtgagctgggcccgcgccggatcacggcgaacatcgtccatcccggcccgatcgacaccgacatgaaccccgccgacgggccgtacgcgcccggtcaggcggcgatgacggcgctcggccgcttcggcaccgccgacgaggtcgcgtcgatggtggcgtacctcgcgggagcggacgcggcgtacatcaccggcgcggagttcgccgtggacggcgggcacgccgcctgagtccgggcagggacgggcctcgcggggcgcgccggtgctgtcatgccgggcgccccgcgggccgtggggcgggtgtggtcagccgcccagttcctggtcgcgggcggcc

SEQ ID NO: 2361 - DNA, 630 bp, Unknown
  Kingdom: Bacteria, Phylum: Actinobacteria, Class: Actinobacteria, Order: Streptomycetales, Family: Streptomycetaceae, Genus: Streptomyces
gctgggagcccgagctgtcggtgcgggtcgccgaggccggggtgtggggcacgaccgtgctcgccgccgcgaccgccaaggccgaggcggacgccgtcggcacggacgtcctcgccgaggtgaccgcgctcgccgagcgctgcctgctggccgggctgtccgacgcgctgcccgtggtgatgcgcgtgctcgccgaccgggcggcactcgacgccgacgtcgggcacctcgcccaggccctgccggccctggtccgttccctgcgctacggcgacgtgcgcggcacggacaccgaggcactggccggggtcgccgcgggcctcgccgagcgggtcttcgtcgggctgccccccgcctgcgccgccctggacgcggacgcggccgaggagatgcgacgccacatggacgcggtccacacggccgtgggtctgcttggggagaccctcggggcgggccgcggcgatctgcgggcccgctggcacggcgtgctccgggtcctgtcgggccgggagagcgtggccggcgccgtccgggggcgggcggcgcggctgctgctcgacgacggcgcggccgagcaggacgaggcggcccggctcatggggctcgcgctctccccgggcacgccgccgc

SEQ ID NO: 2362 - DNA, 1219 bp, Unknown
  Kingdom: Bacteria, Phylum: Actinobacteria, Class: Actinobacteria, Order: Streptomycetales, Family: Streptomycetaceae, Genus: Streptomyces
gcgatggcctcggccagccggttctcgtccgccatgtgggccccgaggctgcgcaccagcaggtgcggtgccgcgtgcaggacgtcgacctgcagcgtccacagctcgtgctgctgctcgacgcccaccagttcggcggccacggcgtcgcgtacggcctccagcggggagagcgtggcgggcgcgtcgagcacggcccgccggacccgggcgccggtgtccgcgtcgaggatcaggaaggcgtcctcccgcgactcgaagtagttgaagaacgtgcgcaccgagacgcccgccgcggcactgatggcctcgacggtgaccttgtccaccccgtgctcggcggccagccgcaccgcggcctcggcgagagcggcgcgcgtcgcccgcttcttccgttcccgcagtccgccgccggcggtctcttccttcgactccttcgacacaatgtgcatgctatgcaaaaatgcagagcatgcaaagtgaagccgcgaccgacggctgatcccgccccctcgttcctcgctccaggccggcatggtcggcgacctcttcgagaagcagctccaggaggagtacggcgtcaccaccggccactggccgtccgcgttcggccggtccaccgtcggcggctggattctgcacctcgattctgcacctcggcgccgcgcgcgagggcgaggtcagggtgcgcaccgcagccgcctggctctgccactccgaccagtccgtcgtcaacggcgaccgggtacgccccctgccgacggcgctgggccacgaggcggtcggcgtggtcgaggagaccggccccggcgtcgaccggctcgcccccgccggccacgtggcgctcgcctgcgtaccgagtcgcggctactgcccgcgccgcaacgagggccggcccgcgctgtgcgaccgggccgccgccaacggctccggcgccctgctccacggcccgtccctgcccaccgacgcctccggagccacggtccaccaccacctgggcatctcggcctccgccgaacacggcgtcgcggcccaggagtcggtggtgccgatcccctccgacgtgtcgttcgccgtcgcctcgctgttcggctgcgccgtgctcaccggcgccggggccgccgtcaacaccggccgcctggggcccggccggtccgccgtcgtctacgggctcggagaggtcggcctgtccgcggtgctcggggcccgcgccgcggac

SEQ ID NO: 2363 - DNA, 548 bp, Unknown
  Kingdom: Bacteria, Phylum: Actinobacteria, Class: Actinobacteria, Order: Streptomycetales, Family: Streptomycetaceae, Genus: Streptomyces
tcggcctgcgcaggcgctggtgggttcggcctgcgcgggccgctggtgcgggcgggcccagcgcggcgggggcgccgtagggagtctggggtggccgggcgttcggtgccgggagtgcttctggggccggcggggcagggtcccggtcatgcaggtgtgtctgaacggatcccggacagccgtcgacggcacggcggtgccgctcactccgcaggcggtggccgagtccgcggcacaggccgtcgcggccggagcgagcgaggtgcacgtccatcccaggacgccgtgcgggcgcgagagcatgtcgccgcgtgtggttgcggccaccgtcgaggcggtccgggaacggatggccgtgccggtcggcgtgaccacgggggcctgggccgagcccggcccggcggcccgcgcggcgcgcgtgcgggactggacggtgctgcccgacttcgcctccgtcaactggcacgagccgggcgcggaggagctggccgccgtcctgctcggcctgggcgtcggcgtggaggccggcctgtggtccggtacggacg

SEQ ID NO: 2364 - DNA, 574 bp, Unknown
  Kingdom: Bacteria, Phylum: Actinobacteria, Class: Actinobacteria, Order: Streptomycetales, Family: Streptomycetaceae, Genus: Streptomyces
tcgtcgagcgaggtgcgccgcagcacccggcacagcggccgcatctcccgctcgcccgccacgctccaccgcgtcgcggcctcgtgcgcgtcggccgggcggtgcgtacggaacttcagcagcgtgaacggcctgccgtcccggccgatgcgctcctgccggaacagcacccccggcccctcgaccagccgcagcagcgccgcacacgccagcagcagcggcccggtcagcagcagcagggcgccgcagaccaggacgtccagcgcccgcttgcccgcactgccgcgccgcgcacccgacatcagcaggcgccggcaggagaacccggccagccgctgcttcgtcgcgtacgacggcaagtccgcgtcgatctcccacaccgcgcaccccgactcggccagcgcccgcagcagcggaccctgttcggtccgtacggagggatggacggcgagcaccgcccgcaccccgttctgcacgaccgcacgctccacctccgcgccgcaggtcagcacgggcagcccgcccgcaccgccgtccggctgcccggcgacgaccccgaccggcaccgcagcac

SEQ ID NO: 2365 - DNA, 977 bp, Unknown
  Kingdom: Bacteria, Phylum: Actinobacteria, Class: Actinobacteria, Order: Streptomycetales, Family: Streptomycetaceae, Genus: Streptomyces
gagcaggttcacggcaggccgggccagcacctcgtccggtgcccagccgagcagccgacgcgcgccctcgttccactcgacgaggacgccgtgctcgtcgacgacggcccgtgccgtggcggcatcgtcgaacggatagaccggactcatcctcgtcactccaacgcgcacactcacagtgatcagccgtgtcactcgcgttccagcctagtgcgtaccggctccgtgcggtcggccgcccccgggaaggatccgggaaggatcggggaaggatcgggcggtaccgtcccaaacccctgtgaccaggggctatttacgcgtcagtaccatcgcggtaccgtatggcccatgccagcgctcaatgtggagttcagcgaccgcgagctagaggacctgcggcagatcgccaaggaacgcggtacgtcgatgaaggcgctcgtgcgcgaggccgccgcggccgacatagcccggcaccgggccctgcaggagggagccgaggcgttccgccggttcttctccgcccacgccgaggaattcgccgccgccttccccgacgacgagcggcccagcaggggcgcgggacgggccgcctgagcgatgacccccgccctccacatcgacgtgccctggctgctccagcgccacgaggaagtgctgccggaccagcccaccgtcgacgacttctcggctctggtggccgccgtcgcccgccaccgcgtggatccgccgcgcctcggcgtcgactccgaccccgcctggcgggccgcggcgctgctgcacaccctcgccgtgctcaagccgctgccgtcggccaacgcccgtttcgcctgcgcgaccgccgtcgcctacatgtacgtcagcggcgtcggcatcgatccgccctacggcgccctcgtcgagctcgcccgcgacctgatgtccggcaagaccgacgtctacggcgccgccgaccggctgcgttcctgggagatctgacc

SEQ ID NO: 2366 - DNA, 827 bp, Unknown
  Kingdom: Bacteria, Phylum: Actinobacteria, Class: Actinobacteria, Order: Streptomycetales, Family: Streptomycetaceae, Genus: Streptomyces
tgtgtggaggacctggctcacatccgctgctttcgctcgggggagggggcgcgggcgcaggctccgtgcccaccgtccgtttccttacggttctcttcccgttctcttacgacggaacgggaccgtatcgtcgcatcgtgagcgtaggcccaaacgacgtcgcaacgcaaccgtttcgtcgccacgccctatgctggaggccatgacgacgaacgccggcgaatcccagacgcgtccgcgccgccgtgcccccgcgggggcggccgtactcagggaggacgtgacggaggcgatccgggccgccgtgttcggggagctggcggccgtcggctacgcgcgcatgtccatcgagggcatcgcgcggcgcgcgggcgtcggcaagaccgcggtgtaccggcgctggcgctccaagctgcacctggtgctcgacgtcgtctccgcgctcgccgtccagggcctgcccgcacccgacaccggctccctggagacggacctgcgcctgctgtacgaggtgacctcgcgcgccctgcgccatcccgtggcctcgcagatcctgcccgacctccaggccgaggcggcccgcaatcccgacctcgccgaggccgtgcagaaggcgctgcgcgacggtcaggagggcgtcgccagcagcatcctcgcggcggccgaggaacgcggcgaggtccgcgccggactcgaccgcgacctggccctcgacctgatctccggcccgctgtactggcgtgccgtcgtcatccgcagcccgaagctccccaagggctacctcggcggcctcgcccgcgggacggcggaggcgctcaaggcgctgt

SEQ ID NO: 2367 - DNA, 1947 bp, Unknown
  Kingdom: Bacteria, Phylum: Actinobacteria, Class: Actinobacteria, Order: Streptomycetales, Family: Streptomycetaceae, Genus: Streptomyces
ggcgggcccctcgtcgcgagcgccggtgccgcccgtgccgcaggcggacaccaaaagggccagggcggcgagcacggccaccgccgtgctcaccgcctggaaggtccttcgggccccgctgggctcagggccgacaccagccctgccggtcaggccgcgcaacgctcccgctcctcacgctccagcgcgcgtgcgtccagatcgcgggcctccagctcctcgcggagccgggcgagcgcccggtgcagcgtgctcttgaccgttcccgcggacatgccgagtgccgcggcggtctcttcggtggacatctgctcccagtgtcgcagcacgacgacgctgcgttgcttcggagcgagaactttcatgatgtccatgagcagcgcacgatcggcgtgctgttcggtggagtcgtcgacacaggcgtccgggagctgctcggtcgggacctcctccagcttccgggcccgccaccactcggtacgcgtgttgatcatgacgcggcgcaggtaggcgtccgcgagccgcttgtcggcgatgccgtcccagcggccgtacgtccgcaccagcgcggtctgcaggaggtcctgggcgtcgaccgggtccggcaccagccggcgcgcactgcgcagcagcgcgtcctgccgggtacgcacgtactcctcgaactcgagcacctcaccctgcgccatgatcaaccgcctccgctccccgttttccggcctgtgtgcgccggaccccgagcctgagtgcgggcggactgtggtcggcagccgcccggtgcctgtcgggcacggaaatgaaggtacggaggagttgtcacggcgctgtccgaagcagcctgcggctagcgctcggctgtgcgtcggttgtgtaacggacgacgtaacggggtaaggcagtgcgccagttggtcccggtatggggcgatttgtccttcagggtggcgcgcgggtctgtgacacagaagcccgcgacgccctctgaagccgtgatccggctgtgaagtgacgcagtgtcggcgacggcgagtcggtgacagagcgtcagtggtgtggtgtggcgtggtcaggtcagtggcagccggtacaggccgccgggcagcggttccaccagaccgtccgcgacgagcccgtccagggcccgggcgcgctggaccggctcgtgccacacccggtcgagcaccgcctgcggcaccgccgtgtgtgcctcccgcagcacggcgagcagcttgccccgcacctgacggtccgtaccggcgtacgtctggccgcggcgcggcggtccgtcgtgctccggcttgcccgccagccgccacgcgcagtgcgcggcgatggggcagcgctggcacgactcgttcttcgccgtgcacaccagcgcgcccagttccatcgaggcggcggcccagcgggcggcggtccgctcgtcctcgggcagcagggtgcgcgccaaccggcgttcggccgcggtggtcgcgttcggcgggtactgcaccccggtgaccgcgcgggccagcacccggcggacgttggtgtccagcacggcgtgccgctgcccgtacgcgaaggaggcgaccgccgccgccgtgtactcgccgatgccgggcagggccagcagctgcgcgtgctccgtgggtacgtcgccgccgtgccgttccgttatggcgaccgcggcgccgtgcaggcgcagggcgcggcgcgggtagccgagccggccccaggcgcgcaccgcctcgccgggcgcctccttggcgaggtcggcggggcgcggccagcgctccagccactgctcgtagacggggagcacgcggctgaccggtgtctgctggagcatgaactcgctgaccatcacgccccaggcgccagcgtcggcgcgccgccagggcaggtcgcgggcgttgccgtcgaaccaggtgatgacctgggtgtgcagggtctcgtggagccggcc

SEQ ID NO: 2368 - DNA, 1140 bp, Unknown
  Kingdom: Bacteria, Phylum: Actinobacteria, Class: Actinobacteria, Order: Streptomycetales, Family: Streptomycetaceae, Genus: Streptomyces
ggcgacagcttccaccgcgcccggcgcggtggaagctgtcgccgtgggccgtggccacctacctgctcggcggcaccctgccggacggcacggtgatcacaccgaagtacgtcggcccgcgccgcatcgtcgaggtcgccgtcaccacgctggccaccgaccgcgccctgctcctgctcggcgtgccgggcacggccaagacctgggtgtccgagcacctggcggccgcggtcagcggcgactccacgctgctggtgcagggcacggcgggcaccccggaggaggccatccgctacggctggaactacgcgcgactgctggcgcacggcccgagccgggacgccctggtgcccagcccggtcatgcgggccatggccgagggcatgaccgcccgcgtcgaggagctgacccgtatcccggccgacgtccaggacacgctgatcacgatcctgtcggagaagaccctgccgataccggaactgggccaggaggtgcaggcggtccgcggcttcaacgtgatcgccacggccaacgaccgcgaccgcggcgtcaacgatctgtccagcgccctgcgccgccggttcaacacggtggtgctgccgctgccggagacccccgaggcggaggtggacatcgtctcccgccgcgtcgaccagatcggccgctccctcgacctgccgtccgtgccggacggcgtcgacgagatccgccgggtcgtgaccgtcttccgtgaactgcgcgacggcgtcaccgcggacggccggacgaagctgaagtcgcccagcggcacgctgtcgacggccgaggcgatctccgtcgtcaccaacgggctcgcgctggccgcgcacttcggcgacggcgtgctgcgggccggcgatgtcgcggcgggcatcctcggcgccgtagtccgcgacccggcggccgaccgtgtcatctggcaggagtacctggagaccgtggtccgcgagcgcgacggctggaaggacttctaccgggcctgtcgggaggtgaccgcgtgagcggcggggcgagcgtgagggggacgggtccggtggcgtgtgcgagcgggacgggaccggtggcgagggtgagcacgacgggagggacggtggcgggcggcggggcgcgggcccgcgcccc

SEQ ID NO: 2369 - DNA, 574 bp, Unknown
  Kingdom: Bacteria, Phylum: Actinobacteria, Class: Actinobacteria, Order: Streptomycetales, Family: Streptomycetaceae, Genus: Streptomyces
ggcggcggcggccggtgccgtcagagcgccgagcaccagtgcgcagacggcggtcgcgacgggcaggactcggcggcggctgcgggccgtccggccgtgctggtggggaacgccagggccggtcgcgccggtcacggagtgcggaggtcggtgcgtggtgcgagctctctcggacaagggggctctcccgtctacggacacgtcagggcgacatggcggagacactctgcacccaggacgcttattcgtgcaagaagtaagccagtttcttgcaggatcacgcatatggcgggtggcgtcagggtaagcccggcactgcgggacccgcggccccggcacccgtcatcgcccttcacggccgactacctgcacacgcgcggcgcttacgcacacccggcgcgtacgtgcccgggtcggccgcactgcaccactcgcgccgctcgaaccgagaagaaacgagcacccatatgcccgctgctcccccacggcgcccgcgccggccccgtctcctcagatccgccgccgtcgccggcgggatcggcctggcactgctggccggcgcgggcgccgtggg

SEQ ID NO: 2370 - DNA, 683 bp, Unknown
  Kingdom: Bacteria, Phylum: Actinobacteria, Class: Actinobacteria, Order: Streptomycetales, Family: Streptomycetaceae, Genus: Streptomyces
gacgtggccgccgcgagcgcggagcgcttcgcccgcgccgccgcccagggccacggcggcgaggacatggccgcggcctacttcgcgagcttcgacgagcccgagccggacctgcccaccgggtgaccgggcgtcagcccaggcagaggaccagcagacacaggtgcggggacgacggggcggacgcggacgccgggtccgtggcggcggaaccggcgggcgcggtgccgctggaggagccggccggcgcggtggagccggacgaggggtgctgtgccgtcgtgccggaggaaccggccggggccgagccgccgctgccggacgtgccggaggaaccggagtggacggaagacccggaagagccggaagtccctgaatatccggaggaggtgtccggggacgagacctgggaggtgcccgagtgggtggacccgccggtcgccgggtggtgcgcgggtgccgggtccgccggggagatcgtggtgggcggggcggcggagtaggggtggacgccctccggcgcggtggtgccgtgcggggttccggcggacgaggaccgtgtctgtgtgacgccggtcgtggaggtccgcgccgaggaggccggggaggcgtcccgggcgtcggaggagccggccggctcgctctgccggacgggctgctgcctgccgacgctgtcggggtgc

SEQ ID NO: 2371 - DNA, 521 bp, Unknown
  Kingdom: Bacteria, Phylum: Actinobacteria, Class: Actinobacteria, Order: Streptomycetales, Family: Streptomycetaceae, Genus: Streptomyces
cgcatccatcacgtgggccgctcgctgtcggggcggcccacgtgatggatgcggaagccttccggctgctccggttccggctcaggcgcgtacggcccggccgggacgtacccgaacgcgaaccgctcgccgcgccgcgcgccgaacaccccggcgtccccggagccctgcgcgcgcccgtgcagcccggagagcctgccgggaaagcctccggcgcccagcggcgaaccgctgtccccgtcgccgcccggcagcccctggaggcgggccaggaagctctcggagggcggcggcggggccgtctgggcgaagacgttcttcaggcggcgctgggcgtcgacctccgccttgcacttcgggcaggtggccacgtgcgccaggacgcgctcacgcgtctcatgaccgagttctccgtcgaccagggcggagaggcggtctcccagatgctgttccgcgaggcccctcgcggcggggggtcgggatccactcacgcggtcgcgccccctcctcccagcgcggcg

SEQ ID NO: 2372 - DNA, 735 bp, Unknown
  Kingdom: Bacteria, Phylum: Actinobacteria, Class: Actinobacteria, Order: Streptomycetales, Family: Streptomycetaceae, Genus: Streptomyces
ctgtgcctgaccggcgcccgctccgcctgggaggagaacgacgagggcgtctccccgctggacgcggccggccagatcgccgtccccgagttcgacggccgcctgatcaccgtgcccttctccttcaaggagatcgacgccgacggcctgccctcctacgtcgccgaccccgagcgcgccgcccgcgtcgccgggatcgccgtacgccacgcccggctgcgccgcatcccgcccgccgacaagcgcctcgccctggtcctgtcggcctacccgaccaagcactcccgcatcggcaacgcggtcggcctggacacccccgccagcgccgtcgccctcctgcgccggctgcgcgccgacggctacgacctcggggacggcgacgtgcccgggctggcctccggcgacggcgacgaactgatccgcgccctcatcgaggcgggcggccacgaccaggactggctcaccgaggaacaactggcccgcaaccctgtccgcatcccggccgccgactaccgccgctggtacgccaccctccccggcgaactgcgcaccgccgtggaggagcactggggcccggcacccggcgagatgttcgtcgaccgcagccgcaacccggagggcgacatcgtcctcgcggccctccgcttcggcaacgtgctcatcctcatccagccgccgcgcggcttcggcgagaaccccgtcgccatctaccacgatcccgacctgccgccctcc

SEQ ID NO: 2373 - DNA, 602 bp, Unknown
  Kingdom: Bacteria, Phylum: Actinobacteria, Class: Actinobacteria, Order: Streptomycetales, Family: Streptomycetaceae, Genus: Streptomyces
cacccagtccacgatcgactgggtgcgggcgaacgtccgccagcctgccgaggcgtagcgccccggccggacggaccggcgcgcgctcgggccggggcggtcctccggcctgcccggtccgccgcggggcgcgcgtcagcctgcccgggcgtcgagttcctcggccatcgcggaacgcagccgcaaggtcgtcaccagccgctggaacgcctccgcccagtaccccccggctccgggcgacgcgtcctccgcttcgtccggcaccgccagcagcccgtcgagccgggccgcctccgcggggtccaggcaccgctccgccagtcccatcactccactgaaactccatgggtagctccctgcgtcccgcgcgatgttgagcgcgtcgaccaccgcccgtccgagcggcccggcccacggcaccgcgcacaccccgagcagttgaaacgcctcggacagcccgtgcgccgcgatgaagccggcgacccactcggcccgctcggcaccgcccagcgtgccgagcagcttggcgcgctcggccagcgacaccgcgcccgggccgccggcctccggcgccgcgggctcgccgaggagcgcccgcgccc

SEQ ID NO: 2374 - DNA, 867 bp, Unknown
  Kingdom: Bacteria, Phylum: Actinobacteria, Class: Actinobacteria, Order: Streptomycetales, Family: Streptomycetaceae, Genus: Streptomyces
gcggctacctcggccgcgcggacctgaccgccgagaggttcctgcccgacccgtacggcccggcgggcgcccgcctctaccgcaccggggacatggcccgctggctggggtccggtgccgtcgagttcctgggccgcaccgacgaccaggtcaagatccgcggctaccgcgtggagaccggcgagatccgcgccgcgctcctcgcccacccgggcgtcgccgacgcggccgtcgtcgccgtgggcaccggcccccaggtccgcctcgacgcctacgtggtcccggcgtccggcgccgccccgctcgacgcggcctcgctggcggcgcacgccgccctgctgctgccgccgtacatggtccccgccggtttcaccgagctgccccgcatcccgctcaaccccaacggcaaggtcgaccggcgggcgctgcccgcaccggccgccgccgcacccgccgtccgtacccgcccggtcagtgagctggaggagcgcgtccaggagatctggcgcgacgcctgcggcatcgaggccggcccggacgacaacttcttccacgcgggcggcaactcgatcctcgcgatccggctcatcgccgcgatccagaccgacttcgagatcaccctgcccgtccgcgccgtgttcgagggcccgaccgtcgccgagctggcgcagacgatcgaggaccacatccgcgccgagatcgccgagatgtccgactccgaagtgatggcggactcgatgctgctgaaggagcagaacgcatgagcaccgaggaagcgacccccgccgtgtcggacgtctcgctccgcgaccagctgctgcgcagccgcctggccggccgccgcggcaggcggctgcgcagcagctg

SEQ ID NO: 2375 - DNA, 852 bp, Unknown
  Kingdom: Bacteria, Phylum: Actinobacteria, Class: Actinobacteria, Order: Streptomycetales, Family: Streptomycetaceae, Genus: Streptomyces
gcatgagcgggcggacacggttggcgctgtgcgctgcggcggccacgctgatggcggcctgcgcgctgctgccgctggtctcccccgccacctggatcgtgcaggcgacgctgatgctcgcggtgcagtcgggcgtcggcgtggccgcacgacgggtgccgctggcgcgaccgctcaccgtggcggcgcaggccctggccaccttgctgctgctgaccctggtcttcgcccggggccaggccctcgccgggttgatcccgggcccggaggccttccgtcacctggccgccctgctgcagcagggcacacaggacgtgggccggtacgcgatcccggcaccgctgtcggccggcatccggctgatgctggtcggcggtgtcctgctgatcggcctgatcgtggacaccctcgcggtcaccctgcgcagcgcggcccccgccgggctgccgctgctcgcgctgtactcggtggccgcggggctgtccgacggcggctccgcctggctgtggttcctcctcgccgccgccggctacctgatgctgctgctggtcgagggccgggaccggctctcgcagtggggccgggtgttcagcggagcctcgcgcgcggccggcggtgagtccggcgccgcggtggcaccgatccgcaccgggcgccgtatcggcgcggtggcgctcggcgtcgccctcgtggtgccgctcgccctgcccggcatgcggggcgggctgctggacgccgccggggccggggccgcctcgggcatcggcggcggcggaacgatctccgcggtcaacccgctcgtctcactgcgcgacagcctgaacgtcgacgaggaccgcacggtcctgaccc

SEQ ID NO: 2376 - DNA, 838 bp, Unknown
  Kingdom: Bacteria, Phylum: Actinobacteria, Class: Actinobacteria, Order: Streptomycetales, Family: Streptomycetaceae, Genus: Streptomyces
tcgacggactcggcgccgtgcacgccgcgctgcatccggtcgtgcggtccatcgcggcgagcacggcgccgagtccgtcgacgtcccggaccccggtggcgtccaggaccacggcagcggggttcccctcgcccagcggcaggccggtgcgggcgagcaccggggcggcgtcgaggctgctctcaccggccgtcaggtgcagcagggagccgtcgagccggggctgccgtggtgaccagcgccgtagcgccgtgggctgcgggagcccgagacggcgggtcaggaagcggccgggcgcggtgccggtgaagctcaggtagcggtcggccatgtgccgtctcccacgggtcgccaatgcctgctgtggagtactgttaccgggggtaagcctacgtcacgggtgaggagcaggtcgagatgagtccccttcaggccggaccgcgacagcccggaccgcgacagcccgaaccgcaggtgatccgccgggtggcggtcctcggcggcgcgcgcatccccttcgcccgctccgacggcccctacgtcaccgcctccgaccaggagatgctcaccgccgccctggacgccctcgtcgagcggtacggcctccaggagcccggcgccgtgggcgagttcgtcgccggtgccgtcctcaagcacagccgcgacttcaacctcgcccgcgagaccgtcctcggctccgagctggacgcgcgcaccccggcctacgacatccagcaggcctgcggcaccggcctgcaggcggtgatcgccgccgccaacaagatcgccctcggccagaccgagtccgcgatcgcgggcggcgccgacaccgcgagcg

SEQ ID NO: 2377 - DNA, 544 bp, Unknown
  Kingdom: Bacteria, Phylum: Actinobacteria, Class: Actinobacteria, Order: Streptomycetales, Family: Streptomycetaceae, Genus: Streptomyces
ccaccgaacgggacctcgccgcccaactgggcatctcccgcagctcgatgcgcgaggcgatccgcgcgctcaccgtgctcggcgtgctggaggcccggcacggctccggcatctacgtcacccagctggaggccggggacctgctggagacgttcggtgtcgtggccgatctgacccgtgggccgcgtctggtggagctgctggaggtgcgccgggtcctggagtcgacggcgaccgcgctggcggcggcccggatcaccccggaacggctggccgaggtggagaagcacctcacggcgatgaacgcgaccgacgacccggaggagatcctcgcccacgacctcgccttccaccgggagatcgcgggggccgcgggcaacgggacgatggccgcgatcctggacggcctgtcctcgcgcacgttccgcgcccgggtctggcgcggctaccaggaggagggcgccttcgcccgcactcgccgcgaacacgccgcgatcttccgggcgttgaccgcccgcgaccccgaggcggcccgcgccgcggc

SEQ ID NO: 2378 - DNA, 948 bp, Unknown
  Kingdom: Bacteria, Phylum: Actinobacteria, Class: Actinobacteria, Order: Streptomycetales, Family: Streptomycetaceae, Genus: Streptomyces
ggctgcccgagcgggcctggtacgacgcgcgccgcctcgacatcgacctgctgctgtggcggctgcgcggccatccggacctcgcggccttcgtggagcgcgcgatcggtccgctgcaggaccacgaccgccgttccaagccgccgctgctgcctacgctccagacctatctggcgcacgcgggccgcaaggcggagacggcccgcgagctgcacctcaaccggcagaccctctacaaccggctcgcccggatcggcgagttgctgggcaccgacctggacgacccgcagacggtactggcgttgagcctggcgctgcgggcgcgacggcacgtgtcggcctgaggcgcgggcgcgctctcaggccgggctcacgggttcggtcaactcgtcgtagacgctgaggacctgggcgacggtctcgtcctcggtgggccaccgggcggcctgggcagcgcccttctcccggagcagttcgcggcgttcggggtcggccagcagcctggcgacagcggctgcgagagcgtgcgcatctccgtacgggacgagttcggccgcgtcgcccaccaggtcggggacaccgccgacggctgtcgccacgagcggcacccgggcgagcagcgcctcctgcgcgagcaccgagcgcggctcccagctgctggtcaccagcgcgagatcggcggcggtgagcagccggtgcacgtcgtcgcggagtccgaggagccgcaccggcagttcctcgtcctcgatccgccgctgcagcgcggcgcgcagcggcccctcccccgccacgacgagcagcggcaccgggtcgagacggcgccaggagcccgccgcgtccagcaggaacccgtagccgcgctcccggtcgagagaaccgacggcgaggagcaacgggcggccggtggcgcccagttcggcccgcagcttggcgcgtgccccatcgggg

SEQ ID NO: 2379 - DNA, 1010 bp, Unknown
  Kingdom: Bacteria, Phylum: Actinobacteria, Class: Actinobacteria, Order: Streptomycetales, Family: Streptomycetaceae, Genus: Streptomyces
cgccgctgacggccgtgcccgcggcggcgcggcgcctggcgggttcgcgcatcacgccgctgtggagcgactggaccgccgcggacaacgtgctggccgtcaccgacaccgtcatcgagtccctggcgcacaccaccacgtcggacggccggcacctgctgatcaccggcgacagccacggcacgctgcgcagatgggagacgtacggcgctccggccggcgcgcccgcacacacgcacggcggtgccctccagcatctgctgccgctgccggacgacctgctgctgtccggcggtacggacggcaccgtacgggtgtggaacagcgcccgggggcagctgctcgccgaggccgtccaccggccccgcacctgggtcagcggcctcacgctcctcaccccggccgacggcccgccgcgcatcctcgtcgcccacagcgacggtcacctcacggcgctggaccccgtcaccttccacgtcctgcacaccgacaccgatgccgatgccgacgccgacgccggcacagccctcaggctcccgtgtctcgacccggctccggcgatcctggccgccgtaggactcgggcaggaggagggcacggcgctcgccgtcgcgcagggccggtacgtgcgggtgtggcggccgggccgggacgtcgtgcaggtcggcgagcacgaggacgaggtgcgggccgtggtggatctgccggccccgaaccagttcgtgacctgcgacgactcaggacacctcggcttttgggacgcgacggccgaaggcggcacggtgacagcgtcgccgtcggccgcccggtcgctcacggccctcgtggccgtgccggtggacggcgagccggccgtggtcaccgccggtgccgaccacgtcctgcgggtgtggagcgccggcaccctccgtaccgtcggcggcccgctcgaagggcacacggccgcgccgctggcgctgaccgccgtaccgggcgacacgccgctcgtcgtctccgcgggcgccgacggt

SEQ ID NO: 2380 - DNA, 1162 bp, Unknown
  Kingdom: Bacteria, Phylum: Actinobacteria, Class: Actinobacteria, Order: Streptomycetales, Family: Streptomycetaceae, Genus: Streptomyces
ccctggcaggcaccgccgcgagctgggaccggctcaccggagccgacatccccggccgcgacgacggctccctcgtcgtcgccaccctcggctccgccttcgacccggccgccgtgcgcgccctgcgcgacggcttccgcgccctgcaccccgacatcgacgtgcggatcaacgctgtccaggccgtcgactggtcggacttcttcgccaagatcctcacccagatcgcggcgggcaccgcccccgacctcgtctacgtcgccacggagggcgtccagctgttcgcgaagcggctcggcgtcgccctggaccgctgggtgcggcgcgacgcggccgaactgcgcgagtacttcgccgacgtccacccctcgctggtggagtcgatgatgtacgaggggagcctgtaccagctgccggtcgagttcaacgcggccgacatgtacctcaaccggcaggtgctgcggcgggcgggcgcggacctgccgccggccgactggacccgggacgacttcaccggcctgctgcgcaggatgaagcggtcaagcgacgcccacttcaccccgtacttctggaccaaccggctgtggggcggggtcgtgccctggctgttcgcgaacgggacgaacctcctcgccgagtcgaaggcacccggcggcgactggctgtgggacgccttctactcccccgcccggcgggcgggccgcggcggcggctaccggtggaccaccccgcaggccatcggcgcccggaccgaggaggcgtacgactacctcgcctccctcgtcgaggaggacctgtgcagccgcccggaaggcggcaacggcagcaacctcgtcggggtgttctccaccggccgggtcggcgtcacacccgcgggcggcttctgggcgggcggactgcacctggcgggcatgcggcccgacgcctacgacgtgcgctacttcccgcgctggcgcaccggccgccaccagttcggcgccgccggctacgcgctgctgcgcacctcgaagaggcaggacgaagcctgggagttcatcaagtacgccgtccgcagggacaccctgacccggctgttccgggccaaccagaccaccccggcccgtcgctcgatgctgacctccgcccgctacgccgggaccggcccggcgtagcgggcggaggt

SEQ ID NO: 2381 - DNA, 678 bp, Unknown
  Kingdom: Bacteria, Phylum: Actinobacteria, Class: Actinobacteria, Order: Streptomycetales, Family: Streptomycetaceae, Genus: Streptomyces
cgggcggcctgctgggcacgtccgaggggcgcgccgtgccgccgggtgacgaccccgccgacctgatcgcccgggtccgcgcgacgggcggcaccgtcgtcgccgcgggcggctgcttcgacctgctgcacgccggacacgtcggcctgctccaggccgcccggcggatcggcgactgcctcgtcgtctgcgtcaactccgacgcgtccgtacgccgccgcaagggcgagggccggcccgtcaacccgctcgccgaccgcctgcgcgtcctgcgtgccctggcctgcgtcgacgcggtggccgtcttcgacgagaacacccccgaacggctcctcgccgaactccgccccgacgtctgggtcaagggcggcgactacgccggagccgacctccccgaagcgtccctcctggaggaatggggcggccaggccgtcctcctgccctacctcgacggccgctcctcgaccgccctgatggcgagggcggcggagggagcacgatgaccggctccggcggctccggcgaactcgggtccgggggagcggaggcccctcgcctcctcgtcctccgggccctcgggctcggagacctgctcgcaggggttcccgcgctgcgtgccctgcggcgggggtttccggcgcacgagatcgtgctcgccgcgccggggtggacgacgac

SEQ ID NO: 2382 - DNA, 638 bp, Unknown
  Kingdom: Bacteria, Phylum: Actinobacteria, Class: Actinobacteria, Order: Streptomycetales, Family: Streptomycetaceae, Genus: Streptomyces
gcccagggagtagacgacgcgccgccgtccggctccggcacgggccgccgcgtcgtctactccctgggccagaaacgcgtctggctgatggacgtgcgcggcatgccgacccgtaccttcaccgtctggcccggcacggtcagccccgacccgggtgcctacgccatctcccggcgggtccccgaccccacgaagggttcggacggcgtggagatcgagcacatcatgtacttcgcgggcaagtcgggtgtcttcgtcgccttcagcaacgccgtcgacggctcctcgccgccgccggtcgcctcgggcatcaagacgggcggcgtccgcaccggcaagcaggacggcgcggccctgtgggcgttcgcggacaagggcacacgcgtggtggtcgtcaagtagggcgatgacggcgggagcgtaggccgggcaggcgggggtggacggcgacggcgcgggcgcggcgctcgatgcaggacctgatccggcagcgcggacgggcgggcttcgtgggccgcggcggcgaacgcggccggttcgagggcgcggcggcggcggagccgctgtggcgggagccggcccggctgctggacggcccgccgggcgccgggtggtgcggtgcgtcacggcctgcggcc

SEQ ID NO: 2383 - DNA, 693 bp, Unknown
  Kingdom: Bacteria, Phylum: Actinobacteria, Class: Actinobacteria, Order: Streptomycetales, Family: Streptomycetaceae, Genus: Streptomyces
  misc_feature (169)..(265): n is a, c, g, or t
ggtgccctccgggccgggagcggtggttgtccgcctcgggcgaggagcaggggcggtcgacccggaggccgacggcaagtgggcagtctgctccagccgaggcgccgaggcagtcggcccctggacccgttgcaggaggcgatcggcccccggcggggagccggggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccctcagtcggggtgccgggacgaacgggtctgcccaaagaccggtggcaggggcgattgcccccctcagtcggggtgccgggacggacgggtctgcccgaagaccggtggcaggaggcactcgcccccccagcggagagcccggacggtcggcccgaagaccggtggcagggcaagcggccgccaggcgggaagccggagcagacggccgccagacggggacctggggcaatcggcctccaggcggagagccggagcagacggcccccaggcggggacctggggcaatcggccctcaggcgggaacccggagcagacggcccccaggcgggaagccggaacagtcagccgccaggcgggaacccggggcaatcggccgccggaccgtggcaggggtggccgccggaccgtggcaggggtggccg

SEQ ID NO: 2384 - DNA, 952 bp, Unknown
  Kingdom: Bacteria, Phylum: Actinobacteria, Class: Actinobacteria, Order: Streptomycetales, Family: Streptomycetaceae, Genus: Streptomyces
cgtccggccgttcggccccgccgagcccgagggacacgccgtgcggcaccacggtcgcaccgcgttcgcgcagccgccgcagcgaggcgggcagatggccggggcacacgttctcggccaccacctcgacccagtcgacacccggcatgcgctccacggcgtccgcgatctccggccgccagccgatccccgtccccagtcgctccatgagtcccgcgccccctggtcccttcgcccccgtcacgtcccgtcacccggacgcccgcgcgcccggcggcgggtgacaggggtatggccccgccggacggccgggaaccgcgccgcaggcgtcttcagagcaagatttgagggttcgcccacgcgcggccccgacaggactaggaaccctggcgcagcgccggatggtcggcgaccaccgtgcacgaaccgggagcgatctccgtgaagcccgcgtcgcgcaccaacggcagtccgctgcccgtgagttcctgccagtgggcggggtcggcggtgcggacggagagcgggaacccggcctcccgccacgcggtgcgctgctcgtcggtcaggtcccaccaggcgagctgcgcaccgtgcccggcctgggccatcgccttgcccgcggacatctccagaccgggattgagccacagcaccgggacgtccggtccggcgggggcgggcggctccgggtcgtcgaggtcggtgccggagacctggagcttcgccaggtccttcggccagccgtccagcgggacgggcgggaagacccgtacctccgcggaccttcccgtgaccgtgatgccgtccagggcctcggcgcgccgccactccgcgccgcgcgcccgccgcaccaccttgcggatccgcgcgtcctgccagtcccgcaccgcctccgcccacggaccgtcgccgccggagcgctcgtcggcgagcagcacgagcaccgcgc

SEQ ID NO: 2385 - DNA, 577 bp, Unknown
  Kingdom: Bacteria, Phylum: Actinobacteria, Class: Actinobacteria, Order: Streptomycetales, Family: Streptomycetaceae, Genus: Streptomyces
cgtacggcgtcctgggcgccgggggccgtgccccggtcgcggaccagcggcagccacgggaggacggcggccagggcgagcaccgcccacacggccaggccgggctgccagtcaccgccgagcgcgttggtcagcggcacggtcgcggcggcggccgacgaggtgccgagggcgagcgccatcgagtagaggccggtcatggagccgacccggtcggggaaccagcgcttgacgatgaccggcatcaggacgttgctgacggcgatgcccatgagggcgagcgcgctggcggccaggaacccggccgtgctgccggcgtagggcctgatgagcagtccggcgccgatggcggccatgccggcgcacaccacggcggcgggtccgaagcggcgggcgagccggggcgccatgacgccgaagacggcgaagcagagcgggggcacggaggtgagcaccccggccacgctgccgctcatgccgagcccgtcgcggacctcttcgaggagggcgccgaggctggtgatggcggggcggaggttcatcgcggacagcacgatgccgatgacgaccaggcgcg

SEQ ID NO: 2386 - DNA, 655 bp, Unknown
  Kingdom: Bacteria, Phylum: Actinobacteria, Class: Actinobacteria, Order: Streptomycetales, Family: Streptomycetaceae, Genus: Streptomyces
ggtcccggccccggccgcggaaccggagcccgtgccggaaccggagcccgtccccgcggcccacgtcccggaccagcgcacgcccgccgacgacgaacacgaactggtggcagcggccttcgacaacgtcacggtcccaaaaccagcaaagccgacggaaccggaccaactgaggccccaggagacccgcgagaccccggaggccccgcaagccccggagacccctgagatccctgaggtccctgaggtccctgaggagccggaggctctcgcaaccccggaaacccccgagccgcaggagactccggaaactcaggaaactccggaggccgcggagacccgcgcgccctcggaagctccggaagccgcggaggaactcccggaggccacggaagtcccggaggccacggaaacgccggaagccgcggagacccctgaaccccgggaggctccggaagctccagatgctccggaagccagtgcgactccggaggcttcggaagccctggagacctctgaggtccctgacgtgccggaggctctcgcggtcccggaggcccccgaagcccccgagcccccgcaagccgccgacgcggaggaacccccgcaggggccacccgcacccgacgacgaaagccgcacgggtggtgcgggg

SEQ ID NO: 2387 - DNA, 1633 bp, Unknown
  Kingdom: Bacteria, Phylum: Actinobacteria, Class: Actinobacteria, Order: Streptomycetales, Family: Streptomycetaceae, Genus: Streptomyces
gaagtcccctccgccgtcgccgaagccgccgccgaagtcgccggggtcgaagtcggcgcccgagacgtcgccgccgtcgtagccgccgaagccggtgccggtgtcggcgtagtcggcgtagccgtagtccgcggcataggccggggtggacatcatgctgccgaggagggtgccgacgaggagtccggggaggatgccgccgccgaagtagccgcctgcccaggggccgtaggcggggcccgcgtcccagtaggggcggcggccctgggccgtgtcgacctcgcggatcaccgggtcgcggccgtcggccaggcgggtggcgtcggcggcgcagaccggcacccggcggggcgcgccgcccggcggcgtccagtcggcgtcggtgaccgaggggccgtggcgggggtcgaagaagcagggcgggcggcgctcgggcagcgggcggccctcgcggcgggcggcgagctgggcaagggagaagcggccgtcctccagggcctgcgtgaccgcgcggacgtcctcggggcgccgggccgcggccatggactgcttggcctgctcgtaggcgtccagcgcgcgttcgtagtcggcgcgcatggcgtcgtcggcgccgggttcggccgggtggaagtccagtcggtcgagttcctcgccgaacgcggtgatgtcctcgtcgacgacgacccgcagcttctccagcgcggcccgctgctccgtctgacggcggcgggcggagcggcgcaccagggcgtacgcgccgacgccgcccgccaccaggaccgccgccgcggtgatcagcgcggtgctggacatgccggtggagcgacccgaggtgccccaggcggagggggccgagccgtgcatgttggccagggcgcggtcggtgaagtccttgagctgggtggcggcgctctcgccctggacgctggtgaccaggttccgcacggcggtgcgcggcagcaccctggcgtcggcgcgggcgtcgaagcggtcgccgaggcggatggcgtaggcgccggtgatgccggtggccgtgcgcaggtcggcgaagaggttctgggtggggtagccggccgggaggacggtgatgaagaggggcttgtccgcgttcttgatcgtgcgggcgagcgcgtcggcgtcggcggaggggagctgggcggcggcggccgggtcgacgtagacggggctcttgcgcagggcctgggcgatcgccgagatgccggtcgccgcctgggcgtgcgggacgccggtcgtcaggagggacagggcgaccaggacggccacggtcagcgctgccagcagcctcgcgggggtccgggtcggggcgacggccttcatggttcgaaactacctgaaatgtgacaatcggggtgttccctcctgttccgtccgacgcccgatcgggagcccggcatgagcacaccgcgcgatctgctgtacgtcaccctggacgtgcccggcggccgtcccgtcgaacagggcgatctctcgctcgccctggcgggggccgaactggtcgatctgctcgccggcggggccgccttcctggacggtgaccggatccggcccggcccgcgcacggtcacgggtgaccggctcctggacgaggcgggggccgggccggatccggtca

SEQ ID NO: 2388 - DNA, 762 bp, Unknown
  Kingdom: Bacteria, Phylum: Actinobacteria, Class: Actinobacteria, Order: Streptomycetales, Family: Streptomycetaceae, Genus: Streptomyces
acgatctgggcgcgcagccggaacgcaccgcactccgggcagtgccagccggactcctcgcgcccgcaccagccgcagcgcaggactcccgcgtcctgcccctccagcgggcctgcgcagtgccggcagcgggccggggcccggcactgcgcgcaggccatccgcggcgcgtacccgcgccgggggacctgcaccaggacgggaccgtgccgcagcccttccctggccgcctgccaggcgagggagggcagccgggcggcccgcgcggcctcgtcccgcgcgaggtcgccgtcgcccacggtacgcacgagcggcgccgcccgccgcacctgctcgcgggccgcgaccagcggccgcgcccagccggtctcgacgagctgggccgcctccacggtgcagctccagttgccgagcaggaaggcgcaccggtcctgtgcggcgcgcagcagcagcacttcgcgcgcgtggggctgcggtgcgtgctgctcgctgtggctgtcgtccccgtcgtcccagagcgcgaccagtccgaggtcgcggaccggcgcgaacatggcggcacgggttccgaccaccgcccgtacggagcctctgctgaccgcgagccactgccggtaacgcttctcggggcccgcgtcggcggtgagcagcgcgtgccgtccctcgccgaggagtgcggtcagcgcggcgtcgaggcgggcggcgacgcgaccgtcggggacgacgacgagcgcgccgcgaccctcgcctccgggcgcggcg

SEQ ID NO: 2389 - DNA, 954 bp, Unknown
  Kingdom: Bacteria, Phylum: Actinobacteria, Class: Actinobacteria, Order: Streptomycetales, Family: Streptomycetaceae, Genus: Streptomyces
acgccgaagcggccgccgccgccgcggcaccccacggcgccgccgtctgtgtcgccgcccgcaacgccccccgctccaccgtcctggccggcgacaccgaggcactgcggagcatcgccgcccggctggaggacgacggggtcttctgccgtctggtgaaggtcaacgtggcgtcccactcgcccttgatggacgacctgcgagaggatctgctcaccgccctcgccgatctctccccgcggcacggccggacgcacatgctgtccaccgtccaccgcgtgctcgtcgacggcacccggctcgacgccgcctactgggcggacaacctccgcgaaccggtgcgtttcgtggacgccgtccgccatgccgcgcagtcggacgagaccgtcttcgtcgagatcagcccccaccccctgctcacccaggccgtcaccgccacgctggaggaacaaggcgagacgccgtccgtcgtggcgacgctcaagcgccggcaggccgagccggagaacctgttgcgcgccctggggcggatcttcgtctgcggaggccgcgtcgactgggaccgctgccacgggtccggtgaccgcagcccgcgaacctgggtgccgctgccgacgtacgcctgggacgtggagcagttccgccgggaaccggccaccgcaccgagcgcccgccacagccgcgagttcacgctgctcggcctggggctcccggccctgggggccggcgtgtacagccggggctcggccgcggtgcccgccgtgctgtacctggaggcggtacgtctggccgcccgggacgccaccggcggccggggcgcggtgctcggcgacatcgagttcgggggccggcccctggacctggagcgggcggggaacgccgccgtacgggtcgacctcacggctctgcccgggcagggcgccttcgccttcaccgtcgccgccgcccacacac

SEQ ID NO: 2390 - DNA, 615 bp, Unknown
  Kingdom: Bacteria, Phylum: Actinobacteria, Class: Actinobacteria, Order: Streptomycetales, Family: Streptomycetaceae, Genus: Streptomyces
aactggccctgcgggcccgccaccgcgaccgggtcctcggcgactggcggctcagcgcgggcggcggacgcggccggggcgtcctcggactgttcgccggtgagtccggcaccggcaagacgctcagcgcggaggtcgtcgccgccgaactgggcctggacctgtacgtcgtccagctgtcctccatcgtcgacaagtacgtcggcgagacggagaagaacctggagcgcatcttcaccgaggccgaccgcaccgacgcggtgctcctgttcgacgaggccgacgccgtgttcggcaagcggtccgaggtgaaggactcgcacgacaagtacgccaacatggagagcgcctacctgctccagcggctggagtcgttcaacggtatcgccctgctcaccacgaacctgcgcgccaacatcgacgaggcgttcacccggcgcctcgacctggtcgtcgacttccccttccccgacgcccggcagcgcctggccctgtggcagcacagcctgtcccacgtgccctgcgccgagggcggcgtcgaactcggcccggtggcggccgggttcgagctggcgggcggctcgatccgcagcgccgtggtgaccgccgcgtacc

SEQ ID NO: 2391 - DNA, 782 bp, Unknown
  Kingdom: Bacteria, Phylum: Actinobacteria, Class: Actinobacteria, Order: Streptomycetales, Family: Streptomycetaceae, Genus: Streptomyces
gtccaggaagagcaggtaggcgccggtcgccgcggccgtccccgcgttgcgcgcgccgctcagaccggcggacggcggcgagtgcaccggccgcacccgtgagtcccgcccggcgtgtgcggcggccacaccgtcggccggggcgccgggcccgtcgcagaccgggatcagctcgaagtcgccgtaggactgggcccggacggagtccagcgcgagggacagcctgcccgccacaccgtgggacgggacgatgatgctgaagcgcggcatgcggctctctcttcgctctctcttcaggcgctctcggcgccggcacttggcggggctctcggcagttcgtcagtggctctcgtcagtggttcccggagacggtctgcgggccggcgggcgggggcacggtggccagccgggaaggggcctgggccgtggcggcccgcgacggcgcggggtgacgctcggcgagcggcacgacgggcggcagcccggccgcctcgtcccgctggccgagcaccacgtgccgcaccacccgctcggcggcgcgcccgtcgtcgtacgggcagaaccgctcgcggaaggcggcccgcagctgggcggagcgggagccgcgccagtggccgccggtcaggatgtcgaccagctcgtccacggtgcgggcgaccgcgccgggcgggtgggcgcggacgtcgaagtaggtgccgcgggccgcctcgtacgcctcccagtcgtcggcgaggagcacgatcgggcggtcgagaccggcatagtcgaacatgatcgacgag

SEQ ID NO: 2392 - DNA, 957 bp, Unknown
  Kingdom: Bacteria, Phylum: Actinobacteria, Class: Actinobacteria, Order: Streptomycetales, Family: Streptomycetaceae, Genus: Streptomyces
  misc_feature (412)..(560): n is a, c, g, or t
ggcggcgccgcccagagcgcgttcctgaagctgacggagggctggtcggggcggttcgccgtcctgctgctctgcctggccctgctgccgaacgcggtgctgtgggccgcggcgtacgcactcggtcccgggttcgtgctcggcgtcggccacacggtcgacccgttcgtctccgcgccggcgccgtcgctcccgccgttcccgctgctcgcggcggtgccggacgcggggcctggcacctcgctgcacctgctgaccgcggcggtaccggcggcggccgggttgaccatcggctggttcgtcgcgggggcggcggtgcgggagggcccggacgggcgggagaggcagcccggacgggacggacgggactcaccgaactcatcgaactcacgggactcgcgggactcgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactcgcgggactcgcgggacgtggtgcgggcgtggtcatggcgacggacggcgggcggtgcggccctggcgtgtctgctgtgcgcgatcgggctcggggtcttcgccgaactggcgggcggcccgctggggaacgccgctctcgacgacttcgggccggtcggctggcaggtcatgggcgccacgctgctgtggacctcggctgcggccgtgccgacggcgctcgtcgtgcggggctggcgctgcctgagcggccggatcctgggggccggtgcggccgggcagcggatgatcgggaagccccgctcagagcggagcgggaagagcgagggaagcggcggaagcgggaagggcggtgccggatcggtacggctcccggacaccggcggccggctgc

SEQ ID NO: 2393 - DNA, 1073 bp, Unknown
  Kingdom: Bacteria, Phylum: Actinobacteria, Class: Actinobacteria, Order: Streptomycetales, Family: Streptomycetaceae, Genus: Streptomyces
tgcaggccgaggtgctcggccccgccaccgcgaaggtgatggccgagcacctcggcctgcacaccatcggtgacctcctccaccactacccccgcagatacgaggagcgcggccagctcacccacctcgccgacctccccatggacgagcacgtcacggtggtcgcccaggtcgccgacgcccgcctgcacaccttcgcctcctcccgggcgccgcgcggcaagggccagcgcctggaggtgacgatcaccgacggcagcggccggctccagctggtcttcttcggcaacggcgtgcacaaaccccacaaggacctgctgccgggcacccgcgcgctgttcgccggcaaggtctccgtcttcaaccggcgcctccaactggcccaccccgcctacgaactgctcaagggcgacgccgaggagaccgtcgagtcctgggcgggcgccctgatcccgatctacccggccaccgccaaactggagtcctggaagatcggcaaggccgtccagaccgtcctgcccagcgcccaggaggccgtcgacccgctgcccgagagcctccgcgccgggcgcggcctggtcaccctccccgaggctctgctcaagatccaccgtccgcacaccaaggcggacgtcgccgacgcccgcgcccgcctgaagtgggacgaggccttcgtcctgcaggtcgccctggcgcgccgacggcacgccgacgcccagctcccggccgtcgcccgccgcccccgtcccgacggcctcctcgccgccttcgacgaccggctgcccttcaccctcaccgacggccagcagaaggtctcccgcgagatcttcgacgacctcgccaccgagcacccgatgcaccggctgctccagggcgaggtcggctcgggcaagacgatggtcgccctgcgcgccatgctcgccgtcgtcgacgcgggcggccaggccgcgatgctcgcgcccaccgaagtgctcgcccagcagcaccaccggtcggtcaccgagatgatgggcgagctggccagttgggggctgtggcgcgacgcgccttcgcagaagggcggtggcgggcga

SEQ ID NO: 2394 - DNA, 1050 bp, Unknown
  Kingdom: Bacteria, Phylum: Actinobacteria, Class: Actinobacteria, Order: Streptomycetales, Family: Streptomycetaceae, Genus: Streptomyces
gggcgctcgccctgacgtgcgccctgtgcgccgggctgccgacggcgccgggcacggggccccgcttcccgcgcgccgcggactccgtcctgcgcccgccttccaccgccgcgctccagcacacggtgatccgccgcggtccgcccgccgccgccttcgtcctcgctgcctgacgcgacgcgaccagcactccaccggacccggccgaccgggttccgccggagggagggccgccgtcgtgcggcacacgcgcgtgcccgtccgacgggcggtccgcaccggcggacgccccggcgcacgcgcctctcccgaccagcggaaccccaccggaacaccggaacacaccggaacaccggactcactcgaagtggagtgctcttcgtgatgaaggccatcagccgcaggacctctcgtctggccaccgtcggcgccctcgcgggcacggccgtgctcgccgtctccgtccccgcgttcgcgcacgtcaccgtgcagccggagggcgcggcggccaagggcggctacgccgtcgtcgacttcaaggtgcccaacgagcgcgacaacgcctccaccacccaggtcgaggtcaacttccccaccgaccacccgctggcctcggtgatgcccgagccgatcgacgggtggaagatcgagatcaccaagtccaagctgcccaagccgctggagatgcacggcgagaagatctccgaggccgtcaccaaggtcacctggaccgccgacggcaagggcatccagccgggctacttccagaagttcccggtctccgtcggcgccctgcccaaggacgccgaccagctcgtcttcaaggccctccagtcgtactccgacaaggaggtcgtccgctggatcgaggtcccgcagaagggccaggccgagcccgacaacccggcgcccacactgcagctgaccgcggcggacgacgctcacggagccgcgtcccagggcgcctccaccggctccgaacccgccgccgcgaccaccaccaccgcctccgccaagagcggcagcgacaccaccgcccgcgtcctcggc

SEQ ID NO: 2395 - DNA, 665 bp, Unknown
  Kingdom: Bacteria, Phylum: Actinobacteria, Class: Actinobacteria, Order: Streptomycetales, Family: Streptomycetaceae, Genus: Streptomyces
cgtgccggtcgtaggcgtggctgtcgatcagctcggcgagggccagctgcccgatggtctcggtgtggtggtcgctgtgcagcttggcgtcggccaccgcgtccaccaggtgcggcggcaggaccatccagcccagccgcagcgccgggccgagggtcttggaggcggtgccgaggtaggcgacctggcccggcgccatgccctggagcgcgccgacgggccgaccgtcgtagcggaactctccgtcgtagtcgtcctcgacgatcagggcaccacgcgcgcgtgcccagtcggtcagcgcccgccgccgctccggatgcagggtcaccccgctcggatactggtgcgccggggtgacgaccacggcgccgtgctcgcccaggtcctgcgcccgtaccccgcgctcgtccacccggaccggcaccacgctgccgccgttgtggcgcacgacgtcccggtggaagggcagcccggggtcctccatggcgatcgaggcaccgtccagcacacgcgtcagcagcgccagcccctgcacgtacccggcggtgatcacgatccgctccggcggcgcgatcacgccgcgggcccgccccaggtagcccgacagcgcggtgcgcagctcgatccggccgcgcgggtcgccgtagtcgtacgccagtgagggc

SEQ ID NO: 2396 - DNA, 716 bp, Unknown
  Kingdom: Bacteria, Phylum: Actinobacteria, Class: Actinobacteria, Order: Streptomycetales, Family: Streptomycetaceae, Genus: Streptomyces
ccttcagccgcggcatgcggcccagccggcactgcgccagtgtccggccggccacggcggtggcctgctcgtaggcccgttcccggtcgccgaaggcgagacggcccctgaccgtcacgcgccggcggcgcgcgcggacggcgacctcgcccatgcccgacacgtccccgacggcgtcccggaccacggtggcgaccgtcgagcggtcgaccgcggcgtcccagccgggcgcctgcacggccagaggcatctggtggcggcgtccgggcgtgagcgcgagcacgatcagccacagccccagcagggccacgacggcaccgacgacgaggacctgcgtgtcacccggtccgtggccggcgagccagtccaccgtctgcctccgccacggcgccgcccggccgccggtcgcgtgcgcccgggcgacgtcggcggcgacagccgcgcagaacgcggcggccagcagggtcaccacggccatcgggacacgccgctgcgaccaccagcggcgcggcgcacgacggcggccggtgtcctcctcggccaagggatccggcggcggctgggcggcgcacgtcgtcagccgggtgacggtcagccgcgccgggcgcatgtccagcccggtcaggtcacgcgtgcggtcggtcacgtgctgctgcacccggcgggcggtgtcggacaacggccccggatacggcagcgccacccgcagcgccacg

SEQ ID NO: 2397 - DNA, 656 bp, Unknown
  Kingdom: Bacteria, Phylum: Actinobacteria, Class: Actinobacteria, Order: Streptomycetales, Family: Streptomycetaceae, Genus: Streptomyces
  misc_feature (201)..(317): n is a, c, g, or t
gccctcatcggcccccgcacctgattctcccggcctccccggctcccccggcgattccggtcctcgcacctccgcgagcagttcccggaacgcggtcgccaccgtctccgggtattccatcatcgccacgtgccccgcgtcgggcagggtgaggaggcgggagtcgcggaaggcgcgggccgcgcgccgggccatgcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgcgcggaacgcgtcatcgcgtcccagaagtagggcagttgcagccgccgctccatctcctggaccgcgttgcggaacccttccggcgtgaccttctccgggtcgccgtagcacagggccatgaccccgcggacccgctgctccgccgtccagtcccgggtcagccgggtgaagagcgcggtgacgccgggcagcgcgagcatcccggtcggcagggcggtgcgctggacgcgcagttcgggcagcgcgggggagatcagcgtgagcgtgcggacgaggtcggggcgcagcgcggcgacgcgcgtcgagacggcgccgcccagcgagttgcccaggag

SEQ ID NO: 2398 - DNA, 753 bp, Unknown
  Kingdom: Bacteria, Phylum: Actinobacteria, Class: Actinobacteria, Order: Streptomycetales, Family: Streptomycetaceae, Genus: Streptomyces
gtggagagcgcgccgcacgcggcggcggtcgccgcgaagctgcgccggctggcggaggccggcacccgggtggtgctgtgcggacggccgccggtgccggacgccgaggcggtcgccctggccttcgacaaccgcgggagcgcgcggcagctgaccgagcacctgacggcgctcgggcaccggcgcctcggctacatcgcgggcccgcaggaacgcaccaccacccggcaccggctcgaaggccaccgcgaggccctggcggcggccgccgtcgaggacgacccggaccggaccgtgcacgggcggttcgaccgccggtccggctacgaggcgaccctggaactgctgcgccgcgaccccgcgctcacggcgatcgtcgccgccaacgactccgtcgcgctgggcgcctgcgcggcactgcgcgagtccgggctgcgcatccccggggacgtctcggtggcgggcttcgacgacctgcccttcagcgtcgacgcggtgccttccctgacaaccgtccgtctgccgctcgcggaggccggcgcccgcgcgggccgcatcgccatgggccgcgaggagcccccgcccggcgggatcgccacggtgcggggagagctgatggtgcgggggtccaccggggtgcctcgggggtgaggcgcggccgcctcgcggatgaggcggggctgcctcggggatgaagcgggctgcctcggggatgaagcgggctgcgtcggggatgaggtggggccgcccctc

SEQ ID NO: 2399 - DNA, 583 bp, Unknown
  Kingdom: Bacteria, Phylum: Actinobacteria, Class: Actinobacteria, Order: Streptomycetales, Family: Streptomycetaceae, Genus: Streptomyces
tccccgtcgccggcggcggcgcgggtggcgagcagtccgacccggccctcgcccgctgccagcccggcggcccgcagcaccgcctcctcgcccgcgtactgctccaggcagccacggccgccgcacggacacgcgggcccctccggttcgaccgggacatgtcccagctcgccggcgaacccgcgggttccgcgcagcagccgtccgtcgaccaccagcgcggcgccgatgccgatctccgcggacacgtgcaggaagtccggcggcgtgttctcgccgagccagagttccgccagggcgccgaagttcgcctcgttgtccacggtcagggggcacgtgccgggcagcagggtgcccaggtcgatgtcgtgccagtccaggttgggggcccggacgacggtgcggccgtcgcgtgcgaccaggcccggcacggccacggcgagccccgccggccacaggccttcccgctccgcctcggcgacgacctgggatatcagggcggtgaggtccttcgccaccggttccggggcgcgtccgcggttcgtgccgtgccgtaccgcccgcgcccggaccgtgccgcgca

SEQ ID NO: 2400 - DNA, 564 bp, Unknown
  Kingdom: Bacteria, Phylum: Actinobacteria, Class: Actinobacteria, Order: Streptomycetales, Family: Streptomycetaceae, Genus: Streptomyces
aaggagggggcgccggcgcccgagccgccctccgcgaaccacggcacgcccgcgacaccggcgagcgcgtacagcatgagggagagcatgccgcggcgggcgccgagcgtggtgccgaccagcagcgccgcgaaggtctgcccggtcaccggcaccggggagccgggcaccgggacggcgatctgggcggcgatcccggtgagcgcggcgccgccgagcacgagggcggcgtcccggacgcgggaggagggcaggaggtcggcgaggacctgtccggtgcgggcagggacggcagcggtgctcatggggactccgcggggtgagggcagtcggggacaccgcgacgctatcccagcgcgctcgagccgatcaccgtctgcgctcgacaaaggcgggaacgcgggcttggtcggctccgtacaaagaccgctgcttacacctggcccgacgtgatgccggtcactgaggtggagtggtcttcccggcaccggcacgcccacgacggcaccgccccgcttctgtatggtcccgccaatccgatcaaaccgatcgaaccgatcgaac

SEQ ID NO: 2401 - DNA, 832 bp, Unknown
  Kingdom: Bacteria, Phylum: Actinobacteria, Class: Actinobacteria, Order: Streptomycetales, Family: Streptomycetaceae, Genus: Streptomyces
gcccgataccgggcacgacctccagccgttcccgcgccgccgccgcgggcatccgcatcgcttcctccagccgcgccgccacccgcaccgcccgcagcaccgccgacgcccgcttgtcgtcgaccccggcgcgatgccagtcccacgacgggatcagcgcccaggtgcgcggcgccggcatcacgtacatccgcaccggtacgggcccgggggccggttccccgtaggtgcgcaccagcgtgcgccacgccgcgtacgcctcgaccgtcgtgaccttctgctccaggaccgacgggatgagcgactccagcaccagcccggtccgcgtcagccgcagtcccgggcgccggtgccgggtgtgcgcgagcagccggtgcctgggtacgaacgccgccgggtcgtcggcggccccgagcaactccggcaactggtccagcagccactcggcgcccggcccccacgcctgcccgcacacctcgccgccgcgcgcggagacccgtagcgtccctgggcccgccggcgtacggctggcccgccacacggagccgtcgggcattgcgcggaacgtcggatcgcccggaccgcgccgcagcggcccgagcaccagcccgaggtccagcggcccgtccggcacccaggtccgtgcccgctccggggcgcccgcctggcgcggcacacccgcggaggcagccccggcgttcgcggtgggcacgccggcatggccaccgcgcacggtggtgcgcgtgggccgcggtcgcggggcgaagcgtcctgccacgaatcagatcccggggtcgccgacgaacggatgagcccacgtcgaggcgggcgg

SEQ ID NO: 2402 - DNA, 814 bp, Unknown
  Kingdom: Bacteria, Phylum: Actinobacteria, Class: Actinobacteria, Order: Streptomycetales, Family: Streptomycetaceae, Genus: Streptomyces
ctgatggggttcgcccagcgggcactggaccgcacggtgtggccgccgttgagcggcggctgccatgtggcccgcgatccggtggccgcgctgcgggcggccgggttcgagctgggtccttaccgccgggtgaggctgccggagacggggccggtcctgccgagttcgtactgctcgctgggcgaaccccatcagccggccgccgcccgcaccgtgctcgaagaaccgcacctcgccgcccggccgcagcacccgccgcgcctcggccagggcccgcggtacgtcgtgcacactgcacaggaccagcgagaacaccaccgcgtcgaaggcctcgctcttgaccggcagcgcctcggcgcggccgggcaccacgtcgaccggtacgtccgcgcgcatggccgccgccacggccttctgccgcagcagccgctccggctcgatcgcgacgacctccgcgaccgcgccgggatagtgcgcgaagttcagcccgttgcccgcgccgatctcgatcacccgcccggtgagcccggccagcagccgctcccgcagccccgccatgcccagccgggtctccgcggccacgctgaagcgggcgtagcagcgggcgaacagcggatggtggacgcagtcccgcgcggccgggccggagcccccggtggaccttggcggcatggcgacctcccggacgcggacgggaccgtacctgtgcctacggtgagtgtcccccgcccggcgccccggcacgcacgcctgccccgcgcgcgggagcactgatggccctatccgaaaggcgccggcgcctttcggatagggc

SEQ ID NO: 2403 - DNA, 600 bp, Unknown
  Kingdom: Bacteria, Phylum: Actinobacteria, Class: Actinobacteria, Order: Streptomycetales, Family: Streptomycetaceae, Genus: Streptomyces
gcccccggcacgctcgccgtccccggagcccccggactccccggcgtccccggcgtcctccagaagtgcctcgtccaccggccggtagtcgacgagcccgaccggctccagcagccggaactggtcgtcaaggcgcatcatcgcgtcggagacctgctccagtatgtcgtcggtgggctcccccatgtcgctgggcacgatcatggaggcggccagcgcgggcagcggtaccggggctccggcggggccttcctcgccgacggtgagcaggtacaggttggcgagcacgccgtccaggaactccgcctcggcctgcggatcccagcccagcgtggagaggtcgacggcgccgccctcgtccatcgcgtcgatcaggccgtccaggtcgggcacgctcgcgtcggcgaggacggcatccagcgcggtcagccagacggtgagcacgtcgtgcggggagccgccggtgagcagccgcagctccgcgcccgccgtgacggtgccctcctcctcgtcggtgatctcgacgagcccggtgtcgacggccatccgccaggcctcgctcgccgtggccgccgcgtcgtcgccgctgagccccagttc

SEQ ID NO: 2404 - DNA, 754 bp, Unknown
  Kingdom: Bacteria, Phylum: Actinobacteria, Class: Actinobacteria, Order: Streptomycetales, Family: Streptomycetaceae, Genus: Streptomyces
cgcaccggcctccaggggccgtgcgtggcgagcgagaccggcgcgcacagcaggacggcgacgacgaggagcgcggccaccacggggacgagggcgagcagcagcgcggtggtgagggtccggcgcagcccggtgagcaccgcgccgcacagccgcgccgggcggccgcgacgcgcacccggggcggtcatggcgcgccgtcggatgttccgagggcggtgtcgaggtagcgggaggaggccgcgtaggcgcgctcgatgcgttcggcggtccgcccgaaactgcggtaccgcaactgccgcagggtgcccgtgccctcctcgggggccgagcccgacggcagcacacggaccgtgacgccgggcggcaggtccgccatgtcgcgggcgaaccggtgccggcgggcgatctcgaacgccaccagcgccacctcccagggagcgcgcggcggcgagagcgggcgctcgacgcggccgacctgcaggacgtagacctcgctcgccccgagggccaccgcgcggccgacggggatgctgttgaccaggccgccgtcgacgtagtgctcgccgtcgagccggacgggcggcagcaggccgggcacggcgcacgaggcgagcacggcgtccaccagcggcccggcggtgaaccagtgctcggcggcgcgttcgatgttcgccgcgacgcactggaacggcagggccagctcctcgacgcgcgtcaccggaaggtgggcgcagagcaggtcgcgcagcgg

SEQ ID NO: 2405 - DNA, 691 bp, Unknown
  Kingdom: Bacteria, Phylum: Actinobacteria, Class: Actinobacteria, Order: Streptomycetales, Family: Streptomycetaceae, Genus: Streptomyces
gctggcagccgggctgcttccggtggtcgggccgcttccggtagtcggactgcttcaggtggtcgggccgcttcggccggtggggctgtctccggtgatcgggccgctgcggacggccgggtcgcttccgccagccggaccatttcggccggtggggccgtctccggtggtcgcgccgcctcgggcgcccgggccccctcctcaggccgggtccccgcgcgtgcgccggtcgtctcagaccgtgaccacccggacccccgcctcctcgaatctgcgcaccgtctcctggcccgccgccgcgtccgtgaccagggtgtccaccgactccgccgggcagatgcgggcgaatgcgcggcggcccagcttgctggagtccgccgcgacgacgacgcgctccgcgcgctcgcacagcacccggttgatggcggcctccgcctcgtcgtgggccgccgcgccgtgcgcgacgtcgaaggcgaccaccccgaggaccgcgacgtcgagagtgatctggccgagcacgccgtccgccagcggtccgatcagctcgtacgactgggggcgggcgaccccgccggtcaccacgatcttgaactggggccgcacggccagctcgttggcgatgttgagcgcgttcgtcaccacggtcagggcgggcgagccggagccgaggtcgcccgccctgaccgtggtg

SEQ ID NO: 2406 - DNA, 635 bp, Unknown
  Kingdom: Bacteria, Phylum: Actinobacteria, Class: Actinobacteria, Order: Streptomycetales, Family: Streptomycetaceae, Genus: Streptomyces
ccgcgccgacagcgctcgcccgcgccccggggcctccaggtcgcccggccacacccgcccgcgcgccgcggccaagggcaagggagacgtacgccgccgcagcggatgccggtcggctgggagctcacaggccgccaggcccgaggacagcgtatgaacccgctccgggtgatccggaggtggtggttcacgcctcggagggccggctacgggaagccggtcgagcacgggccgcccggctcgtacgggaatccgggcaagcgccaggggccgggccggcacaggaagtcccaccatcacgaggagtcgaggccgcacgacaggggagtcccgcgcagcgggccacgcgatggagcggagggtgagttgcggtgcggcggggccgggtcccggtgctcgtcagccggatcgtcgccgcggcaggaaccggaacgtggtgacgggcggaaaccacagagcacgtcgcccgtgccgaggaccggcgcgcggggggagggcagccacgacggaccgcaggcgccgaacagccgccattcggtcggcttcccccgccacaggcgtgacccggaacgggccgccgacgttcacctgagtggcggagcgcccggccgggtcgtcccgcagccgttcccagg

SEQ ID NO: 2407 - DNA, 944 bp, Unknown
  Kingdom: Bacteria, Phylum: Actinobacteria, Class: Actinobacteria, Order: Streptomycetales, Family: Streptomycetaceae, Genus: Streptomyces
cgcgcccggcccgacgcggacgacacggcggtccgtgcggcgctggccgacgccggagcgctgggattcgtcgacgcgttgcccgacggaacgcggaccgtgctcggcgaggacggcgcgggtctgtccgcggggcagcggcagcggctggcgctcgcccgcgccttcctcgccgaccgccccctcctgctgctcgacgaaccgacggcggcactggacggggcgaccgaggccgagatcgtggaggcggtgcgccggctggccgccgggcgcaccgtgctgctcgtggtgcaccgccccgcactgctggacgtcgccgaccgtgtggtgcggttggaggacaccgagtcgcacggtcggaccggcactgctggggcggtgggcgacggcccggccggggagcccggcgcacggccggcggaagtgctggcgcacctggaagctcctgaccacgcgtccgaggcggcagcaggtggcgtcctcggcagggtccgcgcgacggcgggccgccggcgcgctcgtctcgttctcgcgctgctgctgggcagcctcgccctctgcagcgccgtcggcctgatggccacctccggatggctcatctcacgagcgtcgcagcaccctcccgtgctctatctgatggtggccgtcacagcgacccgtgctttcggcatcggccgggccgtcttccgctacgccgaacggctggtgtcgcacgacgcggtgctgcggatgctggcggacacccgggtcgccgtgtaccgcaggctcgaacggctcgcgcccgctgggctgcaccgggcgcgccgtggcgacctgctgacgcggctcgtcgccgacgtggacgccctgcaggactactggctgcgctggctgctgcccgccggtgctgcggtgaccgtctccgtcgcgtccgtggccttcacggcctggctgctgcccgcggc

SEQ ID NO: 2408 - DNA, 1282 bp, Unknown
  Kingdom: Bacteria, Phylum: Actinobacteria, Class: Actinobacteria, Order: Streptomycetales, Family: Streptomycetaceae, Genus: Streptomyces
gccgggggccggtcccggtcgggcaggcgggcgacgcgcgtccaggccgccaccgccttcagcgcggatccggcggccagtccccaggcggcgcccagcgccgatccgctcagcaggtatccgccgagcatgaggacgaccgacaggagggagaacaccacctgcacggacagggtggcgcgcgggctgagcacgcgcagggtgaccagggcgcaggtgcccaggcccatcaccgcgtactgcgcgcccgaggcgggcagcagcgcggacgcggactgccaggtggcgccgaggagctgacgtcctgtaccgccgggcagcgcgtgcagcactagcccccaggcgaggccgacggcgcagagcgcgaggccgagcacggcggcggcgcgggccgtggcccgacggccgccgaggcggcccagcagcggcggtccgaacgcgttgaccgagttgaacaggacgttgaggggcccgaagagcgtggtcgccccgcgcagcgcgccgaccgcgagcggagcggcgaacaggccgaggcccagcacggcgagctggctggaggcgttgcccacggcgaactccaccacgaagcgctgtccgaggtggccgcggcgcacatagggccgcaggtcggtgcgggcgccgcgcacatgaggcagcagcaggcgcaggccgagcagcagcgcgggcacggccgaaaggccccagacggccaccagcagcccgggcgcggtgtgccggggctggagcagcagcatgggcaccacgcacaccaggcgcagggtgtcggcggccagtgccagtccggggcgccgcagggtggagaacgcgtaccgcagcacgtcctggaccaggacgagcggcagcacggcccccagggcgaggaaggcgccgcccggcccggcccagccgccgtcgccggcgactgcggtgaccgcgccgacggcggcgagcagggcgccgcctgcggtggcggccagcgcggtgaaggagaccgcggaccggcaggcggctccggtggcggcccgctcgccccgggtgagcacgacgacctggccggcgtacgccgtgttcaggccgagcagcaccgtgaaggtcaggtagaccatcgagaaggtggcgaagccgtgcgcggtggagacgcgggcggagatcaccagcacggcgatgttggtgaggctggacgccgcctggtcgagcacggaggcgaacacggccgtggaacgccgcggcccgcgcggctcaccgggggccgcctgctgctcgtcctgggcggtcaccggtc

SEQ ID NO: 2409 - DNA, 1328 bp, Unknown
  Kingdom: Bacteria, Phylum: Actinobacteria, Class: Actinobacteria, Order: Streptomycetales, Family: Streptomycetaceae, Genus: Streptomyces
cggtgagggtcgctgggagttccggatcgtctccggtgggtcccagctcagccgacgcgctgtccaagtacgagaattcgggtgcgcatggaaatgaccctccccccggcgcgcatccactgtcaagtgggtgggacgggagtctcatcatgtgggcgcagactcgtcccgccgccgaagacgacgggcatctgacctgcgtggacgcccgcgcccgggccgccgccggcgaacgccggttcggccgcgccgtggtgcaccgggtaggggccggaagcgagcgcccggcgcagccggtactcgtcgagcgggccggagaacgccatgccctgcccgtgggtgcagcccatcgcgcgcagcgcggcgacctgctcgggcaggtccacgccgtcggccaccgactgcaggccgaggtcgcccgcgatccgcagcagcccactggtgatcttgtgcaggcgggccgactcgacgacgccctcgaccagcgagcggtcgagcctgaggacgtccaccgggagcctcctgagcgccgtgagggcgccgtggccgctgccgaagccgtccagggcgatccgtacgccggtccgtctgagggcggacagacggcgctccaactcgtccggcgacacccgcgggtcggtgtcggccagctcgatcaccagggaccccgagggcagcccgtgccgggtcagcagggtctcgacggcgccgggcggaagcgagcggtccaccaggcggcgcgcgcccagccggatcaccaccggcacgttcagcccgctccgggcgcgctcggcggcctgctcgacggcctcctccagcatccagcggcccagttcggcggtcttgtcgctgtcctccgagacccgcaggaactcggccggcgtgaacagcacgccctgggaggagcgccagcgggcctgggcggcgaccgacgtgatccggccggtcgccaggcacaccaccggctggtgcagcagggtgaactcgccgtcgtgcagggcggacctgagccggccggccagctccgccttgcggacgacgtcctgctgcatctgcggcttgtacagctcgacacggccctttccggccgccttggcgcggtacatggcgaggtccgcgttgcgcagcagctcccccgcgcccaggcccggctcggcgaaggccacgccgatggacgcggcgacccggacatcgttgccgtcgatgaggtacggctgcgagagggtcactctgagccggtcggccagctccaggatgtcgctctcgcgggccgcgccgtcgcgggtgccgtccccgacgatgagcgcggcgaactcgtcgccgccgag

SEQ ID NO: 2410 - DNA, 694 bp, Unknown
  Kingdom: Bacteria, Phylum: Actinobacteria, Class: Actinobacteria, Order: Streptomycetales, Family: Streptomycetaceae, Genus: Streptomyces
cgacggtccgcggtcagcgcagcagcacccccgccccgtcgcccgcgtcctgggccggtaccgtcaccaggcccagttccgccggtgaggcgagcaggcggtggtcgggcaggatgcggaccgtgtagccgtagggtccggtgcggtccagggagagcgggccctcgtagacccagcggccgtccgggtcgggtgcgcccgccggtttcagcgggaccgtggcggcgtccgtgatgcggtcctcctcgtcgacccggcccgagaccgcctgcacctggacgtcctccgggcccaggccgccgaggccgacccgcacccgcaggcccagcgtggagccgagttcggcggtggccgtggacggcggttccccggtgcgttcggccagggcgcaggccgtctccacgtggtcgaccgtcacctcgtgccagcccgcccgtacccgcgccttccaggccgccagctcccgcgccgcgtccgcgtccagggcgcggtgggcgtgcgcggccggggtgtacaggcgctccacgtactcgcggaccatccgcccggccagcaccttggggcccagcagggtcagggtcctgcggaccatctcgatccagcggtcgggcagcccggcccggccccgctcgtagaagcgcggcgtgatgcgccgctccagcagctcgtacagcgccgccggaccggtgacggc

SEQ ID NO: 2411 - DNA, 945 bp, Unknown
  Kingdom: Bacteria, Phylum: Actinobacteria, Class: Actinobacteria, Order: Streptomycetales, Family: Streptomycetaceae, Genus: Streptomyces
gcccaggtgccggtcgccgccgggtcggtggcctcggccggggcggacgtgaccgttatctgcggcggcacgtacccgtggcccggcgccgcgagggggctgtcggcggccagcagggcgtcgatgccgccctcggggagtttcacgaacgcggtcgcgccgtcgtcgtagtcgccctgcggcaacgggtcccagcgaccgccgccgtggggcgcgtcctgtccgtgctggtcgtcggtcacgacagcgccctccccagtgctcgtcgggccagcgcggcgacggtgcgccgcaggtgcagtacggcgggcgggagctgcggcaccgaaccgtcctccgccacagccgggtcggggatgcaggccgcggccacgtactcgccgaaggcgttcagcgcctcggggacgatcgcgcggttgttgtcccagtcgatgagctgggccacccactgctcggcgtccagcggcctgagcggcatcggcgctatggcaccgaccgcgcagcgcacaccgcgccgggccgggtcgaggacgagcgccaccgaggcgaccgcgcggccgggcccggtgcggccggtcgccttcaggaagacctggggcgcgtgcagcaggggtacgcggacgtagccgatgagttcgccgccgcgcagcatctccacgccggccagcaggtgggagaccgggacctcacggcgggccccgtccgggcccgcgacgatcagggtggcctccagcgcggccagcaccggcagcgcgtccccggtgggcgcggccgaggcgatgttgccgcccagcgtgccggcgttgcggatgtgcggcgggccggcggcgcgcgccgcggcggccagcgccgggatcagggcggcgaagtcggggcgtcccatgcgcgcgtgggtgaggcccgcgccgagcagggcgtgtccgtcctggtactgccagccgcgga

SEQ ID NO: 2412 - DNA, 780 bp, Unknown
  Kingdom: Bacteria, Phylum: Actinobacteria, Class: Actinobacteria, Order: Streptomycetales, Family: Streptomycetaceae, Genus: Streptomyces
ggctgcggccctgcgccgccacggccgcgtccaggccgtcggccagcccctgcacgatgtcctcggcggcagccgcccgcagtgccgcggtcacctcacccgcgtcccggtcccgggcgccgtacaccacctcgcgcagggagcccgcgaacagctcggcctcgttgtcggcgaccaggatgtgctcgcgcaccccggcgagcgcgtacgcgtccagccgtacgccgtcccaggtcgccgcggacggctcgtaccggcccaggcggtcgacgaccgcggccgcgtcggcggggcgggcgctgaccagcgcggtcagccgccccggcacgacccggacgtccgactccgcatcgtgcagtaccgcaggccggtcgggcgggggcagcgtgccggtgtcctcctgcgggcgcagccgcagcagctccaccacccggcgcgcggccaccacgccccggctcagctggtagcccgactcgacgaagaacgacaccggcgtcaccaggaccgcgacgtacccgtacaccgacaccagctcgcccacgctgatccgcccctgcgcggccagccgggcgcccagccaggtcacgacggcgaggaacagcaccggcaggccggtgcccagcgcctgcagccagctggtcaccgcgcccacccggtagccctgcgcccgcagccgctgcgagtcctgccggaacgcgtccgcgaacagccccttgccgccgagcccacgagaccgtactagatctcgtatgccgtcttctgcttgaaaaaaaaaaaaac

SEQ ID NO: 2413 - DNA, 557 bp, Unknown
  Kingdom: Bacteria, Phylum: Actinobacteria, Class: Actinobacteria, Order: Streptomycetales, Family: Streptomycetaceae, Genus: Streptomyces
gcaggtccagcgcctcggcgatggcgtgaccgaccggcccgagcgaccccgacagcagcaggacgtcgctcttctcggccgccacgaccaggtcgtccgtcaaccgggcgagcgcagcccgcaccagacccaccgcccgcagcatcttgccgacgcccgtcgcgctgcggtgcagtccccgcccgcgcgtcgactccagttcggcccgcggatccaccggcagcgcgtggaaacccaggcccgagcccgcgaccagcggctcgaagcacccgtgggtgaccagggtgaccgtatggcccgcacgggccaggccgtgccccagtcccgtgaaaggggccacgtctccccgggaacccgccgtcatgatcgttacgcgcacgtcggccagtatggccgcgccaccgcccgccaccggcgaacgacccgtccacgtcggcgcgcccacccgcgcagcggcagggacggcaccgggcggatgccggggaggcccggtcggcccgccgcgtcccgatctgccggagggcggcgaggcatcggcccgccgccggggcgcccgg

SEQ ID NO: 2414 - DNA, 873 bp, Unknown
  Kingdom: Bacteria, Phylum: Actinobacteria, Class: Actinobacteria, Order: Streptomycetales, Family: Streptomycetaceae, Genus: Streptomyces
gacgcgcagtcgcgggacgccgggcggacgggccgtgcccgccgcggcttccacgcggcgcagcagggcctcggtgccggtccggtcggcgtgcgtacgggtcaggcagtcctggaggatctcgcgccagacgcaggggagttcgggggccagggccagtccgtccgtgccgcgggcgtaggcgacggccgcgtcccggcgggccgtcggggtgccgccgggcagcgggaaggcgccggtgagggtcaggtgggcgaggacgccgaaggcccagatgtcggcggacggacggatctggcggccgcgttcgccgacctcggaccacagcagctcgggcggggtgtagtcgggggtggagaaggcgggggagtaggcgtgggtgccttcgagttcggcggccatgttgaagtcggccaggcgtgccgaaccgtcgcgcatcagcagcacgttggccggtttcaggtcaccgtgcacccagccggcccggtgcagctggtccagtccctcgcagatctgggcgagcagcgcgggccctgcggcgggccggggtccggcggcgagcagcgcggccagcgagccctccgccttctccaggacgaggacggtggcgccgtcgaggccggggcggtccgggtcgtcgacggtgagggtctcgtacatccggatcagccgggggcggcgcagccggcggtgcagcgtcacctcgcgttcgacgagttcacgcagatgggtgaggcggcgcggggtgcccgtgccggtgggcaggaacttcagggcggctgttcgcggcaggtcgggcggggtgccgcggtctgccgaggcgctgctgcccgatcgtgtgccgcggcccgttccggtgccgcgtcccgcccg

SEQ ID NO: 2415 - DNA, 691 bp, Unknown
  Kingdom: Bacteria, Phylum: Actinobacteria, Class: Actinobacteria, Order: Streptomycetales, Family: Streptomycetaceae, Genus: Streptomyces
gtcgccgcgagtccgtccgggcgccacggcggctgcccccagtcctggccgtgcggggtgaagtcgtccggcggcgcgccgacgctcatcccggcggccaggcagtccgccagcgcccacgtgtcggcgccctcgggcgccacaccgaccgccaggtcgtggatcagaccgatgcccatgcccgcgccggtcgccgccgcctgcgccgcggccagctgttcgtccgtgatccaggccagccagcggtggaagtccacctcaccggcgagttcctggcgggcgcgggcgctgacgggcgagcgcgggtcgcgcagctcggccggccaggaccgccaggcgccgccgtgcacccccgccagcgcgcaccaggtggcgaagtccgtcagatcgcggccctcgcgcgcggtgaacgccgcgaacgcggcggcccgtccgggcggcagcggcaccgcgtgcaccgcgcgcagcgcctcgtgcttgagcgaccgtacagtctcccggtcgatgagcgcgtcaccgcgcagcacggcctcgttcagcgcccgcgcccgtccggcgcaccggtcggcgcggcggcgggcctcgccggtgaggtacgcgtactccggtaccgcctcgacccgtacgtgcatcggatcggggaagcggcgggtgcccggccggtacggcgacgggtcgggcacccgccgct

SEQ ID NO: 2416 - DNA, 693 bp, Unknown
  Kingdom: Bacteria, Phylum: Actinobacteria, Class: Actinobacteria, Order: Streptomycetales, Family: Streptomycetaceae, Genus: Streptomyces
ctgcacatggcgcaggaacaggactacgaccttgtcgtgctggacatcatgctgcccgggctgaacggctaccgggtctgcgcccagctgcgggcggccggggacgacacaccgatcctgatgctcaccgccaaggacggcgagtacgacgaggccgagggcctggacaccgagagcgccgccgtgtggtggctgcgcgccgcgcaggacggcgacggcaacgccgccaacgcgctcggcgcgctgcacgccgagcgcggcgagacgcagaccgccgagcgctggtaccgcgcggcgatggacgccggtgacgtcaacggcgcctacaacctcgcgctgctctgcgccgagcagggccgcaccccgcaggccgagcagtggtaccggcacgcggcctacgccggtcaccgggaggccgcgaacgcgctggcggtcctgctgctgcagggcggggacacgaccggggcggagccgtggttctccaaggccgccgaggcaggcagcgtcgacgccgccttcaacctcggcatcctctacgccgggcgcgacctggagaccgaggcgctgcgctggtacgagcgggcggcggcggccggccacatggaggcggccctgcaggtgggcatggcccggctgcgcggcggcgacgagcgggaggccgagcggcacctgcggtgcgcggccggcggcggg

SEQ ID NO: 2417 - DNA, 720 bp, Unknown
  Kingdom: Bacteria, Phylum: Actinobacteria, Class: Actinobacteria, Order: Streptomycetales, Family: Streptomycetaceae, Genus: Streptomyces
atcgccgaccgccgcgagggcctggcccggctcagcggccaggtgaacgcggcccgttcccgcgccgcctccgcccaggcggagatcgaccgcctggccaccgcccgcgacgaggcccaggaacgcgccgtccgcgcccaggaggagtacgaggcgctcaaggcggaggtcgacggcctggacgccgaggaccacgcactcggcgaacggcacgagtcggcgaaggccgccctggccgaggcggacgccgccctcaccgccgcacgcgaggcggccaccaccaccgagcgccggcgggcagcgacccaggcccgccacgacgccctggccctcggcctgcgccgcaaggacggcacgggcgccctgctcgacgccacggaccggctcaccggactgctgggcccggcggcggagatcctcacgatcaccccgggctacgaaacccccttggcggcagccctcggcgcagccgccgacgccctcgcggtcaccacccccaccgcggccgccgaggcactccgcctgctgcgcaaacaggacgcgggccgcgcggccctgctgctcgccggcgcacacgagaacgccgacgcgactcctgccgcgcgccctgaggcggacggcccgaccggcggtcacaacggccccggcggccccggcggacccagcggctctggcgggcaacgcggccaaggcgggcatccatgcgccgccgacctcgtc

SEQ ID NO: 2418 - DNA, 905 bp, Unknown
  Kingdom: Bacteria, Phylum: Actinobacteria, Class: Actinobacteria, Order: Streptomycetales, Family: Streptomycetaceae, Genus: Streptomyces
tggcagccggcctcggcggcgatctccaggccgccgcgcagcacctcgcgggccagctcgaacgggagcacgtcgcggggccaggccaggaggttcacggcgaggaccgggcggccgcccatggcgtacacgtcggacagggcgttggcggcggcgatgcggccccagtcgtaggggtcgtcgacgacgggggtgaagaagtcggcggtggacaccagggcctgcgcggcggtgccgtccggtgcgggcagcgcgacgaccgccgcgtcgtcgccggtggccggtccgaccagcatcggggtgacgccgggcgccgggagcggcggggtcagtccgccgagcaggtcctccagctcaccgggcgggatcttgcaggcgcagccgccgccgtgggcgaactgcgtgagccgtacgggcgtttcgctgctggcggtcatgccgggtccttccggtagcctggcgggcggtggaggcgtgtgggtgcctggtggccctcccggtcttcaaaaccgaggtgtccgaggatctcgggcaggcgggttcgattcccgtccgcctccgtcccgccttcttctcacgtgtcctgcgcgtcttcccggttcttcgagtgttccgctttctgcggtctttcaggtcttccgcaccttcgcggcctttcacggttccgggcggcagcgccggtgctggtcgtcgatccgttcggtgtggccgcgggcgtcgaggagttccagcagcggcacggcgacgcgccgggtggtgccgagggcctggcgcgcctggctcagcgtgaagggctgcggcagccggcgcagcacggcggcggcctcggtgtccgcgcccggcagcaggacgacggtgtcggtgacgcgcagcagcgcgcccgcccggacggcggcggccagggc

SEQ ID NO: 2419 - DNA, 580 bp, Unknown
  Kingdom: Bacteria, Phylum: Actinobacteria, Class: Actinobacteria, Order: Streptomycetales, Family: Streptomycetaceae, Genus: Streptomyces
  misc_feature (162)..(321): n is a, c, g, or t
gggccaggcctccgggtcgcccagcggatccccggaggccagcgacacgccgcccaccacccggtaggcgacggcggccttcccggtcggcgaccagatgacgctcttctcgcggcgcagcgcgaagtagccgagcgagtcccgctcaccgtgcccctccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcccgggaaacgggcctccggcgcggcgaccgagatcagccgcagtgtgccgtagtgccagcgctccgggtacgtcgaacgggccgcgtccggcgcctggttggtcaccgtgaccagcagggtggccagcagcgaggcgaccaccagcccggccgtcgcgacgccggcggccagccgcgggttggcgcggtcgcccttggcgtagaactcgcgccgcccgagcagcagggcggccacgaaggcggcggtgaggaccag

SEQ ID NO: 2420 - DNA, 1052 bp, Unknown
  Kingdom: Bacteria, Phylum: Actinobacteria, Class: Actinobacteria, Order: Streptomycetales, Family: Streptomycetaceae, Genus: Streptomyces
ggccgccgcccggcccgcgtggtcccgcagcccgtcctgcagccgcccgcgcagctcacgccggtccagctcccgccgtgtcgcctcggactctgcggtgctgccgccctcgccgccggccggacgctcgccgagcagccggccgctctccgcgtggcacgcctcggcgatcagttccagcagaccggcgtacgtccgcagcaccgccgggtccggcggcgcgggagcgcggtccttgtcggccgcgacggcgagggtccgggtgagcgcccgtacgtgcccggtgaccctgctccagcgctcgtcctccgtctcgggcggcacggacgacggcggcctgcgcagcgcgcgcagcggaccggcggtcagacgcaggctctcgcggctccagcgtcgggccgactgcagtgtctccaagcggttttcgagccgggacgagccccgggaccactcggccgccgtgccgctgtcccagtcgccgtcacgcagcccgccgacgaccgcgcacagcacgtcacccgcctcccgcgcgaccgccgcgaggttctcccgcacgtcccgcagatggatcggcggcagcacgaacgcgttgacggccagtccgatcaccgcaccgagcgccgactgccacagacggtgcccgaccgaggcggccgagacactcccggtcgccagggtgaacacggccgtggtggccccgtagatcccctggtcgccgaagcgtgaccagttcgccagcagcatcagcaccggcagcgacaacgcgagcgcggccagggtgtcaccggtggccgcctgcgcgcccgaggcgagcagcgtccccgtaccgatcgccgcgcactgctgccccgctcccagcagcgagctgtacaccgtggcccgcaccatgaccagcgccacccacggcgccatcagggccatcggatcgcccagccagaccttggccacgacccaggcgagcagcgccgccgcggcggccttgagtgactgcacgaccaggtcgcgttcccggccggggccgcgcaccacggcccgcagggaccgcccgaccc

SEQ ID NO: 2421 - DNA, 864 bp, Unknown
  Kingdom: Bacteria, Phylum: Actinobacteria, Class: Actinobacteria, Order: Streptomycetales, Family: Streptomycetaceae, Genus: Streptomyces
gtcccacacccgggccaaccgcagctcctccccggccagttcgagtgcgtccagcgggctgcccagcgccagccggcactcggcggcggcggaacgccacggggtgacgacggggctgatcacctcgcgggccgactggcgccggccgcactccaggaagtcgtgcagcgcgcccgccgtgtccccgtcggcggcgcgctgcacgccacgggcgtacaggaaccggttcagctcccaggagtccggcacgctgtgcaggtcgaagccgtccgcaaggcgccgtgcctcggccgtacggtcctgggcgacgagggcgagcagggtgtgggcgtgcacgttgccgggtccggtgacctggacggcgggcggttcggccgggagccggccataggtgccgcgcgccgccgcgatgtcggcccgggtgttgagcagtgcctcgtgcatggggtgcagcaggccggggcgatggccggacagaccccggtccaccagccggtccgcctcgtcgagttcgtcggcccactgggcgaccgcggcggccgtgcccagcaggaacggctcggtcagcgggtgggcgggctcggcgagcagttcgcgcacctgccgcatggcgtcaccggccgaggtgagcccggcggaggccgcgtaccgcacgagcaggatccggccggccgccccgaccgggtcgggcgagtggtcggcgttctcgcgcagcacccggtacacctcgccgcggaccgtctggtcgcggtcggccagcagcgcggaggcgctgtgcagggtggccaccaggtccggctggtcggcgagttcggccaccgccgcgcacagcacgtccacggcggcgcgcggccggccgcgcgc

SEQ ID NO: 2422 - DNA, 1054 bp, Unknown
  Kingdom: Bacteria, Phylum: Actinobacteria, Class: Actinobacteria, Order: Streptomycetales, Family: Streptomycetaceae, Genus: Streptomyces
cgcgagcccatcgcgccgacgaaggcgaccggcatccgcagcgcgaccgtgagcaggggtatgtcgaacttggcgtcgtgggtgagtacgcacaggaccgtccgccggtccgtcgaggtctgccgcaggtagcggtggggccagtcgacgacgatgtcgtcggcgtcgggaaagcgccccggcgtggcgaagacgggccgggcgtcgcacaccgtcacgtggtagccgaggaacttgcccgccctgaccagcgccgccgcgaagtcgaccgcaccgaagacgatcatgcgcggtggtggcagggtggactccacgaggagggtcagaccgcccgggcagtgcgaaccgtcctcggacagctccaccgtgcccgtgcggccggcctccagcagggcccgggcctcggcgaccgcggtgcgggccgcctccgggtggccgtcgaatccgccgtcgtccgcgccctcgtcggttccgtccggcctgaccagcacggtggcgccgagcaggtggtccgggccccggacgatccgggcgacggccacgggctcgccccggacagcggccgacagcgctgcccgcaggaccgtccgcaccggggcctgcgccgcgaccggggtgatcatcatgtcgatggtcccgccgcaggtcaggccgacggcgaaggcgtcctcgtcgctgtagccgaactgttcgaggacagtggtgccgtcctgcagcgcctgccggcacaggtcgtagaccgctccttccacgcagccgccggagaccgagccgatgacggtgccctcgctgtcgacggcgagggccgcgcccgggccgcgcggcgcgctgccgccgacggccaccacggtggcgacggcgaaggcgcggccctcctcgatccagcggtgcagttccccggcgatgtcaagcatgtggctcccctgtggccgcctgcaggacgcggtcggggcggatgggcaggtggcggtggcggacgccggtggcgtgccagaccgcgttggcgacggccgccgccacctgcccatccgccccgaccgcgtcctgcaggcgg

SEQ ID NO: 2423 - DNA, 732 bp, Unknown
  Kingdom: Bacteria, Phylum: Actinobacteria, Class: Actinobacteria, Order: Streptomycetales, Family: Streptomycetaceae, Genus: Streptomyces
gccgagcgcggtgagcgcgggctcaccgggcctgcggggcgccgtgtcgggagcgtcggtcatgggctgtccttctggggcgagcgagccgcgcgtgcggtatgcacgtccggtatttcggacagggttcgcggctcagggcgtggaaaggaggcggggaagggaggcggggaagggagtggtggtacgccggtcacggggccgtcgggtcgcgccgcgaccggcgtacggtcaggggcggtcgtacggccaggaagcggccggcgtccggtcaggggcggagcaggatcttgccgaccccgggatcaccggaccccgccagttcgacggcgtgcgcgaactccttgagcgggagttcgtgggtgaccagcggcagcgcgtcgagcaggccggccgcgaacacccggacggcgtgcgcccaggcgtccggcggcgccccgaagacggtgtgcacctccagttgccgtacgaccaggtcggtcgggtcgagcccgtccgcgcccggcgccgggatgccggtcaggaccagccgtccgccgcgccgcagcagtgcggcggaggtacgggccgcgtccgcggacccggcggtctcgacgaccacgtcgaagccgcccggcagcgcgggatcgtccttggtacggaagtccgtggccccgaaccgccgcgacagcgcctcccggtccctgtgcgcgcccaccaccagcagttcagcggggcagaccgccttcagga

SEQ ID NO: 2424 - DNA, 677 bp, Unknown
  Kingdom: Bacteria, Phylum: Actinobacteria, Class: Actinobacteria, Order: Streptomycetales, Family: Streptomycetaceae, Genus: Streptomyces
cacccgccctccccggggccgagcgccccgcgcctcggcggcccggtgggccggggtctcggcggtcacctgagctggctgcgacggcccggtgggcccggcttggtcgatctggcgcgtcctgtccgggtggcggacgggcccggctccgctgcctggtggtcccgtcctcggcgggcacctgggcctggcgccaacggtcggacgggtcggcccccggtgagcccggtcccgtggagtccggtgcgttgcgccctggctgcggggcgggctcagctccggtgcgtggtgtggtcggcctccggcggccacctgggcccggctccgacgggcggacgggtccggtgttccatgagcccggtccggcgcgtgcgcccctcgcctcgtcggcctcgtcaggagcctcgtcggcccgtccgggtggtcaggcaggcctctccgcggcagccggctttgtcccgctccggcgccctggcgagcctgttcccgtcggtcaggccccccgtccccacgactccctagtcccgtccggtggtcaggccccgtcacaagccagggaggcccgtccgggcgagccgggcagctcccttccagcagtcggtgaccccggccgccccggtggcccgtaggcccgtcccgtccgcgtgcgtccgtcccgcggacgggacgggcctacg

SEQ ID NO: 2425 - DNA, 533 bp, Unknown
  Kingdom: Bacteria, Phylum: Actinobacteria, Class: Actinobacteria, Order: Streptomycetales, Family: Streptomycetaceae, Genus: Streptomyces
gcccgcgtccgggaccggcgcggcagcggccccgaccggcggcccggcaggcacggcaggccagggaggtgccgctcaggcctctcccgccgcaccggcacccgcacacgccccggcggccggcggtctcgacccccgccagctgtggccgaacatcctggaggcggtgaagaaccgccgccgcttcacctggatcctgctcagccagaacgcgcaggtcacaggcttcgacggcaccaccctccaagtcggcttcgtcaacgcgggcgcccgggacaacttcgcgagcagcggcagcgaggacgtgctgcggcaggcgctggccgagcagttcaacgtgcagtggaagatcgaggcggtcgtcgacccgacgggcggcggtgcccccgccccccagccctccggcgggtacggagggggtggcttcggcggaggtggttacggcgggggtggcggcggcgcccactccggtggtgtcgcggccccgcagcgtacggcggctccccaggccgcgcccacggctcccggccgcg

SEQ ID NO: 2426 - DNA, 1200 bp, Unknown
  Kingdom: Bacteria, Phylum: Actinobacteria, Class: Actinobacteria, Order: Streptomycetales, Family: Streptomycetaceae, Genus: Streptomyces
ccgtgccggcggccccgcgagcccactgagcgcccgccgggcacatcggtgagccgctgtcagaacttggcgcacagcagcgcgtttaccggcgctgcgcgagacctaccctgaaggtatgggagggcctggcgacccgcctgaagggacacccgacggcaccccctcaggcgcggaggacgaataccgatccgtcgtcttcgacgagtcgttcgtccgcgctgcgcgcctgcaggagtactccgcccgggagcggatgaccgaccacacgcccgccgtccgccgccgcccgcacgcgcaccgctccctgccgcggcaggcactgttcctggtcctgctgatcgccgtcgccttcgccaccgcgatctacatgggcgtacggacgccctaccggtccccgctggcgccccacgccgtcgaaccgctgcgtgcgaccgtcgtcccgctcgtcccggccggcaaggtgcccggaagcaccgatctcgcacgcctgtacgcggactctcccgccgcccgtttcacccccggcgcccagggcatcccgctgcccgcgcaccacggcaccgcgcacttctcggacagccaggtcgtcgcggccctgaccagcgcgcaggactacgtcgtggcctccgccgccgacccggcggtgctggtcggcggcagcacggcggccgtacgggccctgctggacccgggccagctcgaccagttcgaccagagcaccggccagggcgccgaccggggtgcgggcgcgaacgacgggggcggcggtggcgccggtcagccgggcggcggcgtcgcggccaccggatggctggtccgcttcgacccgcaccgggtggcgctggccgactcccatgtccgggtgcagggcagcctccaggtcaccgaggcggacgccgccacccttgaggtcaccgccgaccccgtcctcgtctacgcgctcaggccggccggctccggcgccgcggccccggtctcgctgttcaccgtccggcgcgaactgcggttccgcttcgacgacgacgacctgcgactgcaccaggtccagctggtcgccgccaccgtcgaggcgggcccgctgtcctgcggcgacgacacgaccggccgcttccagccgctgctggccggccagagcgcgaaggcgggcggcccggccgggacgaacccgtacgcgccggacggcacgacggccgtgtg

SEQ ID NO: 2427 - DNA, 771 bp, Unknown
  Kingdom: Bacteria, Phylum: Actinobacteria, Class: Actinobacteria, Order: Streptomycetales, Family: Streptomycetaceae, Genus: Streptomyces
cagccgcactcgggcgcaggccgtgggtgaccgctcgtcgggctgtctgccgtggtcgggtgcgggctgtgggtgaccgctcgtcgggctgtctgccgcactcgggcgtgggctgcgggtgaccgctcgtcgggctgtcagtcgtggtcgggcgtgggctgcgggtgaccgctcgtcgggctgtctgccatggtcgggcgtgggctgcgggtgaccgctggccgggctgtctgccgtggtcgggcgtgggctgtgggtgaccgctggccgggctgtctgccgtggtcgggcgcaggccgtgggtgaccgctggccgggctgtcagccgcactcgggcgcaggccgcggggcgccgcacgccgggctgtcaggcgccgtcaggtgtgagccgcgggtcaccgcatgccgggccgtcagccgcggtcaggcgcaagcctcggctcaccgcacgacgggccgtcaggcgccccggtgcgcacgtccgcgcgcaccggacggaccaatcacggcaccgccaccgtttgcgacgtgagtcgatttcgtacccatctgactatcgcttgtccgtcgatacgaccgcaccaccgcccgcccgccccattgaacgtcagtgcgacagcgtgcgggcgcgaccgcaacgaggtgaaccgaccgatgttctcacgccgacaccaggtggccctggccgtgacagccctgctcaccgcggcggcctcctgccaggccgaccaccgcgagcagcggcacgctccggccgcgcgcccggcgccc

SEQ ID NO: 2428 - DNA, 854 bp, Unknown
  Kingdom: Bacteria, Phylum: Actinobacteria, Class: Actinobacteria, Order: Streptomycetales, Family: Streptomycetaceae, Genus: Streptomyces
ccgccgagccgcgccgcctccgcgccgcgtggcagtgcctgccgcagccggtcggcgatctgcagcagcagccggtcgcccgcgaggtggccgagggtgtcgttgaccgagcggaaacggtcgaggtcgatcagcatcagggcggagcgggcgccgatgcgttcggcgtcgtcgagggcggtccagatgcgctccaggagccactgccggttgggcagtccggtcagcggatcgcgcagttgttcctcggcgcggacgcgggcgatccacagcgtggagtcgagggcgatgagcgggatggcgaacagcggcagcagcaccggctcggcgacggcgacgacgcagaccagcggtgcgatgccgaacagggccaccgcgaccaggccctgcctgaccagcgcggtgcgggcgacggtgggcaccgggtcggtgcgcggggagtgcaggtaccacagcaggacccgggtgaccgcgaggtagacggcagcgaccagcaccacctggggagcggtgtacgcggtccaggagcccgggtcccagggccgctccacggtcggcacccggcccaaggcgccgaggaccagggcggcggcaccgatgccgacgatgtcgaccgcgccgtgcagcacgccggggcgccagcggtgccgcctggctatgccgaccaggacgacgacggtcaggctgaccaggccggccgcgacccaaccgtagagcaggagcacggcgagggtgagggcggcgccggagccggtgccgccccaccagcgggcccggccgagcatgaccaggtggccgacgatgatgccggtgagcacggccagcgaccagccggccgtgctcaccggcatcat

SEQ ID NO: 2429 - DNA, 569 bp, Unknown
  Kingdom: Bacteria, Phylum: Actinobacteria, Class: Actinobacteria, Order: Streptomycetales, Family: Streptomycetaceae, Genus: Streptomyces
ggcccgttcgcgcgccgagggtctcgagcgtgacgcccgtgccaaggccgacgccctggagcgggacgcgcaggagaagcaccgcgtcgcgatgggctcgctggagtcggcccgcgccacgctggagcgcaaggtcgaggacctgcgcggcttcgagcgcgagtaccggacgcgactgaagtcgtacctggagtcgcagctgcgccagctggagacccaggccgacgactcgctggccccgccgcgcacccccgcggccgcgtcgctgccgccgtccccggcgccctccatggctccggccggcgcgagcgccccgtcctacggcggcaaccagtcgatgggcggcgcacccagcccgtccggcccgtcctacggcggccagcagcagatgtccccggcgatgacccagccgatggcaccggtacgtccgcagggcccgtcccccatgggccaggcgccgtccccgatgcgcggcttcctgatcgacgaggacgacaactgagggccccctgaggggttcccaagagcgaatcaaggcgtcggcagcctgagagaacggccccggagga

SEQ ID NO: 2430 - DNA, 1078 bp, Unknown
  Kingdom: Bacteria, Phylum: Actinobacteria, Class: Actinobacteria, Order: Streptomycetales, Family: Streptomycetaceae, Genus: Streptomyces
cctcgtactccgcgcaggcggaggccggggaagcggcgggcgccgtggccgcccgctcgcgcaggacccgtaccgccagttcggccgagtcgcgggaggcggccagctccgacaggtccgccgcctgccgtcccactccggcgaagaccgcgctgtgcggcaggggacggacggtggcgaccatgcggcgtaccaggttcgtcccgccgccgcctgcggcggctgccaggacgaacagccggctgcccgagcgggtggtcacgcagcccggcagacaggcggaggcctgcagcgcgagcatgtccagcacccggctcccggtggtgtcagccgccggcgcgtcaaaaggaccgctccggctgtccctctccttgccggcggggatccgcgtgtcgtgcacctcgacgacgaggaccgtgtacgggcccgtcggtgccactccgagtgcgcgtgccgcctgctgcgcgccggggcggccttcgagcaggtccttcagcgcccgttcgcggcgcccggtctcctgcctgccccgcatctcgtggtgcacgaggtgcggcacggcggcgcgagcggcggttctcagtgccgccgcggcgtcctcggcgagcggtcgcccgtcggcggcggcccagagggatccgagtacctcgccgccgtgccgcaccgcgatggccagccgctcggcgtagcgctcgtcggcgggcaggcgcaccacgtcgccgctgctccacagcgcctggaagaaaccccgctcacggagttccgcgaccctccagcggggcacctcctggccgaggatggtcagcatgcgcagcgggtccgccgtgtgctccagccgcgagtaggcgagcacacgcgaccgcgggtcctcgatggtgatggctccgccgaccagaccggccacggcgttggccagtcccgccaggtcgccggggcgcaggtcctccactccgggcggggcggcggtgtcgctggacaccagagccgtgcgcagcctgccgagcacctcggtccagtcggtgtccggggcgcggagcagcagggcggtgcggccctcggcggcggcctcggccagggc

SEQ ID NO: 2431 - DNA, 818 bp, Unknown
  Kingdom: Bacteria, Phylum: Actinobacteria, Class: Actinobacteria, Order: Streptomycetales, Family: Streptomycetaceae, Genus: Streptomyces
gatatgagaccgggggttcggccgcaccggttctccgtgtgccgtcacgcggccgcggtcccttcttcccacgatcgccgtcggcaggaggcgcggtgcgacaacggcaggcgtccggcggcgcgcgccgggcccgggagttcgaggcgttcgtcgcgggcgcggccgggcggctgctgcacgccgccacgctgctcaccgccgaggcgccggacgacaacccgcgcgcgcggcgcctgctgaccctggccctcgcacacacgtacgcgtgctgggaccggctgcacggcgacgacccctacgagcgcgcccgccagtcactggcggcccggttcgcccgcgaggcctggcaccagcacggcgtaggggccagggcccgcggccgccccgccccaccgggcaccctggccgccctctccgcccaggaacgcctcgtcatcgtcctcaggctgtacgagggcgtggccgaggagcagaccgcggcgctgctcggcctgcccaccgaacgggtccgtgtcatctgcgaccgggcgatctccgtcctcacccacgcacccgcgcgcgccgcccctgccgtacgcggcccgaaggtggctccttcgtagccggacctacgcaccggacgcatgcgcgagcgcaggccgggccgcgacgaacacaggcgggcggcgaacggcgaacagaggcgaacgacgggggcgttgtgaacagagtggagcgtgaggcggcggtacggcggatcctggatcagacgccgccccgggtgcccggcgagctgtacgacgacgccgtgcgccgcggcggccgcatgctgcgcc

SEQ ID NO: 2432 - DNA, 607 bp, Unknown
  Kingdom: Bacteria, Phylum: Actinobacteria, Class: Actinobacteria, Order: Streptomycetales, Family: Streptomycetaceae, Genus: Streptomyces
cgccctgcgcgtcgccctggagaccggcgcgggcttcgacctcaccgaggccggcacgcagaagcggctcgcggtgtacgtcgtgcacgacccgcttcaggtgccgggcatcgcccgcctcggccccgatccgctggccgacggcttcgacgaggagcggttcgcgcggctgctggcgggggagcggcggcagctcaagggcgcgctgcgcgaccagagcctgatcgcgggcgtgggcaacgcctacagcgacgagatcctgcacgcggcgaagatgtccccgttcaagctggccgcctcgctcaccccgcaggagacccggagcctgtacgaggcgctgcgcaccactctgacggaggcggtcgagcgctccaggggcgtcgcggccggccggctcaaggcggagaagaagagcggcctgagagtgcacggccgcacgggcgagccctgcccggtgtgcggcgacaccatccgcgaggtctccttcagcgactcctcgctgcagtactgcccgacctgccagacgggcggcagaccgctggcggaccgcagactctcgcggctgctcaagtagcacggggggcgagggggcagggctgtgaagggg

SEQ ID NO: 2433 - DNA, 504 bp, Unknown
  Kingdom: Bacteria, Phylum: Actinobacteria, Class: Actinobacteria, Order: Streptomycetales, Family: Streptomycetaceae, Genus: Streptomyces
cggcaccggagcgcggaccgagaccggcgggcatcaccctgcgccgggagatcaccgatggtctgcgcgtgctgggacgggaccgggccctccggggactgtgcgccgccaccgccctgtgcaacgtcggcatgggcgccctgatcgcgaccctggtcgtcctggtgacgggctggctgcacgccgggcccggtgggtacgcggcggcgatgaccggatacaccctgggcagcctgaccgggggagcggccaacggccggatcgtggcccgcctcggccggatgcgggccgtgctgctggccgggacggtgcagacagccgccctgaccgtgatgggcacggtgcgcagcctgaccgcactggtggcggcgatggccgccttcggcctgatgggcatggtgtggaacgtcaacaccaccacgctgatgcagcagcgcagtcccgccgacatgctgggccgggtcagtgcggccttccggaccctcgcggtcgccggagcgccgc

SEQ ID NO: 2434 - DNA, 874 bp, Unknown
  Kingdom: Bacteria, Phylum: Actinobacteria, Class: Actinobacteria, Order: Streptomycetales, Family: Streptomycetaceae, Genus: Streptomyces
cccgggcaccggggcgttgacctgggcgcaccgctgggcacgccggtacgggcggtggcggcgggacgcgtgtccttcgcggggcccgtggcgggacggggtgtggtgtcggtggagttgccggggaccggcgccccgccgctgcggacgacgtacgaaccggtacgggcgtcggtgaaggcgggctcccgggtgctgcccggccaggtcatcggcaccgtggagagcacagggacgggctcgcactgcggaagcggctgcctgcactggggcctgctgcgaggcgatacctacctgaacccgctgctcctcctgcctccctggctactgaacggcggcccttcacgcttgctacccgtactggacgtacctctgccgaggtgaccaagagcgcacgactgggcggcagcacgccgacaggcccgcgctcgctgtcagaccgccagcccgcgtgccgcgtgaccgcgagggccccgtgctgcgcggctgcggggcggtgaggttcacggctgcgagccgtgcgccgacggggccgggagatccacggctgcgggctgcgagcccaggtcagtggggccgtgccacgagcgcgtgcccaggaccgcctgcgcgatgtcgcccaccgctacggcgtacggctgcggcgaagccacacatggcgggactgcgaactgctcgaccgcggggcgcagccgcgcactgagccatctcgtactgcagcgccgccggctgcacggttgggtcgcacatgccgcgcggccgcaggggggcgtgtcgtgccgttgaggcggcccgggggtgcggagggcgcgtcagaacggcccggcggcgcggatgcggcggggccggtccccggcgcgaggcaggccggggc

SEQ ID NO: 2435 - DNA, 819 bp, Unknown
  Kingdom: Bacteria, Phylum: Actinobacteria, Class: Actinobacteria, Order: Streptomycetales, Family: Streptomycetaceae, Genus: Streptomyces
cagccggaccgaccggcccaggccacccgggccgcccggccctcccgaccggaccgacccgaccgatcggccgggccggcccaaccggttcggccgatccggccgggtccaccgcgtccaccgaccccgccgcgtccacggcgtccaaggcgtccagcgcgtccgcccggtgcccgccgtccggcgggtccagcgcgtccgccgccgccatggggcgcgccgccgctgcgggccccaggggctccgggcgcgcccttccttgcccactccacgcatgacctcaccctcacccccatccgccccgtccgcgatgtgtgctgtgccacctggtggaaccatcgtcctggtccggggcgtttctgtgggtacacgtacacgtggccggttcccggatccacgtgcgcgtgaccgatcacgctgatcactgggcccgtcccgcgcgtatttcgggtccgagagaaaggcggcatgcgtggacctgctcgacctcgtgctgttgctggtgatcgtgctctacgccgtctccggctaccggcgcggactggtggccggctgtgtctcgctggccggattcgtgggcggcgccgtcgtcggcgtatgggtgctgccctgggtgatggacctggtcacccgcgggtcgacggcggcgacggtgaccgccgtgctgaccgtcctggtgcccgcggtcgtggggcacgaactggcggggcggctcgcgctgcggctgcggcgcgagctggaccgggcaggccgcggtccgctgcgcgtggccgacgggatcggcggtgccgccgccaactcggtggcggtgctcatcgt

SEQ ID NO: 2436 - DNA, 521 bp, Unknown
  Kingdom: Bacteria, Phylum: Actinobacteria, Class: Actinobacteria, Order: Streptomycetales, Family: Streptomycetaceae, Genus: Streptomyces
ggactccgccgaggcggcctcgcgggcgtcctccgcggccttgcgggaggcctcgcgggcttcgtcccaggcggcgacggccgtcttctcggcatcgctggcggccagggcggcgcgggccgggtcggcgtcgggggcgctgtcgtcgagccagccggcgcggaccgcctcggcggtctcctgctcgacctcggtgagccgctgacgcaggtggccggcctcactacgggcgcgctgcgcctcggtggcggcggcggtcgcgtcccggtgggccgtctcgcccgcctcctggagctgtgcggagcgctcctccccctcgttggcgagggcttcggcgctgctcgccgccgcgtgcagggcccgtacgaggtccacggcggcccgggcgcgggcggcgagcgcgggagccgcgtcccgttcggcctcctggatggcggcggagacgcgggacacgcggtcggctgcggcgcggtggcgcaggacggcctcggccgcctgccaggccgagtacagggtgcggg

SEQ ID NO: 2437 - DNA, 1718 bp, Unknown
  Kingdom: Bacteria, Phylum: Actinobacteria, Class: Actinobacteria, Order: Streptomycetales, Family: Streptomycetaceae, Genus: Streptomyces
ttctacctgtcagcgggcgcggcggcggaaccgcggggccccggcggctgccttggccggaaccggaccggaccggaggggacgcggctgtgccgccgtcccgggggcaggcccgcgggacggcggcacacgtcgacgggctccgtcagcggaccggcttcaggtcggtgatcttgcgggtcctcaggtcggaccgtacgtcgatcttcgtcacctgggcgttccggccgtcgctccaggtgagcgtgaccctgctggtggcgtggccgccgcccgaaccggcgtaggcgaccttccacttcaccggtacgttctgggcgaagaggatgccgtccgcgtgctccctggcctcgtacgcggcgacctgcttgcgcgcgcccgctgacaggtagaaggccttcagcgccttggcgtcggctgcggcggccgggtcggagccgtcccacgccgtgtcgatgtaggcgccgtagaagtcggcgacccgctgtgtgacgctgcgcgggtcgccctggacggtggtggtgggcgcggacgccgcccggtcggtgccggaggccgtacgggccgggtgggaggccgcggtgccggccagggccggtgtcacggcggcgagggagagggccgccgcgagggcggaggcggtgatcaggctgcgtcggttgcgaacacgcatgggcatgtgagtgtttcccccagttttacggggccgggcgtctcccggcacgacggtcggcaggtaagaccggaacacgccgctcaccggttccgtaatgtcccggaaaattgccgcagttccggaagacgaagaaggttgcccggtgttccggccgatccggccggaccctccggctcgcatgcatccggcgggtccgggaacccggcggaggccgtacacccccacacgtctggagaggaccatgagtctgctgcgcgtggccggtcgtcccctgctcgcgtccatgttcgtcgccggagggatgaactccgtacgcaaccccgagggcgtcactccgctggccgaacccgtcgtacgcccgctcgtcgaacgcgtgccgatgctgccggaccggaccgaacaggtggtacggctgagcggtggtgtccaggtggccgccggtgtcctgctgggactcggacggctgccccggctctccgccctggccctggcggccacgctggtgccgaccaccatcgccgggcaccgcttctgggaggcggaggatcccggcgaacgcgctcagcagcgcatccacttcctgaagaacctctccatgctcggcgggctgctgatcgccgccgacgacaccggcggtgcgccgtcgtggctgtggcggggccggcacggcacccgggaactgcggcgcgaggcggggctggtgcggcgctccgtccgtgcgacggcgggcccggccgcgacgatcggcggcatccgggccaagcttcccgggtgagcgccacgccggtggacatcgccggtgaccatgccggtggccgtggtggccgtgccggtgcctgccggtggccgtgccgctgagcggcattcgtcggtgccgtgccccggtgggctgagccgacatgtgcggatgcgggctctccgagtcggagagcccgcatccgcatgtcacgtgtcatcccgtcgtcccccggcaggcgtcagggcttgagggtgtccttgcccttctccttggcctgacgtgcgtcgcccttggccttctcgg

SEQ ID NO: 2438 - DNA, 1168 bp, Unknown
  Kingdom: Bacteria, Phylum: Actinobacteria, Class: Actinobacteria, Order: Streptomycetales, Family: Streptomycetaceae, Genus: Streptomyces
aggctgagctgctcggcgagccccgtgaccgccgcgcgggccgccgagagccgcgcggccgccgccgggtccttgtcggcccacgcccgcggcggcggggaaccggtgaccgcctggccctgctgtggcagcgcggactcgggcagcgccctggcccggtccaccgcggcctgccactgctccagctggcgccggcccatccggtgcccgaagccggtcagcgcggccagggcgtgcacgttggccggcacggcgagcgctgcctgcacgatggcggcgtccgagagcaccttgcccggcgagacgtcgcgccgctgcgcgatccggtcccgggcctgccacagctcccgcacgacggccagctgccgcctgcgccgcaccttgtgcatgccggaggtgcgccgccaggggtccttgcggggctcgggcggcggcgcggcggcgatggcgtcgaactcctgcagcgcccattccagcttgccctgccggtccagctccttctccagcgcgtcgcgcaggtcgacgaggagttccacgtcgagggcggcgtagcgcagccacggctcgggcagcggccgggtggaccagtcgacggcggagtggcccttctccaggacgaaaccgagcacgttctcgaccatggcgccgaggcccacccgcgggaaaccggcgaggcggccggccagctcggtgtcgaacagacgggtcggcaccatgcctatctcgcgcaggcacggcagatcctgggtcgccgcgtgcagtacccactcgacgccggtcagcgcctcgccgaggccggacaggtcggggcagccgacggggtcgatcagcgcggtcccggcgccctggcggcgcagctgcaccagataggcgcgctgcccgtagcggtagccggaggcgcgctcggcgtccacggcgacgggaccggatccggcggcgaaggcggcgaccacctccgcgagcgcctccgggtcggcgatcacgggcggaatgccctcgcgcggttcgagcaacgggatcggcgcccccgtgtcagaagttccgccgtcgtccggaggggcgcctccggtggtgcgcagtgggctgtctgctgcggtttcttgggcgtcggtcacctgtcaagggtatcggtggatggacggcgcccgccgacggaacgttccgtcgg

SEQ ID NO: 2439 - DNA, 668 bp, Unknown
  Kingdom: Bacteria, Phylum: Actinobacteria, Class: Actinobacteria, Order: Streptomycetales, Family: Streptomycetaceae, Genus: Streptomyces
gatgaccggcagcctggagagcctggccgccgccgtgcggtgcgcgccggacgtgcagaccgacgccgacaccatccggcaggcgatctgcaccacccccaccggccggttcgtgctcgtcaccttcgccaccgaccgcggccggcgcgagtggatcgccggggccgaggactacggcggtttctacctggtgggccgcaagtgggtcgccgtcggggacgccggcgtggtcaccgcactgcgccgcaccctcggcggcgaggtggaggccggcgccggccaccacgcgcaccacgggtgagtacgcgcgtgccgcgtgcgccaggtgagcccctgagccgcgtgcgccgtgcgcggcacggtggcgcctctattcggtccaggcgtgttccagcagggtgcggaaggcggcgggctcccggccgatcagttcggccagcgtggggtcgacggcggtgaactcgccgttccgcgccgccgcgaagatgctcaccatcaggtcggcgatcggggccggggcaccgtgcgccagggcctgctcgcggaaggcgtcgtcggggacgacggtgcgggtgaaaggccgtccggtggcctcggccgcgatgtcggcgaggtcgtcgaagtcgagcgccgccgggccggtgagcggtggggtgggtccctcgaag

SEQ ID NO: 2440 - DNA, 834 bp, Unknown
  Kingdom: Bacteria, Phylum: Actinobacteria, Class: Actinobacteria, Order: Streptomycetales, Family: Streptomycetaceae, Genus: Streptomyces
tgtgcggggctggaccggcgttcgggtccggacctgcgtgcgaggctggggcggtgtgcgggttcgggccggtgtgcaggtccgcgaggtccggggcggcgcggacgagttcggcgcggaacgccagccggtcgccgcggatgcgcaggaactccaggtccaccgggcgcccgtcgggcagtctggtcagccgttcgacggtgaacagcgccgagccggccgggatgtccagcagcgcgcacgtgtgcgggtcaccgcccaccgcgtgcacggtgacactcgccgtgccgagccggccgccggtggactgctcgatgagtccgaacaggtcccgcccggccaggtcggcggccagcagcggcagcccgatgtccgcggccaggtaggtcaggtcgagggacagcggcaccccgtccagcagccgaagccgttcgatgtagaccacctgcccgccgtcgggcacgtgcagcttgcgcgccacctcaccgggcgggcgcaccaggtccgcgacccgcacccggttggtcacctcgccgtgcgcgcgcagcgtctcggccaggccggtcagccgctccagcgtgtgttcgtaggtccgccgcacgatcaccgtgcccaccccctggcgccgctccaccacgccctcggcgcgcagcacgcccagcgcctcgcggacggtgttgcgcgacaccgcgaagtcggcgatcagcacccgctcgtccggcagcttgcccgaggcgaacgccccggaggcgatctgacgccggagcacgtcggcgacctgccgggcccggtcggcccgggtccgccgccggctctccggtgccggacctcgcg

SEQ ID NO: 2441 - DNA, 615 bp, Unknown
  Kingdom: Bacteria, Phylum: Actinobacteria, Class: Actinobacteria, Order: Streptomycetales, Family: Streptomycetaceae, Genus: Streptomyces
ctcgtgctcgcgcagggcgcgcagggcgtgcgcgacggcgaggtcgccgccgcggtcgccgtccccggggtcgccgacctcgatccgggtgacgccggtgcggttggtccgcgggctcgcccggcgcacccggtcggcggtcaggtccggcgccgcggcgaagtgggtgcgcacggtctcctcgacgaggtgggcctcctcgccgtcgcgggcgaggaccacgcccttctcgtagaggaactcggcggagtcgtccgggcccatggccagcgggacgtccggcatcgagcgctggatctgcgcgaactgctcgtggaagcgctgtggtgccatggcgcgcgtgtcctcccgtcgggacggtggtccgtcagtcagagtcgtggggtccccggttgatacatccgctgcggctccggagccgggggacgcggttccggggcctctccgggaccactaccatccggtaggtgacagcgggaagcgaatcggtgctcgaactgctgccgatggtgttcgccgaccccggcgaggcgctggcgcgggcccgcgcgctgctcgacgcccggcccgcaccgctgcacgcctcggtggcgcaccaggtgatcggcatctggc

SEQ ID NO: 2442 - DNA, 504 bp, Unknown
  Kingdom: Bacteria, Phylum: Actinobacteria, Class: Actinobacteria, Order: Streptomycetales, Family: Streptomycetaceae, Genus: Streptomyces
tcacggcgcgaaggcctcacgccggggggacctcacgacgcggccaccgcgcccgcgagccgcgcgaccactgcgcgagccgtggggcgcggcccaccgcactcgcgccggcaccccggccccgcgggcagcaccggcacgcaccccacagcatcaccagttccgccagttcgaccagttccaccagttccgaaggagcgacccgtgtttcccgatctcgtcctgctctccgcccggctgctcgacccgggcacgggctcgctcctgccgcacacggcgctggccgcgggcggcgggcgcatcacgcacctcggggacgaccgggaggtccgcgcgctggcaggaccggcgaccacggtgatcgacctgaagggcgcggtggtcaccgcgggcttcacggacgggcacatccatcccgtctccggcgcggagcgcaccatgggcgtggacctctccggctgccgggacctggcggccgtgcgggcggcgctcgcagagcgggcc

SEQ ID NO: 2443 - DNA, 810 bp, Unknown
  Kingdom: Bacteria, Phylum: Actinobacteria, Class: Actinobacteria, Order: Streptomycetales, Family: Streptomycetaceae, Genus: Streptomyces
tccggttccggcaagtccaccgccgcccgggtcgcgctcggcctgatcccgccgacgtccggcaccgtcaccctcttcggcgccgacctcggccgcacccgcgcccgggcccggcgcgccctgcgggccggcatcggtgtcgtcctccaggaccccgtggcctccctcgacgcccggatgaccgtcggcgagtgcgtcgccgaaccgctccgcatccaccgtcgcgacctgtccgccaaggaccgccaggccaaggtcgccgccgtcctcgaccgggtccggctgccccgcgaggtcgcccgccgtgcgccccgcgaactctccggcggacagcgccagcgggtcagcctggcccgcgccctggtcctggaaccccggctgctggtcgccgacgaacccaccagcgcgctcgacgtgagcgtgcaggaagctgttctggaggtcatcaccgaactccagggcgacctgggcttcgcctgcctgttcgtctcccatgacctcgccgtcgtacagcacttcgcgcagcgcgtcgtcgtgatgcgggccggccggatcgaggagcagggctccaccgggacgaccctgctgcacccggagaccgactacacccgccgtctgctggccgccgtgccggtgcccgacccggtggtgcagcgggcccgcagggccgagcgcctggccaccctcgcggccggccgtacggaggcccaggcgtgacgcgaccccgcttctccccgcacactccgcaggacccgcccatgcccagcaccctccggccgctcttcgccggcatcgacatcggcggcacca

SEQ ID NO: 2444 - DNA, 751 bp, Unknown
  Kingdom: Bacteria, Phylum: Actinobacteria, Class: Actinobacteria, Order: Streptomycetales, Family: Streptomycetaceae, Genus: Streptomyces
atcgtgaacgaggcgtccgccaacgccccggccgcctcggtggtcccggccgcgccggccgtcccggcccgccgggtccgtccggcgtccgcgctcgccgtcgcacggggtgcccggcccggcggggtccgggtgtggcggctgctgccgagtccgggcgggacgccgttcaccttctggtacgcggccgtgctcgtcggcacctcgctggccgcacggtatgtgacgccctccgtgatggacgtcgtctaccggagttccagtacggacgtcgcccacctggtgcgggcgccgctgacggtgctggtggcgagcgcgctgtggatcgcgggcggggtcgtgacggcgtactcgctctgtttcctgctggtgctcaccgcgctggagcgccggaccggggcgctgcgcgcggcgggggtcttcctgctcgggcacgtgttcgccactctggccaccgaggtcccggtcggtctcgcggtcctggcgggccggctgcccgacggtgcgctgcaccgcctggactacgggatcagcttcggcgtcgccacgagcgtcggcgcgctgtgcgggctgctgcgcccgtgggtgcgctggcccgtgctggtcgtgttcgcggggatgctgctggaggacctggtggcgttcacggacccgatgaccagtgccgggcacctcatcgcactcacggtcggtgtcgcgtgctggccggtgctgcggcgcccacgccccgccccggcccgttgaccagccc

SEQ ID NO: 2445 - DNA, 879 bp, Unknown
  Kingdom: Bacteria, Phylum: Actinobacteria, Class: Actinobacteria, Order: Streptomycetales, Family: Streptomycetaceae, Genus: Streptomyces
cggtgagcacgccgaccgtgccgggccgggggccgagggcgccggccacctggacggcacgggcgcgcagggcggcgtaggtcgtggatccggcggcgtcgacgacggcgacggactccggttgcagagcggcggtccgccagaagcgccgcaggacgtccgggaaggtctcgtgcatgagggtctccgggggtcagaggtggtcggcgtcggcggcgcgggcgggctgcggcgcgggcggcaggccgccgtagggtgcggtggccgcctgcttctcgccgcgtccctggacgaggagtcccgcgcaggccacgacggccagggccatcaccgcgacgctgtacacggtggtggtcgggccgagcccgtaccgctgcacggcgagccccgcgatcacggcgggcacgctgaagccgagatagcacaccacgtacatgccggccatgagcccggcgcgttcgtcgggctcggccagcggcgcgatggtctggaaggcgccgaggaagccggtgccgaagccgtagccggcgatcacgatgccgacgaagaacagtgccggggagggcaccgccagggcgccgagggtggtgccgatgccgatgaggaaggccgcgaagccgagggtcgtggtggtgcgcggcggtttgccgcggcgcagcagcgcgccgacggcgcccgacccggtctgggcgaagatgacgagtccgccgaccagatggccgccgaggcgcagcgtgtgggccgcgatggacgggccgagcgacatgtacagtccgcccaccgcccagaccgcgacgagggagggtgccacggtgaggaacagcggccggatccggcgcggtaccgcgaggcgcggtaccagcgacgcggccgcgccgg

SEQ ID NO: 2446 - DNA, 788 bp, Unknown
  Kingdom: Bacteria, Phylum: Actinobacteria, Class: Actinobacteria, Order: Streptomycetales, Family: Streptomycetaceae, Genus: Streptomyces
ggggtcggggcgacggcaggggtcgtccgggccgtgaccgtggctgtagccgtagccgtggtcgtggccgtgagcgcggtctctctcgtcgggttgtcggcgacgaggaggcggcggagcaggtcgcagcggtcggtcgtcggcaggttcagcgcggtccagaaagcgggtccgaagccgctgggcacaggcaggccgcactcctgccagacgccgatccggtcggcgagcaaccgcagcacaccggcgtacggcgtcgcgtccgggacgcgcagcaggacaccggcgaggagccgcgacgcccaccaggagtgcggatcgctgtcgagggcgcacagcagttcctccagccggacggcgagccggcgcgggccgtgctggcgggccagctggaggagggcctggaggaccgggccgatgcggtggtgcgggacgggcagcggacggtgcggctcgccggggacgtgccgccggtggaccaggacacggagggcttcgtccaggtcgaggtgggtgccctggatccagtcggcgagttcctcgtgcgcgaagcggtagccctcgcccgccgggacgaggaggccctcggtgaggacggcggacgcccagccggtgccgccgccgaggcgggcgggggcggggccccacgggaacacctcctcgaacgtcgcccggtccagttcgccccggccggggccgagactgcggcgggcggcctcgtgcacctggccggagaccttcgccgcgagacggcggaccgcggtgccgcgcaggtcgttctccgcggc

SEQ ID NO: 2447 - DNA, 530 bp, Unknown
  Kingdom: Bacteria, Phylum: Actinobacteria, Class: Actinobacteria, Order: Streptomycetales, Family: Streptomycetaceae, Genus: Streptomyces
ggtgagcgagggggaggggcgaccgcgcggactcccgaggagcaggtggcggcctgcgtacgggcgcagctgacgtacgggacggtgagcgccggatcgcacgggcgccggccggggaccgggacgcggccgtgctcagggagggcgccgctcaggcgcacgcggaggtccccgaaccgctcgtcgccgcgctcgccgccctgggcgacgacgcaccgcgccgcacggcccggctgccgcaggggttcgtcgacgcggccaccacggccgtcgcgtcgggcgacgacttcgaggcggtcaccgaccgcgcggtccgcctgaccacggccgcggtgaccgccctgccaccggggtaaggctcataccggcggtgcggggctcgtgccctcggtgtcagggctcaggagctgccctgctggcggcggatccggtcggccacctcgttgtgctcggtctcccaccacgggcgtacccgctcgggcgccgacgggtccgccggttccggcgccggggacccgcccgccgtggcc

SEQ ID NO: 2448 - DNA, 506 bp, Unknown
  Kingdom: Bacteria, Phylum: Actinobacteria, Class: Actinobacteria, Order: Streptomycetales, Family: Streptomycetaceae, Genus: Streptomyces
cggcggaggcacgcgggcacggggtgctcggcgaggtacgggcctgcaccgcctcgctcgcgcgcgccgagcgcgccctggaggccgcccggcccggcgacgaggtgccgtcgtgggcgcgctccttcgacgaggcgcacctcgccgccgaactcgcgcactgccaccgggacctgcagcagtaccgcgccgccgcgcagcacgcggagcgctcgctgcaactgcgcgcgccggcgtacgcccgcagccgcctcttctgccgggtcgtcctcgccagcgcccgcctcgccctcggtgacctggaacaggcctgccgcctgggcgcggaggcggcggcccaggccgcggacatgcgttcggtacgggccgacgagtacgtccgcgacttcgaacgccgcctggaaccgtacaaggacgcgccgccggtccggacgtaccgcgacaagatcgcggccctcggctgacgagggaggggcggggccgcagcgggtcccgccccggtgtcc

SEQ ID NO: 2449 - DNA, 802 bp, Unknown
  Kingdom: Bacteria, Phylum: Actinobacteria, Class: Actinobacteria, Order: Streptomycetales, Family: Streptomycetaceae, Genus: Streptomyces
ggtctggcccgcgccaccccggcctcgctgcaggcccgctgggcggacgcggccgacgacgccaaggccctcggcggccgggcctgggcgatactcggggccggtccgcgcgggccggtctgcgccgacctcgtggccgacggaccgcatctgctggtcgagggccctgcgggcagcggccggaccgagctgctgcgctcggtcgtcgcctcactggccgccgccgagcgccccgaccgcctcggcatcgtgctggtggacggccgggacggcaccggcggcgcgtccggcgagggactgcgggtgtgtacggacgtaccgcacgtgacgacgcacctcaccgccaacgacccggtgcgcatgcgggagttcgcccagtcgctgagcgccgagctgaagcggcgggccgagctgctggggctggccgacttcgccgagtggcacagccggcgaggggtgtccggccgcatcgtggcccagcgcacggggccgccgggcacgggaaccggaccgggcagcggctccccgacaggagcgggagcggccgatctcgacacgccgcccagttccacgctgcggctgcggcccgcggcggcgcgggcgcgggccgaggcggcgccgccgctgccccggctcgtcgtggtcgtagacgacctggacgccctggtctcccccgcgctcggttcgcccggccggccctccgccgggtccgtgatacgcgcgctggaggcggtggcccgggacggcgagcggctcggcgtccacctggtggcggccaccgcgccgggaggccgtacggcac

SEQ ID NO: 2450 - DNA, 719 bp, Unknown
  Kingdom: Bacteria, Phylum: Actinobacteria, Class: Actinobacteria, Order: Streptomycetales, Family: Streptomycetaceae, Genus: Streptomyces
aactggtcgggcggcggctcctgaagcactggccggccgctgccgccgagccgctgaggcggggctggctgagcgtgctggaaaccggagaggcgtacgagagcgagccgttcgcacagcaggagacggggccggacggccaggagccgcccacgtacgcggtgcgggccgcccggctgggcgacgccctggtggtcacctggctgcggcacgacacctcggaccggcaggagcagcggctggccgatctgcaacgcctcggccgtctcggctgggccacctggaacctcgtcaccgaggaggcggcctggtctgcgcaggcctacctgctgtgcgaccgcgacccggcgctcggtccggtcccgctggcgcggctggcggacctcgcgctgcccgaggacgcacccgtgctcagccgcgccgtggacgaactgctggcacagggcacgccgttcgacgtgacgttccggaccaggacgtcggccggtccgcggcatgtgcgggccgtcgccgaggccgtcctggacaccgagggcgcgccggtggaggtccacggcttcctccaggacctcaccgcgcagcgcagcgcggagctggccctggtggagagcgagcggacgatgctcgaacaggacggcatcctgcggaccgagcggacgctggcgggccggctgcagcacgcgctgctgccgctgccgcgccgtccggtgcgcctggcc

SEQ ID NO: 2451 - DNA, 1069 bp, Unknown
  Kingdom: Bacteria, Phylum: Actinobacteria, Class: Actinobacteria, Order: Streptomycetales, Family: Streptomycetaceae, Genus: Streptomyces
ggcgtggatgagcctggtggaactgatcgcgcgggccgacgagcgcggcctcgccgccagcgggctggcttgtttggaccggtgccttccgctgctcggcggagacgacgacgtgctgcgcccgctgtggggcgcgctcggatgctcgacgccgcaccggccgcccggtccgccgacgccgttcgggagtgggccgacgcctgttcggccgcctccctgcggatccaccggctcctcgacccggccgacggcgccgtggccgccgaaagccggggcgagggcatgtcaccgctggtcgccgccgaactgcgccgccaggtcaccgtcctcgaactcctcatcgggcacggtcccgccgggctgcgtcaggcgcgggaggtctccaccgaagggcgccgggtcctgcgggcagtggtgtcgcgccgggcccgcggacgggggtgaacaccggacgcggacggcgtcggggcctgtgacactccgtacccgcacgaacgaggtcagcggtgggccagggaggggagccccgccgggcgcacgcgtccgacggggaactgggcgcggcggtcgcgcgggcccagcagggggacgagagcgcgttcgcggtggcgtaccggatcgtgcagcccgggctgctcggctacctccgcgggatcgtcggcgaggacgccgaggacgtggcctccgacgcctggctggagatcgcccgggacctgggacggttcgacggggacggggcgggcttccggggctggaccgcggccatcgcccggcaccgcgccctggaccacttgaggcgccggcgtgtacggccccgggcgacgacgctggacgaggcggacgtgctcggcctggccggtccgctggacacgtccgagcaggcactggagtcgctctccacggcacaggctctcgaactggtgcgggcactgccgcgcgaccaggcggaggccgtactgctgcgggtcgtcgtcggtctcgacgggcccggcgcggccggcgtcctcggcaagcggcccggagcggtgcgcacggccgcgcaccgcgggctgaaacgtctcgccgagcg

SEQ ID NO: 2452 - DNA, 617 bp, Unknown
  Kingdom: Bacteria, Phylum: Actinobacteria, Class: Actinobacteria, Order: Streptomycetales, Family: Streptomycetaceae, Genus: Streptomyces
ccgctgccggaccggctcgcagacacccgccaccggcgcgcccccgacgggccggtgagagccgcttcccccctggtgctctcgcccgtaggtgcgcccccgcccctgttccaccgccttccggacggccgccaactcctcgcccaggacggctggtccgggaaagttctcgtcgcgctccagcagcacgcccggcggggacacgcgggaggcgaggtcggtcaggatggcgagcaccggctcggggaccgggtgcgcgtggctgtcgtgccagacgccgtcccgttcgaacccgcccgccacatggacgtacgcgagggcctccagcggcagctcggccagcgcctgcgccggatcctcgccctggttgacgtggttggtgtgcaggttggccacgtcgatcagcagccgtacgcccgtgcggtcggccagttcgtacaggaactgcccctcggtcagctcctcgccgggccacgccagcagcgcggcgatgttctccacggcgagcggcacgggcagcgcccgctgcgcgatgcggacgttctcgcacagcacgtccagggcctcgcgcgtgcggggcaccggcagcaggtggccggcctcgatgcggtccgagg

SEQ ID NO: 2453 - DNA, 1164 bp, Unknown
  Kingdom: Bacteria, Phylum: Actinobacteria, Class: Actinobacteria, Order: Streptomycetales, Family: Streptomycetaceae, Genus: Streptomyces
accacctcgagggtggccgcggcggccgtcgtgctggacgcggccaccctcgaggtggtcaccgaggccaccgccgtcggccggatctccttcccgtacgtgcccggtctgctggccttccgggagatcccgacggtgctggccgcgctcgacgccctggaccgggcgccgggcctggtcgtctgcgacggctacggactggcccacccccgccgcttcggcctggccggtcacctcggcgtcctgaccggactgccgacggtcggggtcgcgaagaacccgttcaccttcacctacgacgacccgggcgcccggcgcggcagcaccgcaccgctcctcgccggcggccgggaggaggtcggccgcgcactgcgcacccgcgacggagtcaaacccgtcttcgtctccgtcggccaccgcgtgagcctggacaacgcctgcgcccacaccctggccctcacccccgcctaccggctgccggagaccacccgcagggcggacgccctgtgccgccgggcgctcagggaggccacggcgggcgaccggccgaggtgaggggagcggcccccggtgagaggagcgccgtccgtccgtacggcggtgccgccccggagcaacccccggacgcgccgacggccgcttcctaaccgctcacccgcgtccggaacgtgatccccgccccgcgcagccgctcgacgagcgcgtcgcccatcgccacggccgtcgtcacctgccccgctgtcccgggcagttcgtcgagggccagggagagcgccgattccgcgaacatcttcgccgtctcgtcgtaccccgggtcgccgcccgccacctcggtgcacacgcgccggccgccgccctcgcccacgaaccgcaccgagaaccagctcctggcccgccgctcggcgctcggcccctgtccgggaccgatccggccggacaaccagcgccgcgcgggcggcacttgtgcagcggccgtcagcgcgccgacggcggcgacgccgccgagggcgaccggaaggtggcggacggccgcgtagtgccggtagcggaagtccggaccgtaccgttccagtgcccgcgccgagcgcagcacgatccgcgggtcgagcgtcggcagcggcagcgcccacgcgccgacctccggcgcgaaccgcggggcgccga

SEQ ID NO: 2454 - DNA, 648 bp, Unknown
  Kingdom: Bacteria, Phylum: Actinobacteria, Class: Actinobacteria, Order: Streptomycetales, Family: Streptomycetaceae, Genus: Streptomyces
ccggagtggcggtggcccgctgcacgggggcgccgagggcggtggtaggtgacggcgtggacgaggccgtacgactgccctcggactccggtcggcgttgtacggcgttcggcgtcacgccggacgtgggcccggacaccgaagtcgaactcgggcgcggggcagggggcttgatcgtgggcgaggaagtgcgcgacgaagaagacggcgaaggcgaagaagacggagaagacgaagaagacggcgaagacgaggagggcgaagcggacgaaggggatgaaggggaggatgacgacggtgaagaagccgagggagacggcgaggggccagccgggggcgcggtaggcacggaagccgggcgggacgccttggccgaacgctggaccggagccggagccggagccggagccgcagccgcagctgagggtgccgccgagcccgagcccgcgcccgagcccgaagccgagcccaggcccgagcccgagcccgagcttgggaatgctgccggggacgggccggacgccgaagtcggaggcgtggccgggctggtggcaggggtctgacccggtgccgtgaccgaccgtgagaccggagttcgcggcgggaccgggaccgagaccggggccggggccggggccggggcaggaa

SEQ ID NO: 2455 - DNA, 1069 bp, Unknown
  Kingdom: Bacteria, Phylum: Actinobacteria, Class: Actinobacteria, Order: Streptomycetales, Family: Streptomycetaceae, Genus: Streptomyces
ctggcccggctgcgcggcggccccgtacccccggatccgccgcagcggccggccgacccgggagcgcagtccccgctcttcgaaccgcagggcacccgccttccgctggccgacctgctcgcggtctacgccgagcagcagcggcggcaccagcggaccgcccaccccgaccgcatgcacctgctgaccaccgccgagtcggccgggatgctggtggcggccgagatgaaccgcgcgggcctgccctggagcgcggacgtgcaccgccgggtcctgcacgaactgctcggcgagcggtacgcgggcggcggcgagccgcgccgcctggccgagctggccgacgaggtgtcggccgccttcggccgccgggtccggcccgatctgcccgccgacgtcgtcaaggccttcgcacaagccgggatcaaggtcaggtccacccggcggtgggagctgcggtccgtggaccaccccgcggtggcccccctgctggagtacaagaagctgtaccggatctgggtggcccacggctggacctggttgcaggactgggtgcgcgagggccggttccggccggagttcctggccggcggcacggtcaccgggcgctgggtgaccaacggcgggggcgcgctgcagctcccgaaggtgatccggcgggccgtggtcgccgacccgggctggcggctggtggtggcggacgccgaccagatggaaccgcgcgtgctggcggccatctcccgtgacccgggcctgatggaggtggccggacggccggacgacctctaccagtcggtgtcggaccgcgccttctccggcgaccgcgcccaggccaaactggccgtgctcggcgccgtctacggccagacctccggggacggtctgaagaacctcgccgcgctgcgccgccgtttcccccgcgcggtggcctacgtcgacgaggccgcgcgggccggtgaggaggggcggctcgtacggacctggctggggcgcacctgcccgcccgcggccggggcggcggcggacgaggcgacgcaggaggccggtctcccgcaggaagagccggacgagc

SEQ ID NO: 2456 - DNA, 724 bp, Unknown
  Kingdom: Bacteria, Phylum: Actinobacteria, Class: Actinobacteria, Order: Streptomycetales, Family: Streptomycetaceae, Genus: Streptomyces
ccgcgacgctgcgcgcgaccctcggcatggtgacccaggacggccacctcttccacgactcggtccgcgccaacctgctgctggcccggccggacgcggacgacgcgcagctgtgggacgccctgcgccgcgcccgcctcgacgacctcgtgcgctccctgcccgacggcctggacaccgtcgtcggtgaacgcggctaccggctctccggcggcgaacgccagcgcatgacgatcgcccggctgctgctggcccgccagcgcgtcgtcatcctcgacgaggccaccgcccacctcgacaacacctccgaggcggccgtccaggaggcgctgaccgaggccctggcggaccgcaccgccgtcgtgatcgcgcaccggctgtcaacggtgcgcaccgccgacctcatcctcgtcgtggaggccggcacggtcgtcgaacgcggcacccacgacgaactcctggccgcggacggccgctacgcgcagctgtaccgcacccagttcgccaagcaacagcagcagctgggcggggaggagccgcagcgggaccaggcgcagccggctggtgagaacccgctcgccgccggacccgtgtccgacggcgagggagcgctggcgtaggcgcggtgcgcccggccgggccagcagcaggttggcgcggaccgagtcgtggaagaggtggccgtcctgggtcaccatgccgggggtcgcgcgcagcgtcgcgg

SEQ ID NO: 2457 - DNA, 987 bp, Unknown
  Kingdom: Bacteria, Phylum: Actinobacteria, Class: Actinobacteria, Order: Streptomycetales, Family: Streptomycetaceae, Genus: Streptomyces
gcccggggcagccgttcggccacggctccctgctgggccagggccgcgcacacccaggtggccacggcggcactcgcgcccaccagcagccagccctggtcggcgacggcgagtctgtcggcgccggactcgaggacgggccagtgccgctgcccgaggtaggcggcgcacagcaggaccgcgagcagggccgcggtgtgccaccaggtccggcggcgcagggcggcggagcgggtgagcagcggtgcggtcatgtggcggggcccttctgcgccgtcggcgcgacgtacaggaggaggccgccgagccggtgggcgggccagccgcgggcgtaggcgggcggtgaggcgcccgcgggggtgagcgtggcggccgggatccggcgtgcggtctcctcgatggcggcgcgggtggagttggcgttggggccgtccgtcgcggcggaggcgcagccggtgtagaaggcgatgggcagggcctcctctccggtgagcaggcacggcgggcgcactccgagggcgtgcagcgtgtcggcggtgcggttccaggcgcggcggtcggcggtggtacgggtgacggtgtgggcgaggacggcgtactggaccgccaggtggacgccgagggcgaggacggcgaggctcagggcgaccggccgccaggcgccctcgggcgtggtgacgaggtggcggacggcgtcggctaccgggacggcgagcagggcgtaggcgggcaggaggaagcggggcgcggcgtagccgatcaggaacagataggggaaggccgccgcggcggcgcaggcgagcgcggtcagcgtgggaccggtgcgcccggcgcggcgcgcgaggagcaggcccagcagggcgagcaggggcaggacgtaccaccaggcggtgaccagcgggttcggcagcgctccggcgcaggggcggcacagggtccgcccgcccaggctgcgcagttggtcggcgacggctccgccatccaggg

SEQ ID NO: 2458 - DNA, 550 bp, Unknown
  Kingdom: Bacteria, Phylum: Actinobacteria, Class: Actinobacteria, Order: Streptomycetales, Family: Streptomycetaceae, Genus: Streptomyces
gccggcgacttcaacgcctcccaggaccacgccgcgttccgccgcatcctcgacaccggcctgcacgacgcggcccgcctcgccggctcggaccgcacgcccagctggccgtccaggaccactccggtactcggcgcgcagatcgaccacgtgctggtctcggggcagttctccgccgctcacgtacggttcctgcgcctggccggcaccgaccaccgcgccctgctcgtcgacctcgcgctgcacgtgcggcaggacacgcccggcgcgtcttgacacggcccggcccacgtccctctcccgtggcctggaccgccaccgggggccgctaaccttacgtgtccgtcctggccagggattgacgggatcaactcacgcgaagggttgcgcacatgggcattctcactcgcctgcggaacgcgttcggccggtcacgcaaggggcgtacggccgaagcagagggtgcggggcaggagcaggttccgacgacccgggaaccggcacccgccgcggccgacgcgcagcagccgacgccggaggtcccggcccc

SEQ ID NO: 2459 - DNA, 697 bp, Unknown
  Kingdom: Bacteria, Phylum: Actinobacteria, Class: Actinobacteria, Order: Streptomycetales, Family: Streptomycetaceae, Genus: Streptomyces
aggtgtgggggttgaggagggtggctttgagccagagccggttgtcgaggcgggcgcggccgaggacggctcggccgtcggtgaggagtcggcggcgtacggcggcgacggcgtcgtcggtggcgtgggtggggcggaagaggacggtgctgatggtggggtggtcgtgcagttcgaagccggggtggtcgtcgatgaggtcggcgaacgtgtgcgcgagggcgcagacctggtcgacgagtgcgcccaggccggtgcggccgagggttttgagggtgacggcgattttgaggatgtcggggcggcgggtggtgcgcagggagcggccgaggaggtcgggcaggcctgcttcggtgtcgtcgtcggcgttgaggtagtcggcgcgttggtgcagggcggcgaggtcggcggggtcgcggacggcgaggagtccggcggcgacgggctgccagccgagtttgtgcaggtcgagggtgacggtgtgggcggcgtcgaggccggtgaggcggtggcggtggcggtcgctgaagaggaggccgccgccgtgggctgcgtcgatgtgcagccgggcgccgtgggcggtgcagaggtcggcgatctcggggagtgggtcgatgaggccggcgtcggtggttccggcggtggcggctacgacgagggggctgtgggggctgccgaggtcggtgagggcggcgtg

SEQ ID NO: 2460 - DNA, 780 bp, Unknown
  Kingdom: Bacteria, Phylum: Actinobacteria, Class: Actinobacteria, Order: Streptomycetales, Family: Streptomycetaceae, Genus: Streptomyces
ggagggcccccttcccgtacggcgtcccgtgcggctacgcgccgagcagcgtccgcacccgctcctgccccaccgcgagcagcagcgtgggcaggcgcgggccggtgtcgcggccgacgagcaggtggtagagcagcgcgaagaacgtccgctgggcggtcttgatctccggcggcagctccttgggcgtggcgtcggcggagaacccggcctggaccttgggcacgccgtagacgaggtgggtgagcccgtcgagcgaccagtggtcggcgagtccgtcgagcagcagccgcagcgactgctgggaggcctcgtcgagggacttgagcaggtcggtgtcgggctcggcgcggacgatggtgcgcgcctcggcggggacgtgggtgttgatccacgcctcggccttgtcgtagcgcgggcgggcctcgtccagggagccgagcgggttcgccgggtccagctcgctgaggatgcgcagcgcctggtcctggtggccggcggtgatgtcggcgaccgaggcgagcgtgcggtacggcagcgggcgcgccgtcttcggcagctcggcggcggcggtgcccacggcgcgcgtgtacgcggcgacgtcaccgggcagcgcggagccgtcggccaccttggcggcgagcttgtcccactcgtcgtacagccgctggatctcctggtcgaaggcgatcttgaaggactggttgggacggcggcgggcgtacagccagcgcaggagctgcggctccatgatcttcagcgcgtcgccgggggtgggca

SEQ ID NO: 2461 - DNA, 554 bp, Unknown
  Kingdom: Bacteria, Phylum: Actinobacteria, Class: Actinobacteria, Order: Streptomycetales, Family: Streptomycetaceae, Genus: Streptomyces
  misc_feature (244)..(268): n is a, c, g, or t
ccagcgcgccgacgacctggagacccggggcgccggccaggaggacgcggaggaggagccccggcaggaggacgcgtccgacatcgccgaggcaccacggcccgtcggaccggccgcgcccggctacgacgaggccgaacgcgaggccgtgctcaaggtgatgcgcgagcgccgcgacatccgcaacggcttccgcggcgatcccatcccgcacgaggtgctgctgcgcgtcctggaggcggcnnnnnnnnnnnnnnnnnnnnnnnnncacaccgcgcccagcgtcggtcactcccagccctgggacttcgtcgtcatccgctccgccgacacccgcagggcgatgcacgaactggccatgcggcagcgcgacgcgtacgccaagtcgctgccgaagggccgcgccaagcagttcagggaactgaagatcgaggccatcctcgataccccggtcaacatcgtcgtcaccgccgacccgacccgcggcggccggcacaccctcggccggcacacccagccccagatggcgccgtactccgcggcgctcgccgtcg

SEQ ID NO: 2462 - DNA, 546 bp, Unknown
  Kingdom: Bacteria, Phylum: Actinobacteria, Class: Actinobacteria, Order: Streptomycetales, Family: Streptomycetaceae, Genus: Streptomyces
cccctcgccgcgcctgctgacccgcaccgaggacggcgaacggctgcacgcgctgctgtggccggcgggccccggcgggcggatgatcagcagcgcggtgctcggcggcggcatcggtacgcgtggctgggtcctcaacgcccaggtgccgcacggctaccggcgcaccgacccggaccgccacctggccgagctggccgccggggccggtctgaccggagagggcgtcggcctgatgacggcggccgacgtctcccgccacacccgcgcgacggacggcggcgcacaggccctggtcaccgcgggcatcgacgtacggggctgggcagcctccccggccgacccggccgagggcaccgccgtccccgcccgaccgggcacgatcaacatcgtcgtcgccctcccggcccccctgaccgacgccgccctggtcaacgcggtcgccaccgccaccgaggccaaggtccaggccctcctggaagccggcctgtcctgcaccggcacgcccacggacgccgtctgcgtggccgcccgcaccccgtcccc

SEQ ID NO: 2463 - DNA, 527 bp, Unknown
  Kingdom: Bacteria, Phylum: Actinobacteria, Class: Actinobacteria, Order: Streptomycetales, Family: Streptomycetaceae, Genus: Streptomyces
  misc_feature (139)..(287): n is a, c, g, or t
cagcgggccgagctggtccgcctcgtgagtcccgggggctcccacgccgcccgggtggtcgagggagcagtgctgggccatgagcgcgcccgagccctcggcgtgcgccttggggacgacgtagcgctcctcgtacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgggcccgcatgtgggcgcgcatggtggtgagtttgcgcagcacgccctcgacgacggcgatgtcgccggccgtgaagaggttcgcgaggtactcgaccgggatgcgcagggcgtcgatggcggcgaagatccggtcggggtcgtcgtcgtggtagccggtggcgtgcacggcgtcggcgaccggggagagcggggggacgtaccagaccatcggcagggtgcggtactccgggtgcag

SEQ ID NO: 2464 - DNA, 817 bp, Unknown
  Kingdom: Bacteria, Phylum: Actinobacteria, Class: Actinobacteria, Order: Streptomycetales, Family: Streptomycetaceae, Genus: Streptomyces
gtcctgctgcgccgccgcgcccgccccgacggcctccgcctcgccgacgcggtgtgccccggcagcccgcacatcggcgtgatgctgccgtacacccccgtgcactgcctcctgttcggtctgccgggcgacccgcccgggccccgcgtcctggtcatgaccagcggcaaccgctccggcgaacccatcgtcacggacgacgcggaggccctgacccggctggccggactcgcggacgcctggctcgcccacgaccggcccgtcgcctccccgtgcgacgactcgctgctgcgggtccgccccgacggcaccgagcaggtgctgcgccgctcccgcggctacgtaccccgcccgctgcggctgcccgtcccggtacgtcccgcgctcgcggtgggcggcgacctgaagaacgccctctgtgtcggcgacggcgaccaggcctggttcggtccgcacatcggcgacatgggcgacctgaccaccttgcacgccgcccggcgggccgagcggcacctgttgaacctgaccggtgtcacccccgcgctggtcgccgccgaccggcaccccggctaccactccgcccgctgggcccggcgccgcgccgccgaactgggcgcccgggaaccggtgttcgtgcagcaccatcacgcccacatcgcctccgcgatggccgagcacggcctcgacggcacgacgccggtgatcggcgtcgccttcgacggcaccggctacggcgacgacggcaccgtctggggcggcgagttcctgctcgccggctacgcgggccaccggcgcttcgcccacctgaccccggccc

SEQ ID NO: 2465 - DNA, 753 bp, Unknown
  Kingdom: Bacteria, Phylum: Actinobacteria, Class: Actinobacteria, Order: Streptomycetales, Family: Streptomycetaceae, Genus: Streptomyces
agccgcagcgccgtcgccatgtcaccgccgagcagcgcggcggccccgcactcccggaacaccggggagacggcgcacgccgcctcgtaggtgtctggcaccggcgacgccggggacgccgccaccgcctcggccaggcacaccacgtggatcccggcccgggggccctcctgcgccagccgcgccaccgcttcgcgcaccgtggccccgccggggtcgccgtccacgacgagcacggtgtacggccccgcgaaaccgctcgccgggccggacgcgttctcctcccgcgcccaggagggacggcgggcgagcgcggacgcggggagcggtgtgggtccggatatgggggcgtcggcggcggtgcggggcgcggctgctgtggccggctgcgcctgcgcatgagcccgggactgcgcctgcgtctggacctgtgccggggccggtggctgggtgtccaccaggtggtccgccaagtggtcctgcaggtggtcctcgaggcggcggaggagttcgtcggtacgggccgtggcctgctcgcggtcgtaggccaggagcagacggcagtcctggccgtggcccggccgcacatgagggagccagccgagccaggaccactccgccgtccgctcctccagcggccgggcgcggtcggcgctgagcaggacgatctccagggcgtcgggggagtgcagcgcggccagctgggccagcaccgcacgggccagcccggacagccgggcgcggggtccggcc

SEQ ID NO: 2466 - DNA, 1391 bp, Unknown
  Kingdom: Bacteria, Phylum: Actinobacteria, Class: Actinobacteria, Order: Streptomycetales, Family: Streptomycetaceae, Genus: Streptomyces
accatgaacaggctcgcgcccgcctcccgcgccagggcgtcgagccgctgcccgtgcagtacgccgactacgccctctggcagcacgccttcctcggcgaggaggacgacccgggaagcccactggcccggcagctcgaccactggacccgcgaactgaagggactgcccgccgaggtggcgcttccggccgaccgggaccggcccgccgcgcccgggtacgaaaggggcctctccgcctggcggatcgacgcggagctgcggcagcggctcgacgccctggcgcgggaggcgggcgcgagcctgttcatggtggtgcgggccgggctggccgcgctgctgtcccggctcggggccggggacgacattcccgtcggcgtgccggtcgccggccgcacggacgaggcgctcgacggactcgtcgggtgcttcgcgaacacgctcgtgctgcggaccgacgtgtccggccggccgtccttccgtgagctggtcgagcgggtccgggacagcgacctgcgggccttcgagcaccaggacgtgcccttcgggcggctggtggaggcgctcggtgccgaggagctgccggggcggcatccgctgttccaggtcgcgctggacttccggaacgacgccggggcccggatcgacctgccgcacgtcctcgccgccgccgagccgatgggcgggccggccgccggctgcgacctctgcttcaccgtccggtacgccgccgacggcggtctggacgggaccatcgccttcgcccgcgacctcttcgaccggtcgaccgtcgatctgctcggggaacggctcgtgcggttcctcggggcggcggtggacctgcccggacagccgctgcacgagcaccggttgctgggaccggacgagcgggtgcgggtgctggaggagtggaacgacaccgccgtcgagctggacccggcgaccgtccacgggctcttcgagacccaggccgccaccaccccgggccgcacggccctcgtccacggcgaccgacagctcacctacgccgagctgaacgcccgcgccaaccgcctcgcccaccggctcatcgcccggggcgccgggccgcacaccgtcgtcgccgtgtcgttgccgcgctcggtggagctggtcgtggcgctgctcgccgtcatgaagtcgggggccgcctacctcccggtcgatccggagcagcccaccgagggcatcgccttcctgctcggcgacgtccggtgcgtcgccacgatcgatgagccgggggatgtgcgggaggacggtgcctggcccgagagcaacccggtgggagcggcggacgcggcccggctgcccgcgtacgtcatccccgtcccggggccggccgggcggccagagggcgtcgtggtccggcacgac

SEQ ID NO: 2467 - DNA, 590 bp, Unknown
  Kingdom: Bacteria, Phylum: Actinobacteria, Class: Actinobacteria, Order: Streptomycetales, Family: Streptomycetaceae, Genus: Streptomyces
ggcgggtaccggctggtcgccggcaaggcgatgccgccgctcgtgctcgacgacgaggaggccgtggccatcgcggtcggactgcgggccggggccgggcacgcgatcgagggcatggacgaggcgtcggtccgggcgctggtgaagctggagcaggtgctgccggccaggctgcgccaccgcgtctccacgctccaggccgccaccaccccgctgaccagcggagacggggcgtcggtcgcacccgagacgctgaccgtgatggcctccgcggtggccgggcgcgagcgactgcgcttcgcctaccgcgccggtgacggcaccggcacgcggcgcctgacggagccgtaccggctggtgtcgaccggacgccgctggtacctcgtcgcctacgacctggaccgggcggactggcggacgttccgcgtcgaccgggtcagcgagcccttcccgaccggcgcgcgcttcgccccgcgtgaactgcccaccggaagcgcggcggaatacctgcgccactcgatgcagcggcggcaggagacgtacacgttcgaggtcacctttcccgaacccgccgaagcggtcgccgcccg

SEQ ID NO: 2468 - DNA, 1265 bp, Unknown
  Kingdom: Bacteria, Phylum: Actinobacteria, Class: Actinobacteria, Order: Streptomycetales, Family: Streptomycetaceae, Genus: Streptomyces
cggcggcgccgccgaggcgatcaaggccggcgtgctcagcggcgtgagccggatcatcgccgtgcactgcgacccccgcgtggacgccgggatgatcggcctgcgccagggcgccatcacctccgcctgcgaccgcctggaggtctccctggacggccccggcggacacagcgcccgcccgcacctcaccaccgacctggtcaccgccgccgcccgcgtcgtcacggacgtgcccgcgctcgtcggccgccggatcgacacccgcgccgggctcgccatcacctggggccgcatcgagtccggccacgcccccaacgtcatcccgcagcacgccgagctgtccggcaccgtgcgctgcctggacatcaacgcctggcggcacgcccccgacatcgtggtcgccgcgatcgacgaggtcgccaacctgcacaaggccaagtcggagatcaactacgtacgcggagtgccgccggtcgtcaacgaaccggtggtgaccgaactgctgcgcgaggccatgacggcacggcgcggcaccgactccgtcgagggcaccgaacagagcctgggcggcgaggacttctcctggtacctggagcacgtccccggcgccatggcccgcctcggcgtccgcaccccaggcgagcgcaccctgcgggacctgcaccagggcgacttcgacgccgacgagtccgcgatccgcgtgggcgtggaactgttcacggcggcggcactgctgcatccgacgcactgagtgacgcaggcgcacggagcgatgccagcgcgctgagcgcgcatcccccgcgctgagcgcgtgcgcgtactgagtcatgccgccgccacggaccgacggcggcacacggggcgaatgccgcggcaccgatcggcaccgggcgtactgggtgatgccggccgtaccgggccgtgccgggccgtaccgggccgtgccggggtacgaagcggtgcgggcgtaccgagcgacgccgcgcgtaccgggcggcgccggggtgcgaagcggtgccggcgcaccgggcgtagcgggtgacgacggcgtacgaagcgatgtcggcgccccgaggggcgccggtgtccgaagcggtgccgggcgatgccaggtgcgagagtggcgccgacgtaccgggcgacaccggctgtgccgggcggcgcgggggtgtcaaggggtgccgccctaccgagcggcaccggtcgttgccaggtgcggagtggcgccgacgtaccgggcgacaccggccgtgccgggcggcgcc

SEQ ID NO: 2469 - DNA, 537 bp, Unknown
  Kingdom: Bacteria, Phylum: Actinobacteria, Class: Actinobacteria, Order: Streptomycetales, Family: Streptomycetaceae, Genus: Streptomyces
gtgcggcacaccgacaccaccgcacgcctggccgaacaggcccgcgcgctggccgaccggctcggcgaggaggtcgtaccccacccggcgctgcgggtagccgaccgcggcgccgtcctcgccctgcgccgacgcctgcactccggtctcccgccgcgccccgcggaccacgggctgctgctgcgctcacccgccgcccccgcggacctcgccgaccaggtccaccacctgctgcgccgggcggaggaggccgacgagaccctgaccgggctgcggcacgcgatcgccgccgaacaggaacgcctggccgcacgggcctggcagaccgcctgcgccagcccgttcctgcgggccttcctcgacagcgccgcgccgggactcaccgacgacgtccgacggcggctcgccgagggccagccctggtccggcaagcaactgcgcaagcgcaccgcctacctgtggcgggccgtgggccgggccgcggcgaagaccaccccgcgcggctgggccggccagatcgcggcgctcccggtcgcc

SEQ ID NO: 2470 - DNA, 2068 bp, Unknown
  Kingdom: Bacteria, Phylum: Actinobacteria, Class: Actinobacteria, Order: Streptomycetales, Family: Streptomycetaceae, Genus: Streptomyces
ctcggcgacctggccggccgtgtccgccgacgccgccgctgccgccgccgcttgggcgcccagttccagcgactcccgccacgccccgaggtagcggcgatggaggaacagggctgtgaacagctccgacaactgccaggtcagggagtgcagttcctgccgggccgtcgcgcgcagcaccgccaggacggcggcccgttcggtgtccagccactccagcggcggtggaccgccggcggccgcgaacggatcgtcgacgtccctcagcaggacggacaggtcggcgatgcgcagccggtcccgcctgagcgcccggtcggcgcacgcggtgaggacgaggtagtgggtgcccacgcgctcggtcagcgcccgctgttcggtctgcgcctcctcctgtgccgcgcgctcgcgcgcgtgcaggcggaccaggtcgtgcatgcggaagcggccgtcgcccacggcctccacgaggctcgcacgggcgagcgcgcgcagcaggcgggtcgcgctcctcgtgtcggtgcctgcggcgaccgccgccacgcccgcgtcgaagacaccgaccggcagccacccgagcagacggtagagccgggctgcgtccggcggcagcagccggtaggcggaggcgagcacagcggacaccgagatctcctcttctccgtcgagtgccaggtcgtccagcgccagaccggccagtcttccggtctcgtcgtccagctccgctgccagttccgtcatggtcagcccgtcgccggtggccagccgggcggccacgatctgcagggccaccggcaggcctccgcacaactccacgaggcgctcggcggctccgcgttcggcctcgacggcctccgtgccgcagcggtccttcagcagcgccaggccgccgtgcgcgtccagcggccgtacggagatcagccgcgctccgtccagggtcagttcaccgagcctgctctggctggtgaccaggaccgcgctgcccggccccttggggatcagcgcgcgtacctgggcgggctggtccacgtcgtccagtacgagcaggatgcgcaggttcgccgaacgcgagcggaacaggttggtccgctccacgagcgagcccgggatgccgtcgtcgcctcccggtcccggcagcgaccgaaggcacatcgccagggcctccgagacgtccgcaccgacaccggcgccggaaccggaaccggtccccggcgcgggcccgtcccgccacggcgagggagccgaccggtcgtcgcgcagggccgcgaagtcgacgtagagctgtccgtccgggaagcggtcccgggccagggacgcccaccgccaggccgtggtcgtcttgcccacgccggggaggccgtccagtacgcccacgtcgacggtccccacgctgcccgccgagccgtccgttcccgcacctgctcctccgccgagggccgcgtccagcgccgccagttccgccgtacggttgctgaacgggacggtcactagcggcacttgatcgggtgtgagggcgcccgccgacgcgaccggcgcggggacgttgaacgtgatgcctccgtggatgtgcgatccctggaagaccgggccgttgtgcaccccgccggtgacgaggtggacgaaggtgcgtgacgcctccggtgccagctcggacagcagtcgcgccaactcctcggccgcgccgacatcggcctcgaacaccgcctccaggcgccggcgcaaccgggcctgtacggccgcctgggcggacgtgtcgcccgccgcccgcgcccgttccagctccgtccgcgccgccgccagcaggtcgtccgctgcggtccggcgcgctccccggcgtccgaagaacgcggccagcccgctcttcgcgcgctcccacgactccgacaccatcaggccgaccagcgtcgtcgcccccgacgcggcaagggccaccaactcggcttccactcagtccccttagcgatccagcgcccccgcgaggcagtccgacctgcacaccgtagagagatcgcggccgcttggacagcccggctcgccgacaccgcccgcgccttcccctcccctctcc

SEQ ID NO: 2471 - DNA, 746 bp, Unknown
  Kingdom: Bacteria, Phylum: Actinobacteria, Class: Actinobacteria, Order: Streptomycetales, Family: Streptomycetaceae, Genus: Streptomyces
ggctgatcggcgacggcgtcatcgaccgcgagggcgtcggcgggctcgccgcgcggctcggctacagcgcacggcaggtgcagcgccagctcaccgccgaggtgggcgccgggcccgtcgccctcgcccgcgcgcagcgcgcgcacaccgcgcgcgtcctgctgcagaccaccgacctgccggtgacgcagatcgccttcgcggccgggttcgccagcgtgcgccagttcaacgacacgatccgcgaggtctacgcggcgaccccgagcgagctgcgggccgccgcgccccgcaccaggcaccgccgggccgccgtgccgaccgcagggataccgctgcggctcgcccaccgggggccgtaccaggccgggcccgtcttcgacctgctccaggacgaggccgtgccgggtgtcgaggaggtgagcggcgtgcccggcgcacgcacctaccggcgcaccctgcgtctgccctacggcaccgggatcgtcgccgtcgacgagcgccccggcggaccgcgcaccgcgtccggcgcgcatccgggcggctggctggaggcccggctgcacctgaccgacccccgcgacctgacgacggccgtgcagcggctgcggcggctgttcgacctcgacgcggatccctacgccgtcgacgaccggctcggcgccgatccccacctggccccgctggtcgccgcccgcccggggctgcgctcgccgggcgccgcggacccggaggaggccgcactg

SEQ ID NO: 2472 - DNA, 570 bp, Unknown
  Kingdom: Bacteria, Phylum: Actinobacteria, Class: Actinobacteria, Order: Streptomycetales, Family: Streptomycetaceae, Genus: Streptomyces
ggcgttcctggccgccgccgagcgcgaacgcgacggcttcgcacgcgggctgctccagcaggtgttccggctgttcgccctggaacgcctcgctccgcacgcgggtgtcctcctggcggacggccgcctgaccgccgaagcggtccgcgatctcgccccggccgtggaccggctcggtgccgcgctggcgccgcacgcgctcgacctcgtggcggcgttcgccgttccggacacgatcctccaggcccccatcgccaccgacggctacgccgccgtgtacgacgacccgggcggaccgtggcggcggacagcggccggctgaccgtaccccgtcccctcccctgcttcctgggagcaccaccgccatgaatgacgctttctcccgcgagccgcggtgggacccccggcgcttcccgccggccgcccccgccccgcgggccgtgcagaccgtacggatgctcacggacccccaggggtacacccgttcgctgcgcgcgcggttcgggccggtcttctcactccgtacgttcccctaccgcggcgccctcgtgtgcgccgccgacgccgcgg

SEQ ID NO: 2473 - DNA, 527 bp, Unknown
  Kingdom: Bacteria, Phylum: Actinobacteria, Class: Actinobacteria, Order: Streptomycetales, Family: Streptomycetaceae, Genus: Streptomyces
gtgtccggacggcgggtgcgcatccggccgacaggcgcgtccggacggtatccgcccccggcgggctgcgtctcccggcggctgcgtctcctggggggctgcgtctcctggcggaccgcgtctccgcgccgcacgcggctgcgcgctccacgggttccacgggctccgtgcttcacgccgctccgtgcctccgtgagctccgcgtcctcacgccgccccgcgtctccatgcgccccgcgtctccgcgcgttccgcgcgttccgcgccccgcgcgtctcagctgcgccgcagcaggcgggtcgcgcccgccgccaccgtggtggccagggtccagcccagcaggaccatcgccgccgcgacccactgccaggcgccgtccagctcccactcgctggcctggccgaagtcgacgaccggcagcagcaggtcgagggcgtacagggcggggttccacgcctggtgggtgcctgggcctgggccggggtcggggcggccggcgtgggcgaaggcgagcgagccggccgccc

SEQ ID NO: 2474 - DNA, 588 bp, Unknown
  Kingdom: Bacteria, Phylum: Actinobacteria, Class: Actinobacteria, Order: Streptomycetales, Family: Streptomycetaceae, Genus: Streptomyces
ctggtcgcagaggtaccggaccaccgcgaggtcgtgcgagatgaacagcagcgcgaaaccgaggtcccgctggagccggcgcagcagattcagcaccgcgccctggaccgagacgtcgagcgccgaggtgacctcgtcagcgatcaacaccccgggccgggcggcgagcgcgcgtgccagcgcgacgcgctggcgttgtccgccggagagggcgtcggggagctggacggcgcgcgccgggtcgatgccgaccaggccgaggaggcgggcgacctcggcggccgtctcagcgcgggtccagcggccggcggccggcgacacggggtcggggtcgggatcgatgtctgcggcccgcaggtccgggttctgcttcgggccctgggccggccgaatcctgggcaaggcctccgcgaccgccgccccgatgctcagtctggggttcagcgaggcatacgggttctggaagacgagctgcacggcggtacgcccgggacgccgtggctggtccacgccgtcgacaaggatccggccgacggtcagcggcgccaggccgacgacggccttgccgacggtggacttgccggagcc

SEQ ID NO: 2475 - DNA, 680 bp, Unknown
  Kingdom: Bacteria, Phylum: Actinobacteria, Class: Actinobacteria, Order: Streptomycetales, Family: Streptomycetaceae, Genus: Streptomyces
tccggcgtcccggtggtcatcaccgcacctgtcacggaacgctcccgccgctcctcctcgccgtcccggggccaccggggccgcaccggccagggccgccccgccggcgcggggatgctccgcagggcaccacggcggcccggcaacaacgaatcggctgcttagtccggcgcggcccccgcccccgtggcctcgcgggagccgtggccgtagcgctcccacggggccgcaagcgcccccaggccgaccagccggcccctaccgaaggagacaccgttgacgccctcgcggacgcagtaccgcatgccggactccgcccccgtgcccctgtccgaggacgccgaaggactcgggccccgggtatgtgacgacatgactgtcgaggtggctctggccgtcatggcgggtgcccgggtcgagtacctgaccgtgtgcgacggcgacgaccagcgcacgggcctgatcaccctggtccggctcgccctcctgcgcggcagttccgcgtacacggaccggatccgcctgcgggacgtcctcgacggaccggcgccgtcgcccggtgctcgcgccgacggcttcggtgagtaccgccgggtcccgggcgtcctcacccccgcgcactgacccgcctcgccctgcacagcccgcccgccttcccgcccccacctctccccctgtga

SEQ ID NO: 2476 - DNA, 530 bp, Unknown
  Kingdom: Bacteria, Phylum: Actinobacteria, Class: Actinobacteria, Order: Streptomycetales, Family: Streptomycetaceae, Genus: Streptomyces
cacggctgccgccgcaccggcgctgtacacggtgatgccggtgcggcggcagccgtgcccgtcggtgttcgcatccgaggtgaggtaggtgtccgcggccgtgcggaccgtcggctccaggtcggggtcggtcagtaaccgcagttcgagcggcggccggcacgcgggaccaccgccggcggcgaggaaacggtgcccggcgtagccgacaccggcgagcgcgagcacgagagcggcgctcagcacggcgcggcccaggcgccccttgcccgcgaaccaccgtacgagcgcgccggggaccgccccgacggcgcggcgcaggaccgcgagcgtacggcggaaccaggaaaccggcgcttcctggccctgctgctgcctgtgatgcggtccggagtcctggtccgggggtggagacgcgggcgagtccggcgactcgggcggttccggtgaagggagcggatccgggggcgtgggtgcgtccggcgtcgtgagtgcgtccggcgtcgcaggtgcgtccggcgtcgcaggtg

SEQ ID NO: 2477 - DNA, 555 bp, Unknown
  Kingdom: Bacteria, Phylum: Actinobacteria, Class: Actinobacteria, Order: Streptomycetales, Family: Streptomycetaceae, Genus: Streptomyces
gctgaccgcgctggccagcgccgcgggcgtcagcatcgagaacgcccggctctacgaacgcctcaagcgggccaccgaacagttccagcgccggatgctgcccgtcctgcccgatctggcaccgctgcgggtcgaggcacggtacgagccggcgtccgagctgccgcggctcggcggggactggtacgacgcggttctgctgccggacggtacggtcttcgtcgtcgtcggcgacgtcaccggccacgacgtggaggcggcgcccctgatggcgcagatccgcaacatgctgcgcgccctggcgttcgaccggtgcgggccgcccagcctggtcgtcgacaggctcgaccgggcgctgggcatgtacggcgacccgaccgcggccacgctggtggcggcccggatcgagcacgggccgggcgccggatacaccgtgcgctggaccaacgccggacatccgccgccgctgctggtcaccgccgaccgggatgccgtgctgctcgggggccaggacgtgcacggtgccgtcggcggtgaccagcagcggcggcggat

SEQ ID NO: 2478 - DNA, 893 bp, Unknown
  Kingdom: Bacteria, Phylum: Actinobacteria, Class: Actinobacteria, Order: Streptomycetales, Family: Streptomycetaceae, Genus: Streptomyces
acccaaccccgacacacccgccctgcaccgcgccgaggcacgcatcgcggcggcccttccggtcacggcaccggtcccgcggctgctgatctcactggacgccgaaggctgggtggtcctggccttcgaggacgtggcgggaaggacaccggcacagccctggctgcccgacgaactgcgccgggtgctcgcggcgacggccgaactgtccggcctgctcgacccctccccggtccaagtgcccccgctcgccgaccggttcgacggcaagttccagggctggcggcggttcttcgccgcgtacacggcgggcaccgacgacccgcccctgcccgatccctgggcgcggcagcatctcgggcgtctcgccgagcgggagggcggctggagcggcgcggcggccggcagcgccctggtccacggcgacctgcgggcggacaacgtcctgctggccgacgacggccggatcgtggtcgtggactggccctgggcggcggtgggcgccgcatggttcgacgtggtcgcgatggggccgagcgcgatcatgcagggcggcccggccacgatcgacctgctcgacgagcacctcgacgcgcgcggcgcaccggcgcagagcgtcacgacggttctggtcgccctcgccgggtacttcctgtaccagtccgtccaggccgcgccgccggggctgccggccctgcgcgccttccaacgggcccagggcgacgccgccctcgtctggctgcgccgccggacgggctggtcgtaactcggctcaggtgccctcggcgagctggcggttcgcgaaggcggtgatccgggcggccaggtccgccagggtgggttcgtgtcgtgcggcggctcgggccaggcgggccacatcggcgggccaggcg

SEQ ID NO: 2479 - DNA, 501 bp, Unknown
  Kingdom: Bacteria, Phylum: Actinobacteria, Class: Actinobacteria, Order: Streptomycetales, Family: Streptomycetaceae, Genus: Streptomyces
  misc_feature (166)..(240): n is a, c, g, or t
cgccctcggtgaccgaggtgcgctgcttctcctccgccttggcgcgcagccagtgctccttgacctcctccggggtctcggcgctctcctcgccgaagacgtgcggatggcggtggatcagcttggccacgatgccgcccgcgacgtcgtcgaccgagaagggggnnnnnnnnnnnnnnnnnnnnnnnnnnnnnnnnnnnnnnnnnnnnnnnnnnnnnnnnnnnnnnnnnnnnnnnnnnnggccctggtgggtctgccgggacgaccaggggcattcggcgcggatgcggtccatgacctgcacgaggtcgagcaggcgggcgccgggcaggtcgtaggaggcggggagcagttccagttcgggcatggcgacgcggccggagccggcgagccgggcgaggccgtcggtgagggccggttcgccctcacccgtcgccacgaccacgaccgtacggccgccggcgcaggcgtcgaccaggtcctcggcgctcggggacgcct

SEQ ID NO: 2480 - DNA, 510 bp, Unknown
  Kingdom: Bacteria, Phylum: Actinobacteria, Class: Actinobacteria, Order: Streptomycetales, Family: Streptomycetaceae, Genus: Streptomyces
catcgcgggccaccgcggcaccgccgtcgccctcgccgacggcgacccggccttcttcggcgtcgtacgcaccctgcgcgcacccgagttcggcctggaggtcgaggtcgtccccgccgtctcctcggtcgccgcggccttcgcccgcgccggaatgccctgggacgacgcccaggtggtcgtcgcccacaaacgcaccctgcgccgcgccgtcaacgtgtgccgcgcccacaccaaggtcgccgtgctcaccgcgcccggcgccggaccggccgaactcggcctcctcctcggcggcgtgcaccgcaccttcgtcatctgcgaggaactcggcaccgggcgcgagcaggtcaccgtcgtcacctccgacaaggccgccgaccacacctggcgcgacccgaacgtcgtcatcgtcatcggcggcaacggcggccggaccggcggcggcgagagcggcggctggatcgccggacgcgacccggccgacgcgccgcgcggctggacgcagcc

SEQ ID NO: 2481 - DNA, 843 bp, Unknown
  Kingdom: Bacteria, Phylum: Actinobacteria, Class: Actinobacteria, Order: Streptomycetales, Family: Streptomycetaceae, Genus: Streptomyces
accacgtgccaccctcgggccggccgcggccagggcgcgggggcccgccccggcgagggagttgcgcgcggccgtctgctcgtgcgcgggccatgctgatggccgtagacctcgcgcccctgtgtgccgggccggggggcctgagccgtgacgcagccgttccggtgccccgggagggcgccttcgcggctcagagccagccggcgaactccaggagcagttcggcgtccttgtggcggccgacccggcgggcccgtacgccggactccacggcgcggaacagggtccagccgcccagccgctcccggtccacctccagtgactccgccagccgtttgatccggcgccgcgtggtggcaggcccggaaggcgaggcgatcaggtcctccacccggtcacggaccagccgggccaggtcgaacgcggcctcgccgaccaccggatccggtccgacggccagccacggcatccggtccccggcgagcaccttgctctgccggaacgtgccgtgcagcaaccgctgttcgggcggcgcggccagcaactgctcacgggccgcgagcgccgcctccaccagcggcgccacctccacgtcgtgctccgcgctcgcccgcatcgcctccgcctgccgaccggtccgctcggcgaccgtctcgaagggatgcccgtccggcggctgaacccacagccgccgcagcgtgccggcggcctccagcagggcccgtgcctcgggcagcgaacgcacggacacgtccggatgcagccgttcgagcagcagcacaccctcgcccgtaccggccggctccagcagctgtacggcgccccggccggcccagtgcgcga

SEQ ID NO: 2482 - DNA, 511 bp, Unknown
  Kingdom: Bacteria, Phylum: Actinobacteria, Class: Actinobacteria, Order: Streptomycetales, Family: Streptomycetaceae, Genus: Streptomyces
ggcctcggcccggtcgctgcccgcgcgggagacaccgacctgctccagggcgcacaggtccgcccggcgcgcggccagcgaccgggccgaggccacgagttcgggaacactgggatagcgcggttccggcagaggactcacccccgtactcgtccgcccggcttcgcattccgcagtaccccacggccggtgatgactgtcaagtagccgatcgcatccagccgttgcggcacccggcccgatccgcgctcagtcctgcccggcgggcttgcccgcacgttcgaggagggccaccgggagggttgcgaacaggtctttcgcggacgcgtggtgctcgaagtggtctcctggggcgagggtgttgatccatcggccggggggcagggggagcctggtgtcgtgccagccgcccgtttcggccaggcgcagggacagccgggtcacggccgtgacgacgtcgccggagcgcgcgaacgccaggcagtggtgcgccgcggggccctcggcgggc

SEQ ID NO: 2483 - DNA, 735 bp, Unknown
  Kingdom: Bacteria, Phylum: Actinobacteria, Class: Actinobacteria, Order: Streptomycetales, Family: Streptomycetaceae, Genus: Streptomyces
cgcttgtcggggcgcggcggctgaccgccgaaggggttgccgccgccggggtgcgggtggcccgggtcgtgcggggtctgcggctgctgcggggcgtacggcccctggggcggcccgaaagccccgtccggcgcatgtccgcaggacgcggtgttgaaggcgcggtccacggagcgcgggagttcgtggtcgagcaagaggtgcgcgagccgtccgtcggtgaactcggcctcgcgcagggcgagccggatgccgtgcaccgcgtcgtcggcgagccggcgggcctcggtgagcggcgtgccggtcgcggtcagcgggttccaggcacccgacgcggcatcggcttcgcggtcctccacggcgtccaggaggtgcgcgagccggccgaagaggcgccctgcctcggcgaggggttcggcgttgccgggccgtccggcgagcacggcggtgtgcgcgaaggccgcggcggtcgcggtctcggtcggttcggtgacggtcaggaccggtgtcccggggccggccagcgactcgatgccgacctgccggtccaccgcgtcgacgaggacggcggtgtcgtagccgtccaggagttcgtaggcgaggtccaggccgcggatgccgaagtcccgtgcccgcactcccgcgggcagtggccgggcggccagggcgctcagcacctcggggccgaaggcgtcgtcggcgaggaagatgttgccgacgcccgcgaccagcagc

SEQ ID NO: 2484 - DNA, 671 bp, Unknown
  Kingdom: Bacteria, Phylum: Actinobacteria, Class: Actinobacteria, Order: Streptomycetales, Family: Streptomycetaceae, Genus: Streptomyces
gttcgacaccgcgagggcgcgcagggcgtccggcgcggcgggcggcggcgccggtggccccggcggcatcggtggtctcacgaacgcgtcggccgcgcccggaacgtccccggacatgtcggtccccccgtcactctcgttccgcatgtcggcgaggggagagtgtacgggcaatccacagggttccgacagggagttcggccgtcggcgggggccggccagggggccgccaccagcggaggttcaagcgggacgagggagcagggccggtacttcgtggcgtactcggcggtcgtgcggcacctgccttccgggggcccggaccgcctcccggcccgctttccatgtcaggcctcctgacatgtcttgccgcgtgctcctagctgcaccgcgacgggtgcgatgggaggatgagcgggatggatctccaggtgccgcgtgcgtccccgaggtgggcgccgctccggctcgccgtacctgcgggcaccgcccggcccggcgccggcgggcccgcgtcgcggacatgccgttgcctggagcaatggcgcggacggggccggggcgtcgagcacgctggtggttcgaccgagcccgtcgggagttcctgtgcacaggccgcctgagtcattccacgaggaccgccgcccgcaggcggcggtcctcgtggaatg

SEQ ID NO: 2485 - DNA, 725 bp, Unknown
  Kingdom: Bacteria, Phylum: Actinobacteria, Class: Actinobacteria, Order: Streptomycetales, Family: Streptomycetaceae, Genus: Streptomyces
cgggcgccgaccacgccgtcgtacggcatgagaacggcaccctgcgcggagagctgaccgccgtagccgacgcgaccgtcgccgacgtgctgctcgtgcccgccgacgacggcggcctgtacgcggtcgaggccgccgccgcgaccgtcaccgcgcaggtgtccctggacctgacacgcccggtggcacgcgtcgtcctggacggggccgcgggccgccgcctcggcgacgccggacccgcggtgcgccgcgccctgcgcaccggcgcgggactgctggcctccgagcaactgggcctggccgaatggacgttgacggagaccgtgcggcacctgaaggagcgcaagcagttcaaccggcccgtcggcggcttccaggcgctcaagcaccggctcgcccagctgtggctggaggtcgtcaacctgcgcgccgccgcacgcaacgcggccgacgcgctcgcccgggacgaggacgccgacgtggcggtcgccgtcgcccaggcctacgcggcgaccgtcgccgtgcacgccgccgaagaggccctccagttgcacggcggcatcggcatgacctgggagcacccggtccacctgtacctgaagcgggccaaggcggactcgatcgcgtacggcaccgcgggcgcccatcgcgacgcgctggcctccctggtcgacctgcccccgcccccgcccccggggccgatctcctgatcggccctccaggag

SEQ ID NO: 2486 - DNA, 790 bp, Unknown
  Kingdom: Bacteria, Phylum: Actinobacteria, Class: Actinobacteria, Order: Streptomycetales, Family: Streptomycetaceae, Genus: Streptomyces
ccacgaggacgaccgagacgacgaaggtcgccaggtcggccgcgtaggccggggcgaggcccgcgtacgccacgatcacgcccgccaccgccggtcccgccaccccgcccaccgtccagcgcagcgagttcagcgcggtcgcggcgggcagatggtcgtgggccacgatccgcggccacagcgagtccagcgcgggccgctgcacggcggtcagcgcggaggacagggcggcgaccgcgtacagcggccacaccgccgggtgcggcagcagcgcgtcgaccagcagcccggcgctgagcacaccaagaccggcctcggtccacaggatcagccgccgcttgtccagcgcgtccgcgagcgccccgccgtagagcccgaacacgatcagcggcaccagctccacggctccgatcgcgcccaccgccgcggcggatccggtcagctccttcatctgcacgggcagcgccacgaaggtcaggaaggtcccgaagttggagatgagccccgacacccacagcctgcggaagtcacgggaggaccgccagggcgcgagatcgggcagcagcgcgcgcagaccggagggcggagcgtccggtgcatcggctgcggggtccgcggaggggacgcccgcgggggccgcggagggatccgccgggggttccgcggcgggcggtgcgtcaacgggtgcggggtcggtcacgtcgggacatggtccggcgggtgctggacctggggcaactggttttccggggctcaccggccggagggcccgcccgcctgcccgccgggt

SEQ ID NO: 2487 - DNA, 602 bp, Unknown
  Kingdom: Bacteria, Phylum: Actinobacteria, Class: Actinobacteria, Order: Streptomycetales, Family: Streptomycetaceae, Genus: Streptomyces
cgcccgtgccctgcgcgcgctcgtcgacgcccgcgccgtccacgacccgggccggccccggggagagggcccctcggccgcctcagggtgaacctcagggctgactcggggacctccgccctgacgcgtcgggcccggtcttgattaatctggtggcggagacgtttcgctgcgtccccgcccctgagccccgcccggtgccaggggttcctgctacccgaggagtgactccctccggcgatggacggatcgtcctgcagtacctgcgccgccccctgccgacatagcgcgcaccgcgagcaagcggtccgcgcgcacactcaggcggcggcatcatgaccatccccctgctgctcctcggagcggctttcctgctgattctcgccaacggcttcttcgtcgcggccgagttcggcctggtgaccgtcgagcgccccgacgccgagaaggccgccgccgacggcgaccgacgagcccgcagggtcgtcgagtcgctgggcgagctgtccttccagctctccggcacccagctcggcatcaccatcacctccctcgtcgtcggcatgctcgccgaaccggcactggccgagctgctgcacggc

SEQ ID NO: 2488 - DNA, 968 bp, Unknown
  Kingdom: Bacteria, Phylum: Actinobacteria, Class: Actinobacteria, Order: Streptomycetales, Family: Streptomycetaceae, Genus: Streptomyces
gtactgcagtcgatggccgccggcgcgcgggcggcgctgatcatcgagggcggggggcggcgggcgcgggtggcggatctgacgacgaccgtcaccgtgtccgcgggcacgcgccaccacgacgtccagggcatcaaccggacgcccggactcgtccgcgactgcgggcgtccgggagcgacgcccagcgagcggccctggcaggacgtgacctgtcacatcagcgacgaactggtgctgttcacggacgagttcggcgcgcggctgcccaccggtcccggcacccaggtcgtgctggacgccacgggccgcgtggtgtcggccggggcccggggcggctccgtcccggcgcacgggacggtcgtccaggggatcggccgggccgcggactggctgaccgctcaggcacacgagggccggcggatcggtgtccgcgaggacgtccgcgacacggccggccggcggctacggctcgggcgcggcgacagcatcgtcagcgccgcccccactctcgtccgtcgcggccgtacgcacatcgacgcggcggccgagggtgtcgtcgacccccgggacctgtcgttcggctacgcctgggccaacgcccgccagccgcgtaccatggccggggtggacgcccggggccggctgatcctggcgacggtggacggccggcggaccggtggcagcgagggtttcaccctgcaggaggccgcctccttcatgcgctcgctcggtgccgtggacgcgctcgccctcgacggcggcggctccaccgccatggccgtcggcggtgtcctggtcaaccggccctcggacgcgacgggcgagcgcgcggtcggcggcaccctccaggtactgccgacccggccccgcgcgtgaaccgtgccggtgcggtccgtgcggcccgtgtggtgcggtgcggtccccggcccggtgcggtccgtgcggtgcggtccccggcccggtgc

SEQ ID NO: 2489 - DNA, 1444 bp, Unknown
  Kingdom: Bacteria, Phylum: Actinobacteria, Class: Actinobacteria, Order: Streptomycetales, Family: Streptomycetaceae, Genus: Streptomyces
cgtctggcaggtgccggacgagcgcggcgcgaaccccggcggggtgcctggcacgcccgtctggaacgagctgcggaccttcgagacggcgaacgtcgccaagttctacgggtcgctgttcgggtacgaggagcggcgggcggaggccggtggcgaggacggtgccggcgagggggcgggcgagggcgaggaggccgtcgaccaggtgaccctgtgcctcgacggccgcccggtcgccgggatcctcggtgcgggggccgccctgcggcacgacggcgggccccgctggacgacgtacttcgaggtcgccgacgtggacgcggcgctggagcgtgtgaccgctctcggcgggcgcgtcctcgctccgccgggaaacaccgcccgcgggcgggtggcgacggtcgcggaccccgagggggctcggttcgcgctggtgcggagcgggagttgaggggacgtggtcgagtcgatccggcttgagcgggcgttgtcgaacgggcgttgagcgggctgcgggtggttgccgccgcgtcgccgggtcgtcggtgtcctcggcgcggtgtcacgacggtgcgtcggtgaccagttccggtcggcccgtgacgcgcacggggccgcgggcggccacctgccgctcgtgcgcccggtgttcctgcactgcctcgcgatgagcggcgagctgtggcacgacctcaaccacgaggggatcgagctgggcgagatcctcgacgtcgaggtgaccagcatcgacgtccaccaggacaaggtctgcgtccgggacgtcgagccggaggaggccgagcagccccggggccccgtcgaggccggggagaccggcgcgaccggagagaccgggcacatcgccgaggccgcctgaccgccctcgtccccgggacgccgtgacaacacggcgcccccgggctcccgcaccgtcccccgaagttcacccccgacgacagacgacagacaacaggacaaaccgccatgtcccgcgacaggacccggctggaactgtacaaactcgtgatcgagacggccgaccgcatctccgtgcgccgcggcaaggcgaacgcgtacttcctgaccgtgcagaccaccctggcgacggtgaccgccgcgctcccggcacgccgctcgccggggccgccggactcgccgtcgtactgctgctgtccaccgcctggtggctccaactgcggtcctgcgggacctgaaccgggcgaagttccgcgtcgtcctggccctggagacccggctcccgtcggccgtctacaccgacgagcagcgggccctgccgccgaggttcctggaactcgggcgtgccgagcggctcgtgccctgggcgttcgccgccctgcacggcgccgtcttcctcgtccagctcgtccccggccgaccgcgccccgccgccacggccccgcctccgcgctcctgcccgcgcgcg

SEQ ID NO: 2490 - DNA, 607 bp, Unknown
  Kingdom: Bacteria, Phylum: Actinobacteria, Class: Actinobacteria, Order: Streptomycetales, Family: Streptomycetaceae, Genus: Streptomyces
cagggtcaggtcgagaccggcgagcgcgtccgtgtcctgccccgtgtggcgggccgtgaggccccggacggtgagcgggaaaggtgtcgcgggcgccggccgcggctgctccggctcacgtacgggctcgggcgcgtccaggatctcgtacacacgctcggcgctgcgccgcacccggtgccggtactgcgcggcgaggggcataccgaggaccgcctcgaaggcggccagcggggtgaggacgacgacggccagggccaccccgccgaggcgtccgtcggcgaccgcctgggcgccgacgagtgcggtcgccgccacggtcagccccgagacgagtgcggtgagcccgtcaccgagcgcggtcgcggtggcggcacgcgacgcgatccgggtcagtacggtgtcggcgcgccgggtctcggctgcccgggcgggcagcgcaccggcgaccgtcagttcggcggttccggtgagcaggtcggtcacgcgtgtcgccagggcgccgcgtgcgggggcgagccgctgctcggcccgccgtgccacagcaccggtgaccagcgggacacccgccccggccaccagcagccccgcggcgaggaccgccccg

SEQ ID NO: 2491 - DNA, 1524 bp, Unknown
  Kingdom: Bacteria, Phylum: Actinobacteria, Class: Actinobacteria, Order: Streptomycetales, Family: Streptomycetaceae, Genus: Streptomyces
cgccccgtcgcccggcgctgcgcgcggcttgatcccgccgtggcgcgtccgcgtgtgatccgcgaggatgctgcgcgcacccgcccgccacggaatggagcgcaccgatggtcccggaggcccgtgaagacctcgtcgtcacccaggcgaccctggaggactggccggtgatcagccggtgggcggccgacgagggatggaaccccgggctgtccgacggtccggccttcttcgcccaggaccccgccggcttcttcctgggccgcatcggcggcgagccggtctccgcgatctccgtcgtccgccacggcgccgacttcgccttcctcggctgctacctcgtccgccccggcctgcgcggccgcggacacgggctgaccacctggaagaccgcgctggcgcacgcgggaagccgtacggtcggcctcgacggcgtcgtcgcccagcaggacaactaccggcagtctggcttccggccggcccaccgcaccatccggttcgccggaccggctcctgcctcctgggcccttgaggaccaggctcccgccgcccgcgccctcgccggtgtacggcgcgcgaccgccgccgacctggcggacctcaccgcctacgacgcgctctgtcacccggccgaccgtccgcgcttcctcggccgctggctgaccaccgagggccaccggaccttcgtccgccgcgccgccgggacccgcgtcaccggctacggcgtgctccgcccggcccgggacggactgcgcgtcgggccgctgttcgccgacaccaccgaggacgcccgcgccctgttcaccgcgctgtgcgccgacgcccagggccgggagatcgccgtggacgtgccggagaccaacgcggccggtgtcgccctggccgaggaggccggcctcacgccgtcgttcgagaccgcccgcatgtacacggggccggtgcgcgagtacgcccgcgaacgggtcttcggcgtcaccacgctggaactgggatagccgcgggccggcgagggccggcggcgtaaacgggttgcccggggcaggcccgctctgatggcatcctgcgcatggatcacgccacggtactcgccctctacgaccgggacctgcgcgaacgcgctcgcccggacggccccggagcccgcgtcgaacgcgtcgggaacgtggtgcgccacgtcggccgcagcgcacaggactggaacggcgtgctgtggtccgcgctggacgccgacggcgccgacgcggcgatcgccgagcaggtggcccacttcggtgcgctgggccaccccttcgaatggaagctgtacgggcacgaccggcccgcggacctcggacggcggctgacggccgccgggttcacgcgcgaaccggaggagacggtcctggtcggcgagatcgcggacctcacgctcgacgccggactgcccgagggcgtacgcctgcacaccgtcaccgacgaggccggtgccgaacgccttgtcatgggcggcgaccatgagatccacaccggcctcgtcggtgacgg

SEQ ID NO: 2492 - DNA, 934 bp, Unknown
  Kingdom: Bacteria, Phylum: Actinobacteria, Class: Actinobacteria, Order: Streptomycetales, Family: Streptomycetaceae, Genus: Streptomyces
tcgcccgagcgcatggcgcacgggcagctccggcgtaccgatgttgccgtccacttcgacaacggcgcgagcggctacgacgacctcgaccagaccgtcgagacccccgtcgtcggcgcccagcgcggcccggaagccggccagacccggctgctgccgcagatgcgcaccgcgggcagcgcctacgacgagaccgcgtacgccgaccccgcatacggcggtcacccgccctacggccacccccgccccggccacggcgacgactacgcctacgacgactcggcctacggcggccaggagtaccacgacgccgcctacgacgacgatccggacgtccgcgacgccgcccccggcacccggcgccgccgcggcggacggcacagcgacgacccggcccgccacgcctactacccgggccgccggatgaacctcggcgtcgtcctcctcccgctgcgcgtcttcctcggcttcatctccatctacgccggcatgggcaagctgtgcgacccgctctacttcgacggcggcaagcgcggctccatggtcaagtggctcaccgccctgcacccctgggaagtcgccgaaccgctgcgccagttcgccctccagcacccggtcggctccggcctcgtcatcgccttcctccaggtcatcgtcggcgtcctgacggtcctgggctgctggcagcgggtcgccgcggtggtcggcggactgctgtcggccgcgctcatcgtcaccgtcagctggcgcaccgtccccgtctacgacgcaccggacatcatctacctcgccgcctggtccccgctgatcatcgccggcgcccccgtctactccgtcgacggcaggctcgcggcgtccgcctggcggcggctcggaccccgctccgacatctgggacctgcgccggtacgtgctgcgccgcggcgcactgctca

SEQ ID NO: 2493 - DNA, 1586 bp, Unknown
  Kingdom: Bacteria, Phylum: Actinobacteria, Class: Actinobacteria, Order: Streptomycetales, Family: Streptomycetaceae, Genus: Streptomyces
cggcgaccgggcgggccgccgggtcccagagcgccagggaggcggtcgaggtgaaggcgggcagcgcggtgcggtgaccggccttcagggtcggcacggccatgtcgctggtcttctcgcggcgcagcccgttctcgtcctcctccacctcgccgagcacggcgacgacgggcacgagcagccgggcgcccttgagcgcgcgcagcaccgggtccacggcggtgcggtcctcggcccagacggcgagcgccgcgctcagcgccgggtcggcggagccgtcgtcgtcggagaaaccggagtcggggatgttcttgttcgccacgctcccgagcctatccggggccgttcacggttttctcagggtcccctgacccccgtctcacgccggtcccacggcacgcacagccgccgccagaaccatcgcggccatggagaccccgtcccccggcgcccgccaccgcgcccgccgtcaccgtcgcgcgcgcccctcccggcggggaagcccgccgttcaccctcatcgcgctcgtctgcgccgtcctcgtgggcggtacggccgcgggcaccgcctacgtgagggcccggacgggctccgccgggccgggcgccgtatcgtcaccggcgtcgtcatccacgtcgtcctccgtgccggcgtcggcgccgagccaaagagcgggggtggaggcggtgacggagccggtggtggaccggacggcgctgctggccgcggcgatgcggtcggtgcgggtggcagagggtgccgccgtgtcggtggcggtcctcgacctggactccggccagggcgcccggtacggcgaccagacgttcgagacggcgagcatcgtcaaggccgacatcctggcggccctgctgctccaggcgcaggacgcggggcgtcggccgaccgcgcgggagcgtacgtacgccaccgcgatgatcgagaacagtgacaacgactccgcgtcggcgctgtggcggagcatcggcggggccgacggactggacgcggcgaaccgccggttcgggctgacggagaccaccggtggcgacggcgcgctgtgggggctgacccggaccaccgccgccgaccaactcgccctgcttgagcaggtgttcgggcaggagtcgaagctgagcgcggcatcgcgggcgtacctccaggacctgatgggacggatcacggacgaccaggactggggtgtgtccgccgccgcggacggctccgcgtgggcgctgaagaacggctggctgccgcgcaccacgaccggcctgtgggtcgtcaacagcatcggccgggtgacggccggcggggacgactatctggtggcggccctttcgcacggcaacgcgacgaaggacaccggcatccggctggtggaggagtcggcgcgggcggcggtgtcggtgttcgcggcgccggcggcttctgcctcgccttctgtttccgctccgtcctccggcgccggctgacggcggcgggacgggctcacggctggacgtcgcggcgggcgccggctcgttcgcgccggccgcgccacaggacgcccgcggcgaccagcagcacaccgccgacgctgcctgcgaggg

SEQ ID NO: 2494 - DNA, 579 bp, Unknown
  Kingdom: Bacteria, Phylum: Actinobacteria, Class: Actinobacteria, Order: Streptomycetales, Family: Streptomycetaceae, Genus: Streptomyces
gcgatggcctggcagcccgcggactcctcgccgaacgaggcgccgatggcgtcgggctgggccagtccgatcagggtctcggtctcgtcggacaggcgcagcacggtcgggcgcggcccgtcctgggcgagccggcgcagcgcgtgcgtgccctcctcgaaggaggcgaaccgccagccctcgtagacgcgggcctgcggcagcgggcgcagccgcacggtcacggcggtgatgacgccgaacgccccctcggagccgaggacgagctggcgcaggtcgggtccggcggccgagcgcggggcgcggccggtctccagggtgccctcgggggtggccagggtgaggccgagcaccatctcgtcgaagcggccgtagcccgcggacgcctggccgctggagcgggcggcggcgaaaccgccgatggtggcccactcgtaggactgcgggaagtggccgagggtgaagccgtgctcggcgagcagtgcttcggcgtccggggcgcgcaggccgggctggagcgtggcggtccgggagaccgggtcgagggcgagcaggcggtccatgcggcgcaggtccagc

SEQ ID NO: 2495 - DNA, 855 bp, Unknown
  Kingdom: Bacteria, Phylum: Actinobacteria, Class: Actinobacteria, Order: Streptomycetales, Family: Streptomycetaceae, Genus: Streptomyces
cactccacccaggccggcgggcacccgccggcctgggtggagtgcgcgcggctggtcatggtgcccatggcggccctgaccgtgctggccgccctgatgatcgcactggcctgaccctgcgccgccttcacggctcaggtgctgaagccgatgtggacgtggtcgtggtgcgtggcgtcgctgaagaactggtccggccgggcgccaccggaaagctgcaccgggccgccgacgttgtaggaaccggcgtccgccgcgtcccgcatgaagtgctccaccagggatcgcggggtgcgcggatcgacgaccggccggccgtcgatgcgccacacgtcgaaggcccgtccgcgcgggtggtcgctgggacggctggtgccgaagacgtccaggggatgcccggagcggaccacgctcacggacatccggtacgtaccggccagccggagcatcgcggtgagcacgctgtcgtggacccggccgctgcgcagatcggccgcggcggcgggcggcagctcgatccgcgagtcggccagcaccctgcgcaccgccgcctcgggcgtggcttcggccggccccggccgggccgggtgcagggcggtgacggtccatccgcggccggtccgggcgagccgtacgtcgaccgtcgtaccgcccgccgtgaccgccgtcccgcgccgcgtccactgccggcacacgacgagcacgctcgccgagtcggcgaggatcccgccgtactgggcgtccaccacctgcaggaccgcctcgtcggccgggggcagcagggggccggcctgtgcgacgagcgccggccgctggtgcgcggcggccgccctggcccgcgccgcgcaccagcgg

SEQ ID NO: 2496 - DNA, 575 bp, Unknown
  Kingdom: Bacteria, Phylum: Actinobacteria, Class: Actinobacteria, Order: Streptomycetales, Family: Streptomycetaceae, Genus: Streptomyces
gccatgccctgcctgccctgccgaggagggcgcggtgtgccggccggcggtgatcggtccggcgggtccggcgggtccggctgtcggccggtgttgcgggccgtcgcgccgggttcgtcggggtgcctgccggcttctccggtccgtgggtggggcaggtggccagtgcgcgggtgacgggtctgccgaccggccgggcctgccggggggctcccgaccggtctgtctgccggtggtccctcctttccgtctgccgggtgactggccggtctcttcttccgggcgtccagcgaacggacggccgggctgttcggccgtccgttcgcctactggtgcgtcaggcctgtcgggggcgggggccgtgggggattccgagttccaccgctgtgcagcgccagcgccggtctctgccctgctccaggcggaacgccatggcacggagctggcggcccgcgccgatgcgggcgaagacctccagcgcgccggggtgcggctcgtagtagccgatgtcgcggacgacggggcgggtgccacgcgtccgcaaggggccgcgttcggcgaggcgggccagttcg

SEQ ID NO: 2497 - DNA, 634 bp, Unknown
  Kingdom: Bacteria, Phylum: Actinobacteria, Class: Actinobacteria, Order: Streptomycetales, Family: Streptomycetaceae, Genus: Streptomyces
ggcccccgtgccgtgggtcgccaccgggtacgtcgccggttccagcctccagcggatcgtcggccacgaccacggcccgctgcccgagcggtcggtgcgcgtcctcgccgccggtctcgccgccgcgctccgggacatccacgcggccggcctcgtccaccgcgacctcaagccgtccaacgtgctcgtcacgatcgacgggccgcgcgtcattgacttcggcatcgcgcgggccctggagaccgtcgcggacggcgggctcacccggaccggggcgctggtcggctcgcccgggttcatggcgcccgagcaggtgcgcggcgaccggatcacgcccgcgtgcgacgtcttctgcctcggttccgtgctctcctacgcggcaacgggcgcccttcccttcggcaccgccgacagcggagggcacgcgctgatgttccgcatcgcccaggaggagcccgacctggaggcgctgccggagggcatcgccgacctggtccgcgcctgcctgaggaaggacccggcggcccggccctcgccggagcagatcatcgagcgcaccggtgtgcgggacacggtgtccgacggccgtttccgcgacccgtggctgccgagcgccctggtggcccagctcgga

SEQ ID NO: 2498 - DNA, 585 bp, Unknown
  Kingdom: Bacteria, Phylum: Actinobacteria, Class: Actinobacteria, Order: Streptomycetales, Family: Streptomycetaceae, Genus: Streptomyces
ggcgcggatgccgtcggcggcgcgccggtgggccgcgtcgtcgagcccgccgggaagccggcggccggtctcgtcccgcacgacctgccacactccgcggtgttcccagcccacgatgccgaggccgtcgaacacggcgcccagcagcgccagggacacccgccagtcggcggggaccgggtcaccggctgcggcggtgtggaagtccagccaggccagggagtcggcggtgaacagtccgtgcacatggggcatggagcgggggccgccgaagaggtaggtctccggctcgtacacgtcggcgacgggctgcgcccaggctccgtccgccgcgggggcgagacggcggacgagggtctcccgcagtcccggtgcccgctcgggtccggccgcgcggaaccggacgcgcagtcccggaggtttgtgcatgtagaagaagtcgcgggcctcttcggtgccgagcacgtcccgtgccgtgtcggcgaggcagcggtacaggcggggccaaccggccggttcggcccggaggttgagctggacccatccggcgtcgggcgcgtgctcgcgcagcgcgtgcagcccggc

SEQ ID NO: 2499 - DNA, 539 bp, Unknown
  Kingdom: Bacteria, Phylum: Actinobacteria, Class: Actinobacteria, Order: Streptomycetales, Family: Streptomycetaceae, Genus: Streptomyces
gccacaccgtcaccggcgtcgcacgcgtcaacggacgcacaccggacggactcggcggccgtcgccgcttccatgacctgacgcccctgcacccgcgcgagcggctccgcctcgaacacccggcagccgggctcgccgggcgggtgacggacctggtcgcgcccgtcggcaagggccagcgcgggctcatcgtggccccgcccaggacgggcaagaccgtgctgctccagcagatcgccgccgccgtcaccggcaaccatcccgagtgccggctgatggtccttctgctggacgaacgtcccgaggaagtcaccgacatgcggcgctcggtgcgcggcgaggtcttcgcctccacgttcgaccggacgcccaaggagcacatcgcgctcgccgaactcgtcgtggagcgggccaagcggctggtggaggccggtgaggacgtcgtgatcctcctcgactccctgacccggctgtgcagggcgcacaacaacgccgcggccgcgggtggccgcaccctcagcggtggcgtcgacgcggcg

SEQ ID NO: 2500 - DNA, 1459 bp, Unknown
  Kingdom: Bacteria, Phylum: Actinobacteria, Class: Actinobacteria, Order: Streptomycetales, Family: Streptomycetaceae, Genus: Streptomyces
catcaggtacggcgctccgaccgcggccgtcaggacgccgaccggcagctcgacggggtggaacaggcgccgggccagcaggtcggcgaccacgacgacgagcgcaccggtcagcgccgaggacagcagcgggatctgcgcggtgcgggtgagcctgcgggcgatctgcggggcgagcagggcgacgaagtcgacggggccggtggcgcccgtcgcgaccgaggtcaggaccacgccgagcgcggtgagcccgagccggaccgcgttcaggcggatcccgagggcgcgtgcggtgtcgtcgctcagggccgcgccgcgctgggcacgggccgcccacaccaccgccgggacggagcagagcaggaccagggcgagcggcgccgcctggtcgtagccccggctgttgagcgaaccggtcagccagaccttcgcctgctgggccaccacgacatcgcccttggtcagcaccagttgggtcagcgagcccagcgccaccgacacaccgatgccgatgagcacgaagcgcgcagcgtgcagcccgcgccgccacgcgaagacgtacaccagcagtgcggcgccgagcccgcccgccacggagacgtacggcagcgcgttgtgggggacgagcccgaagctcatcgccgtcaccgtggccagcccggccccgtgggtgacgccgatgacgtcggggctggccagcgggttgcgcgcgaccgtctggatcgtcgcgcccgcgatgccgaacgcggcgcccgcgagcaggcccacgacgaggcggggcaaccgcagcgtgccgacgacgagttcgtcgggactgggccggccgagcaccacgcggatcacctcgcccggtgcgacgaaggattcgccggtgcagaggtaggccaccgccgcgcacgccagcaggacggccaggccggccgcgacgagggccgcccggcggtgcacgaggacactggcgcgccgggagcgcagcacggcgtgtccggccggtgcgaaggacatcggttcggtgcggttcacgcggtcaccgccgaacggcgccgtacgagggcgatgaggaacggcacgccgatcaccgcggtcatgacggccaccggtacctccgaaggggggaagacgacacggcccagtacgtcggagcagagcagcatcaccggcccgagcagcgccgccagcggcagcacccagcggtgcgagccgccgaccagggcgcgggccaggtgcgggacggcgaggccggtgaaggcgaccgggccgaccgccgccaccgcggcgccggtcagcacggtggccgcgagtgcgccgagggcgcggacccggaccacgtggtggcccagcgcgcgggccgcctcgtcgccgagcgccagcgcgtcgaggccgcgggcgagcacctgtctctgatatacatctccgagcccactacaccttactatatctcttatacctttttcttctt

SEQ ID NO: 2501 - DNA, 523 bp, Unknown
  Kingdom: Bacteria, Phylum: Actinobacteria, Class: Actinobacteria, Order: Streptomycetales, Family: Streptomycetaceae, Genus: Streptomyces
ggtctgccgccccagccgccccacggcagcggcgccgggcaccacgcggcccgtcctgtactacgtgcacggcggaggcatggtcctcggcgaccacagggccggtgtcgagatggcgctgggctgggcgaaggaactggacgcggtcgtggtgtccgtcgcttaccggctggcccccgagcatccgcatcccgcgcccgtgcaggacgtgtacgcgggcctgctgtggacggcggagcacgccgcggagctgggcggggatcccgagcggatcgtcatcgtgggcgcgagcgcgggcggcggcctcggcgccgcactggcactgctgctccgggaccgtggcggcccgcgtccgtgcgcgcagatgctgctgtccccgatgctcgacgaccgcaacgacaccccgtccgcccaccagatggcgggcgtcggcctctgggaccgtacggccaacgagacggggtggtcggcgctgctgggcgaccggcgcggtggcccgcgggtgtcgccgtacgccgctccg

SEQ ID NO: 2502 - DNA, 663 bp, Unknown
  Kingdom: Bacteria, Phylum: Actinobacteria, Class: Actinobacteria, Order: Streptomycetales, Family: Streptomycetaceae, Genus: Streptomyces
ccgcaaccccccgcacccgcacccgcccgcgcaacccgacccgagggacgagaccgagatggcgaacacacacgacagctgggatctggaatgcgacgtactggtcgtcggctccggcggcggcgcgctcacgggcgcgtacggcaccgcggcgcgcggcctggacaccctggtcatcgagaagaccgagtacttcggcggcaccaccgcctactccggcgccggcctgtggctgcccggcaaccaggcccagacgcgcggcggcctggaggactccgccgacctcgcccgcgcctacttccgcgcggtggtcggcgacgccaccccgcacgcactgcaggacgcctacctcgaccacgcgggcgagacggtcgccttcctggaggacaacgcacacgtccgcttcgagtaccggcccttccccgactacttccccgcacccggccggttcgacgccgggcgcgccgtcttccccgtcgacctgcccctgcccggggaaccgcacgagtggctggccgcggtccggcccccggcctgggcccagcggctcggcctgccggtgcccgagggatcgctcaccgacggccgtgccctgatcggccggctgctgctggcgctggagtccaccggccacggccgcaccctgcggaacacggcgctgac

SEQ ID NO: 2503 - DNA, 745 bp, Unknown
  Kingdom: Bacteria, Phylum: Actinobacteria, Class: Actinobacteria, Order: Streptomycetales, Family: Streptomycetaceae, Genus: Streptomyces
gcagcatgaacggcttcgtccacggcggacctgacggccggctcggccttggcggcctgttcggagtcggggaacgtcgtgagcagttcaccgaagtacccggcccagtcggacttgccgcccgtcagttcgttcgacccgcactcgtacagggcggtggccaggcgtgcgtccggccaggtggccagggcgcccagcgtctgcttcggcatgcggtcgggcaccgtccgcaggtacttcagcggcgggacggcgtcgcagtacctgcgctgttcgtaggccgcgccgaccgcgcggtagtaggccgtcatgcggtccggcaggcggtgggccgcgcgggagccggggtggtcgcggccgagtgcggcgtagacgcccagtgcctcgcggaagccgggctgcgcggtgtcgaacggctggtccgtacgtgcctggacgaggtcgtcggcccgctgcaggcggtcgaggagcatctgctcggtggcctcgtcacgcgcctggccgtacagcacgccgccgccgaccggcacggccagcagcaccaggcccaggaccgccgcgaggggcgggcggccgggccaggacagccgcgtgcgcagtccgacgaccgcgccgtgcgcggccgcgatcccgaggaccacggcgtagccgacgaggacggcggacggcactccgtcggggtcggccgggagcgccaccacgagcagcacggcggtcgcggcccagcacagcccggccggcaccc

SEQ ID NO: 2504 - DNA, 977 bp, Unknown
  Kingdom: Bacteria, Phylum: Actinobacteria, Class: Actinobacteria, Order: Streptomycetales, Family: Streptomycetaceae, Genus: Streptomyces
gccccggcccggcgtgcgggcacctccaggacgagcgggtcgtccccgtcgccgtcgctccacagcggatcgtagggccgcgagccggtgatcagcacgggtacgtcggtggcggcggccagcgtgcgcacgatccgcgccggttgctccggcagggcggagaccacgaccgcgccgccggtcagccgcgcctcgcgcagcaggccgggcacgtgctcctccgggcccgtgaagtgcagggcgggcaggccggcggtgcgcagggcggcggcggcacaggtgagggcctcgccctcgcggccctcacggaggtagacggtgggcggcggcccggcggcgagccgggcggccaggcggcggacgaggacggtgaactcctcgtccccgccgtcgtccgcagggcccccggtgccgtccggccacggcgggtcgggcagggagcgcaggtgcccggcgagggcggagtcgggggtgtcgtcgccgagcaggtgggcgaccagccggtccggcacgcgcaacgagcggctgaggaagggccgttccggctcctccaccacgagcaggccgagcgcggacagcggggcggtcggatgcagccgggcccgtgcggatgccgagtggaccgggatgccgcacaggtccagggcgagggcgacggtggcccgccggcggctgacgtcgtcgttgaggtagccgtagagcggttcgaaggtgcggtccaggtcgggggcgagggcgaccaggaggagggccgtgtccaggtcgccgagcccgcaccgctcggccagcccggccagccggtcgccgggcggcccggtgaggtccaggacggaaccgggcgggtcctcgtcggacgggccgggcacggtctccgccggtcgcagcaggtgccgtacggcgtcctccgacaggtacagaccgcgcagcgggtcggtggccgtggggtcgtcggtggagcgccggccgaccagcagggc

SEQ ID NO: 2505 - DNA, 515 bp, Unknown
  Kingdom: Bacteria, Phylum: Actinobacteria, Class: Actinobacteria, Order: Streptomycetales, Family: Streptomycetaceae, Genus: Streptomyces
ctgcaccgccgccggggcccgcccgtgcacctggagcacgtccacgtcgcccaggtccccgagcccgcccgcgacccgcgcgatctcgcccgcgcccggcaggaagcacagcacgtcccccgcccgctcggtgagcgcacgccgcaccacggagcccacatgggtcagcagcgcgggatccacccgcatgccgtgcggcggccggacagggcgcgcgggcggcgcccacaccacctccaccggatacgacacgccctgcgcctcgaccaccggcgcatcgcccagcagccgcgcccagccctgcgcgtccgtggtcgcggacgccgccaccagccgcagctcgggccgcagcgcctcccgtacgtcgcacaggaacgccgccgccgtgtccgcgtccagatgccgctcgtggcactcgtcgaggacgaccgtgtcgaccccggccagctcctggtcgcgctgcagccgctggagcagcacgccggtggtgacgacctccacgcgcgcgcgtggag

SEQ ID NO: 2506 - DNA, 515 bp, Unknown
  Kingdom: Bacteria, Phylum: Actinobacteria, Class: Actinobacteria, Order: Streptomycetales, Family: Streptomycetaceae, Genus: Streptomyces
gcgcggcggcgacgagcacggccgcgccgagctgctgtggcgcgccctgagcgcgtacgccgcccggtccccgctgctggtggccgtggacgacgtccacctcgccgacggcccctcccaccgctggctcgtggagaccgcacggcacctggaccgcttagcgctgcccgtcctgctggccgtcaccgaacgcagccagtacgacgtcgacgcgccccgcccgggcttcacccacaccctctcgcccgcgctcgtgcgcacccacaccctcgccccgctcagcccggacgcggcggcccgcctggtgcgcgccaggttcccggccgcacccgccgactgggccgaggactgcgtacgggccggggcgggcagcccgctgctgctgcgcgccctcctggacgacctcggcgacccggcccggcaccccgccgtgcccgagacgtcggcggcgctgtccagccaccacgacacggcggccgggtaggcgcccgggtacagcgccgccgacgtctcgg

SEQ ID NO: 2507 - DNA, 552 bp, Unknown
  Kingdom: Bacteria, Phylum: Actinobacteria, Class: Actinobacteria, Order: Streptomycetales, Family: Streptomycetaceae, Genus: Streptomyces
gcgcgcgggcgacgaccggcgcgcccgcgcgcgtgagcgcgtggccgccctcaacgaccgcgaacgcgaggtcgccgtccgcgtcggacagggcctggccaacgcgcagatagccgccgaactgttcatgagcgtcgccaccgtcaagacgcacgtctcccgggtcctcgccaaactcgacctcaacaaccgcgtgcagatcgccctgctcgcgcatgacgccggacttctcgaagaggacgccccgtaggggcacttggcgccgccgccggtcgttgtcggatcacggggcgcccgatggtgtacgcgctccggaggggagccgagatggcagacgtgatcgacctggcggagttcggcgaggggttccgggcggacccccacaccgtctacgcgcgactgcgcgagctgggcccggtccaccgcgtgcgactgccgccgcccgagtcctacgacacctggctcgtcgtcgggtacgaggaggcgcgcgccgccctcgccgacccgcggctcgccaaggacgtcgccggtctcgacgtgcggcccgtcgag

SEQ ID NO: 2508 - DNA, 510 bp, Unknown
  Kingdom: Bacteria, Phylum: Actinobacteria, Class: Actinobacteria, Order: Streptomycetales, Family: Streptomycetaceae, Genus: Streptomyces
ctcggtggcggtgctcatcgtggcctgggtcgcggcgagcgtcctgggcgcctcctcctcccccgtggtgacgtcggcgatacgggactcgacgctgctcggcaccgtgcagaacgcgatgccggacaccaccccggcctggttctcgcgggccacctccgcgctcaccgaggcgggtttcccgcaggtcttcaacccgttcgagaacgaaccggcggccggtgtcgccgcgcccaccggcgacagcgtgacggcgagcgcgacgagcgccgcccggctcagcacggtcaagatcgagggctcctcgggcaaccagggccgcgagggcagcggtttcgtgttcgcgcgccagcacgtgatgaccaacgcgcacgtggtggcgggcatcgacaacccgtacgtgcagatcggcggcgtcggccactcgtacgcggcgcacgtggtcctcttcgaccccgaccgggacgtggccgtgctctacgtccccgggctgcgcgctcccgtcctgcg

SEQ ID NO: 2509 - DNA, 617 bp, Unknown
  Kingdom: Bacteria, Phylum: Actinobacteria, Class: Actinobacteria, Order: Streptomycetales, Family: Streptomycetaceae, Genus: Streptomyces
  misc_feature (267)..(379): n is a, c, g, or t
gggatgcccggatcccgccgcggccgccgcccgcacactgtcgacgcgcaactgctgtgcgaggtcgacgagttcgtcgtggttcatgagtctccttccgctggcatgtcggcgcgcttgaccgggccgggggctggatggtgttcgtggtgcggggcgggctcgggtcctggctggttcttcgcgggctccgggcctggttggttcttggcaggctccgggcccggctggttcttggcaggctccgggcctggttggttcttggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggccggttctggttgtcggtgatgtcggtgatcccttccctgatgtcggtgacgtcggcgctgccttcgctcttcggcccgccgcccgctccgcccactcgcgccagttccggcgacgccgagtccaggggcacggaccaggaccgtacgagccccaactggacggcctgccgcggcagtacgccgcccagcagccagtcggccgccacccgcacccggttgcccggcatcgcggcc

SEQ ID NO: 2510 - DNA, 799 bp, Unknown
  Kingdom: Bacteria, Phylum: Actinobacteria, Class: Actinobacteria, Order: Streptomycetales, Family: Streptomycetaceae, Genus: Streptomyces
ccacccagccggagctggcgatgggcgcgatcggcgaggacggcgtacgggtcgtcgaggacaccgtcgtgcgcgaggcgcgcgtagggccgggcgcactggagcgcgtcgaggagcgcgagcggcgcgaactggcccggcgggccgcccgctaccggggcgaccgcccgccggtggccgtcgccgggcggaccgtcgtggtcgtcgacgacggcgtggccacgggctcgaccgcgcgcgccgcctgccggacggtacgggccaggggagcggcacggaccgtgctcgcggtgccggtcgcaccgccggactggacccggcggctcgcgggcgaggccgacgaactggtcagcctggcgaccccggtcggattcttcgccgtcggccagttctacgccgacttcggccagctcgacgacgaggacgtcgtcgcctgcctgcggcgcgcaccggccaccgcccaccgcgcggcgaccgaccaggaggtggaggtgacggcgggcaccgtacggctgggcggccggctgaccgtccccggggacgccgtcggcgtcgtcgtcttcgcgcacggcagcggcagcggccggcacagcccgcgcaacctgtacgtcgccgccggactgaaccgggccggtctcggcaccctgctgttcgacctgctcaccgaggaggaggcggcggaccgggccctcgtgttcgacatcgggctgctggcctcgcggctcgccgacgccaccggctggctgagcggccggcccgaggcccgcgacctcgccgtcggttacttcggtgctggcac

SEQ ID NO: 2511 - DNA, 1278 bp, Unknown
  Kingdom: Bacteria, Phylum: Actinobacteria, Class: Actinobacteria, Order: Streptomycetales, Family: Streptomycetaceae, Genus: Streptomyces
tcccgcccgtgcgcgctgaccaccacggcgtcgtcccagggcagcccggcgcgcgcgaaggcggcggccaccgaggagacgcccggacgcacgtcgaggagcgcggagccgaaccgttccgccagcgcccgtacgatcccgaagaacccggggtcgcccgaggcgagcacgaccacgcgccgctcccgcccgacgtactcggcgatcacgtcgagggcgggcggcagcggccccagcacgacccgccgggcgccttcgggcagccgtacggcgtccaggtgccggcgtccgcccacgaccagctcggcaccgtcgagcaccccgctgtccggcggcgtcccggtacccgtaccgacgaccgtgatcacccgcccgccccctgtcgcacggggcctcggacggagcgcccggaggtcacctcgccggtgggtgcatcggccatggggtcgagtcctctcgtacggaatgtcacggtctgtgggggtcggccggtggccggatgtgcgcgatcgggggttgatcggatagcaagagcacatggcggtcttcgtcgcgctcggcgcgttcctgatgacgctggccggcggctggacggcacagcgggtcaccgaccgccgccatctggtcctcggactggccggcggcctgatgctcggtgtggtcggcctcgacctcctgccggaggcactgcgcgcggtgggccgcgaggtgttcggcgtaccggcggccctgctgctgttcgtggcaggcttcctgctggcccacctggtggagcgcctgctggccgcccggcaggccgcgcacggcggcgacgaacaccatcagcaccgcgcgcccgaggtgggcctcaccgcggcggcggccatggtcggccacagcgtcatggacggcgtggcgataggcgccgccttccaggtcggcggcggcatgggcgccgccgtcgcgctcgcggtcatcgcccacgacttcgcggacggcttcaacaccttcaccctcaccagcctgtacggcaacgcccggcgccgggcgatagcgatgctcgtcgcggacgccctggcgccggtggtgggcgccgcgtcgaccgcgttcatcagcatccccgaatggttcctcggcggctatctcggcctgttcggcggcgttctgctctacctcgccgccgccgagatcctgcccgaggcgcaccacgagcaccccgcccgctcgaccctgctgtgcacgatcgcgggcgccgcgttcatctggctggtggtgggtctggcggcctgagcgcagccg

SEQ ID NO: 2512 - DNA, 932 bp, Unknown
  Kingdom: Bacteria, Phylum: Actinobacteria, Class: Actinobacteria, Order: Streptomycetales, Family: Streptomycetaceae, Genus: Streptomyces
gaactggtcctgccgctgcgcctcggcccccgcgccgactggttcaccgccgcggccctgcgcaccctcttctcggcggcgtaccgcctctccccgcacagcaaccgcgtcggcctgcgcaccgagggaccgccgctcgaacgtgcgaggcccggcgagctgcccagcgagggcatggtgctcggcgcggtgcaggttcccccggacggacgcccggtcgtgttcctgaacgaccatccgacgacgggcggctacccggtgatcggagtcgtcacggcatccggcctggcgtcggccgcccaggccccggcggggacaccggtacggttcacaccgggctgacggaccgagccacggagcaacagggggcagcggcgtcagacgtccggtaggttctgtcccgtatgcccgctcccggcggcgcaggccccgtgccggtatcagccgcactgcggacttcgcacttcggacctcggactcggagggaatcggagagaagctgaagccatgcgcgtctcggtcgtcctgttcaccgccgacctgcggctgcacgaccacccgccgctgcacgccgccctgcgctcggccgacgccgtcgtcccgctcttcgtgcgcgaccccgccgtggcggcggccggcttcgccccgccgaaccgcagcgcgttcctcgccgactgcctggccgacctcgacgcctcgctgcgcgagcgcggcggacggctcgtgctgcgctccggtgacgtcgtcgccgaggtatgccgcacggcgagcgaggccgacgccgacgaggtgcacatgtccgcggcgcacagccgtttcgccggccgccgcgaggagcggttgcggaccgccctggcagcgggcggacgccgcctgcacgtgcacgacgcggtcaccgtggccgtaccgcccggcgacgtgacccccgccgc

SEQ ID NO: 2513 - DNA, 503 bp, Unknown
  Kingdom: Bacteria, Phylum: Actinobacteria, Class: Actinobacteria, Order: Streptomycetales, Family: Streptomycetaceae, Genus: Streptomyces
cggcggcgcggagccgctcggccacgatctgcgcggtgcggtgctcgcagaaggcgagttcgggatgggcatggaggtcgcggtagagaccggcgagatcgcggaggtcggggacgtcggaggcgtcggcgtgcggggacgggctgctgggcatcgtgccaccttccggtgctcgggaccggcgctgccgccgggacgtaccgctcggtcccaacttaaccggcgcgtgatcttgacggtcatgcgcctcggatcgggcgcccgtgcggccggggacgggctcgacctgcgcgccggactcgaggtgtacgagggcggcagccaccgcatcgacatcgccgctcagggcaggatccgcagcgaggccacccggggccacggctgctccgggttctcgtcgcgcacgcccggcgcgacgccgccggaggcgcggcccgcgtcatatgaggacgccgaccggatgaccgtgaccgtaccgtccaaggtgacggtgacggccgcgg

SEQ ID NO: 2514 - DNA, 526 bp, Unknown
  Kingdom: Bacteria, Phylum: Actinobacteria, Class: Actinobacteria, Order: Streptomycetales, Family: Streptomycetaceae, Genus: Streptomyces
gccgcgtcgcgcagggccaggggcaccaccagcagcgtatgggagtccgaggaccgcatggcgcgcgtgcgcggcgggtcggcgggcatccacggcgctgtggtgcgcagcgggaccacgcgggggcgcaggtcggtcagggcctggctgaagggcgtgggggacggcagccgccgcacgtcaccgaccgggtgcgcctgcggcgggtgcgtggtgccgctgcggaaggcggtgcgcatcagcggtgtgcccggcggcagcggggccggcgggggatcgtcgccccggatcaccgattccaccacctccacgaccgcgatgtccgcgaacgccgggaccaaggccgcgaccagctcctcaccggccaccaccgggtccagagtccgccccaccctccgccgtacggcgtcgaggaccctgctgcgggctcgtccccgttcgcgctcggtgacgtcgaccgcggtgaccgcgacacccagcacctccccgtcgcggccctccagccgcacggcggtcgtctcgaaac

SEQ ID NO: 2515 - DNA, 752 bp, Unknown
  Kingdom: Bacteria, Phylum: Actinobacteria, Class: Actinobacteria, Order: Streptomycetales, Family: Streptomycetaceae, Genus: Streptomyces
agctcgcccgccgcgcacgcggcgaccgagctggtgcagcggccgttcgaaggcctgcccggtgagtgcgactgggtcgcgctgcgcgagctggttccggcggccacggccgagctgacgctcaaggacggtctgcccgagggcgttccctcggtccggctcgccaccgtgctgccgatggcctggcccgcgctgcgccgcgacgacggctcggtgctcgtcggcctgcagaacgacacggcgtccggcgacatcagccgcgacctcgccgacaccctgctgcgcgcccttcaggccgagcccggcaacccggtgcagggccgccgcgccccggcggacggaccccgcctgcaggacctgctcgacctgacggccgccttcgagccggtggtgcacgagggcttcgagttctgggtcccggacgcggagaacgcgacggcggaggtcaccgcctccctggagcgggccaacgccgcggccatcccgaccgtgcgcctgcagggcgtcgaggcggcgtactggtgcgagaccccggacaagaaccacctgcgctgggtcatgccgcacccggaggagcagctgctggacgctctcgcgcggctgcacgcggcgggcacctccagcctcggcgagggcacccgtctggtcggctccttccgcgcccacggcctcacggtgcccgtgtgggacctgcccagcggattcggcgcccaggacgcggagaagccggccgccgagttcgccgagcggct

SEQ ID NO: 2516 - DNA, 1094 bp, Unknown
  Kingdom: Bacteria, Phylum: Actinobacteria, Class: Actinobacteria, Order: Streptomycetales, Family: Streptomycetaceae, Genus: Streptomyces
gcccgcccagcgggtgcgggcgtggatggtggtgatcgaggccgccgggcaggccctgggcgacgtcgacgcggtcttcccgcaggcgctcgccgacgcgggcgacgaccccgggctgctcgcgcaggtccactaccagctggcctggcgcggactggtcgtcgagggcgacttcggcgtggcccgcgaggaggccgcgcacgccgccgagctggccgcgcgcggcggggaccggcgtaccgagctgatggcactggcgttccgggcctccaccgagaccctgatgggccaccccgacgcgcccgccaccatcaagcgcgcgatgaaggagccccaggacccctacgtcgcctgccaccacaacggcgtcggctcggcccgctaccgctggctgctgatgagcgaccagctcggcgaggcacgcgcgaccatcaccgcgctgctgcgcgaggtgcggcggcgcggcatggtcgagagcgaggtgcactacctgcggctgctcgccgagaccgaactgcgcgccgggcactgcgggcgcgcgctggacctggcccgcgagagcctgcggctggcccgggacaccgggatcggcgagggcgcctcggccatgctggcctgcttcgcggaggcatcaggcggcgacaccgagcgggcgctcgcgctcgccggtgaggcggtccggctcgccgaggaggacggcgaccagatgtacctctcgcgcgccctggcggccctcgggtacgcgcagttcgtgtccggggacgcaccggccaccgtggcgacgctgcgccgggtgcgggagctggagctgggcctcggcatcaccgacccggcacgtggccgctggcacggcgacctggcggaagcgctggtgctcgtcggcgagccggacgaggcgcagcaggtcatcgacacggcccgcgagcacgcgctgcggctgggccgcgagagcgtgctggccgtactggaccgcgccgaggccctggtgcgggcggcccgcgacgacaccgaggccgccgtcgcccggctgacgtccgcgcaggaccggctggcgaagctcggcaacggcctggaggaggcgcgggccgccttcg

SEQ ID NO: 2517 - DNA, 594 bp, Unknown
  Kingdom: Bacteria, Phylum: Actinobacteria, Class: Actinobacteria, Order: Streptomycetales, Family: Streptomycetaceae, Genus: Streptomyces
gtgcgcagtggggctcgagcggggcgaggacgccgtgcacgatgcggaacggctccaccgcctcgtcgagtccgtccagcaccacggtcaccgggtcgcccggctcgctgaggtacgcgtcgaggagcgcggtccaccgttccaccgggtcgtccgtcgggccgggcgggctcggctcgatgcccagccccaggagcagcgccctgaggacgtccgcggcggagtgccggcgcgcgaggacggcgacggacacggcttccggcgccgggacggtccccggcggtgccgagccgacggcgtcgcggtagcgcggatgggcgcggaagagcgggtcgctgagcgtcaccgcccggcccagcaccgccgacttcccgctgcccgccgtgccggtcagcagcaggacaccgcccggccggcccaggaagtcggtcagttcccggttgagccggcgccgcccgctgaagtaccagcccgggtcgtcctcctggggccgtccgctggcccgggcgagccatacgtcgatgtcgtccgcgggcgtggcgacctggcggcgtgccggtgcgacgacctcgcggggcggccggtagcccgggt

SEQ ID NO: 2518 - DNA, 497 bp, Unknown
  Kingdom: Bacteria, Phylum: Actinobacteria, Class: Actinobacteria, Order: Streptomycetales, Family: Streptomycetaceae, Genus: Streptomyces
gtcggggacgtcggcccggctcgccgccgagcgcacggcaccggaggacctggcgccgctgcaccgctccgccgaggaactggtgtccgcgcccggtgcggcggcgcgcagccgggtgtacggccgtttccacgtcgaactggcggccgcggcgcagtccgcgcggctcacgcgcgagcaggtggcgctccagcgggaggtcggtgcgctgctgtgcctcgtgtgggacgacgccgcatatcgtgaagaagtcgcggaacggcagcgcggcctcctccgtgccgtgcaggatggcgccggtgaggcggcccgcgcgtcggccgagcggtgcgtccaggaggcggcggcgcggctggtcgccgtacggctggctctgtaggagcgctgtccggggccgcccgtctccggtttcgtccggtggagggcgcgatgagcaggagtccgggactcgccgtggcggcggcgacccgctcctcggcacggctgccgtcggccgc

SEQ ID NO: 2519 - DNA, 1383 bp, Unknown
  Kingdom: Bacteria, Phylum: Actinobacteria, Class: Actinobacteria, Order: Streptomycetales, Family: Streptomycetaceae, Genus: Streptomyces
gcccggcacgtcgttcgccgccctgcgcgaggagcaactggaccggctcggcgacctgatcgaggagcacgccgacacggacgcgctgtggcggctcatcgagtcgggtgcaccgcgggggctgccgttcatcccgccgggggcaccggtatgagcgccgggcgggggccgcgggccaggccgggcgtgggtacgcctgagccgccgcgggcgatttttgtggaacttgagggcgacttggagggcgtggagaagtgagtaccccgtttccgttcacggccgtcgtgggtcaggacgacctgcggctggcgctgctgctgaacgccgtctcccctgcggtcggcggggtgctggtgcgcggtgagaagggcaccgcgaagtccaccgccgtgcgggcgctgtcggcgctgctgcccgcggtggacgtcgtcgccggctgccgtttctcctgcgacccggactcccccgaccccgcctgcccggacgggccgcacgagccgggggcgttcgagacgcgggcggcgcgcatggtcgagctgcccgtcggggcgtccgaggaccggctggtcggcgcactggacatcgagcgggcgctggcggagggcgtgaaggcgttcgagccggggctgctcgccgacgcccaccggggcatcctctacgtcgacgaggtcaacctcctccacgaccacctcgtcgacctgctgctggacgccgccgccatgggtgcctcctacgtcgagcgcgagggcgtctccgtacggcatgccgcgcggttcctgctcgtggggaccatgaaccccgaagagggcgagctgcgcccgcagttgctcgaccggttcgggctgaccgtggaggtggccgcctcgcgggagccggagcagcgggtggaggtcgtgcgcaggcggctggcgtacgacgacgatccggccgcgttcgccgcgcgctgggccgaggaggaggccgacctacacgcccggatcgtggccgcgcgggagctgctgccgcaggtgcggctcggtgaccgggcgctcacgcagatcgcggcgacctgcgccgccttcgaggtggacggcatgcgggccgacatcgtgatggcgcgtacggcgaccgcgctggccgcgtgggccgggcgcaccgacgtgctcgccgaggacgtacggcaggcggctctgctcgcgctgccgcaccggcggcggcgcaatccgttcgacgcgccggggctcgacgaggacagactcgacgagacccttcgggagttcggcggcggaccggaggacggcgacgaacttcccgaggacgatcccgaccccggcccggacgggcccggtgggggcggcgggcagcccgggcccgacggcgacggcggtgcaccgcagggagggg

SEQ ID NO: 2520 - DNA, 885 bp, Unknown
  Kingdom: Bacteria, Phylum: Actinobacteria, Class: Actinobacteria, Order: Streptomycetales, Family: Streptomycetaceae, Genus: Streptomyces
gtgcgcgggcgctgatcgtcaccgatcgcgcgcagaacccgaccggcgcggcgctgagcgccccgcgcgcgcgtgccctgcgggccgtgctggccaggcatcccgagaccctgctcatcgaggacgaccacggccacggcatcgtcgaccttcccctgcacccgctcgccggaaccacccggcactgggccttcgtccggtcggtcgccaaggcctacgggcccgacctgcgcctcgcggtgctcaccggggacgaggtcaccgtcgaccgcgtgcgcgggcggcagcggctcgggcccggctgggtcagcctgctggtgcagcgggccgtggtgcggctgtggacggacggcacgctggacacccgggcggtggcggcggagtacagccgtcggcgcgaactgctcatcggcgcgctggcggagcgcggtgtggccgcgcacgggcgcagcgggatgaacgtgtgggtgcccgtgccggacgagacgggtgccgtcgcgcggctgctgcacgcgggctgggccgtcgccccgggcgcccgcttccggatgcacgagcctccgggcgtccggatcaccgtctcgacgctgcgggagggcgagaccgagcggctggcggacgcggtggcggcggccctgggaccggtcccggcgcgaagttacgtctgagggacggggctgcgccattctgaggggcggggctgggcctttcgggcccgcctcgactctccggtcccgcctcatcctctcgggggcccgcccggcgtgcggctactgcttcgctgccgccgtcttcctcgcggcggtcgccggggtctccgggccggggccggccgcctgttccgcggtgacggagcccgccgcgcggggctgccgggtgtgggat

SEQ ID NO: 2521 - DNA, 575 bp, Unknown
  Kingdom: Bacteria, Phylum: Actinobacteria, Class: Actinobacteria, Order: Streptomycetales, Family: Streptomycetaceae, Genus: Streptomyces
ctgagactggccgcggccggtctcagtgcgcggtcaggtgctccgggccgggcgaccggggcctttgcacaggcacgggaacggccatgggcggcagcggcacgggcagcggcaccagcagtggctcccgggaggcgccttccggctccagggccaggacagcggccacggggtgcgcctcgtggccgtcgtcctgtgcgggcccgggagcgggtacggacgcgggcaccgtctcctgctccacggtgtgtccgggcaccgtctccgggtgcgcgggcgctccttgcgccggatgcggcgcggcccgcgacagttcgacgacgccccaggcggcgaacgccgcacccgcgagcgcgagcagtacaccccgtacgccgccctgcagcccctggcccagcagggtcagaccgatcagcgcggcggccaccgggttcgtcagcgtcaccaccgcgagcggtgcgcccaggccgcctcggtaggcggtctgcgagagcagcagcccgcccgtcgcgaacgccgcgaccagcagcgccacgacgatcacgcgggcgctcagcaacggcccggtgtggtcc

SEQ ID NO: 2522 - DNA, 875 bp, Unknown
  Kingdom: Bacteria, Phylum: Actinobacteria, Class: Actinobacteria, Order: Streptomycetales, Family: Streptomycetaceae, Genus: Streptomyces
cggccatgctgcgcggccggggttcaggaagcgacggctccaccgggctcggcctggacatcgtgcgccgcctcgcggaggcgaccggcggcgacgtccgcatcggctcctccgtcctcggcggcacggagatacgcgtctggatacaactggacggccgccgcccggagcgcaggggccaccgcggcacggtccgccgccgccggcgcacggcggtgggcggcgcgaatcgttaaccggccccgatgccttccttaagcgcaccctaagaaccccgactgccgtccggatcaagctgattgcccggttccggatcgctagcgtgctgccgcaccccacaccaccggggcggtccgcggacctccgggcccgcgggacgccaggcccaggggacttccgagtcccggatcccggatccccctgaacagcgaaggcaggcaggcacgatgagcacgcaccggcgcaggatcagcggcaggaacaaggcgataggcggcgtggtggcggcggccgtggtcggcggcggggtgttcgtgttcaccgccaccgcgcaggccgccgggaccgctgccgcgtacacgaggaccagcgcctggtcgacgggctacaccgcgcagtacgtcgtcaccaacaacagcggcgggaccgagaaggactggaccctggagttcgaccttccgtcgggcacgaagctgggctccctgtggaacggggaggccggtgtcagcgggcagcacgtcaccgtgaagcccgcgaagtgggacaccgccgggctcgcccccggcaagtccgtcaccgtcggcttcgtcgtcgacggcaccggcgccccgaccggctgccgcatcgacggtgccgtcgacgacgaagccgacggt

SEQ ID NO: 2523 - DNA, 543 bp, Unknown
  Kingdom: Bacteria, Phylum: Actinobacteria, Class: Actinobacteria, Order: Streptomycetales, Family: Streptomycetaceae, Genus: Streptomyces
gtggagccggccggggccggcggactcggcggagggctctccggcgggctcggtgggactctcggcggcggtctcgtcggggagggtctcgggggcgcgctcggcggcggtctcgtcgtcgatggtctcggaggtgcgctccgcggcggtgtcggcggtgccggcggggctctcggtggggcgctcggtggtcgggtgcgcaggggtgcccggagtggtgaacgtgccggtggccgggtgggcggcggtggtgtcgagggtcgccgtggtggtggccgtgccggtctcggtctcggtccggggcgtggtctcgggggcggtggccggggctgtggggctgctgtgtgggggcagtgtgggcgcagtcatgacgcttccgatcctgccacgtggcggcggacgggcgtgtgacccggcgcgggccgtttcgtcaccgacggtcgccggcccgtcaccggcccggcaaggcgggtcgacggcagggccgttgccggaatgatgatccggaaaagttgtactcggcgcggcgggtggggcgggggc

SEQ ID NO: 2524 - DNA, 728 bp, Unknown
  Kingdom: Bacteria, Phylum: Actinobacteria, Class: Actinobacteria, Order: Streptomycetales, Family: Streptomycetaceae, Genus: Streptomyces
gggcaccggggcgtgccgacgacccgggcggtgccggcggcccgggaatctcaccccgcagccgccagtgcccgcatcgcgcgccgtgccacctcccgtccgatcggcagtgaggccgtcgccgccggggacggtgcgttgagcacgtgcacggtccgcgccccctcccggatcaggaagtcgtccaccagtgtcccgtcccgcaggacggcctgcgcccgcactcccgcgggcgcaggcaccaggtcgccctcctcgacgcagggcagcagcctgcgcaccgcatccgtgaacgccgccttggacacggaccgccgcagctccccggccccgtagcgccagtgctgccgggcgatccgccacgagccgggccagctcagcgtccccgccagctcgcgggggcgcaccacgccccagccgtacccctcgcgggccagcgcgggcaccgcgttcggcccgatgtgcacaccgccgtcgatcccgcgcgtgaggtgcacgccgaggaacgggaacgccggatccggcaccggatacaccagtgaccgcaccagctccggccgcgccagctcgtagtactccccgcggaaggggacgatccgcacctccggctcgtccccggtcagccgcgccacctcgtcgcagtgcagcccggcgcagttgaccagcacgcgcgcgcgtacgacgtcgccgcgggccgtccggacggccacacccagctcggggcgccg

SEQ ID NO: 2525 - DNA, 922 bp, Unknown
  Kingdom: Bacteria, Phylum: Actinobacteria, Class: Actinobacteria, Order: Streptomycetales, Family: Streptomycetaceae, Genus: Streptomyces
cccgcccgtcacgctggacgacgtgcggggcgcccagaagatgctctcgggcgtggcgcgggtgaccgcgatggagagcagcaggcacctgtccgagctggcgggcgcgccggtcctcctcaagtgcgagaacctccagcgcaccggctccttcaagctgcgcggcgcctacgtgcggatcgccggcctgctgccggaggagcgcgccgcgggcgtggtggccgcgagcgcgggcaaccacgcgcagggcgtcgcgctggcgtcggcgctgctcggagtgcacgccacggtgttcatgcccaagggcgccccgctgccgaagatcagtgcgaccgagggatacggcgcccaggtgcgcctgcacggccaggtggtcgacgagacgctggccgccgcgcaggagtacgcggccgagaccggcgcggtgttcatccaccccttcgaccactcggacgtgatcgcggggcagggcacggtcggactggagatcctggagcagtgcccgcaggtgcgcacgatcgtcgtcggcatcggcggcggcgggctcgcggccgggatcgcggtggccgtgaagacgctgcgccctgacgtgcggatcatcggggtgcaggcggcgggctcggcggcgtacccgccctccctggcggccgggcggccggtggcgatcgggaacccgacgaccatggccgacggcatcagggtcggccggccgggcgacgtgccgttccggatcgtctccgaactggtggacgaggtgcgcacggtcggcgaggaccagctgtccgccgcgctgctgctcctgctggaacgggccaagctcgtggtggagccggccggggccactccggtggcggcgctgctcggcgcgggcggggacggcggcgccggggcgggcatcgaggggccggtcgtggcggtgctc

SEQ ID NO: 2526 - DNA, 847 bp, Unknown
  Kingdom: Bacteria, Phylum: Actinobacteria, Class: Actinobacteria, Order: Streptomycetales, Family: Streptomycetaceae, Genus: Streptomyces
gcgggcggccccacggacggcgggccggacggacggtcaggcgggccggacgggcaggcgggccggacaggggctctgccggggaattaccggcatgagcggacacgggcggacctccgtccgtaggctcggcactcatggcggcgaccgacgacgggacccagcaccgcggaccacgcctgcggcggtggtgcgccgggctgctgttcgcctcggtgagcgtcgtcgtcggttgccggaccgccggctccgacggcatcacaccggtgccgcaactgctcgccttcctgccctggctgctcgtgccgaccggcctgggactgctgctcaccctgctcgcccggtggtggacgggcgccgtgtggggggtcgcggtcctcggtctgctggcgtggttcatcgagccgtacggcagggtcgccgagcccgtcggcctcatcgccgccgatctgcgggtcctcacctccaacgtggagttcgggcgcggcacggcgtccctggtcccggtgatccgccgggagagaccggccgtcgtcttcgtcgaggagtgcgagtccacctgccgggcgcggctgtggcgcgacgtcggcgccgactatccgtaccgccgggccgtggccgcggccggttccaagggttcggtcatcctgagcaagtacgtcctccggggcacctccggggtacgcggcacgatgggcatgccgggcgcggtcgccgacgtccgcggtcacgccgtacgcctccagctggcccatccgatgcccccgctgccccgccaggtcgcgctctggcaccgcgaactggcccggctgcgcgcctacgccgccgccggcaccgggacgcccac

SEQ ID NO: 2527 - DNA, 772 bp, Unknown
  Kingdom: Bacteria, Phylum: Actinobacteria, Class: Actinobacteria, Order: Streptomycetales, Family: Streptomycetaceae, Genus: Streptomyces
aacccgccccccgacccccgccgcgcggtgctgaaggcaccgtcggtgtaggcccagcggcggcgagaaggtagcgtgcgtagcgcgccgtggcgaacgttctcggccgcgcgccttacgtgcataccgcagaatggatgacgtaggtgcgcccgagcgcgatcgggcgcggacgtcgacgcggtccagggtccgctccgtccgccccgccgccttcaggccggcgcacccgtcagacggcgtaggagagaagcgatacctgtgagcgcagcgaccacgcgaagccgcacccccgaccgcctgtgcgccgaggcggtcgacctcgcccgggccgcagccgaggaggcggccgcccccggcgtcgtcggcgagcacgcgggcctgatgtccgagggcgaccgcgtcgtcacccacttcttcgagtgcaaggaactgggctaccgcggctggcgctgggcggtgaccgtgacccgggcctcccgcgcgaagatcgtcaccctggacgaggccgtcctgctgcccggccccgacgcgctgctcgctcccgagtgggtgccctggagcgagcggctgcgtcccggcgacatgggccccggcgacctgctgccgaccgacgccgaggacctgcgtctggagcccggtttctccggcgaggacgagcccgcgccgaactcaccggtctcccaggagatggcggaactggcggaggcggaggacgccgacgtcaccgcgggcccgccgcgcaacctgcccacggcgccctcgcgcggct

SEQ ID NO: 2528 - DNA, 755 bp, Unknown
  Kingdom: Bacteria, Phylum: Actinobacteria, Class: Actinobacteria, Order: Streptomycetales, Family: Streptomycetaceae, Genus: Streptomyces
ggaccgtgcggggcccgcgtgggggcggggcggcgcgcgtcggcccgtccggcgcgggtacccggccgggcggacacggtcaccgggccggggaggtccccggacccggtacggacgcgaggaggcgcaggtgactcgtgaggaggcccgggtggctgcggacgagcggctgcgggagtaccggggcaagcgcgacttcgtgcggacccgggagccggcggggcagcgggccggtgcgggggccggtccccggttcgtggtgcagatccacgacgcgcgccggatgcacttcgacttccggctacaggtgggcgacgtgctgaggtcctggtcggtgcccaagggcccgtccggcgacccgcacgacaaacggctcgcggtgcccacggaggaccatccgctggagtacgaggacttcgagggcgtgatcccgaagggcgagtacggcggcggcacggtggtcgtgtgggaccggggcacgtacgaaccgctgagccacgaccgcagggggcggcccgtggacttcgccgagtcgctggagcgcgggcacgccacgttccggctgcacggctccaagctgcacggcgagtacgccctcacccgcttccgggacgagggcggggaggaagcctggctgctggtgaagaaggccgagggccgtgccacgggcgggcacggcacacccgacccgcaccgcgcccgctcggtgcgcaccggccgcacgctggcacaggtcgccgcggagggcggcgagg

SEQ ID NO: 2529 - DNA, 486 bp, Unknown
  Kingdom: Bacteria, Phylum: Actinobacteria, Class: Actinobacteria, Order: Streptomycetales, Family: Streptomycetaceae, Genus: Streptomyces
gtgcgggcagtgggggcggggcggtgttctcctcggtcgccttcgacctcgtcgtccccaacctgtgggcgccgctgctcaccgggcagcgggtgctgctgctgccgcaggacctcgacctgtccgagctgggggagcggctcacggcgcacgccccgttcagcttcctcaagctcacaccggggcacctcgacgtcctcacccggcagctgagcccccggcaggccgccgccctgacgccggtcgtggtcgtcgcgggcgaggcgttgcagggcgaactcgccgaccggtggtccgcgctgagcggctcgacgcgtctcgtcaacgagtacgggccgaccgaggcgtccgtcggcaccagcgtccacccggtgccgggtgccgcgggtcccggcgtcgtcccgatcggccggccgggacgggccgcagccgttcgtcgaggacccgcatggtcatgccgggcagcggccggccgatcgggacgac

SEQ ID NO: 2530 - DNA, 590 bp, Unknown
  Kingdom: Bacteria, Phylum: Actinobacteria, Class: Actinobacteria, Order: Streptomycetales, Family: Streptomycetaceae, Genus: Streptomyces
ctgccactacgacgggagccgcgcctacgcggatgaccggtggcggggacggctgcgcacctggagcggctgccccggcggaagccttctcaccgaggccgcgctggtccccgcgggcgccgcccggcagccccaggtgtacgtgcagatccggcagcgcgacggcgacgacgcgaccgaccgcatactccgctccctgcgggtcacctgacccccctacgagtgaacgtgacgcgagccgggaacgggaagaacgcttcgggaggaattcccgggatccgcgaactttccgcccggtccgcgcatcggacctcatgccggcgcacctggcgccgggacgcacgccccgagcgcgtgcgagaaacgacgaggagcgtggaacatggcgcacacgtccccttcccaccgccgcgcggccctgctcgcgggttcggcggccgtactgggtctgctgacggcctgcggcagcgccgacggcacgtcggccggtccgcagaaggtgccgggcaccgccgcgcccgcgaccggcggcagcacgaccggagcggcgcccgccacgagcggcacgcccggcggcgagacacccgccc

SEQ ID NO: 2531 - DNA, 513 bp, Unknown
  Kingdom: Bacteria, Phylum: Actinobacteria, Class: Actinobacteria, Order: Streptomycetales, Family: Streptomycetaceae, Genus: Streptomyces
gtcctcggcctgcccgaggacgcgtacgtggtcggcggcatcggacggctcaccgcgggcaagcggttcgacgtggttgtccgggcgctggcccgcctgccccgcgaccactggctgctgctggtgggcggcgggcccgaggagagcgtgctgcggcgcaccgcgcacgaggccggggtggccgaccgggtcctgttcgccggcgaacgcccctgtgcgcccgacggctcgcccggccccgacctgccctcgctggccgccgcgatggacgtgctcgcctcaccctcgacgcaggaggcgttcggcctggcggtggtggaggccctggcggccgggctgcccgtgctgtacgcctcctgcccggccgtggaggacctgcccgccgacgccgccgccggcgcccggcgcgtccagggcggcccggaggcgtacgcccgcgcgatcaccgaagtacgtgccgccggtccgcacccgcgcacgcccccggcggcggcccgccactacagcatcgcc

SEQ ID NO: 2532 - DNA, 927 bp, Unknown
  Kingdom: Bacteria, Phylum: Actinobacteria, Class: Actinobacteria, Order: Streptomycetales, Family: Streptomycetaceae, Genus: Streptomyces
gccacggcccgggagctcttcaacgcgttgatcgtccgctcggcttcgttcctgcgcttgtagatcgtcttgtcgaagcctgcgggtcggccgcccttgcttgcccctacgttgggacccgcccgacgcgggtccgctcgtgcgagggggcgcgggcgggggcccgggggaggcgtcggagtgggcgacccggacctgttcgtggtgtcgtcgacggtactgcccgggctgtcgtgcgacgcccgcgccgctggagccggccgcgcgtccgggggtggggacggcggtacggcccgcatgacgggcggcggtgcggacgggtccggggcggtgttccggctggtgcaccaggtggcctcggcggcgtacgagtaccgtctggccggccgggggagcgtggcgcgggacccccctgatttccctggtggacgacagcaccccgatactgcagtacatgcggtacgcggtggacctgctgccgcccgacgagaggacccccacggtggaaggcgatacacggtgacgaccgtcgcatatcagggtgagcgcggctcgaactcggcgaccgccgcccgcgcgctgttcccggacggcagcgagctgccctgcacgggtttcgagcaggcgctggacgcggtgacgctgggcacggccgatgtggcggtgatcccggtcgacaactccgccgcgggccgggtggcggacgtgcaccacctgctgccggaatcggggctgttcatcgtcggcgagtacttcctggccatccggttcgacctgatgggcgtccccggcgcctccctcgatcaggtggagtgcgtgcgcagccatgtgcacgcgctcgggcagtgccgcaagctgctgcgcgagggcggctggcgcacgctcgtcagcgacgacacggcgggttcggcgcgtgaggtggccgag

SEQ ID NO: 2533 - DNA, 595 bp, Unknown
  Kingdom: Bacteria, Phylum: Actinobacteria, Class: Actinobacteria, Order: Streptomycetales, Family: Streptomycetaceae, Genus: Streptomyces
tgacgtccgccaagcacggcgaggcgcgggcggcttgcgccctcggcttcctgctgcgcgacgccgtgcttggcggacgtcaggtaccagcggccggcctccttcaactcgccccgcttctccaggatcgcgccgaggtgcagcgcggcgcgccggtgcccgcgggcggctgcctggcggtaccactgctcggcctccgccggcgggcccgcaccgctgtccacggcggccccctgcccggcgcgccggtccagtgcccgcgccaggcggtacgcagcctcccggtgcccccgctcggcggcgacgcgcatccagcgctcggctcccgcgtcggcacggtgttcgagcaggtcggcgagtgcgtaggcgcccaggacgtggccctgctcggcggactggcgcagccagtactcggcggcgggctcgtcgccgcgctcgcggtggtggcgtccgagcgcgtgcgcggccggggcggagccggcgacggcggcgatacgccaccagccggccgcctcgtcggcgtatccgcgctgctggaggaggactcccaggttgttggccgccgcgcggtcgccggccgcggtggcggcgcgca

SEQ ID NO: 2534 - DNA, 652 bp, Unknown
  Kingdom: Bacteria, Phylum: Actinobacteria, Class: Actinobacteria, Order: Streptomycetales, Family: Streptomycetaceae, Genus: Streptomyces
gacgacgcgcgtgccgtgctggccgcccgtcccgcggtggggctggaggcgctgagccggaccgtgggtgcctcaccgcaccacctgagccgggtcttcaccgccgtcaccggcagtacgctctgcgcccaccgcgaccggctgcgcctggcccggctcctggaccgcctcagcgagggtgaacgcgacctggccgggctggcccgggagctgggctacaccgaccagtcgcacatgacccgtgcggtccgccgatcgatcgggctgcctcccgggcgcctgcgcaccctgctgacgtcaccggccaccgcggccgaagcgggcgcggatgccgtcacggacacgcgtgccgcccgccgcggacgccgtcaggaagactgacagggggagccgccagcgaggggtgtacgtacggccggtgcatccctcccgtggcgtacccgtcgtaccgtcgaggttgtgggcaaccgtgaagaggtccgcgagtccctcacctcgcggcgaacgaagatcacctccgggcggaccggcccgccctcgggcggcgggtggcgcgcgttccggcctcggcgccgcacgaaccggccatcacccttgcaccgcggcctgcggcggaccccgggcgcggtcccggtgcaagggtgatggccgg

SEQ ID NO: 2535 - DNA, 888 bp, Unknown
  Kingdom: Bacteria, Phylum: Actinobacteria, Class: Actinobacteria, Order: Streptomycetales, Family: Streptomycetaceae, Genus: Streptomyces
cgtcgtgttcctggccggccaccttgccgtcctggtcgagcgcggtctggccggccaggaacacgacgcgggagccggtggcgacgacggcgtgcgagaagccggtgggcggggagaggtcgggcgggttgacgcgctggacggtcacaggtcctccccggtcggttgccgagcgtacaactccttggcgatgatggtgcgttggacctcgctggcgccctcgtagatccttggtgcgcgcacctcgcggtagaggtgttcgaggaggtggccccggcacagggcgcgggcgccgtgcagctggacggcgctgtcgacgacgtactgcgcggtctcggtggcgaggagtttggccatggcggagcgccggggcacgtccggcgagccggcgtcgtacgcgctcgccgccgcgtgcaccatcaggcgggccgcctccgtgcgcagggccatctcggccacctggtgggcgacggcctggaggtcgctcagcgtgccgccgaaggcgtcgcggcgcgcggtgtgggcgacggtggcgtccagcgccgcctgcgccatgccgacggcgaaggcgccgacgctggggcggaacaggttgagggtgcccatcgcgacccggaatccgcggtccacctcgccgagcacgtcgtcctcggtgacgggtacgccgtcgaagtcgagggtgccgatggggtgcggggagagcatctccagggcgctgccggtgaggccggggcggtcggcggggaccaggaacgcggtcacgccccgggcgccggcgccgggggtggtgcgcgcgaagacggtgtagaggtccgcctcgggggcgttggagatccagcacttcgcaccggtgagccgccagcgccggagccctccgggcggagcgca

SEQ ID NO: 2536 - DNA, 994 bp, Unknown
  Kingdom: Bacteria, Phylum: Actinobacteria, Class: Actinobacteria, Order: Streptomycetales, Family: Streptomycetaceae, Genus: Streptomyces
cggcggcgagcgcggcgagcagcgcggccttgccgccgggcccggcgcagccgtccagccacttggtgtcggggccttcgacgggcgcgttggccagggcgagggcgacgagctggctgccctcgtcctgcacgcccgcgcgtccctcccgtacggcgtccaccgcgcccggctcgccgccctcggtgagccgtaccgcgtacggcgaccagcggcccggcaccgcggcctcctcccgcagcagctcctcggtggtggcccgcccgggccgggccaccaaggtcacctcgggccgctcgttgtcggcgtccaggaggtcctcgatgccggcgcgtccgccgccgagcgagtcccacagggcggagacgacccagcgcgggtgggagtggacgacggcgaggtggtcctcggggtcctcgtcgtagggcggggcgaccttctccagccaggtgtcgagatcgtgctgggcgaccttgcgcagcaccgcgttgacgaacttggcccgcccgtcgccgagcacgacccgggccagctcgaccgtggcggagacggcggcgtggctcgggatgcgggtgccgagcagctggtgggcgccgaggccgaggacgtcgaggacgggcgggtcgacctccctgagcggccggtccacgcaggcggcgatgatcgcgtcgtacgtcccctgccggcggagcgtgccgtagaccagctcggtggcgagcgccgcgtcccgcccgtcgaactcgcccttctcccgtgccttgcgcagcagcggcggcagcacgaggttggcgtacgcgtcccgttcgtccacggcgcgcagcgcgtcgaaggcgaggatgcggacggggtccttctggggccggcggtagggcttggcgggcttgcggggccgacgaggggtgtcgctcacgaaaaggtgctccggatgtctgggggcgccgcgcacggacgcgccgggcagggcccggcgcgggtgcgggcggcccggatgcgc

SEQ ID NO: 2537 - DNA, 721 bp, Unknown
  Kingdom: Bacteria, Phylum: Actinobacteria, Class: Actinobacteria, Order: Streptomycetales, Family: Streptomycetaceae, Genus: Streptomyces
ggtctctaccgtgccgcgcagcgcggcacgctggtcggcggggacttcttcgacgtgcgccgcgggccgcggggcgtccgggcggtcatgggtgacgtgcagggccacgggctggcggcggtgtccacggtcgccgcgctgctgggcagtttccgggaggcggtgctggaccggccgggtctgacggagatcgtggcggcgctggaccgccggctggtggtggactcggcggaggtgcggcacgcggagctgttcgcgacggccgtcctgctggagttctccggcgacgcgcggtcggtgcgggtggtgacgtgcggccatcccccgccgatcctgttgcgggacgggtccgcgaccgagatcgccgcgccgccctggacgccgctgggcctcgggctctccgacgggctcccggcgctggacgggcacatcgagccgctgcgccccggcgacgtgctgttcctggcctcggacggcgtcaccgaggcacggaacgccgacggtacgttctatccgctccttgaccggctgccccggctcgccgaccacgagccggccgtcctcgccgaccacgtgctggccgatctcctcacccactgcgggacgatccgcgacgacgtgacgatgctcgtcctcacgccgtgcccgtcggacggcacgcaggtgagcggggcgggctgaggcccgcgggccggcggtcccggtggtgccgccgctcagc

SEQ ID NO: 2538 - DNA, 579 bp, Unknown
  Kingdom: Bacteria, Phylum: Actinobacteria, Class: Actinobacteria, Order: Streptomycetales, Family: Streptomycetaceae, Genus: Streptomyces
ggcgagctgtacgtcggcggccagggcctggcccgcgggtatgccgggaacccggcgcagaccgcggcggccttcctgcccgacccgtacgggggccccggcgcccgcctctaccgcaccggcgacctggcccgcgtcctggccgacggcacggtcgacttccgcggccgcgccgacgaccaggtcaagatccgcggctaccgcgtcgagcccggtgagatcgaggccgccctcgtcagccacccggcggtccgcgaggtccgcgtcaccgtccacgcgtcggccgccggcaagcagctcgtcgcctacgtcgtaccggagggtgaactgccgccgcacgcccacctggaggcccacgccgccgaccggctgccgccctacctgctgcccgccgcctacctggccctggaggcgatcccgctcaccgccaacggcaagctcgacacccgcgccctgcccgcaccggacaccaccgccctcgccgccgcctcgtacgtcgcgccgcgcacccccgccgaggaacgcatggcggccgtctgggcggggcacctgggcgtggagcgggtcggcgtccacgac

SEQ ID NO: 2539 - DNA, 535 bp, Unknown
  Kingdom: Bacteria, Phylum: Actinobacteria, Class: Actinobacteria, Order: Streptomycetales, Family: Streptomycetaceae, Genus: Streptomyces
gacccggccggtcgggctcgctgtggccgccgcggtgtggacagcggccctcgcctcgctcgtccgggagcggcgcggttcccccgtccgggagcggcccgcaccgaacgcacccgccgccatgcgctcctcccccgcgcttccgaccaccgggccgcggagcccgggaagccgtctcctcggcatgctgctcgccccgctcggcgccgccggctacgtcctgtgggtcggccaccgcaccggcggcggcctcttcggctacctcgacgtccaggcgggctggcgcaacggcttggacggcggctacgccttcgcacgcttcgtcggcgacaagctcacctcgttcccctcggccctggccggggcggggctgatcatcggggtggcactggtggtctggctgtacgtcaccggcgtacggcagggccaaccgcccgcgctgctggtgtacacgggcgtcgtcacggcgctcgccctgtgcgcgtcgagctacttcggctccaagccgcgcctgctgctgcccgccttcccgctg

SEQ ID NO: 2540 - DNA, 1090 bp, Unknown
  Kingdom: Bacteria, Phylum: Actinobacteria, Class: Actinobacteria, Order: Streptomycetales, Family: Streptomycetaceae, Genus: Streptomyces
agctcgggtatccggccgtggaggagtccaaccacggccggatacccgagctgataccgatccgggtgggcaggatggcggccacgccgttcgccttcctgcggggtgcggcgggcctgatggcgtacgacctggcccgcacccccctgaccggcgtcgccgcccagatctgcggtgacgcccacgcggccaacttcggcctgtacggcgacgcccgcggcggcctcgtcatcgacctgaacgacttcgacgagacggtgcgcggcccctgggagtgggacctcaagcggctcgccgcctccctggtgctcgccggccgggaggcgggctgcgacgaggacagctgccgcgaggcggcccgggacgcggtgggcgcctaccggcgcaccatgcgtctgctggcccggctcccggtcctggacgcctggaacgccatcgccgacgaggaactcgtctcgcactccgacgcccacgacctgctcggcaccctggaacgggtctcggagaaggcgcgggccaacaccagcggccggttcgcggccaagtcgaccgagcggaccgaggacggcgggcggcggttcgtggacgccccgccggtgctgaggagggtgccggacgcggaggccgcggcggtggcggcgtcgctggagcactacctggccaccctctccgaggaccggcttccgctgctggcccggtacgcggtgcacgacgtcgcgttccgggtagtcggcaccggcagtgtgggcacgcggtcgtacgtggtgctgctgctggaccaccgcggtgagccgctggtgctccaggtgaaggaggcccggccgtcggcgctgctgccgcacctgccggtgctctccggggccggggggaccggtgccacaacggagggcgctggtgcgggggaggccaggggggccgaggcggcccacgagggccggcgcgtggtgctcgggcagaagcggatgcaggtggtgagcgacatcctgctcggctggaccactgtcggcgggcagtgcggccgggtcgacgctgcccttgcggttgcggaactgccgcacctggaagggccgcccgccgacagtggtccagc

SEQ ID NO: 2541 - DNA, 528 bp, Unknown
  Kingdom: Bacteria, Phylum: Actinobacteria, Class: Actinobacteria, Order: Streptomycetales, Family: Streptomycetaceae, Genus: Streptomyces
cgagcaccgcgcggacggcctgcggcggcacggtgacgcagtcgccgcggtcccagctgagcacgcgcagcgcgtgcagttcgggcagggactcctccagcgcgccgccgcccaccctcccgcgcgaggtggcgaaggccggccagcgcagcccttcggccgcctccccgccgagcagcacgtcgagtccgccgcccagcgggtcggcgtccacgagcagggtgcgcaagccctcccgcgcggaggtcacggcgagcgcacaggccagcgtggaggcccccgcgccgccgcgaccgccgaggacgcccacggtgagcgcgggacgtccgacgccctcggcgacgtcggcgatccggtcgaccagccactgctcaccgtcgggcagcaccagcacgtggtcggcgccgatctcgacggcgcgccgccagaccccggagtcgtcctggtcccggccgacgagcacgacgccccgtcggcgcagggctccccgcacccgtcgcgcggcgtcgtcgccgaccagcaccagcg

SEQ ID NO: 2542 - DNA, 698 bp, Unknown
  Kingdom: Bacteria, Phylum: Actinobacteria, Class: Actinobacteria, Order: Streptomycetales, Family: Streptomycetaceae, Genus: Streptomyces
gaccgcggccagcgcctcggccaggccgcggcggcgcagcagctccgttttgtgccgggcgtccgccgcgagctggtggcgcagccgggaccaggtttccgcgaagaacgcctcgtcgcagtcctggaggaactgccgcagccaggtcctgatgcgcggcgggtcggccaggaggcgctcactgaagcgcacctgctgcgggccgcgcgcggcggccagctccagggcacgacggcgcagccgcacgtcggccagcgggccggggcccggttcgctgtagggcagggcgcaggtgaactccagggcggcgtcgacgaactgctcgtcggacagcttgtcgagcaggtccagctcctcggcgagggactggcccggcagctctgtccggcccggcagaccggcgcagggcaggaagaggtcggagaacgtcgtccgccacaggaagtccgcctcgcacatccggtcggcgagatgcgagtcgagccgcgccgtcacgcccgtggcccagccctgcaggcccgggtggtgccccggctcggacagcgcgtgcagcgccatgcccagctcggccaggggcgagggcacggcggcggccctctccggccgcagccccgcgatgtcgatgcgcacgctcatgcccccatggtgcacggcgccactgacaacgccgctcccgattgacggccgccgtcaatcgg

SEQ ID NO: 2543 - DNA, 618 bp, Unknown
  Kingdom: Bacteria, Phylum: Actinobacteria, Class: Actinobacteria, Order: Streptomycetales, Family: Streptomycetaceae, Genus: Streptomyces
catgtggggcagagccagcccggccaggccgcgtatgccggcggccacgcacagaccggtggccagcgcgggcagggtgcgccgccacagcagggcggccagcgcgcccgcggcgagggcggccagggcgacggcgacggtggtgggcccgttggcgtgcagggtccaggtgtcggtccagcccttggcggtgtcgacccggccgcgcgccgccgaccaggcccggttgtgcagcagcaccagcagaccggtgcccacggcgaccagcgccgccgggacggccaggcgggtcgccagccagcgggtgggggtgaccccctgggcccaggcgagccgcgcggtgccgctctccagctcgcgcccgaacagggagccgccggcccaggcgccgaccaggagcgggagggcgttgagggcgagggtggtgtagttgtagacgtccttgtagcgcacgatcgcgtcctggtcgtacgagcagcgcggggacatgccgcaggcgtcgtactggcgccaggcgctctcggcggcgtcggcgagcgggccccacagccacagcaggccggcggcgaggacgacgacgatcccgccccacgtgtacagcgccgggcggtgcaggcg

SEQ ID NO: 2544 - DNA, 590 bp, Unknown
  Kingdom: Bacteria, Phylum: Actinobacteria, Class: Actinobacteria, Order: Streptomycetales, Family: Streptomycetaceae, Genus: Streptomyces
ggacggggaccgcgtcagggtctcaggcgccgtaggcagtgcggccgatccggccggagcacgccatgtcgcggaagtccccgacagggctgcagcacccgatgcggccaacgcgccggacgcggaccgtcgttggcgggagcggacgtggcgggaacgggccgggctcgcgctgcgagagcggatgcccctgtggttgcagacgcggtgcgcgatggagcgcaggaacgtgatcgccctgacggtggtgctcgtggccgtcgcggccctggccgtgcagcacttctggaccggccgcgcccagcccgtcgcggcccccgaggtcgtgcgggcggcggcgccgcgccccggccgggaccaaggcagcggcgcccctgcggacacctcggcatccgcaccggccgccgcgccctcgtccggtgcgccgcagatcgtggtggacgtcagcggcaaggtccgccaccccggcgtccaccgtctcccggcgggtgcgcgggtggccgacgcgatccgggcggcgggcggcgcacggccggggaccgacctcgacggactcaaccgggccaggttcctcgtggacggcgaacagg

SEQ ID NO: 2545 - DNA, 740 bp, Unknown
  Kingdom: Bacteria, Phylum: Actinobacteria, Class: Actinobacteria, Order: Streptomycetales, Family: Streptomycetaceae, Genus: Streptomyces
cgggcgcgtcccctcgggcgcggcgcccggccagcgcggcgagttcggtggtacgcccgctgccgggcgccccgaccactgcgagcacggccgccggcccctgctcgaacgccgccagctcccgcagcacggcgacccgttcgaccggcggcccggacagggccgtggccggccccggtactgccgccggcccggtctgcgcggtcgtgccggcatgcatctggtccggcagggcgccgcgcggagcctcctgggccacggaggtggccgtgagttccaggacgcccgccaggttgagatcggggccgtaggccggaacggtcgccgcgttccgggcgagcagttcgcccagggggccgtcgccggtcggcagcggcaccgcgaagccggtctcgcgcgggccggaccgcaaggcggtgccgagtaccgcgaccacggcgccggtctccaggtcgagcaccggtcccccggccgctccgccgcccggccggagcgcgtcccggcctgccgtgccgatcgccagttccagtgcgccgtccaggaggtggaagcggtccgtggccgtgtaggtcacggcggtcgtgccgaggacgcgggcctcgcgccagccgccggcggcgatccggacgtagcttcccgtgcgcaccccgccgcgcaccgacacgggcagcgggggcacgtcgagcccctcggtccgtacgagtgcgaggtccagcccgggcagcggggtcaccgcctcg

SEQ ID NO: 2546 - DNA, 523 bp, Unknown
  Kingdom: Bacteria, Phylum: Actinobacteria, Class: Actinobacteria, Order: Streptomycetales, Family: Streptomycetaceae, Genus: Streptomyces
tcggcgagcggcacggacgggaccggcgggacggccgaaggagcggagggctgacgtgggtggtgacggcgcacgggtcgggatcgtgctggtgtcgcacagcgccgaggtcgcggcgtcggtggcggagctggcgaagggactcgccggcggggccgagggggttctcgtggaacccgcgggcggccgggcgagcggcgggctgggcacgagcgcggaactggtcgccgcggcggcggccgcggtggaccggggagcgggggtggccgtgctgaccgacctcggcagtgccgtgctcacggtgaaggcgctgctcgccgagggcgacgaactgccggacggcacccgcctggtggacgcgccgttcgtcgagggcgcggtggctgccgtggtgacagcggccaccggggcggacatcgacgcggtggaggcggcggccgcggacgcctacgcctaccggaaggtgtgagccggaccgcctgccgggccgggaccggtggtcccggcccggcaggcaggcggg

SEQ ID NO: 2547 - DNA, 631 bp, Unknown
  Kingdom: Bacteria, Phylum: Actinobacteria, Class: Actinobacteria, Order: Streptomycetales, Family: Streptomycetaceae, Genus: Streptomyces
ccggacgcctccgcacggtggcggccgtgcgtccggacgcagcggtcgcggcggcaccggtcgcggcgcgtccgcggttcacccggcgtcgagctggtggtcggcccagacgtaactcgcgggcagcaggtcggtgatggggacggtgcggacgcggtcgccctcgccgacgatgacccggatcgcgggaaagtagtccagcagcacctgacggcaccggccgcacgggggcacgaccccccggtcgcggtcgcccacggccacgacggtctccaggtcgtggacgccctgggcggcagccgcgccgatgaggaccagttcggcgcacggcccgcccgtgaagtggtaggcgttcacggcggtgacgatgtgtccgtcccgggcgcgggccgccgcggccatggtgtggttgtcaccccggcagcgggtgcgcgcgacccgcgccgccgcctggatgagttcgtggtccacggggtgggtctgcggtgtcgtgttcacggcgcccgagtgtgccagttccggggtgcccgtccgggtgtgccgggagggcgccgcgggtgtgccggggccgcggtctccgggggtggtgcgccccctgccgcacctgccccggccgttctccccggccgtt

SEQ ID NO: 2548 - DNA, 710 bp, Unknown
  Kingdom: Bacteria, Phylum: Actinobacteria, Class: Actinobacteria, Order: Streptomycetales, Family: Streptomycetaceae, Genus: Streptomyces
cggcgagccggtcgcgcccggtggcgggggactggccgagctggcccgcgcggacctgtccggcctcgacccgcggctcgccgggatcgagttcgtgctggccagcgatgtcgacaacccgctgaccggcccgaagggcgctccggcggtctacgggccgcagaagggcgcctcgcccgaggacgtggagacgctggacgcggccctcgcgcactacgcgaaggtgctggaggaggcgatcggggccagggccgccgagtacgcggcctcgcccggcgccggcgccgcgggcggcatcgggtacggggcgctcatcctcggtgcccggttccgtgccgggatcgaggtcatgctcgacgtgctcggcttcgcccccgcgctggagcgggcctctctggtgatcaccggcgagggctctctggacgagcagaccctgcacggcaaggccccggccggggtcgccgccgccgcccgtacggcgggcaaggaggtcgtcgcggtgtgcggtcggctcgcgctcgcccccgaggtgctgggccgggccgggatccgccgggcgtacgcgctcaccgacgtcgagccggacgtcgcccggtgcatcgccgaggcgggcccgatcctggagcaggtggccgagcgcatcggcgaggacttcctgcgctgaggcggccggccggcggccgtacaagcggaagggccccggaaccgta

SEQ ID NO: 2549 - DNA, 915 bp, Unknown
  Kingdom: Bacteria, Phylum: Actinobacteria, Class: Actinobacteria, Order: Streptomycetales, Family: Streptomycetaceae, Genus: Streptomyces
cggcgggttcgtcggtgacggcgagcacggcggcgaagccgacgccgaagcggcccaccgagggcaggtcggatgcggcggtgtcgcgcttggcggaggcgcgcagcgtggacagcgactccacaccggacgcgtccagcggggcgccggtgttggcggcgacgaggaccccgtcgcgcagggtcaggcgcagccggccgggcacgcccgcgcgggcggcggcgtcggcggcgttctgcgccagctcgacgacgagccggtcccggtagccgccgaggacgaggtcctcctcggcgttggcgtcctcacggaacctggccgggctggtcgcccaggcgtccagcacaccgcgccgcagccgcacggtcccgaaggggtccgccccggcggagggctgcaccaacatgctcacgtcgttcattctcctcacgagggtgaggacgaaggtaccgcgcgggcgaacgggcggggcaggtggcgagcggcggggtggcggtacgccctacgagtgccccagctccgcggtgtcctcgtcggaggtgtccggtaccgagccggagtcccgggccgggcgcagcgggaacgggtccacgcgggtctcgtcgaccaccggcgcggccggctggggcggcttcggcatgacggcggcctcggagtggccgccgcacccgtacgccagggagacgacccggccgtcggccggggagaactcgttggcgcagacgccgaaggcctggcccagcgagccgccgatcggcgtcaggaaaccgcagctcacgcaggccgccggggccgcctgggccatcggggtcttcgcgccgtacgcctcttcccagcggtcgccgaggaactgggcatgcgccgcgcccgcgtcctgtcccgctacggactgcacgtcgccgccgaccgctggga

SEQ ID NO: 2550 - DNA, 759 bp, Unknown
  Kingdom: Bacteria, Phylum: Actinobacteria, Class: Actinobacteria, Order: Streptomycetales, Family: Streptomycetaceae, Genus: Streptomyces
cgacgcgctggtcctcggcgtcgacctcggccgggtcggcttcctcaccgaggtgcccgcagcgttcgtgcgcgccgcgctggacgccgtgctcgacgggcggctgaccgtcgagagccgcatgctgctcaccctgcgcgcctcccgccgcctggaggtgcccgcgggcatcgaggaactgatgcgctacggccgccgcccgctgcttccgccgccccgggtgcgcaccgactgcgaggccggcggcgactggggcatcgccctcaacgtcaccgcgctcaacgacatcgtcgtggagaaactcgcccgcgaccggcaggtgtccgtcggcgtctacatcgccggccggctcctcgcgtcgtactccgccgacgccctgctcgtcgccaccccgaccggctcgaccgcctacagcttcgccgccggcggccccgtcgtctccccgcgcgcggacgccctcgtcttcacccccgtcgccccgcacatggcgttcaaccgctcggtcgtggccgcgccggacgaacccgtggcgctgcgcgtactggaacgctccgggcaggccgccgtcagcatcgacggccagctgcgcggcgtgctcgaccccggggactggatcggcgtgtacgccgccccgcgccggctgcgggccgtacggctgggccccacggacttctacgggcggctgcgcgaccgcatgaacctgaccgacgccccggccgccgtggccgacggcaccccggcgccgcagtggtcacgggc

SEQ ID NO: 2551 - DNA, 747 bp, Unknown
  Kingdom: Bacteria, Phylum: Actinobacteria, Class: Actinobacteria, Order: Streptomycetales, Family: Streptomycetaceae, Genus: Streptomyces
cacgccggcgggccgctggcacacccggaccgacgcggcagcggccgccgagcggttcggcggacccctcgtcctgctgcaccgcgccacgctggtcgacgccctggccgcgctcctcccgcccggcaccgtccgcacggccgccgccgcccgcctcgccgaccccggtgacgcgcggcgcccggcccgcgtgaccacgcccgacggcgaactcgaggccgacctggtggtggccgccgacggcatccgctccgaggcccgccgcgtgttgttcccggatcatcccggaccggtctactccgggttcaccacctggcggctcgtgatcccggtacccggcgccgagttcgcctcgcacgagacctggggccgcggctgcctgtggggcacacacccgctcaaggacggcagggtgtacgcgtacgccgccgccatgacgcccgccgggcagcgcgccgccgacggcgaactggccgaactcctgcgccgcttcggccactggcacgacccgatcccggccgtcctcgccgccgcccgccccgaggacgtcctgcgccacgacgtccaccacctcgcggacccgctgcccgcctaccaccgcgggcggaccgtcctcctcggcgacgccgcgcacgccatgccgccgaccctcggccagggcggcaaccaggccatcgaggacgccgtcgtcctcgcccaccacgccgacgacccaccggcctacacggccgcccggcagccgcgtac

SEQ ID NO: 2552 - DNA, 533 bp, Unknown
  Kingdom: Bacteria, Phylum: Actinobacteria, Class: Actinobacteria, Order: Streptomycetales, Family: Streptomycetaceae, Genus: Streptomyces
ggcggcctggacgtcgcgggcaaggtcgcgaccccggccaccctgagctcagcccgcccacctgatgcgcacggttctcgatcgcacgggcgtgcggcatggactgtatccggcaccgccgcccgaacgactcccggatctcctccgccgagccaggatcgcggacatcgggccaggcccgtggatccctccgcgcgacttccaccagtgccttatacctcccgccgcgcccggtcgtgcggcagctgcgtcatgaccgggtgtgggccgcgtgccgttcgcggccgtgcatcgtcttcgtttaggcgcgtgactttcctgcggcgcgggcggtcggtgctgtgtccgggcggggcgggttcggtcctgcgtggtcagctggtgcggcggtcgatctcgttctgcacggttgagatagccgcaagggcgttggcgattgcggtcccctgctggcgggacagatccagcaggtcgtccaggaggattctcctgttggccagtttgtgctggaagtcgtctggcaggggggtctt

SEQ ID NO: 2553 - DNA, 1148 bp, Unknown
  Kingdom: Bacteria, Phylum: Actinobacteria, Class: Actinobacteria, Order: Streptomycetales, Family: Streptomycetaceae, Genus: Streptomyces
cggggcaagcggccgtgcgggcgtgaaccagggggcggggacgtcggccgaggggacgcggggggagccgcgaagtgatcccgaggtgatggccgaagtgatccgttcctctgtccgtggccgcgggtgctgcgtagggtgatcgggtgactcagtccgcatcgtctgcatcgaccgtaccgtccgcctacctccggttcccgcacctgcacggggagttggtcgccttcaccgcggaggacgacgtgtggctcgcaccgctggacggcggccgggcctggcgggtcagcgccgacaacgtgccggtgaaccacccgcgcatctcgcccgacggcaccaccgtcgcctggacctccacccgggacggcgcccccgaggtgcacatcgccccggtcgacggcggccccggcaagcgcctcacccactggggcagttggcgcacccaggtgcggggctggacccccggcggcgaggtcctcgcgatcagcacccagggccaggccagcctgcgccgcagctgggcccgcgccgtcccgctggacggcggaccggccgccaccctgccgtacggcccggtcggtgacatcgcgtacgggccgcgcaccgtgctgatgtccgcgccgatgggccgcgaggcagcctggtggaagcggtaccggggcggcacggccgggaagctgtggatcgacccggaggacaccggcgagttcgtccggctgcaccaggacctggacggcaacatcgagtacccgttgtgggtgggcacgggggtcccccctgtccgggaggagccggggacgtgggggaggatcgcgttcctgtccgaccacgaggggaccggcgccctgtactcctcgctggccgacggctccgacctgcgccgccacaccccgctggagggtttctacgcccggcacgccgccaccgacggcacccgcgtcgtgtacgcgagcgccggtgaactctggctcctggacgacctggacggcgccgaaccgcgccgcctcgacatccggctcggcggcccgcgcatcgacctccaggcccacccggtcgacgccgcccgctggttcggctccgccgcgcccgaccacaccgcccggggcagcgccgtcgcggtgcgcggcgcggtccactgggtcacccac

SEQ ID NO: 2554 - DNA, 622 bp, Unknown
  Kingdom: Bacteria, Phylum: Actinobacteria, Class: Actinobacteria, Order: Streptomycetales, Family: Streptomycetaceae, Genus: Streptomyces
tcaccgtgctgtccgcggcggccgccgccctcggcgcccttccggccacctcggccgacgccgcaccacacggcgacctgcgggtccaggtggaccgcctctaccacgaggccgagaacgcgacccaggccttcgaccgggccgacgagcgcgccgacgtgctgcgccgtcaggtgcgcgacgcacaggaccgcatcgcccggcgccagcagcacgtcaacacgctgcgggattcgatcggttcggtggccggtgcgcagtaccgctccggcggcctcgacccgtccctggcgctgctgttctcccgcgacccggccgagtacctcgacaaggcggccacgctcgaccggatcggcgcccaccaggcaggcgaactccaggaactgcgccaggccctgcgccaactcgcccaggaacgcgccgaggcaaccggcgccctcgccgaactggagaagacccgcaccgccgtcgccgcccacaaacacaccgtcgagcggaaactggcccaggccaggcggctgctcaactccctcacccgctcccagcgcgacgcctacgaccgggcctcccgctccggcggcgacggcctcctgaccggccgcgacgacctgctgtccggccc

SEQ ID NO: 2555 - DNA, 505 bp, Unknown
  Kingdom: Bacteria, Phylum: Actinobacteria, Class: Actinobacteria, Order: Streptomycetales, Family: Streptomycetaceae, Genus: Streptomyces
cccgggaaccgcgccggcagtcccggccgccgcccacgacctgacaccggtgctgccacccgtgctcggcaagcccggcgggcccgccggacggaccgtcaggggcgcaggatgagccgcaccgggtcgccctccttcttctccagcatctcgaccgcgcgtgcggcctcggcgagcggcagtacgccgctgacggacgcggagaagtccacccggccgccctggatcaggcgcagcagttgtggaagggccaccggcatgtcggagccgtagtggccgaggatccgctgctgcagatagctgaagcgggtgccgtcggcgacggtgagcggcttgtcggtcaggccgaccaggaccagccgtccctggggcgccaggacggacagcgcctgctcgcgcacggcgggcacgccggcgaagtcgaacgccgccgcgatgccggccccgccggtggccgtgcggacgcgggcccgcagctcggggtcggccgagtccagcgcgaggt

SEQ ID NO: 2556 - DNA, 1352 bp, Unknown
  Kingdom: Bacteria, Phylum: Actinobacteria, Class: Actinobacteria, Order: Streptomycetales, Family: Streptomycetaceae, Genus: Streptomyces
tgagccagatcgcccagggtcgtgcgggcggtgagcggcccgcgagcgtgcgtggctcaggtctgcgctggtcctgcggcccgaccagcgcgtcggtcaccgcggacccgccgcccgccgaagcgctggcctccgccggcctgctgcgctgggagttcgagctgcccccgggcggtacggcgagcgtggaactgcgggtacgacaggacggcgcggggccgctgcgggccgcgggccgcgcggcgacgagtcctctggccccggcgcgagccacgggtgacacccccggagtcggagagctgatgcgcgtcggcatcgacgacctccacgctctcctgctgcgcgatccggtgtacccggccgacctgcacctcgcggcgggaacgccctggcggtccggcctggccccggccgaggcgctggtcgccgcccggatggtgctgcccctgggcacccgcctcgccgcgagcacgctgcgcacgctggcccgcacccagcgcgcgggcccggggccgcagtccggcatgatccccggtccacggagggacgcgggcccacacctgccgcccggttgcacgggtacggaggcgaccctgctcttccccgtgctcctcgctgaagcccgccggtggggtcttcccgagcaggagacggaggagttgctgccggcggcggtgaactgcctgacctggttgcgtgcggccgtcggcgagggcacatacctgtgcgatccgctgcccggacggcccgtgcgctgcgagatccaggcgtacgcccaccgggcggcagtgctcggggcggacctgctcgaggcgttcgaccggccgggcgccgccgagctgcggcagtgggccgggcacctgcgaacggcgttccgcagcggtttctgggtccaggaccgatgcggcggcagaccagccgctggccaggcccccgacgggcggctcctgacccacctcgacgcttccgccgtgcatctcctcgacacggggctgtccggcggtggcgagcaggcgcccggactgctcgacaaggcgcagaccgggcaactcgcccggctgctgggcgggccggccatggactcgggctggggtctgcggggactggcggccaaggaggcgggctacaacccgttcggccatcgtgccggggcggtgcgggtggcggagactgcggtcgccgtcgcgggtctggccgccgccggccacgagaaggaggcgggcgcgctcctgcggggcgtgctggcggcagcccaggcattcgggcaccggttgcccgagatgttcgccggggagcagcgcgcggacggcagtgcacctgtgccgcacccggcggcctgccgtcccccggcc

SEQ ID NO: 2557 - DNA, 732 bp, Unknown
  Kingdom: Bacteria, Phylum: Actinobacteria, Class: Actinobacteria, Order: Streptomycetales, Family: Streptomycetaceae, Genus: Streptomyces
caccatcagcggccggccggcggcggccagctccagcgcggcgcggacgacgagcgtggacttgccagcccccggaggggagtcgacgacgacaccgcggtgcgtgccgtgcagggtgtcggcgaggatcgcctcggtggcacgggcggccgcggcaccggggtcgaagccgctccgcggggcctcgtgcccggcggctgcctcctcggtgggggcggtcacagcaggtcctcctcggtcaccgggtccggggcctccggcgcgctctcctcgccgggcgggccgccgtgcgtccagggggtgttctccgggtcgggcagcttcgggccgccgcgctgctcgtgctcgaagagcgtgaagcagacccggtcccccttctccggcacggacccggcctcgggctccttgccgcggcccatcttgtcgaggacgcgcagcacgaccagcgtgccgtcctcctcgcaggcgacgacctccgccgactgcggcctgccgcccagcgagcggtacaccttgacccgctcgcccaggtgcggccggtcgtccgtgcggacggtgaccagcggacgcgggctggggcgcttgccctcgctgtacgccatggtcacgtccatgacctcgccggcgaacgcctccccagccagccgccgcccggccatgaccagcgggtcgtccagcgcctcctgggcgtccaggcgggcctgctcgcgctcgcgcgcggccagcttgttc

SEQ ID NO: 2558 - DNA, 512 bp, Unknown
  Kingdom: Bacteria, Phylum: Actinobacteria, Class: Actinobacteria, Order: Streptomycetales, Family: Streptomycetaceae, Genus: Streptomyces
gtgccggcgctcgcccacctgcacggcctggagcaggcgctggcggaactggccgcaccgctgcgcgccccctcgggctcgcccctggccggcgcctgacacggcggttcgaggagcaccgccgggacactcctccgccttggtctagaccgttcctgatcgactgctaccgtcaccccgaacgggtcgacggagaaggggacagacgtggcggacgaggacggcgggcggcggcgggccttcatcggatcgttcacggcggccggaggccccggggtggtcaccgcggccgtgaccgaggacggcgcgctgaccgtgctgagcagcgtggacggcgtgctggacccgtcctacctcgccctgtcggccgacggcggcacgctctacgcggtcagcgagaccgccgagggcgcgctggccgcgtaccgggtgaagggcgagtcggtcgaactcaccggcccgccggtccgcgtcgacggcagcggccccacccacctcagcctgctcgacgg

SEQ ID NO: 2559 - DNA, 1009 bp, Unknown
  Kingdom: Bacteria, Phylum: Actinobacteria, Class: Actinobacteria, Order: Streptomycetales, Family: Streptomycetaceae, Genus: Streptomyces
gtccccgagcacgtcggcggcgtcggggcggacggctgcggcgcgctcggcgaacaggcggtgcgcctggtccgggtccaggggctccaccgggcgcaccagctcgcccggcacgcccagcggttcccggctggtggcgaggatcgtgaggccggggcagcgggtgagcaggacttcggcgaggcgggcggccgcgtcgatgacgtgttcgcagttgtcgaggatcaggagttcgctgcgctgtgcgcagtactcgacgagcagggccaccgggtcgttctgcggggtgaccagctcgttggtcatcaggacggtctcgcgcaggccgagggcgctgaccaccgcgcccggcaccgcctccggccggtccagcggcgccagctcgaccagccaggcctgcggaagcccggcggcggcttcctcggcgaggcgggtcttgccggagccgcccggtccggtgagcgtgacgaggcgggccctgtgcatatcggaacggatggcggcgagttcgggttcccggcccacgaaagaggtaagacgcggacggatgttgccggtccgcccgggcgggtgaggggcctggtgccggcccggctgtgcgtcccggggcggggcctggagtgaggcggcctggggtgaggcggcctggggcgaggtctgcggtggggcctgcggaggggcctgcggaggggccggaaacggttctgccgtcggttctgggcgcgcggtcgccggggcgagcagtcctgcgtgcagggcgcgcagttcgggccccgggtcggtgcccaggccgtcggcgagggcgcggcggacccgctcgtaggcggcgagggcgtcggcaccccggccggtgtcccgcagggcgcggacgagaagggcgtgcagcgtctcgtcgtacgggtgtgcgacggtcagttcggtcagttccgggacgacgtcgacggcgcggcccaggcgaagccgcgcgtccgcgcgggcacggaccgcctccaggcgcaggctctcgggg

SEQ ID NO: 2560 - DNA, 573 bp, Unknown
  Kingdom: Bacteria, Phylum: Actinobacteria, Class: Actinobacteria, Order: Streptomycetales, Family: Streptomycetaceae, Genus: Streptomyces
cccggcccgctgcccgtggtgggacgcgtcgagggcggccggtgcctgctcgacctgcgggccgtgccggccgaggacgacgaacggctggccggggccgtgcgacgggccgcggaaaggtaggcgggcgccatgcgggtcctggccaccgccgggcacgtcgaccacggcaagtccgccctggtgcgggccctgaccgggatggaacccgaccgctacgaggaggaacggcgccgcggcctcaccctcgacctcggcttcgtgtggacgcggaccgcaccggacggcgagtacctggccttcgtcgacgtgcccggacacgagaagttcgtcgccaccatgctggccggggccggacccgtgcccgccgtgctgttcgtggtcgccgccgaccagggctggcagccccagtcgcaggagcacctggcgatcctcgacgcgctcggcgtacaccacgccgtgctcgccgtgacccgcagcgacctcgccgaccccgagccggtgcgcgccgacgccgtgcggcggctggccggcacctcgctgggcgccgtgccctccgtcgccgtcagcgcg

SEQ ID NO: 2561 - DNA, 510 bp, Unknown
  Kingdom: Bacteria, Phylum: Actinobacteria, Class: Actinobacteria, Order: Streptomycetales, Family: Streptomycetaceae, Genus: Streptomyces
ccgtgcgcagcgcgtcctcgaccgcccccgcgcgccgctggtgcgcgccgacggcacggtagaaggcgtccagccggtcctcgccccagtgggcggcgatcatccggcaggccagccagccgccctcgtaggcctgggcgaggcgggtggcgtcctcggcgaagccgaagtccttgtcggtcggcagtgcggcgggcacgtgcccgtcggccacggcgtgctggagttccggcgcggcctgctccggggtgcgtccggagcgccggtagccgacccagtcggcgtagccctcggacagccacagcggcgtggcggcgtcggtgtgggcgcgggtggccacgtgggtggtctcgtgggtgagcacgacctgtctgccgagcgggccgagcaggctgtacgcgtcggggttgatgacgacccggtcggccggtgcccgcccgccgccgcccgcctcgccggtggtgacggcggcgatgccgcggtagtcgtcggcgggcgagccgagcagcg

SEQ ID NO: 2562 - DNA, 680 bp, Unknown
  Kingdom: Bacteria, Phylum: Actinobacteria, Class: Actinobacteria, Order: Streptomycetales, Family: Streptomycetaceae, Genus: Streptomyces
gccgaggggcggtgtcctcggtcggccgacgccggggtgggcgtgtcggcccgtgaacggcacgggccggggtcagtgcctgcggggcaggatcaacagggcgtcgcctaccgggcgttcgccggtggcgtcggaggggtcgttgaggaccttgccgtcggccaccatggtggtcgagccgccgccgtccaggttgaccgcgtcacgcagcccgagcgccctggcgacgtcggcgctctcggcgatgctgaggccgagcgaggcggtgctgcggccgtcggcggtgacgagcacggtgcggccggcggcgtccaccccggccagtgtgcgcgggttgcgcttgtgcacccagccgtagtaccagctcgggtcgcccgggtgcaccatgccgtcggtggcgggagtgatgtggatcctgccgtcacggaccagttcgggaccggcgttgacgatgtcggtcctgggcgagggcgagacgcggtgcccctggccgtcccgcagggtcgtcgagacgcgcaggtggccgccgacgtgggcgagcccggtcagttcggcgacgcgccggccggtcgcctggacggagctgccgccggacgggagcggtccaccgcgcggcgagcgcacctcgacgacccggtcatggacgtccagcacggcctccacgccctcgcccttcggag

SEQ ID NO: 2563 - DNA, 774 bp, Unknown
  Kingdom: Bacteria, Phylum: Actinobacteria, Class: Actinobacteria, Order: Streptomycetales, Family: Streptomycetaceae, Genus: Streptomyces
gtgcgcgccccgcaggccagcagcgcgggcagcgcgtcggtggcctcggcgaggccgggcagcaccagcagccctgtggcggcgtgcggcagcagcggtacggtgcggaagaccgcctcgccgacgaagcccagggttccctcgctgccgatcatcaggtgggcgaggatgtcggccggttcggtgtggtccaggaacgcgttgaggccgtaacccatggtgttcttcatcgagaacagccgctcgacggtggcgcgggagggggccgagccccgtacgcggtcgcgcaaccgctgcagtccggcgtgcagttcgggctcgcgggcgcgcagcgcgcggtccgcgtcggcggcggcggtgtcgacgacggtgcccgagggcagcacgaactggagggactccatggtgcggtaggcgttgtcgcgggtgccgcagttcatgccactggagttgttggcgaccaggccgccgatggtgcaggccgactcgctcgccgggtcggggccgagccggcgcccgtaccgggcgagccgcgcgttggcctgacgtaccgtcagccctggttgcaggcggatgcgcaggccgtcgtcgaggacttcggcggcgcgccagtggctgcggacgtccacgaggatgccgtcgccgcccgcctgccccgccaggctggtgccgcccgagcgcagtgtcagcggcacgccggccgcgcgggcacccgccatcagcgcacccacctcggccgcggtggcggcgcgcacgacggcctgcggcgtgaac

SEQ ID NO: 2564 - DNA, 541 bp, Unknown
  Kingdom: Bacteria, Phylum: Actinobacteria, Class: Actinobacteria, Order: Streptomycetales, Family: Streptomycetaceae, Genus: Streptomyces
ggaccggactccgcggcgcggagagccggttcggcgcgggtgacggcggcgaccatggactcgcgcaggatggtcagcaaggccggatcgcggcgttcccccggggtggagtgccaggtgacgaccgcgccctggccggaggcctggatgatctgggccgccagctcctcgtcgacccgcagccaccccccggccgccagccggcacacccgcccgtggaggatctccagaccggcgcggtgtgccgcgtccgccccccggccgctcgcccggttcatcaccgcgaacagctccgggcgcgagaccccgaactccaccaccaggtcccacccgcggcgcagctcctccaccgggtccttcggggcggggtcgagctgcgcgcgcttgctctccaggaactgcgcgtaaccgtgctcggcgaccgcctccagcaggccctccttgtcgccgaagaggcggtagatcgccggcggctgcatcccggccgcggcggcgaccgcgcgggtgctgacccgctgcgcgccaccggcctgccctggac

SEQ ID NO: 2565 - DNA, 662 bp, Unknown
  Kingdom: Bacteria, Phylum: Actinobacteria, Class: Actinobacteria, Order: Streptomycetales, Family: Streptomycetaceae, Genus: Streptomyces
ggataaatatggggatgatgttaaggctattggtgtttatggctctcttggtcgtcagactgatgggccctattcggatattgagatgatgtgtgtcatgtcaacagaggaagcagagttcagccatgaatggacaaccggtgagtggaagggggaagtgaattttgatagcgaagagattctactagattatgcatctcaggtggaatcagattggccgcttacacatggtcaatttttctctattttgccgatttatgattcaggtggatacttagagaaagtgtatcaaactgctaaatcggtagaagcccaaacgttccacgatgcgatttgtgcccttatcgtagaagagctgtttgaatatgcaggcaaatggcgtaatattcgtgtgcaaggaccgacaacatttctaccatccttgactgtgcaggtagcaatggcaggtgccatgttgattggtctgcatcatcgcatctgttatacgacgagcgcttcggtcttaactgaagcagttaagcaatcagatcttccttcaggttatgaccatctgtgccagttcgtaatgtctggtcaactttccgactctgagaaacttctggaatcgctagagaatttctggaatgggactcaggagtggacagaacgacacggatatatag

SEQ ID NO: 2566 - DNA, 1224 bp, Unknown
  Kingdom: Bacteria, Phylum: Actinobacteria, Class: Actinobacteria, Order: Streptomycetales, Family: Streptomycetaceae, Genus: Streptomyces
gacggggagcaggggcgtggggggtgttctttgctgggccgggtgcgggcggcacccggggtcagcgcgggcgtccgagttcgccgagcagggcccggcggtcgatcttgccgttcgggttgagcggcagctggtccaggacggtgatccggctgggcatcatgtacggcggcagacggccggccagcgccgcgtacagacggtcggggacgcagccggtgccgctgaccgcggcctggagctccggttcgccgtcggcggccggcagggtgacgacgatcgcgtcccgcaccccgggctgggcgcgcaacgcggcctcgatctcaccgagttcgatgcggtggccgcggaccttgacctggtggtcggtccgtccgaggtggacgagccggccgtccagcctggccacccggtcgcccgtccggtaccagtgcccggggcccggcggtgtcccgtcggccgggcggaggtcctcggtgaggaagcggcccgcgtcgtgccgcgggtccaggtaaccggcgaagcgcagcgggccccgcacgcacaactcgcccttctcgccgggccggccgtcctcgccgagcagcacgaggtcgagatccggatggccggtcccgatcggggccgtgccgttgggggtccggggccagtccgcctcgtcgtccgggaagcggtaggcggtgcacgagatcgtcagttcggtggggccgtagaggacttccaggcggctgcccggcgcggcggcgcgccactcgcgggccgcccgcagggtcagcggttcaccgccgaagacgctccaccgcagggtcggcatgctgtccggcgccagggcgcccagccgggcggcgaaggtgatcagcgacggcaccgagaaccagtgggtcaggcgcaggctgttgacggtcttcaccgggttcagcaactggccgcgggacgggacgacgagggtgccgccgtccgcccaggcgacgaacaggtcgtgcacggatccgtcgaaggtcagctcgaagctctgcgacagccgactgcccggaccgatcccgtagcggcccgcgacccgctccagataggcgcagatgttgcggtgccggacgggcacacccttgggcgcgccggtggatccggaggtgaagatgatgtacgcgatgtcgtcgggaccggcgatgggctcggcgtccgcgtgggcgtgtgcgctgggaccggcaccggcctccgcctgggcac

SEQ ID NO: 2567 - DNA, 650 bp, Unknown
  Kingdom: Bacteria, Phylum: Actinobacteria, Class: Actinobacteria, Order: Streptomycetales, Family: Streptomycetaceae, Genus: Streptomyces
ggcacaccgcgccgctcctcaggcgcagccgcaggccgccagggccgtcgccgtgcggtccagggccgactgggccgcctgggggtcggtcgtgccctcggtcaggaaggcgaaggccaggaggcggccgtcgtggtcgacggtggtgcccgcgagcgtgttcacgccggtcagggtgccggtcttggcccggacgatccccgcggcgccgtccggtgcgtagcggtcggcgagagtgccggtgaaaccggcgaccggcaggccggtgaggaccggacggagtccggggcgggcggggtcggctgccgtgcgcagcagggcggtcagcaggttcgcggtgagccggtcggtgcggtccaggccgctgccgtcgtggaaggcggtgccggccaggggcaggccgagccgcttcagctgtgccgtgaccgcccgggcgccgccggcgaagtcggggcgttcgcccgtggccgcggcggtctgccgggccagggcctcggcgatgtcgttgtcgctgttggtgagcatgcgttcgacgacgtcggagagcggctgcgaggacacggtggcgagggtctgcgcgcggccggtcgccttggacgggccgggggcggtggtccggatgccgcgggcgtcgaggaagcggccgaagg

SEQ ID NO: 2568 - DNA, 651 bp, Unknown
  Kingdom: Bacteria, Phylum: Actinobacteria, Class: Actinobacteria, Order: Streptomycetales, Family: Streptomycetaceae, Genus: Streptomyces
gcgtagaggcgcagcgggccgccctggcccgggccgcctccctgggcatcggctccgtgcacgagtgcggcggcccggacatctcctccgaagacgacttcacggggctgctgcggctcgccgccgaggaaccgggcccgcgggtcgtcggctactgggccgaggaggacgccgacaaggcgcgccggctgggcgcgctcggcgcggccggggacctcttcgtcgacggctccatcggctcgcacaccgcctgtctgcacgccccgtacgccgacgcgggccacaccggcaccgcctacctcgatgcggacgccgtcgcctcccacgtcaccgcctgcaccgaggcgggcctccaggccggtttccacgccatcggcgacgcggcggtcaccgccgtcgtagagggcgtgcgggccgccgccgacaagctgggcctggcccggatccgtgccgcccggcaccgcgtcgaacacgccgagatgctcacccccgagaccgtcgcggccttcgccgagctgggactgaccgcgtccgtgcagcccgccttcgacgccctgtggggcggcgaggacggcatgtacgcgcagcgcctcggcgccgagcgggcccggacgctgaaccccttcgcggcgctgctgcgcgccggtgtcc

SEQ ID NO: 2569 - DNA, 576 bp, Unknown
  Kingdom: Bacteria, Phylum: Actinobacteria, Class: Actinobacteria, Order: Streptomycetales, Family: Streptomycetaceae, Genus: Streptomyces
gaggccgccgccggccgcggcgcccgcgatgatcagcgcgagcagcgcgcgggccagcatcgcggcggccatcgcggcgcgccggccgtgcggcagccggtccaggagcgggccgatgaccggcgcgaggaccgtgaacggcgccatcgtgatggccagatacagcgcgacccggccgcgcgcctcgtcggtgggcaccgagaagaagacggtggaggcgagcgccacggtgatcatgacgtcgccggcgccgttcaccgcgtgcaattcgatcagcttgccgagcccggactccccggcgccgtgcgcgtgcgtggcgcggcggatgccgcggacggtggcggtgaccggcaggcgcagggcacggcccagcgcgcggacggagccgcctaaccggcccgtaccgctgcctcggctgctgccctccgccagctcctcgggctcaccgagccctgtggtctccgggggcgtcctcgcggctgccaccccgtcatagtgccccgataaggccccggctagcgccatcacggcacggatggccaccggacaccccccggacgccgcccaccgtccctc

SEQ ID NO: 2570 - DNA, 519 bp, Unknown
  Kingdom: Bacteria, Phylum: Actinobacteria, Class: Actinobacteria, Order: Streptomycetales, Family: Streptomycetaceae, Genus: Streptomyces
aggcggtgccgggctccggggcgaaggcgtacccggcgggccgggtggtgaacgtgcccctgccctgggtacggctgcgcagccgggtcgcgtatccgaacagctcggccagcggcacggtggcggtgacgaccgccgtgcccgcccgcccggcctgcccggacacccgtccgcgccgcgcggccagatcaccgaggacaccgcccacggcgtcctccggaacgctcaccgtcacctcggcgaccggctccagcaggcgcatcgcgcacgccctcagcgcctcccgcagtccgagccgccccgccgtccggaaggccgcctccgaggagtccttcacatgggtggcgccgtcggtcagcgtgacgcgcagcccggtcaccggatgcccgcccagcggcccctcggccagcgcgtcccggcacccggcctcgaccgcacggacgtactcctgcggtacgcgaccgccggccacggcggagcggaacgagaagccctcgccgccggccaccggctcgacgt

SEQ ID NO: 2571 - DNA, 742 bp, Unknown
  Kingdom: Bacteria, Phylum: Actinobacteria, Class: Actinobacteria, Order: Streptomycetales, Family: Streptomycetaceae, Genus: Streptomyces
acctaggggatccggggcgtgggggctgcggttggcgctctgtgacgtgcacggcatcagcgaggccgaggcggcacggatcgcggacgggcagccgtacgcctcgctgctcgacttctgggagcgggcccggccgggtgggcgcgctggacgcgttcggcgccaaccgccgcgaactgcaactgcatctgaccgaactgcaccggggcgcccggggcgcgggcggcggccaactgcccctggcgggcggccggaagaccgccgcggccgggctgcccgacctgtccgacgccgagaagctcagcgccgaactgggcgtgctgtccatggacgcctcgcgcaacctgatggacgaccaccggacgttcctcgacgagctgggcgtggtctccgcgcgccggctgcgcgaggcgcggcacggcgagacggtgctggtcgcgggcgccaaggcggccacccagaccccgccgatccggtccggcaagcgggtcatcttcaccacgctggacgacggcaccggcctggtcgacctcgccttcttcgacgactcccacgacgcctgcgcgcacaccgtcttccactcctggctgctgctggtgcgcggagtggtgcagcggcgcggcccgcgcagcgtcagcgtggtgggtaccgccgtctggaacctcgccgaactggccgaactgcgcgccgagggcggcctggaggaggtggcggcccggctggcgccgtccgcggtgggtga

SEQ ID NO: 2572 - DNA, 544 bp, Unknown
  Kingdom: Bacteria, Phylum: Actinobacteria, Class: Actinobacteria, Order: Streptomycetales, Family: Streptomycetaceae, Genus: Streptomyces
ccgcgaccgcgccgtccggcccggccagggcgcccgcgtcgagcagggaccgtcccagccgcaccggcacgcccagccgggccagccgtgtgccccgctccgtggcccgcccggcggggtcgaccgcgcccacggcgctcagcacctcccgcgcggccgccatcgcgccggccggcggccgatcgagcaacgccagcccggacgcctcaggatcgccccagcaggccgcctggagggcgaacgccgtcaggtcggccaccttgatctccggcgccgggaaacgcggcagacgcccgtcctccgcctccgtccagcaccggtacaccgtgcccggcgcctcgcgcccggcgcggccggcccgctggcgtccggcggcctgggaggcccgcaccgtcgtcagcgcgcccagcccgcgcgcgtggtccacacgaggctcccgcgcgagacccgcgtcgaccaccaccctgaccccgggcaccgtcagcgacgactcggccaccgacgtggccagcaccacccggcgccgcgggcccggcgcgagcac

SEQ ID NO: 2573 - DNA, 524 bp, Unknown
  Kingdom: Bacteria, Phylum: Actinobacteria, Class: Actinobacteria, Order: Streptomycetales, Family: Streptomycetaceae, Genus: Streptomyces
gttcccgggcgtgctgggcgcgctggagggcgccgcggcacggggcgtcgacgtcacggacctgctcggccgccagcgcgagcgggcctcggacgccgccgcgttcacggccgcctaccgccgctactgctggcccaccgacggcctggagggcgtgcgcctggcgccgttccagatcctcgccgtccagggccgcagcctcgccgcactgccgcacgacgaacagctcgcgctgatcgaccggctggccgagcacgacagcaccggcctgctgcaggtcacccgccgcctgtacgtcgacaccggagacccggagtcggtccgggccggcgtcgactggtggctggagatgaccggccggggcggtgagggcatggtggtcaagccgctgggcgcgctggtgcgcgacgaggcggggcggctggtccagccgggcctcaagtgccgcggccgggagtacctgcggatcatctacggtcccgagtacacccgcccggacaacctcgcccggctgcggcagcggt

SEQ ID NO: 2574 - DNA, 513 bp, Unknown
  Kingdom: Bacteria, Phylum: Actinobacteria, Class: Actinobacteria, Order: Streptomycetales, Family: Streptomycetaceae, Genus: Streptomyces
gctcggcccgtgaggtgtggctgctcgcggcgggcgaggacaaggcgaacgcggtggcgatggcgctgtccggcgcgggcgagatccaggccccggcggcgggcgcgtacggccgcgcacgcacgctgtggctgctggacacggcggcggcctcgcaactgccgaggtcgttgtacccgccggcgtccgcctgacggacgaggcgaccgacgacagatcggcgtcccgggggcggcgagggcagcactgcccgcgccgcccccgtcgtgtgcggtcagccggaaccggcggcgcacctcgcaggacgggccggggccgcaccgtaccggctcgcccgggtcccaccgttcagcgcgtggtcccggccccggcgcccatcgcatcgtcctcggaggcgacggcttccgtgtgctgctcgcgcacgcgtatcagcgcggcgacggacaggacgaagaacgcggccgtgagcagcgccgggctgttcgggcccgaggcggcggcgacggcgccgcc

SEQ ID NO: 2575 - DNA, 774 bp, Unknown
  Kingdom: Bacteria, Phylum: Actinobacteria, Class: Actinobacteria, Order: Streptomycetales, Family: Streptomycetaceae, Genus: Streptomyces
ggctacaaccacacaccccgcctgccggactggcccggcctcgacgcgtacccgcgcgagctgcggcacgcctgcgagtaccgatcgcccggcccgtacgccggccgggacgtgctcgtcgtcggcatcggcaacaccggtgccgagatagccgtcgacctggtcgagggcggcgccgcgcgcgtacggctggccgtgcgcaccgtcccgcacatcctgcgccggtcgaccgcagggtggcccgcgcagtacacgggcgtcctgtgccggcgcctgcccgtcgcgctcgtcgacaggctcgccgggccgctcacccggctgagcgtgcccgacctgtcggcccacggcctgccccgcccggacaccgggctgtactcgcgggtcaaggagggcgcgatcccggtccaggacgcgggtctgatcgacgccgtacgggccggccgggtcgagatcgtggcggccgtcgacggcttcgaggacggtgcggtcgtcctcgccgacggtgagcgcgtcttgccggatgccgtcatcgccgccaccggctactcccgcggcctggaacccctggtcgggcacctcggcgtgctggcccccgacggcagaccgaccgtccgcggcccccgcacccccgccggcgcccccggcctgtacttcaccggcttcaccaatcccatcagcggcatgctccgcgaactggcccgcgacgcggagaagatcgccaaggcgatcgcccgcgcccaccgctgaccgcccgaccggggcggccaccccggc

SEQ ID NO: 2576 - DNA, 525 bp, Unknown
  Kingdom: Bacteria, Phylum: Actinobacteria, Class: Actinobacteria, Order: Streptomycetales, Family: Streptomycetaceae, Genus: Streptomyces
tcctcgccggccgcgcccacccggcggccaccgccacggtccgcctcaacgccgccgccctcgccctcgcgagcggcacgcacagcgactggcccgccgccctcgcggccaccggggaagccgtcaccagcggcgcggccgtggccctggccgagcgcctgcgggcccggcgccaccgcccggcggtgctccatggctgacttcttcacccgcggcgcacctggccggcccggactcgcgctcttcctcaacgcgggggacccgcccctcgacgaactcgacgacgtcgtccacatgctcgacgaggaaggcgtcgactgcctcgaactggccgtgcccttccccgactcgttcaccgacggccccgtcgtacgccgctccgcacgccgcgccctggaccggggcaccggcctggacgacgtcctcgccttcgtcgcccgcacccggcccggcctcagccgcctgcggatcgcgctgctcgccgactggagccactccctcaaacacctcgacctcgccgccgcg

SEQ ID NO: 2577 - DNA, 693 bp, Unknown
  Kingdom: Bacteria, Phylum: Actinobacteria, Class: Actinobacteria, Order: Streptomycetales, Family: Streptomycetaceae, Genus: Streptomyces
ggagcgcggtcgccgcgtcgtacgccccgatgccctcggcgggcagcagcgccacccaccgggtcatgacggcccctccggcccaccgggctccccgtccgggccgagcggctccagcacctggcggtcgcggtgcagcgcgatctcgtcggtgcgcgcccagaacgcggtgacccgcgggtccttcttcgccgcggtgcgcgcggcgaagaaggcggcacggtccggcagcgaccacaggatgcgcacggccgccgtgtccggaccgctccagctgcgccagacgtgctcggcgcgcagaccgcgtgcccgggccccggggaggtagtcggcgcgccagcgccgcagccacggcccgaccccctcgcccggcaggacgaccgtgtccatgacgtggacgccgctcacggcagcttctccaggacctcggtgcggtagcggtcgacctgctcgcgcagcgcgtccagaccgcgcgggcccagcagtccgtgcgggccccggacgcgcggcgcgacgacgaggcgggtcgcgcccgcgtcggtgaagccgcgcacccacgacgggtcgttctgccgcgcccggtcgcgggacccgggccacaccgtgacctccacggcgtcctcggcccgccccgcctcccgcgcggcctcgcgcagcacagaggcctggcgggcgaagtcctcggggccgatc

SEQ ID NO: 2578 - DNA, 614 bp, Unknown
  Kingdom: Bacteria, Phylum: Actinobacteria, Class: Actinobacteria, Order: Streptomycetales, Family: Streptomycetaceae, Genus: Streptomyces
ggcgggcgcgtgtccggcggcggccagaaccggacggccgccgccggagccggtccgggggatcagtcgcgcaggcccggcccgtcgtactgcgcgcggcggctgccgtgggccggtccgtcgtattccgcgaggcggctgccgtgggccggacggccgggcaccgtggcggcgtccagtcgagcggtgatcaccaacgtgccctcctcgatctggtagtccaggggcagaccgaggccccgcatcgcgctgaccatgccggtgttcgccgcctgcgtgacggcgtacacgctcgcgcagcccgcctcgacggccatgtgcaccagccggcccagcagttcggcgccgatgccgcgccgctgccactcgtcctcgacgagcagggcgacctccgtctcgtcgccgtcccacagcagatggccgaggccgatgatccgtccggacgcggtccgcgcggcgagggtccggccgaagcgggggctgaggaggtggttcagatagcggtcggcgtccgcgaccgggccgtggtagcgcagcccgagcgtgcgggccgagcaccgttcgtgcatctgccgggccgccgccaggtcgccctggtcggcccggcgtacggt

SEQ ID NO: 2579 - DNA, 513 bp, Unknown
  Kingdom: Bacteria, Phylum: Actinobacteria, Class: Actinobacteria, Order: Streptomycetales, Family: Streptomycetaceae, Genus: Streptomyces
cggtgccccgctcgtgcgggtcggcggcgacggccttgacgtggcggcggtgtccggggcgtgggatcgacgtcgtggtcacgagcgtccttccgtgggggaggggaagtggggctgtacggcgccgccgacgaccgtggccaggacggcgttggcgggctgtgcctcgggggccaggctcagcgggtcggcggcgaacacggtgaggtcggcgaggaaccccggggcgagccgcccgagttcggcgcgggcaccggccgcgtacgccgccgcggtggtcatcccggcgtaggcctcgcgcgcggtgagtgcctgttctggctgcaccggcgccgtctccggttcctcgaccgggcggcgcagctggcagtcggcgagtccgacacgcgggtcaccgggcccgatgggccagtccgagccgagcgcgacgacggcgccgtggtccaggaggtcgcgggtgcgccagccgtgcgcgacgcggtcggggccgatgcgccgcgaccagttgtcggt

SEQ ID NO: 2580 - DNA, 659 bp, Unknown
  Kingdom: Bacteria, Phylum: Actinobacteria, Class: Actinobacteria, Order: Streptomycetales, Family: Streptomycetaceae, Genus: Streptomyces
tcgcccgcctcgccctcggcggccccggcgccccggccgcgctgacccgggcgcagcttttcgaacacgcgttttacccactcgcccagcactccggacgattcctcgcggaccgcctgcaccgtctgcgccgccaggaaggccacgaccgcctgggtcgtccccagggcggtcatggtcagcgccgacaccgactcgcccaggccgaagcccagcatgtcgtcggtcctccggttccggcggcctcggcgtggccgccggaagtacaccgcggccgtcgtctccagcagccagagttcctcgggagccaccgcctcgaccgcgcaccgcgccagcaggacgacgtcctgctgcccccacgcccgtcccatcgcaccccccgaaccctcggtgacggattgccgacgggacccgccccgcccggtgaagcccgacggatccccacggatcccgacggatccccacggatcacaaccggtcacaacgaagcccaccggagcacaacggatcatccgaccgcagtcatagtgcggtacgccgccgggacggcgcagccgtttcaccgaagaccgaccggctccacggcgaaaccgaggcccgcacgggccggcccgacacgtttcgcgggcgccgggcgaccgcgaaacgtgtcgggccgg

SEQ ID NO: 2581 - DNA, 567 bp, Unknown
  Kingdom: Bacteria, Phylum: Actinobacteria, Class: Actinobacteria, Order: Streptomycetales, Family: Streptomycetaceae, Genus: Streptomyces
ccctggtaccgggcggccgacctcgtcgtgctgccctcgcgctgggagggcatggccctggcgccgctggaggcgatggcgtgcggccgggccgtgctggtcacggacgtcgacggcgcccgggagagcctgccgtccgagctcgccgcacgctgcctggtgcccgccgaggacccggccgcgctggcccgcgcggtcaccgggctgctgctcgacccgtcgctgcgcgcgtcgctcggccgcctcggccgcgcccacgtgctgtgctcgcacgacgcccggcgcggcgccgaggcggtcacggccctctaccgcgacctgctggccgcccacctgggcacaccaccggccgaaacaccgccaccgcccccgccaccgcgcacgcccagcgaacacagcgaacgcagcgaacacagggagtccagccactcgtgaccgcggaaagcaccgtcccctcgcccggcctggcccccggccggccgccacgggaccacggatccacggccgtcccggttctccggccgcgccgcggggcccctggtttccgcttcccggcccggcggcagc

SEQ ID NO: 2582 - DNA, 698 bp, Unknown
  Kingdom: Bacteria, Phylum: Actinobacteria, Class: Actinobacteria, Order: Streptomycetales, Family: Streptomycetaceae, Genus: Streptomyces
gcagaccggctcgtggcgggcggtgttctggtgcgtggtgccgctgtcgctggcggcgctcgtcctggtggtggcgttccccccggccccgccgcggcacgaccggccggtgtcggtggtgtccgcgggcctgctgacggccggattcctcgcgctgctgtcgggcatcgtctccggcccgcaggcgggctggggcagcgcgcgggtgctgggcggcttcggtgccgcggcggtgctgctggcggcctgggccggctgggagctgcggcgtgagcatccgatgctggacccgcggctgttcaccgtgccggtggtgcgggcgggggcggtcgggatggcgctggcgttcgtcgggatgttcggcctgttctacgtcaacgggcagtatctgcagtacgccaagggctgctcgccgctgggggcgggggtgcggctgctgccgatggcgggcgcgctgctgctcgcaccgcgctgggcggtggctgtggagcggcgcaccggccctcggatgacgctcgggttcgggctggcggtgctggccgccggtctgggtacggtctcgctggtcggcccgagcactccctatgccctgtacgcatgcggggcgacgctcaccgcggccgggtgcggcctggccacgccgctgctgtcgcacggcatgatgtccgcgctgccggcgcaccgggccggggtgggcg

SEQ ID NO: 2583 - DNA, 518 bp, Unknown
  Kingdom: Bacteria, Phylum: Actinobacteria, Class: Actinobacteria, Order: Streptomycetales, Family: Streptomycetaceae, Genus: Streptomyces
cccgtacgcaggcggcgtcgtcgaagtagtgcgggttgtcgtggccggtggcgggcggacgcaggccggtggcgaggttgcccagacccgcccggacggagatgcgggcgcgcagcggcagcaccgcggactcgatctcggcggcgcgctgggccgccgccgcgacctcgctcgccacggcgttccaggtgaggtcgatcgcggcccgcatccggcgctcccggctcaggtcgccgagcgcgccgtcgtccccggcccgcagcaccgcctccgccgcgaacgccgcccactccgcgtcgtcggagggacccaggcgcagcggttcgggggactggttcagggcgacggggacgggcagcgtggtcgtcgcgttctcctcggcgaaggtgtccagctcgcgggtgagccgccgggtccactccggcatccgtgcggcccggtgccgcgcggcgggccacccggcggcgtccccggccgccagccccagcagcagcccctcgatacgccgctgctcactc

SEQ ID NO: 2584 - DNA, 517 bp, Unknown
  Kingdom: Bacteria, Phylum: Actinobacteria, Class: Actinobacteria, Order: Streptomycetales, Family: Streptomycetaceae, Genus: Streptomyces
gcccgcctgctggcctccctcggtcccgacgcgatcgtctcctccgacctgaagcgggccgcgcgcacggcggccgagctggccgccctcaccggcctggacgtcgcccgcgacgagggtctgcgcgagacctacgcgggcgtctggcagggactgacgcacgaggagatcatctcccggtacggcgaggagtacgccgcctggaagcgcggcgagccggtgcgccggggcgggggcgaactggagagcgaggtcgccgaccgcgccgcccccgtggtgctgcggcacgccgacaagcttcccgaggacggcacgctcgtggtggtcagccacggcggcaccatccgcaccaccatcggccgcctcctcggcctggaggcccgccactgggagagcctgggcggcctctccaactgctgctggtccgtgctcggcgagggcgcccgcggctggcgcctcctggaacacaacgccggcaccctcccggaaccggtcctgggcgacgacacctgacccc

SEQ ID NO: 2585 - DNA, 732 bp, Unknown
  Kingdom: Bacteria, Phylum: Actinobacteria, Class: Actinobacteria, Order: Streptomycetales, Family: Streptomycetaceae, Genus: Streptomyces
tgtctacaccgtgccccgcctgaccgtgcgcacctcggccgggaagcagccggaccgcagcgccgacgcggcccgtcccggcctgcgcatcggtgtcgcccgccgcggcaccgcggcgggccccgcgccgaagccgtcgatcaccgcccggtgcccggccggcagcgaggtctacctctgggcgccgcacttctccggcaccgcccgcctcaccgccgccccggcggccgggaccgcggcgggcgccgcccgcggctacggcccgaccggacggttcgcgtccgacgcggccaagatcgccgccatgcagcggctcggccgcgtcccggcctcgggccggctgcggatcgagctgacccccaccaggaccggcaccgtcccggacggcgccgtcggctgcctcgacaccgcccggctgcgcaccgccgtcgagcacctcaaggccaccggcgcgagcgaggtgaccgtctccgacggcacgctgcacgcccgcctcccggcccacagcacccgcaccgccgtcgtcgccgcgccccggatcgccggctggcgctgtgcggcgggcagcgcctccgccgtccccgccgagcagtactacggcctgatcgccgtcccgctggacggcaccgcgaccagcgtcacctgcaccttccacccgccgggcctgcgcctgggcgccgccgccggcggtgcctcgctcctggtcctggccctgctgggcgccctcggcgc

SEQ ID NO: 2586 - DNA, 781 bp, Unknown
  Kingdom: Bacteria, Phylum: Actinobacteria, Class: Actinobacteria, Order: Streptomycetales, Family: Streptomycetaceae, Genus: Streptomyces
cagctccgcctcgccgcggaggggctcggggaggccgccggtgcacatcagcagggctccgggttccctgcgggccgcccggcgggcgcctcccgcacccgggggcgcagccggggcgggggagcggtacgtgcccgcctgggcggcggctccccggggaccggaccgaagtacgcgccgaacacccgctcgtaccgttccagatcgtcccggtccccgcacagcgtcagccgccccgcccagtacacgtccgcccgcatacccgggcgcagcgcgtccaccgcgcgcaggaacgcgtggagccgctcggtgctcaccccgaccccggccgcgcgcaacgcccgagcgaagccgagcagcaccgcgtcaccgcgcggccccccggcgccgtcactcacacggtcaacgccactggtcccgccgtcggacgcgccggcggaccggccgccggacgcgccactgggccggccaccagacgcactgccggacctgccgccgccggatccgccctccgcgccaccgcctcccgcgccgatcccggtgaccgctccgctcgccgccgtcacgcccgccccgctccccgtgccgccaggatcgccgcgaagtcgaggccgcgggcccgggccgtgtcctcgcggtacttcaggaccgaacccagcgtggccaccgccagttccgcgtcggcctcgtccgcgcccagcgcgtccagggcgcggacccagtccagggtttccgcgacgcccggcggcttgagcaggtcctcggcgcgcagcgcctgcac

SEQ ID NO: 2587 - DNA, 777 bp, Unknown
  Kingdom: Bacteria, Phylum: Actinobacteria, Class: Actinobacteria, Order: Streptomycetales, Family: Streptomycetaceae, Genus: Streptomyces
ctcctggagcgccacgacgaacgcgagcggctggtacggctgctcgcccgcggccgttccgtacgcctgaccgggcccggcggctccggccgcaccagcctcctcgacgtcgtcgcccaggactgcgcgggcctcgcgcccgacggcgtcgtccggctcaacggccaccgccgcaccaccggcgacctgctgcacgacctcttccacgccgtgtacagcgcccccgggcaccgccccggccgcgaggaactcctcgaccacgtccgtgagatcggcgccgtcgtcgtcctcgacgacatcgagttcggcggcaccgcgctcgacgaactgctcgacgccacccccgagtgcgccttcctgatcgccgccacgcccgaggtgcccgcgccctccaccgactccgccctcgaagaggtcttcctcggcggcctcgaccgggccggcggcgtcgaactcatcgagcgcggcgccggccgggtcctcaccgaggaggaggccaactgggccggcgacctctggttcgagtccgagggcctgccgctgcgcttcgtccaggccggcgccctgctgcgccagcgcgaccggctgcgcgccggcaccagcgccgtggaggagttcggcgtcttcgccgacgccccggccgccgacgccgtcttcgagaccggcgacggcgacgccgtacccctgccctcgctcggcgaggccgccgcgcccgccccgctgctcgcctcccggctgagcgccgccgcacgcgccaccctgcgcttcgccgtcgcc

SEQ ID NO: 2588 - DNA, 607 bp, Unknown
  Kingdom: Bacteria, Phylum: Actinobacteria, Class: Actinobacteria, Order: Streptomycetales, Family: Streptomycetaceae, Genus: Streptomyces
gtcacggcgacggccagcaccgacgcgcaagccgggccgtccgacggcaccgtgccggacgccgcggccacgtacaccgaacccgactggcgcaaggccccggtcgagacgttcggcatcgagggcggcggtgacgagggaccgctgaccatcacgccgccgggcgagggccgccccgccctgacggtgcaccaggtgccccacgacggagcgtcgttcttccacgcgctgatcgccgccgccgggcaccacggccggctgctgcccctgctcggcaccgccaccgccggcggtacgggcgtaccgccctccgcgtcaccggcggacctggtggagtcggcccgcggccggctggtggacgcgctcgcggagcgcggcaacgcggacctgctcgacgcgctcgcccccgagcgcggcgacgccttgtcgacggaggaactggccgacgcgggcatccgcctggacggtccccaccaggaggagttctcggtgcgcggggcgctgccggaacagcggtggctgacgccgggcgagcggctgagcctggcgaccggcgccctgtcgcgtccgttcggcgggcccgggaacctggaccacggggcggccg

SEQ ID NO: 2589 - DNA, 554 bp, Unknown
  Kingdom: Bacteria, Phylum: Actinobacteria, Class: Actinobacteria, Order: Streptomycetales, Family: Streptomycetaceae, Genus: Streptomyces
ccaccgtccctgtcctggcgctcgccctcgcctgcgccccggcgtgctgggcggcgcatctcttcgcggtgcgcgcccggcgcagtctgacggccagccgcggcctggaggagttcgccgcctccgtacggcccctgctcctcggggtgttcgccggattcctgtgcgtcctggccgtgctgctcgcggcctgcggcaggatcctgcacgagcccaccggccccgcccagaccctcgcactgggcgccctgctgctgctcgcccgcctcctcaccacgtacggcttcacccacgccccgaccgtggccctcggtgccgcggcctgcgtggaggtgacggcccaggcgagcgtcttcgccggccggctcccgggctgtgacccgttcgccgtcccggtcgacaccctcgtgaccgcgtggggcccgggcagcgtcccggcactcgcctgcggagccgcggccgcggccctcctggtccacgcgacccgcaccctgaccagggcctcggcccacgcgcgcacagggacacagccgtgacgggcaccggtcgggccc

SEQ ID NO: 2590 - DNA, 634 bp, Unknown
  Kingdom: Bacteria, Phylum: Actinobacteria, Class: Actinobacteria, Order: Streptomycetales, Family: Streptomycetaceae, Genus: Streptomyces
gggcagggccgcggtgcgggtcgcagaaggctcgtggggcggcggcgggagcccgccgtacgcgacggcgatgcccccggggggacgatcaacggcccgtggcgtgacgcggcaagagtccgcggagcggcggcgaaaagcccgcggcgcgcgacgaagaaggcccgcgagggcgcgacggtggtccgttgcgcgcgacgacggcggtgggtggcgcaccgacggcggcccgcccgccgacgcgcgccacgggccctcgccgtcaggcaccgcaggctctcgccgccacgtcccatcgccttttcccggccgcccacgcgcccttctcgtgttccgtcgggagaccggcggcgcggcagtcacaggtgtacgccactgacgctccgcaggcccgggcggcgtcgtcgcgaaactcgccgggaccccgcctgacatgggaaatcgctgtgctgcgcgcatgattgacggatcgtcggccagccggtagcactgaccccacgccggccccgcacgccccgtcacgcccgagcgccccaggaggctgctttgcgaggatccgccaccgactccagagccacgccggcccgcagcgccacggcgtggctctggagtcggtggcggatcctcgcaaagc

SEQ ID NO: 2591 - DNA, 536 bp, Unknown
  Kingdom: Bacteria, Phylum: Actinobacteria, Class: Actinobacteria, Order: Streptomycetales, Family: Streptomycetaceae, Genus: Streptomyces
cgcgagctgctcggcgagcggcacgggttccgcggcacggccgcggactacgagcggctggactcctcgctgctgcacaccgtgctgcggcggcggcgcgggctgccgatcctgctgtcggtggtgtggatggaggtcgcgcggcgggcgggcgcgccggtgtacggggtggcactgcccgggcatttcgtggtcggcttcggcgccgccgggcagcaggtgctcgccgatccgttcgacgggggccgggtgctgaccggggcggacgcggagctgctggtcaccggggcgacgggcgctccgctggacgcgtcgatgctggtgcccgcggagccgctggacgtcgtcctgcggatcctgaacaacgtccgcgcgtgggccgccgcacgccccgagcggtcggacgtggcgctgtgggcggtcgagctgtccctgctgctgccctcgcacccggcgcggctcaggtacgagcgggctcggctgctggtggagcggggcgacttcgtcggcggggcggaggcgctggaggcttatgc

SEQ ID NO: 2592 - DNA, 506 bp, Unknown
  Kingdom: Bacteria, Phylum: Actinobacteria, Class: Actinobacteria, Order: Streptomycetales, Family: Streptomycetaceae, Genus: Streptomyces
ggttcatttcagtggtcgacggcatggtatcgacagcgcgatcaagatgacccgactcttccaactcgcacatccacgcttctaacactcccgcagtcgggccatctgagctcaatgcgttagctaaggccaagttttgtgaatggttgtggcgcaacactagggaagcaacatcatccgccatggccggcagcaattcatcgcgttcttgttcgctgattccgcctgccgcaacctcagcgtccaggaggatcttgatgttgacttcgtggtccgaggtatctactcctgccgagttgtcgatgaagtcggtgttaatgcggccaccattgcgggcatactcgatacggccagcctgagtccaacctaggtttccaccttcaccggcagccttcgcacgaacgtccttggcggtgacacgcaccggatcgttagcacgatcgcctacctgagcatcagtttcactggtagcgcgcacataggtaccaatgccgccattccacaac

SEQ ID NO: 2593 - DNA, 6605 bp, Unknown
  Kingdom: Bacteria, Phylum: Firmicutes, Class: Bacilli, Order: Bacillales, Family: Paenibacillaceae, Genus: Paenibacillus
ctgcaaaagacggccttcacctttgacgtgtcggtgtgggagctgttctggtggtcgatggtcggctcgaaggtgagtctgttgtcggttggcggggaaaagaacccggaagatatcgtcgatacgattgcccgcgatggcgtgagtacaatgcactttgtacctgccatgctgcatgcgttcctggagtacgtggagcagcagccacgggaagtgatgcaagcgaagctggcaacgctgcgccatgtgtttgccagtggtgaagcattaccgccacagcatgcggcgcgattccaacggcttgtgtcgagcctgactggagcgaagctggtcaatctctacggtccaaccgaagcgacggtggacgtatcgtacttcgattgcgagcctaatgaaacctattcggtcattccaatcggaaaaccgatccaaaatattcgtctgtacatcgtgaaggaaggtacggagcaattgcagccgatcggggttgcgggtgagctgtgcatcggcggtgtcggggtagcccgcggttacctgaatcgtccagagctgacggcggagaaattcgtagccgatccgtttgcgggcggggaagcaggctatgagcggatgtaccgtacaggtgatttggcgagatggatggcagacggcaacattgaatatttgggccggatcgaccatcaagtcaaaatccgcgggtaccgaattgagctgggcgaggtcgaatcgcagctgctccaagtggaatcggtacgcgaagccgtggtcacggcgcgtgcggatgagacgggacaaaaacaaatggtggcgtactatgtcgccgggcaagaaatgggtgccagcgagctgagaagtgagctgggccaggagctaccaagctacatggtgccgtcgtactttgtacagctggagcagatgccgctgagtccaaatggcaaaattgaccgcaaggccctgccagcaccggaaggcagcctgcaaagcggagccgattatgtcgcaccgcggacgtgggtggaagtgaagctggctcacatttggcaggatgtgctgggccttacgcaggtcggcgtgaaggaaaacttcttcgagattggcggacattcgctgcgggcgacgacactggcctcgaagattcacaaggagctgaacaagccgcttccgctgcgcagtatttttgaagcaccaacgattgaacaattggcaacgatgttagaaagtctggatcaagtggcgtacgcgtccattccggtaacggaagaacgcagcttctacccgttatcctcggcgcaaaaacgactgtatgtgctgcatcagtttgatccaagtgatgtgaactacaacatgccgtcggtgctgcaaatgagcggaccgctggacgtaaaacgagtagaagacgtgttccgtcaactgatcgcccgccatgcgaccttgcgtacccactttgagctggtggacaatgagccgatgcaatgggttgaggatatcgtgccgtttaaagtggaatatacgaaggtacaggcagagcgtgcgactacggatacaaatcaggacacatctatagctacagctacggacacgatgatcagccaggaagcacaagaacgggtacgacagtttgtccgtccgttcgatctgaaagctgcaccgctgctgcgggtaggcttggtggatctgggcgcacaaggagcagagcaggaatcccagcatttactcatgctcgacatgcaccatatcgtttcggatggtgtgtcgatggaggtgctgaccgatgaatttgtccgcttgtatggcggtgaagagctatcaccattgcggattcagtacaaagactatgcggtatggcagcaaagcgaagcccatcaggagtggatgcagcgtcaggaagcgtactggctgggtaccttccggggcggcgtgcctgtgctggatctggcaaccgactttgcccgtccggcggtacagagtacggcaggggatacgatcgaattcggactggagcgtgaagttagcgaacgcctgaaagaactggcttcgcaaacaggttcaaccttgtatatggtgctgctggcggcgtacactacgctcttgcataaatacacaggccaagaagatatcgtagtcggcacgccgattgctggaagaccgcatgcggaactggagagtctggtaggtgtcttcatcaacacactggcaatccgcaattatccgtctggcgaccaatcgtttctggattatctgcaagaggtgaaggagcatgcgctcagtgcttatgagcatcaggactatccttttgaagagttggttgaaaagctgaatttaacgcgggatacgagccgaaatgcgctgtttgacacgatgtttgagttaaaaacattggagcagcaggagttgcagctggaaggtctgaccttacattcgtatccgctggaaaatcatacggccaaatttgatctgagcttggatgcaatagagcagccagaaggcattctgtgccgtctggaatacagcacggcgctgtacaagcctgagacgattgcgcgattggcacagcattttaccgaacttgtacgtgcaattacactgcatccgcagcagccactggcagctttggatatggtatctgccgaggaaaaagcacaaatcatctatggttttggaaatgtgggggtatcggatgttgctgtagtcgaggcaggagccttattccatacctttgtggaagaacaggcgcagcttgtgccggatcatgtggcggtggtgtacgaggagcagcagcttacgtaccggaaactgaacgagcgtgcgaaccaattggcgcggagattgcgaaatgaaggtatcggacgcgaatcgattgtcggcattttgagcgaacgctcggtggatatgctggtcggtgtattggcggtgtggaaggctggaggcgcctatgtgccgctggatgcagactatccgtcagaacgtattcgtttcatgctagaggacagtggtgcgagggtactgttgacccaaacgggcttgcaggagcgtgcactgggttggctgaatgaaagccaatgggctctgggcgaaggaaagaatgagagtgagctggagacggcggttagcgctgaaacgatggaaagagaccgccttagtgaaggcgtaagcttgaaatcagattcgaagtctgacagcgaagcagcatccgaaccggcaacagtgctgcgtctgcataccgtgctggtgttggacgatgagtcgctgtacatcggagacaccaccgatatcgagccgattaacgaaccgcaggatctggcgtatgtgatttacacctccgggacaacgggacgtccgaaaggggtcatgatcgagcatcacagcttggtgaatacggctgcggcgtatcgccgagattaccgtctgagcgagttcccggtacgtttgctgcaactggcgagcttctccttcgacgtcttcgtcggggatatcgcgcggacgctctataacggcggcacgatggttatttgtccgaaagacgaccggattgattttagccgtttgtatggctggattcgcgattgccagattacggtgttcgaatcgaccccggccctgatcgtaccgtttatgcagcatgtgcatgaacaggggttagacatgagcagtctggaactgctgatcaccagctcggatagctgcagtgtgacggattatcgggtgctgcaagaacggtttggtgcggatattcgcattatgaacagctacggcgtcacagaagcagcaatcgactctagcttctacgacgaagaattgtcgaagctgccaagcagcggcaatgtgccgattggtcaggcgtggctgaacgcccgcttctacatcgtggacagccagctgaatccggtgccgattggtgtactgggtgaactgtgcattggcggagccggggtggcacgaggctacctgaaccgtgcagagctgacggccgagaaattcgtagcgaacccatatgtagcgggtgaacgattgtaccgcacaggcgatttggcgcggtggatgccagatggcaatgtggactttattggccggatggatgatcaggtcaaaatccggggcttccggattgaactgggcgaggtggaagcacagctgctgaccgtggacggcattcagaaagccatcgtcaccgcctgggaaaacgaagacggagacaaggatttgtgtgcgtatgtcgtagcctctgatgcgctgaatttgccagagctgcgcaacatgctgcagcccaagctgccgggttatatgatcccgacatatgtcgtacaactggatcaattcccgctgacaccaaacgggaaaattgaccgcaaagcgttgcctgcgccggaagcgcgcctcgaaggaggcacagcatacgtggcaccgcggacactgctagaagagcagttggtacgtatttggcaaagtgttctgaatcatccgcagatcggtattaaggaccatttttttgaagtgggaggacattctctgcgcgcgacaaccctgatggcgaaaatccatcaggagctgaattacaagctggcgctgcgagatattttccaatatccgacgattgagcaactggtgcaggtgatgggagaagttcagacacagcaaacgtatgtatccatccctgttgcggaggaacgtgcatattatccggtttcctcggcgcaaaaacggatgtacgtgctgagtcatttggaaggcggagaggttagctacaatatgccaggcgctttgatcattgaaggttccttggataaaacgcgactggagcaagccttccgccagctgattgcccgtcatgaagccctgcgaacccgattcgacatggtggatggcgaggtgattcaacggattgaatcgggcgtcgcattcaacgtggagcatgtgcaggcaagcgaagaagagacccagcagtacgcacaggactttgtacgtgcatttgatctcgcacaagcaccattgctgcgggttcagctggtggaaaccggaccggagcgttacgtcatgctctatgacatgcaccatattatttcggatggcgtcactgaaggaattatcgtgcaggagttctctcaattgtatgaaggcaaggaactgccgcctctgcgcattcagtacaaggactatgcggtttggcagcatgccgatatgcaaagtgaacgtcttcgtgagcaggaaagctactggctgaacacgatggctggtgacattccagcactggatatgccaacggattttataagaccagccgtacagcgtctagaaggagatcgattggaatttgcgatcagcttggaggatagcgagcagttgagacagctggccgcgcaaaccggctccaccttatacatggtgttgctagcagcatatagcacgctcttgcataaatattcggggcaggaggacattatcgtcggcacgccgattgccggaagaccgcatgcggaactggagggcttggtaggcgtattcctcaacacgctggcgatccgcaattatccgtctggcgacaaaacgttcctgaattatctgcaagaggtcaaagagcatgcgctcagtgcatatgagcatcaggactatccttttgaagaactggtagaaaagctgaatttaacgcgggatacgagccggaatgcgctgtttgacacgatgtttgagctgaaaacatttgaacagcaggagttcgagctggagggtctgacctttaaaacgtatccgacggacaatcctacggccaaatttgatctgaccttggatgcagtggagcagccggaaggcattctgtgcagtctggaatacagcacggcactatacaaggctgagaccatcgggcgattggcacagcattttaccgaactcgtacgtgcaattaccctgtatccgcagcagccactggccgctttggagatggtgaccgtcgaggagaaggcacaaatcatctacggttttggagatgtgggagtatcggatgttgctgctgaagcaggagctttgttccatacctatgtggaagaacaggcgcagcttataccggatcacgtggcggtggtgtacgaggaacaacaactgacgtaccgcacactcaacgagcgtgcgaaccaattggcccgtagactgcgaaatgaaggcattggacgcgagtcgattatcggcattttgagtgaacgttcggtagacatgctggtcggcgtattggcggtatggaaagctggaggcgcgtatgtgccgctagatgcagactatccgtccgaacgcattcgtttcatgctggaggatagcggtgcgacggtactgttgacccaaacgggcttacaggagcgtgcacaggtatggctggatgaaagcaaaactacatccgaatccgcagcgggtttgcgtctgcataccgtactggcgttggacgatgagtcgttgtacaccggggataccacagacgtcaatcacatcaatgaaccgcaggatctagcgtatgtgatctacacctccgggacaacgggacgtccgaaaggggtcatgatcgagcatcacagtttggtaaacacagccgcggcctaccgtcgggattaccgtctgaacca

SEQ ID NO: 2594 - DNA, 1448 bp, Unknown
  Kingdom: Bacteria, Phylum: Firmicutes, Class: Bacilli, Order: Bacillales, Family: Paenibacillaceae, Genus: Paenibacillus
cgggattaccgtctgaaccagttcccggtacggttgttgcaactggcgagcttttccttcgacgtgttcgtcggggatatcgcacggacgctctataacggtggcacgatggtcatctgcccgaaagacgaccggattgacccaagccgtctgtacggctggattcgcgactatcagattacggtgttcgaatcgaccccggccctgatcgtaccgtttatgcagcatgtgcatgaacacggactggacatgagcagtctggaactgctgatcaccagctcggatagctgcagcgtgacagactaccggatgctgcaagaacgatttggcgcggatatccgcattatgaacagctacggcgtcacggaagcggcgattgactccagcttctacgacgaagaattgtcgaagctgccaagcagcggcaatgtgccgattggccaggcgtggctgaacgcccgcttctacattgtggacagccagttgaatccggtgccgatcggcgtactgggcgagctgtgcattggcggtggcggggtggcacgaggctacctgaatcgtgcggacctgacagccgagaaattcgtggccaatccgttcgtgccaggtgaacgactgtaccgcacaggcgatttggcgcggtggatgccggacggcaatgtggactttatcgggcggatggattatcaagtgaaaatccggggctaccggatcgagctgggcgagattgaaacggcgatccagcgggtgccgggcgtgtgtcaagcggtagtcatcgaccggacggatgagcgtggacacaagtacttgtgcggatacatcacgggagaagccgagctgcggatcgaggaggtacaggccgaactggaagccgggctgccagcgcacatggtgccagcacgtttgatgcgactggagacgatccccctgacgagcaacggcaaaatcgaccgcaaggccttgccggaaccggaaggaagcatccatacgggtgcggcttatgtcgcaccgcgtaccacggtggagcaagtactggctgcggtatgggccggagtactcggcgtggaagcggtaggcacgcaggataacttctttgaactgggtggcgattcgatcaaggccttgcaagtatcctcccgattgctgcaagcaggttatcgactggagatgaaagacctgttcagtcatccaaccgtgtctgccttggcactgaaagtccaatcggtgacccgattggcggatcagagcgaagtggtgggcgctgtgaaactgacacccgttcaacaatggttctttgagcagaacctgacggatgctcatcatcataaccagtccattatgctgcatggcaaggacggttttgatgaaccggcattgcgcacggcgatggatcaaatcgttagccatcacgatgctctgcgtatcattttccgacctacggagcgcgg

SEQ ID NO: 2595 - DNA, 285407 bp, Unknown
  Kingdom: Bacteria, Phylum: Firmicutes, Class: Bacilli, Order: Bacillales, Family: Paenibacillaceae, Genus: Paenibacillus
tctccatatcttacgacatggcttgattctcttgaaggtgttttgatttgtctcacgttatggggtcagttccccactttattcatggttttgaaggttctttttttcatcttgttgacaacctcttgtgattatggaaaattcataattagcaattatcctgattccattagattgggttattcaagccctgagtgtcaggacttattctcttatttccgggtgttatctgctaacaaatcgcagaacgcttttccgtaaggtggaagatcaggcggccgacgagcagatacaatatgtccatccgttacaactgcctcatccttccaaattgctcctgcattctccatatcatcacgaatacctggtgtggaggttaccgtaacaccatccaaaattttagcagagatcagtacccagcctgcatggcagatttgtccaatcggcttatgagcagcatgaaactcctgtacgagttgaattactttgggatagcggcgcagtttatcaggtgcccaaccgccagggacgagaatcccgtcataatcactgctattcagttcctcaaaggcatattccgcttcagcaggtacgccatattttccaatatattttttacccttttccgcaccggctaaatgcacttctgcgccttcttcacgaacacggtaaatcggataccacagctccagatcctcgaattcctcatccactagggcgataaccttttttccggcaagtcttgacatccaaccatcctttcgtgcgtcacatgatgacacctctgttttgtaatctgtacttttacatcttaagaaaaagaacgcccgaagtccattccttcgcagattcttatcttagtagtctgctctttgacagcaattgtcgtcattttctgacccgccaaagctttggtaatttgttcatagctgcaatctgtggaaggatttgaggtcccaaagtcgaaataaaacaaggtatgatagatttaatggagttaacaaatatttattagactagtagatagatatatttggattctgacgagatcctcgtatagtttgatcctacgtaatgaggtggttaaatgcataagcaatgccaatgtggcaaaccgatgggactggaactgcgaaaggtaatctatgcgggcaaggttgaaattttgcacgtccctgtattctcatgctcgtcatgcttttccagtgaggttttgcagcatgtgacgaaagacattaagacactattacaaagtctagggagcaaacctacggcacggagaatatcttttgctcgcaataatgaactggcagaaatcattcgcaagcttgtactggaggaagcggacaatcccaatgtggattggcaatctgctttggaggagcggatggagcttcgaattaatctcttattggatctttatcgctatgcgagaagtctgggagacgaagattggatgaatgatgtagagagaaaattggttcaattatccggttttaccagtgaatcggtatttacgaatacaaaaaactaaaaaatatgaaaattttcatggtcaccattggattttacatgttctttttgttacgatgagaataggccatacgacaagacacagaaaggaatgtatatccaatggcgacgatgacaaaaatgactactgttcaacaattaaatacggctctggaagcgtcatcagacaagccgttgcttctctttaaacatagcacacgttgtccgataagtgcaggcgcatatcaggaagtggagtcctatttgcatggcgctcccaacgaaaatattgaatacggtatcatttatgtagtagaagatcggccggtgtccaatgaaaccgcggacaggcttcaggtgaagcatgaatccccgcaggccattttaatcaaggacggagaggctgtttggcatacatcccattcgaatattacagcccgtgcactccacgatcatctcacatagataaatgtgtgctgtcgttgcataaagtagtattttgtcgtatcatggttctaattagttgatctaggattcggttgaaaatttattggcaatggagagaaggaatgtgacggtaacgatctatgatgtagctcgcgaagctggcgtctcaatggccacagtgtcccgcgtagttaacaataatcctaatgtgaaacctcagacccgcaagaaagtgtacgaagcgattgaacaattgggatatcgtccaaatgcggtcgctagaggtctggccagcaagaagacaacgaccgtcggcgtggttataccggatatatcgaactcaatttttgcagaaattgcgcgcggtattgaggatatagcgaatatgtatcactataatattattttgtgtaatgccgacaagcgaaaagaaaaagagattcgtgtcatcaacacattgcttgaaaagcaagtggatggtcttctgttcatgggtggtacagtaacggacgagcatattcaggcgttccatacagctgcggtccctattgttctatgtgcaacgagtgatgaaaaaggaagctatccttcggtcgatatcgaccatgaagccgctgcttatgatgcagtaaacacgttgatccgccatggacaccgtcaaatcgcaatgatcagtggtacgcttcaagaccctgcaaacggctatgcacgtttccaaggttacaagagggcattggaaacagccggaattgattatcaggaggatctcgtgcgaatcgggaactaccgttatgaatccggtgtcgaagcaatgaaatattttctcggcctaaagaagaagccaagtgcgatttttgctgctacggatgaaatggcaattggtgcgatccacagtattcaggatgagggattgaaagttcctgatgatttttcggtaatcagtgtcgacaatattcgtatggcctctatggttcgtcctcagctgacaaccgtcgcgcaaccgatgtacgatttgggtgcggtagcgatgcgtttgctgaccaagctgatgaaaaaggaaaacgtggagaaccctcgcgttattttaccgcatgaaactattttgcggttgtcagttaattatttagactagacgcagtgctgaataggatataccttcgttgaaagctcctttgatggagcttttttcgcggatataaagcttcttatggacatcatcatcaaaccaagaatagagggatgcgtaatgagccgactttacggattaatgggtgctatggatgaagaaattgaattgctgctggcagcgatgacggaagcaagcaagacggtcaaggctggaatcacgtacactacaggaatcattcacgggcaaagagtcgttgtctgcaaatccggtgtaggcaaggttaatgctgcggtaacaacacaaatcctgattgatcattttggtgtagaacagattatatttacgggagtggcaggggcagttcatcccgatttaaacattggggatattgtcatctcatcaacatgtatgcagcatgatatggatgtaacgcctttgggttatgccagaggggttattccttatcaggacacttcagagtttgtggctgatcccgagcttgtaagtctagctgagcaagcctgcaaatcatttggcgatcgttatattgtcggcaaggtactttctggcgatcaatttgttgcaagtcgtgagttagtgactgcattgcatcaggaaatggacggtgcttgtaccgaaatggaaggtgcagctgtggctcagacagctcatatgaacgctgtgccttatgttgtcctacggtctatgtcggataaggctgatggatcggctcacgttaattatgctgaatttacggtagaagcttcacatcgttcgcatcgtattgtggagttcatgctcaagcatttgggctaatggtataattttttaatacatgaatcttcggacaaaccggatatggtcaaactgctcctgtgatgcaaggggcacatcctttcccattcgtaccatcagacagttagcaggatgtgaacatatttcaggatcatccgtggcgtaccagaccatatctacagttttcatcagacgttccatcatgcggcggtattcccatacggaaagaccgctgccttttaaatcccaatgccaatagtattcggtcgtaaaaataatataggattcaagctggccgtcctcaaaggcaatccgaatcattcggctacccaggcccagaccacgatagtcatcggctacctcaacagctccaagttccagtaaatccttcatgccagcttccgaccagcgctccatctcatctgggtaatgaaaagtaacatatcccaggagagtttccccgttgtgggcaatgataattctgccttctggcagttccgaaatatccactaatgcatcgaactgttcctttggtttgcgaaaggcatctaattgcttgtgcatttgaaatgaacgcagttgatccgcggatacggggccttctacatagattgtttgtccgttatgatccagcgtatccaagtggtacagttttaaatgctgcatgcgtacgccctccttgttcgccataagctcgttcctcatatcccctacttatagcaaaaaaacaattaaatgaaaaggatggtcgtcacatcctgacctatgatatactgttttagacataaaatgttcacaatttaaatcaatcagtaaaccaaaggacttcatctgctttattgattttgtaagcgttatcttgttctgtatgattctcattaatctattgtgaggaggctgaacgtatgaagtttgaagaactccagactgtagttcccacatccaacatgggcccgtatgaacaagcttacaacaactttcagtgggaagatgcagagcgtcattttacgtggtatgaaacaggcaaggtaaatatggcacatgaagccattgatcgacatgtacaggaaggacgaggggagaaagcggcactattgtattgtgacgcaaaccgtcatgaaacctacaccttctctcagcttcgtgctagctctaacaggttcggaaatgtgcttcgcaaatacggtattggtaaaggggagcgggtgtttattttcatgccgcgttcacccgagctggttattagtttacttggtgttctaaaggtaggggctgttgtcggtccattgtttgaggcgtttatggaaactgcggttaaggatcgattggaggatagtggggcagtagcattagtgaccacacctgcgcttctgtcacgggtaaaacgtgaggagcttcctgagctgcgacatatttttgtggttggtgatatggatgaacgcgagcagggaattatcgattttgagacagaaatgctcacatcctcagaggaacttgagccagaatggttgaatcgtgaagatggattaattattcactatacatcaggctcaacaggcaagcccaaaggcgtgtatcatgtgcaaaatgcaatgattcagcattactatactgggaaaatggtgctggatttgcgagaagatgatgtgtattggtgtactgctgatcctggctgggtcacgggaacatcatacggtatttttgctccatggctaaatggagtgacgaatgtcattcgtggggggcgtttcagcccggaagactggtaccgcacgattgagcgtcacgaagtgaccatatggtatagtgctcctacagcgtttcggatgctgatgagcgcaggggagcaggttgtttccaaatatgatcttagcagtctgcggcatgttttatccgttggggaaccgctgaatccagaagtggtgcgatggggatggcaagtgtatacacaacgcattcatgatacttggtggatgacagaaacaggagcacagttgatctgtaattaccctgagctgccgattaagccaggttcgatgggaaagccactcccaggtatccaagctgctattttggacgacagagggcaggtgttgcctcctaaccggatgggccacttggcgatccgtacaccatggccatccatgatgaatcgtatatggaacaatccgaacaagtttcaggaatatttccgctttcccggttggtatgtatcgggtgattcagcttacatggatgaggacggatatttctggtttcagggtaggattgatgatgtcattaactcctccggggagcgcatcggcccttttgaggtggagagcaagcttctggagcatcctgctgtagcggaagccggagttattggaaaaccagataccgtgcggggagagattatcaaagcttttgttgcactgcgtgaaggctatgcaccgtctgaagctttaaagcaggacatctatcgcttcgttaaggaagggctgtctgctcatgctgctccacgcgaaattgagtttaaggaaaagttacccaaaacccgttccggtaaaattatgagacgcgtgttgaaagcctgggagcttaaccttcctacaggtgacttatccaccatagaggattgaagtgctctgcatattagaattaaaaaagggagtctccaaagccttaatggctaaggggactccctttttgttagggcaaatctcatcttcacccaacctatcactttctgcttttgtcttcagttatggacggacggctccggaaggagccgattcccccatggcattcatggaagtgacacgaaaccaaccttttagctttttccctgacttatattcaaagctggtagatgcggtagagcctatgtttgtaaaaggctccgcaccgttttcgctgtaatacacgttatagcctgtaatagcgtccgcagatttacctgcgctccattggagcgctacggatgagccagcggctttagcttgaggctgtccaggggcagtaggaacctctgtaggctgcgcacctgttccatctccctcgcccggaacgtttggagactcagaatctgcaggtggcaccacaggtgctgcgcttgctttcgtgcttggcccggactcatgaccgcccacatcaacggcagtcacgtagtagctggagctgctgcctccagggctgtcagagaacaccttggagctgtcagccataacgaccttgccaagccgttggaagctacccccatctgtagaacgatacagacggtatcctacgacgtcgctgtttccgcttgggttaaagctgattatggctttaccgtcactatagcttacgttgacgctagatggagcgttaggagctgctccatcgtccttgcgtggatcaatctgagtaggagcttccttatctgcatcctgaggtagatagtaggacaacgaattatgtcgtctcatcaccttaaaggcttgctgaagctctttaatcaattctgagattgacttttcccgtttcctaacggtccgttcatataacatatcatccggtgtaccatcgcgtggaatataattcacaccttggtaggtaatatatttcgcacggctcacaccattttcactgtttttaggtggatacttactgttataaatgtccgaaccatacgcggatgctgtacggcttacaatgccgtcaggtctcttgaagctgtccgtttggaacagctgagcatctttagctgttacttcattcatgattagagcccataagcggcgagcccgctctttttggactttcgtttcaagcttattgacaggttgcttgtaaccaacccatacacccagtgtgacgtcaggcgtaaagccctcgaaccaaacatcagtgtaggattgcgtagtgcctgtcttgccggcaatcggaatcttaccggattgatcaaagttccgcttcaccagtctgcctgtgccttccgacacggctgtacgcaacatatctgtcatcaggtaggcggtttgcggtgagaaggcctgcacaggattaggctgatgcttatatacaatattgccttgcgaatccacaatcttttcgatcatataggcatcattaaacacaccgccatttggaatggctccatatgcattcgtgagttcctcgacggtcactccgtgggctaagccgccaagtacacccgtttgggcgttgttatcactagattccaaggtggtaatacccagttttttagcaaaagcccaagcattgctaatccctactttttcgttaaacagcttgagtgctatcgtatttagcgattgattcagtgcataacgcgccgtgaccaatccttgatagcggttgttagcatttttcggaatgtgatatccattactgccatctttcaaaataataggggcatcatccacgatactaccaggctgcacaagaccgctgtccaatgcagggagataggcagcaatcggtttcattgccgaacccggctgacgtaccatctgggtggcataattcatctgctccttttggaagtcccgaccttccatcattccaagaatggcgcctgttttatgctgaatcagaatagccgctgcttgttcgtcacccttggttttactagtggcagagaagttgtttttattttctgcaatttgacgcatagatttgtatacgctcttatcaatggtggtgtacaccatataaccgcctgtgcgaagctgctgttcggcttccttgagtaaatcgttatcatccttggtcttggtatctgcactggcattagctgcttgacccggattggtgacagacatgagtgcctgcgcagcttgtcgttctgtttccatcataaggtatggataggtgttataagctttaacagtgcgtggtgcgagagattttttgatatcaaaagccatcgcttcatcatactgtgctttattgattttgttttcctccagcattcgactgagtactaggtgctggcggttgagggctcttttaaagccagcttcattaaactcacccttaccgttgaaagcagaataagaagaaggaagctgtggcaaacctgctagataggcagcctgggctatattaagctcgttcagatcattctcattaaagatacctttagccgctgctttaatgccaaagacgttgtaaccgcttgaaccgttaccaaaaggtactttattgagataggccgtaataatttgttgcttgcttaggaagcgctcaaggcgcagagacagcaaaatttctttgaccttgcggtcatccgtgcgatcgagatttagaaagacacgacgcgcaagctgctgggtgagggtactacccccggtttgtacggattcatgcagcgccttttgcttcacagcacgcagcgttcccgacagatcgacacctttatgctcgtaaaaatgattatcttcaatggcaatgactgcgtcaatgacgagttgtggaatctccttaaacgtgacaggtcttcgatcttcttctgtccgaagttgtccgatgggagagccatcattgaaataagcgaagcctgtgattgcattcttatctacttcctgtaggatcatggatctggaacgcacgggttcgctttttacaatagaagcaacatagccggcggcggctcctcctgcaaatagtgcccccataaaaccgatgatgacgacccactttatgacacggccgagccttcgcatggttgtccgcaagcgggaaggctttggctctgatacattgtttttttcttcaaccattaagtcttcctcctttataacagccattattatagcataaaattacaaaatgaacccatatgctaaaaagcctgtcttttggtgtcgttgactacataaaagcagtgtgttataaataggtcaaagtaaatatcgtgaaaagcagagaaagacttcagtagaaggcggattcacgttgtacagagagccgatgggtggtgtgaatcggtagcgtccctcctttgaattaccgtctggagctgtctggatgaatggaagcatttgcaggtttgcgaagctatcatagtaatccagtaccgggtgtaggcccgttataggaatgaagtgaaagaaatgtatgtctttgacatgcgtttctttaattagggtggtaacgcgagcagctccttctcgtcccttgggatgaaaggggctttttggtttgtctaatatgtaatattttggatgaaaaataggaggtatacaggatgaagtgggaagaattgaagccggagcaactggtagaggtcgagcgacagctagaggtgatacgtcgtggagtagcggaaattgtacctgaggatgagctgaagcgtaaggttattaaatcggtcgttagcggcgagccactcaaaattaagctgggtcttgatccatctgcgcctgacattcacatcggacatacggttgttatgcacaaactgcgccagttccaggaattaggccatcaagtgcaactgattatcggagattttacaggcagaattggtgatccgacaggtaaatcggagactcgcaagcaactgactgaggaagatgtacagcgtaatgcacaaacgtacaaggaacaaatttttaaaattctcgatcctgaaaaaacaaaggtattctacaattccgaatggttagggccaatgtcttttgctgatgtagtaaccctgtcggccaaagtaacggttgcccgtatgttagaacgggatgattttacaaaaaggtaccaaaacggattgccgatcagcatccatgagttcttttacccgctgatgcagggcatggattccgtggctctccaaagcgatattgaattgggggggacggatcagaagtttaatctgctaatgggcagaaccctgcaaaaagaatacggagttgagccgcaggctacgattacattaccattgcttgaagggctggatggcgtccagaagatgagcaaaagtttggggaactacattggtgttgatgaggagccgaacgaaatatacggtaagtccatgtccgttcctgacgagctgatgctgaaatattttgagcttgcaacggatatcaacaacgaggagctggcagagctggcgaaaggtgttaaggacggctcagtgcatccacgtgatgccaaaatgaagctggctggaacgttagtgcgcatgtaccatggtgaagaagcagaggaagcagcgaagcagcattttgtgaccgtattccagcaacgtgcgctgcctgacgatattgaagagttcaccttgacggctgatcagttagaagaaggtggcattcgtgtgatccagttgctgactcatctgggctttgcagcatctaacggtgaagccaagcgcagtattcagcagggttcggtcaaaattaacgaagagaaatggaccgatgtgaacgaagcatacatgccgaaggaaggcgacattgtgcaggtaggtaaacggaaatttgctaaaatcaagcttggataatgaaaatatattcaaaagcagcgttgagattgtatcgatctcagcgttgcttttttatttctgcaaagtgaaaagtcatggtaaacttagcacaaataatcaaacatgtaggtaaagagttatacataatgaaaacgtgggttgcacaatttcggtgtaggatcgataaccaaaacaattacaagtgcggggaaggattatatggactactttaaacgaattcagtgtgcgattgagtttattgaattgaatctccgggaggatctaaaaattgccgatattgcttcacaggcatgcttttcagcttttcatttccagcgggtttttcaggccatttcgggttttacggttcaacaatatataagaaggagaagattgtccgaggcggctgaacagctaaaacaatccaatcaaaaagtgttggacgttgctattgagtatcagtacaactcacaagaggcttttacccgcgcttttgaaaagaattttgggatcacccctgggaagtatcgtaacggtgatattgagcttcctgagcaaagtaaaatcaattttctggattaccaaaaaaatacgatgggggatttggatgtgaataagccggtgatattgcagctcgaaacggtcaaaattgtaggatatgaatataaaacaaacctgaataatgagcagcactataaagaaatcccaggattttatggacactttggagcaaatgaatattttatgtgtatcccgaacaaaattgcaccgggaatgtcatatggggttgcctgtcgatttgaagacaacggtgcattttcatttgtggtgggcgaggcagttgaaaaagagtcaaaagaactggcagagggtttcatatatatggagattccagcagggaagtatgctgagtttgacgcttcgggttcagatggacgggttcagaatatacgagactttatctatggcacatggcttcctaattctaattttgaacggagggaggggcctgattttgaaattacggacgtgatgaattcctcctatccagatcatttgagtatgaaggtatacatccccattgaataaaaccctcaggctcgatgcatagagaatataaaaagcacccgaataaattcgggtgctttttggtgctaatgcaaggattagcggttgtagaattcgacgatttgtttttcatcgatatcttgggacaattcgccacgctcaggcaaacgaatgaatttaccttccagagctgcgtcattgtactccaggtaagctaccaagtggttgcggttttccaaagcttctttgatggaagacagggaacgacttctttcacgaagaccgatcacgtcgccagggcttacttggtaagaagcgatgtcaacttttttaccgttcacagtaacgtgaccgtgagctaccaattgacgtgcgcctgcacgggaattagcaaagccaagacggaatacaaggttgtccagacggctttccagcaagaacataaagttttcaccagcgataccgtgcatgtgttgagctttgttgaacagggtacggaattgtttttcacccaagccgtacatgtgacgcagcttttgtttctcttgaagctgcataccgtagttgctgatttttctccgttggtttgcaccatgttgtcccggagggaaagggcgtttcaattctttacctgtgccgctcagggaaataccgagacgacggctcaatttaaatttaggaccagtgtaacgtgccattatagagttaactccttcataattaaaatttgagtggggctctctttgcgctccaatttgttcggcgctacctattaaggtaagacgcactactgacagaaaagttcagccgctgtcctgtcagcaacaaaaaagatgagggtgacacaaactgttacgcccaaaatttaagatccgcacagtagatagttctgccgtacagtctttttcaataatatatactatatgtaagagtaggtcaatgtcaagaagagaaaaagaatgaaaacgtcaaaatttgtcgatagggctttagaactaaaaaagtgggacgaatttctgaaaaatggatgcaaatttctaaagttgagagtaaaatagatcatattatgagctatagtggtgtatagccgctgtcttggtacagctaactttgctgtgaaggagcgccttaatatgtcggaattttcaacaacggatcagcaaatgcttgacagtaaaacagtccaggctagcggtgctccgctgtttgatgataaaggatatacgtcttttgcctggctccagaacatggatatgacaccctatgatttcccctatataaatcagcttcttgtccaaggatatcggagttggttacagcagagcaatggtatatcctggattaacgaagagtatactgctgtttttaattttataggtgttcgtgttgctggtagggaagaagatgatgacgaggatttggatttggtcgaacgttgttgcatatctagagaggtggaagtgagccagcgcaaacttcgtgatggaagccttgcgtttgtgtatatggctcccatactatgtcgtaattataagagtgagccctttgccgctcttcgttttacacggcctgctcaacattctgtctcaaatcaggacacattgttagtagctgctttacattttaaatcctgcttttactcgaagtttgagtacatatttatggaagatatccttgggatgcagaatcgaagcgatcgtgaaggtagacgccgttctattttatttcagattgtaaaacggatgcatgacaaaattgacgtggaaggcgtgctggatgaggtattcgggagcatcgcctatttgtttccccatgtagatatcaccttgtacatgagtcaggatcgacacagtcgcaatccgcaggtcaaacctttgctgctgcatgaacgggatgaagatgtatgcgtccgtgcatttatgaaagggcaaatggctgtgaacgagcctgtcggtacacaagatgaaataactgaaatcgccatcccattacgtggcaagcagggtgtatacggtgttttccatatgattcttccatcgggtgcggatagtatgaaaaaagtggatgtagagctgattgccatgatggcggatacggctggtactgcatttgaaaatgcgaagctgcttgagcaatcgaatgtacttatccatgaattgcgtctcattaatgaactggttcagcgcttgaatcagagcctgaagttaaatgaaatatttgaatttgccgtgcaggagttattaaaaatgttcatggcggacttttgttgtattgtacagcttgatcaggatggaaactgttttaatgtcatgtcgagtaatgtggaaagcttaagactggaaagttaccctcttaaagatggatttgctgggctgatacgcttaacaggagaaccagtgattgtgtcggactatagaaaggatggaaagatatcctctcattttatggatgcgacagactcccagtctttgatggctgtacctatgaagaccagcgatactcctaaaggggttatactattgtccagcaagcttccacactttttctcttacgataattacaaaatgctgcaaatgctagcccctcatatcggattggcggtaaccaatgctatgctgcacgctgaagtgcggcggttggctaatatggatatgttaacaggtctgtatgtacgtcactatgtggaccaaatcattcagcaacatcaggaaaaggatttctgtggatctcttattttggtagatattgatcaattcaaacaggtgaatgatacgcatgggcatcagacgggtgacgaaattttgaaaagcgtcagcaatatcgttcgttcggcgactcgcgatgaggatgtatgtgccagatggggcggcgaggagcttgccatttatttaccacagctgggggttcagcaggcgctcgaatatgcagaaaaaatacgttaccgtgtacagcatgaaaccgagcctcaggtgactgtttcttgcgggattgctgaatggaactggctggatgagcagatcagtattgaatctttattttatagggctgatatggccttgtacgaagcgaaaaatgaaggacgcaatcgaatagttgttgatcatgtagccaatgtgtagagaatattccatagggaatgttctctttttgtcttgcataacccattgtagacaggtaatcctaaacgtagctatatcgtgtgtatgattgaattatagggaaaacacgataaagtgaaccaggtagcataactgccttgaagcaggcttattgctcatgagtatagttatgttcaggataggacggatgatggatgcattggagaaagcaatgggtgatgcaggtttgtgtgttccttgtaataggtgtgttaagtggttgtgcactggatcgacaatatactcctgagcagatttttaagagagctgttgcaggaatggccggcaaagagatggtaacgtttactggacggactgcaattagagctgacagtggtctgccgacgaataagcagtttgaatatcgcggtaggctaagaaatcacgatgaattgaccatgcactggggttctgcagtggcttttcgtaagcaaggtggctacgcagctctgcaacaaggtaagtccgagcatgatgttacacaagaacgttttcttcgtcagagtggaaaatgggttgcgctgacatccggttatccccctctggttggaaatggtatgttaaatcgcttcaatccgattcaggagcttgaggaattaaatacactgaataagagcattcgtatggaaacgggagctgcccggggaacttgggtgttgaggattgaaccggaatcagcttcggcaaagcgctggttgaaagatcgtttaataaaagaaatgaatactttaaaccctcaaatcgggatattaaaaacgcagcatacaggaacgaatcgagaactacaaaagaagttgagccaaatatgggcacaaagttgtgaggatatgagcaaccagctggagcaatccattgtgcgtactgtgtatcatctgaccatagatcgtcaaacaggtttacccttaaagctttcatcggaatgcaggatttcccgacaaggagcgaatgaagagctgcatcaagaggctttgataaccagagttacttttaaggactacaagtaacgtggcgggcatgatacaatgaattttgaattaaccattgttcaaaaagaatgaaatagagaaggagagaactacatgaaagatcctagaatacttaagctggcagaaaatctggtcggttactctgttgaagtgcagcctggagaaaatgtattgatcgaaatgattggtacagagcgcgacttgcttaacgccatcattcatgaagttggtaaaaaaggtggaaatgtttttgtacaacttacagaccgtaaggtacagagcgccatgcttcgtcacgcgacaaaggagatgctggagacctgggctgagattgaccttaaccggatgaagcaaatgcactgctacatcggaatacgtgcaggtgaaaatgtaaatgatctgtcagatgtgccggaagataaaatgaaaatgtataattccatttatcagcatgcggtacatagcgaacaacgggtgaagcacaccaaatgggtagtgctgcgttatccgaatgacagcatggctcaattggcgaatatcagcacagaagcgttcgaagatttttatttcgatgtgtgtaatctggattatgcaaaaatggacaaagctcaagatgcattggcagacctgatgaatcggacggacaaggtacggatcagcggaccgggtacggatttgaatttctctattaagcaaatcggagctatcaagtgttcaggtcaatgcaatatcccggatggcgaagtatacagcgcgcctgtacgtgattccgtaaacggaactatcagctacaatgcacaaaccttgtataatggtattacttttgaaaatgttaaattccgttttgaaaatggtaagattgtggaagcgacgagtaacgatacgaagcggctgaatgatattctcgattctgacgagggagcacgttatattggcgagtttgccatcggatttaatccacacattttacatccaatgaaggatattttgtttgacgagaaaatcgccggcagcttgcattttacaccgggtcaagcttatgaaacagcggataacggtaatcgttcatcgatccactgggatttggtgttgattcagcgtccagaatatggcggtggtgaaatttattttgacgatgttttgattcgtaaagacggcatctttgttctgcctgaactggagccattaaaccctgagaatttaaaataacgatatccgttcttgctgagaaagcgatttcaatgtattattatgggtgagtaacgatacatgacaattcagtaaagcgagggatctctatgtccaataataacgcggcggttgttgaaattgcacagacggcgagcaagttcacctcttccatcgtccttcattccgaaaataagtatattgatgtgaaaagtatactgggcttgtttacgaccctagtcagcagccatagctatgaactacacgttcatggaccagatgcggaggaagctaagaaagcgatcatcgaggtattcgagaagcacggacttcatatttcagtagccagctaactttattcttgaagcaaaagcatccctacctgtaactgtagggatgctttttttgtcaggttcttgtattagcctgcaatttggtctaatattaaggataggacgtcttgtgcgacattgagacataggggggaagaatccatgacttcatctgatttgcaggaacaattgaatatcaaggctattaatctgcttcaggaagatgcagataaaataaagaagcttattgaagtacagatggagaatctggcaacccgttattgccctctctatgaggaagtgctggatactcagatgtacggattttccaaggaagtggattttgcggttcgcgctggacttcttccagaaatggtaggtaaacagctggtcagtgagctggaacgcaatctggctattctatatgaggccatgaataataaggccaattaggaagacggttgaattgatgagagcatgcggagtttgagagcatgctttttttgatgccttttttaaaaaaatgttcctttaggatggcaaaagcgcctcgcccttccaccatcctaatgcacattttaaaaccttaaaagctacacaaggaagaaggatacacctaataatacatacactaccagtagcatgagtccctcataccagttggttgagccgtcctgggtgatggatttggcgataaatacagcgacagcaatggcgaccagctcaatagtggtgaaaacaatattcatcgtgtttcccataaagtaactgacaaaaattagcacaggggcaacaaatagtgcaatttgcaaactgctgccgacagctatttcgaccgatgcaccaattttgtttttcatcgccagtaaaatagcagcgctatgttcggctgcattaccaataatagcgacgaggaaggcacctacgaacaattcgctgagcccaaattgggtcgtaaacacctccagtgtacctaccagccattcgctgacaaaagcgaccatgacggtagcgagtaccaaataggcaatggatttgtttctggaccacacaggggcatgctcatgtggcaattcttcatctttttgttcggtcacgtcagctaaatagtccttatgcgtaatcatagaaaaaataagccacgcaatatacgcgacaatgagcgtgcctgcgacaatcaggctgagcgtatctgattcgctatccgtgataacgtgtgtgttcagaaagacagctggaacgaacaaggcaataacagccacaatcatcagagaaccacttaatccagccagcgatacattgaaattttgcactttgtacttcaaaccgccagcgaacagacttgctccgagcaccagcagcagattaccgatgatggaaccggtaagactggcctttaccatatcgtaaagaccttctttaacgagaaagaatgcgatgatcagttcggctgcgttaccaaaggtggcatttaagaacccacctagacgttggccagcataatgcgcgacactttcggtcgccctgccgagaaaaccggctacgaatacaacagaaattgcacaaatgacaaattgggctatagcgttccaatgggtgtaatgagcgactgcgctaagagcaaatgtcgctatgagcaaagcgggagataaccattttttcaatgaagagcacctcgatatcaatagatgtgtacaagtttggcgaaagctgtcacttgtatggattttctaaattaatatacccaaaatgatataggttgtaaacgaaagttgtttttcatacgtagggtttgcatttggagtggctgaggctttacaatacaaataaaggatggatgaagggggacataggtcatggcagagcaaattcaacaactggaagcaggaaacatcaagatttccaacgatgtcgtaggtaaaattgccgggatggccgcattagagacaccgggcattgctgcaatgtcaggcggtttatcggaaggctgggccaaaaggctgagcggtaaaaatgtacaaaaaggcgtatcagtggaggttggacagctggaagctgccattgatctacgtattatcgtgctctacgaaacacctattcatgaggtgtcccgaattcttcagcaaaatgtgcgagaagccgtcgaaagtatgacgggtttgcgggttgtggaagtgaacgtaaaagtggaaggtgtcgcgttcaaggacgacgcagtgtaaaagaatcaggaactgacaaattgacatttttaaccaattgtatacatgtcgggaaattccgtgggataacccgaataaaaacacgaaaactggtggttatagaatcgccagttttcgttttgtgaatcaacagtatagccatttttgcagagggctctcgtattttatacataaccaaaagaacttccaaagccaccgttgtaagtggaccttggaagttcttttttagcgaaaacggttggttctacgagtttgaaagcgattgggtacttcattacggacagctacccctgtggtgcgttcctgcaccgcttgtttggtgttctcacgagaaatactgagcataatgcccatggaaaacatcatgacaagtagggaggagccaccaaagctgataaatggaagcgttacgccagtgattggaatcgtttgggttacaccgccgatattaatgaaggcctgaatggcgatcaaacccatgatgccggtgcctaccaacgttccgaacggatcatgacaacgcagagcaatgatcatgcctcgccaaatgaaatacaaatatagcatcaggaatatggctgttccgataaatccgaattcttcaccgattacggaaaagataaaatcattaaatgaattaggaagatagtgaagcttgataatacctttaccaaagcctgacccgtttaagccgccttcacctatagcttgtaaggactgtaccagattgtatcccgttccttgtctatatttctcgggattaagaaaggcttgaaagcgcccgattttataatcttgctgggcagcagcttgtccatctgtggttccagaatctcctccaaacaacgacccaataccaaacacgatggaagcacctagcacgagcagaacaatggatgctgtaatatgcttgacactggctcccccggcataaataatcagaccactggtggcaaccaaaatgaagcaggagcctaaatcaggttgaagcatgatgagtcctgcaacacaacctacaatgactgttacaggtatgtagccagtccgcagatctctaaagcgatctccttttttgacgatgagtgcggataagtaaagaatgatggaaattttcgcaagctccgttggctggaagccaacactaccaaacctgagccagctttttgcgccgttaagtgagcctgtaaaaagaacgatgattagcagtaatatagttatgaaaaataaaggtacaaaaagctttttatatttttccatcttaatattcatagctaccaacataataaaaagtccaagtacagcaaaagcagattggcgcttcacaaaatataaagaatcaaaattgtattctttattcagcagagctacgctggagctggagctaaataccataattacaccgaatccaaccagtaacaaagtgaggatcagcaattggaaatccggtgtgcctcttcttcgagtctccggcttcgtatttctcatatcagcttcccccggtattcgccacaaggtatattcctcgcagacggttatcattttatcgtttatccattttatcatattatgtttgatgggcttctgcaagctccctggagcaacagatatcgcaacaattccatatctgctacaataggataaaaatgaagacttgagagcagcggtgcatacgtggtgacgctgcatgtttaatcgggaacttgcccgatgctttaaaaggagaggtggagcagaatgacacaacatgtgatagacgagacctggtttgatcgtttgcaagaaaacatggtggaatggcgtagacatttacataagaatcccgaaatttcctttcaagaaagcaaaaccgcagcttttgtagcggataagttggagagttggggaatcgagattcgccgtcaggtagggggacacggtgttgtaggtaccattcgtggtgctaaaccggggcctgtcgtcttactgcgtgccgatatggatgctcttccgattcaggatgaaaaggaatgtgaatatcgctccagcgtggacggagccatgcatgcttgcggccatgacggacatacatccgcgttgcttggaacggcttactattttagtctgaaccgggacgagctgcaaggagaaattcggttgttgttccaacctgcggaggaattgctgcctggcggagcggtcagtgtgataaaggatggtgtattggaaggtgtggatgtcatttatggcatccatttatggacaccttttccggtcgggacggccgcgagttgcgcagggccgctgatggcggcggcagacgatttttatattgaaatcacaggtaagggtgggcatggtggcatgcctcagtccactaatgatagtgtcgtggcgggttcagctcttgttatgcaactgcaaagtatcgtaagtcgttcagtcgaccctttgcgacctgccgtgctgacggtgggaaccatccaagggggctctgcgcaaaatgtgatcgcagaaacgtgtcgcttgagtgggacgattcgtacgtttgatgaggagacacgaacagtaatgaaggagcgactgcatgaggtgacagagcttacagccgcaacatacggtacaacagcacaggttcgctatattatgggatacccaccagttgtcaatgacgcacatgaagcatctcgtttctttaatgaagcaaaatctgtttttggcgaggagaatgtacaggaagcgtcgaagctgatgcctgctgaagattttgcgtattatttggaacgtgtgccaggttgcttcatgttcgtaggagcgggtaacccagttaaaggagcagtttatccacaccatcatccgaaatttgattttgatgaggatgctatgattaacgcggttcgtttgtttattgcgatgtctacgggatacgctgcggaacgaaaagcaggggcaattaagggctaaaatgagttgaattgggaacggttcaatctggagtatgagctgaatgaaatggggtaccctactcttgaaaaggagggagtacccatgaaaaaagttcaggaagttatgactaaaaaatgcgtaacggttaccccgcaggacaatatttatgaaattgcggtcaaaatgaaggacaatgatactggttttattccggttgtggaaagcgaaggcagtgataagttgatcggtgtagtaacggaccgtgatcttgtcgttcgcggctatgctgctaaaaattcgggttcgggttcggtcgatacagttatgacgacaggtattcgtacagctagtgcggacatgtcggtggaccaagcagctgagctgatggcagagcagcaaatccgtcgtttgcccgtgacggaaggagaccgtctgatcgggattgtctcgatcggggatttggctgttcgtaatatttttgcagacaacgctggagaggcgcttagtcatatttccgagcaggtccactagaagaataattaaggtaggcattggtttggggaggtcttttaccccgagcttctaatcaggagttcaacccgaatatgggttgaactccttgctgttctggttgatatgcgaataaacggataagctatttattatataacttaaaatgatgtatggttagattatcaggaggtagttatgaatccagaacatccttgtattgtacaacgtgattttaccgttctgctggaaatgggcttgcccggttcagaatgggctcgttcacagttgcagatttatgcggagctggttaaaagcccgtccgcttttcatacatatcacctcactccactgtctttgtggaacgcagctgccctcggatggagtgctaaggacattcaaaatagtttgaactccatgtctcgttgggatattccacgtgatttgttgaaggatattgaacagctcgtttctcgttatgggacgttgacgctttcaagggagggtacggaagaagagcgaacttatagcacagatacgattggcgcataccgtgctgaacatgagccagacggaggtataaagacagggaaagccaacagctatacaataggtgatcgcttgatcttgggagcagagacccccgctttactggatgagctactgaccaagcaagagctaaaacagcttggtttacttcgcgttgacgaggtaagcgcatcggtcccgcccgaaaatcggggcttgctcaagcaggaattaacgcgcttgggatatcccgttgtggatacggcaggctatcttgaagggaatcagcttagttttaccttgggaaagggacaaacgaagttgcagcttcgtgattatcaagtaaaggccgctgatgcgtttgaaggagcgaacggcttagggggtagtggtgtactggtgcttccatgcggagccggaaaaacagtgataggtatggcggtaatgaatcggtttcagtgcgaggtgcttattctaacatctaatactacatctgtacgtcaatgggtagaagagttaaagcaaaagacggatattcctgccgattccatcggggagtatagtggtcagaaaaaagaggtgcgtccgattacggtggcaacttaccagattttgacacaccgtcgtaccaaagatggggattttgagcatatgaaactgctgagtgagcggaagtggggactcattatatatgatgaggttcatttgctacccgcgccagtattccgggcgacggctgacattcaggctacccgtcgtttggggttaacggccacgctggttcgagaggatggttgtgaacgggatgtgttctctttaattggacccaaacgatacgatatgccgtggaaggagctggagcggcagggctggatcgctcaggtcgattgtgtggagctacggcttccaatgacagctgaactcttggagcgcagtatgcgtgcggagggcagacagcagtaccgaattgcagccgaaaatccggtcaaactggaggcggtgcgtagcctgatgcagcagcacagcggtttgcccacgcttattattggtcaatatttggaccaattgcgtatattggctcaggagctgggcgtcccactgattacgggttcaatgagccagaccgagcgggtgcgttggttcgatgcgttccgcaagggtacaattcggaccctattggtgtccaaggttgcaaactttgcggtggatttgccagatgcggcagtagccatagaggtatcgggtagctttggctctcgccaggaagaagcacagcgactgggccgtattttgcgaccaaagtcgggcgagaataaagcttatttttatgcgctagtgacggagaatagcaaggagacggattttgcggctcgtcgtcagctgtttctgatcgagcaaggctatgaatatgcggttcgcagatttagtgtgacagaggctaacggaggccggaatgctaagcctgatcgtgggaagaaaaaggaggcctaattaagaatgggcgtaacgaacacgcaagacagctggaatgagctttcatcggatgagctactggtgcttagacgatgctttatctggtacgcgggacagcccatgaaggaagaagaacctatacagcttacccggggagtgttaagcggagtcgaaacgaaactggcactacgtggattacgtgcccgaggctggctggaggctgttaccaaatcgtggggcgaacgaattttatatattccggttcatcggctaccggatctgtacgatatgttgttagagcaaaatccaatgaacatgatgcattcggatcatccgataacggtacatgaatcaatgacaggcctggagtcggaattactgcatgcgttgtcacgtattgcggtacaaggtgtccctttgacggccaaaggaaccatacataagcgatcattgcaaaaattgaatgaactgaccccctttcgcccagataacctgatgggtcttgggttgcattatgcgcatgcagagctgtatccagtgcaaacggtggtaatgatggatttgctactcagtttggggctgttagtgaaagaaactgtgtcttttcgcattcaggaaacggaactggcaacttggattcgtttgtctgcttggcaaatgcgcaagcatatttttgctacactcatggaaagatacggcaaggccgaagcgtctatgcagcattttcgctatatgctgtgtgccgtctctcagtacgtaggaacagaagggtggatatctatcaagtttctgctgcaatggatgcttcaggtaggcctaatccagcatgagagtacgagcagagcggattccaagaatggtgcccttttagaccttgttcctataatctcaaatccggaagggtttgcgggagaaacgggttctgattttaatttcaatgaacctttcatggaggaattgaagggttggctgaaggctctgactgcttttggaatgggtgattggggccagactgtatcgggcgaactgtgttttcgctggaatgtatctgtgatagatatgcttcgtcccaataattacgaggatacacatcaagagcaaggtgctttttatgtacaacctgattttgaaatattggttccaccagatgtggcatatgatgtgcgctggcgactggaatgctgctgtgaacgtgtgacaggagatcggatggtagtataccggatcaccagagaaagcgttacagaggcaatcgagttagggatggaagccaaagcaattcctgctcttctggataaatatagccgaacaggtgtgcctgatcatgtacgtatggcggtagaacagtgggcaggtgatgtcggacggaccgcttttgcaacggtaacacttttgcgatgtggtacacgggaggatgcagacatagttgcacgccatcccgcgctggaaggattactggaacggctgggcgatagggactttattattccggcgagctctgctgtcaaaatacgaaaaacgcttgctgcaattggattaggtccacgtcgtgaaccggaaggtgtggacgagccaactcatcattatccattgatttcggaaacagagaacataagttcaggcagtcccaacagtgaaatggagtccgacccgattcaggcccgtcctatcttttcccaagagggaagagcaggtttggtttatacagggcgcacgctgcatttttacgaacaagagcacatgttgcctgatccgtctgactattttccagaaagatctacagtcccctcctcatggacaaaagaatggaggagttaccatacttccactgcccggcagttgatcgagcaagcgatccgttggcaggccgctgtgggattgcgaatcggtgggaaagaggttaaatggataccggaggcggttgttcccggtgcgccatggagtgtcacaggctggtacgcctcaggaatggatgacgaaacaccttctcaagcgagcttacagccaagtgaatggtcagacatgcggttgctggttccttttacatagtagagccaggaagtgcatgaaactccttcttctcaaaagaaggatgtggtatgataaatgagtctacttttacagggtagaactttatataaagtgagatgaacattcatgagcgtagccgaattgaatacggtcaatatggcagaagtgcttattaacgcctatgaattgggcgatatggtcaaccgatcctttgaggtatcggattatttatattggaaacagcgtgtggaattgaatccgtctattcaggcgtgtgtacgcaagctggatgccaaaaaggagctattcgcggaaacggagcgttttgggcattttcatccgaactatcatgaagcgaaggatgcagtgcaggtcgttgagctggaactggaacaattcgtggaggttaaggagttcaaacgagccgaaaaggcgctggatgatatgcttcatgccatgtctgaaacgattgcatattccgtgtccgagaccattaaggtgccgagcaatgatccgaatgtgaaaaagggcggatgtggcagcggagggaaatgctcctgtggataggtcataggaatgataccgagtggaggggagatgaagcgaatgtttgccgagcggacagggtacatcatttgggtaagcgatatcaaggctgcccgcaatctggagaaatacggaaatgtccactttatttcaaagcgtatgcattatgtagttatatatatgaatgcggatcgggcagaagacaccgttaaaaatattcgcagactttcctatgtgcgtaaggtcgagcgttcttttcgaaatgagattaggacggagtacaacgacgataaggaaaagatgaaagaatatgaaatataagtttctaatatctataaattgtaaaatattcttaaaaggtcagcctacgggctggcttttttttgtaaagtcaggacttttgcataatggtcttaatgctgttagacctaaaaaatctttaaaaaccgcccataaacttcaattttgtaacttgtagtcccgggtctgttgaggtaacatatgaatatattggtagatataaagacctatctggtggggagagtgatcccgtgcgtgacaaagcaatgcagcgatggagtacatacgaaccgttctacgtggagatgggcgataaaaaagtcgccgatatcgtgattacaaatcatgcgaaaactcgctacttagatcggatagagcagaaacagtccgagacgaatcatatcgccgcctggctttgggaatgcctgaagcaaaacaggatggagtcctactatcataacgaagaggatgtatatttaattgatggtgatctggtcgtcgtggccgaatttggagagttgcccggcgagatggatattgcggggaatccgcttcacaagatgattgtcattacctttttgggtcgaatgtcggagaccattgaattaagggatttgaagtcatactattcatggctacgccattcgcggcgcatgacactgatgaaaagcactcgtaagcaaaaatagacggtgattgggcggttggctctagatgaaaaaatctccgaacttatgattaccgtcaattttgagtagaaagtatgcagttatcagctgcatgctttttttatttccagcaataaaactcccccaattcagtaagtttacttggaaatgcttcgacagatgtttttcttatggtaaaatagagagatcagaggggagagggctgtcagtatgaactttcatcagttgcacattttttataccgtagcggagcgtgggagcttttcggcggcggcacaagcgctgcatatgacacaacctgcggtgacgatgcaaattcagtctttggaagattatttcggcacgaagctgctgcaacgttcgactaaaaaaatcgagctttcagaggcgggagcgacactactaccttttgcgaaaaaaagcatgcaactgattagggaagctgacgaggcgatgtctgcttttactcacatgctggagggaagattgcatattggcgccagcctaacaattggtgagtatattgtaccaagaatgttggggccgtttggccaggaataccctcatatacgcatggcaatgaatgtgatgaatacgactcaaattatggatgatatactaaaacatcagttgaatttaggactgattgaggccccagtccagcatccggatatcgtggtagaacctgtaatgcaggacgaactgaaactgattgtgccttcaggacatgcgctggccaaggctaaaaaagtggttctggaagatgtgtttaagcatccctttgtagccagagaaaagggatcgggtacacgtcaagtgatagaagatgagctgaaaagtcgtggtgtggatgcctctcgacttggtattgtaatggagatggggagcactggagcggttaaatcggcggtggaggctggactgggtattaccatgctatcaccttcttcggtgaagcatgaagttgcgctcggtttgttgaaaattgtgaacatttcaaatatcacgttcaaacgagaattttatgcaattcatttgaagtcggcgttgttaccgattccggtagtcaccttcctgtcttacttgcgtcgtcatgatcagggaacggacgtgctgagggactcgcaggacgagctggcaaaggtgaaagagaaggaggatgtataatgaaggagcagattaacgtaaaacgatatgatttacatacacacacccaagcatctgacggcatgcagccacccgcagataatgtgcgctgggccaaggaaaaaggactggcaggtgtggccattacagatcatgatacggtagctggtctggaggaagctctgaaggagggaaaacgcataggaattactgtggtgccaggagtggaaattagtactcgagctggcggtaaggatattcatatactcggttattttatggattacagcaataaagtgtttttggagcggttggaaaagcttcgccaggcgcgggatacccgtaatgatttgattttgagtcaattgcgtagtctgggcgtggaaatcacactggatgaagtggtggctacgatgggcagaccgctggcaccagatgaaagcattggacgtccacatatggcagatacgctggttcaaaagggatatgcgaaggatatgcgggatgcgtttgaccgttacttggcggaaggagcacccggatatgtgtctgtaccccgtgtagagcctgcggaggccataaactggattcgtgaagcaggaggggtacctgtggtggcccaccctggcttatacggaaatgatgagctggttcgctctattatagaggaggcgaagcctgtgggcttggaggtgcgacattcggaccatgatgctgaggctgagagccgatatactgcgatggcggcacaatatgggctcattgcaactggcggctcggattttcacggtgcacgccaaggtgttattttccacggtgatctgggtagccgtagtgtggaagatcgggttgtcgaggaattgaggaaggctgctgttggacaaaagtaaatagaaagccccttgccttatgcatggaacacaagaagtgtatcgtgcaaagaacaaagggctttttttgtggattcaataggctggtgagacttagccgtttttgatgcgattcggcaacttcttgaccagttcctcatcgggtgtaatgaagagcgtacgctgatggtcgtagatgacaaagccgggcttggctccgctgggcttacgtacatgccgaatcagggtggcgtccacaggcacactgctggactgcttggcctggctaaagtaggcagcgagttgagctgcttcctccagcgtcgtatccccgaattgctcagcacgaataacgacgtgtgaccccggaatatcctttgtgtgcagccaggtgtcatttggtccggccagtcgatttgtcacatattcattttgcaagttgtttttgccgaccagtaactcgataccttcggatgatgtatagacgtgcagggttggacggtcgtttttcttctttttctttccttttttgacccgatctctgagatagccctgctgaaccagttcttcacgtatttcctcaatgtcattcatagaggcgtgggctagctgctgaagaagattgtccatataacggatttcttcgtgcgttttctccagttgttcgtcaatgacagccaagctgtttttatatttgttgtattttttaaaataccgttgtgcattatccgatgggttgagtagcgggtccagtgggatggtcattggacgctgttcctcatcataaaagttggtgagcgtcacttctttgtccccttttttcacctcatgcagcgaagcgaatagcagctctccataaatgcgaaattgatccgcatcttccgcctcggccaaatcctgatggagatagtcgagtttttttacgtttttactccgctcgttttgcagaaaccgcagtaggtcactgaccttttgcttaaccgtatcccgttctgctttttctccgaagaagtcctccatacactcactgatagtagcgtactccttacgttcttcttggatcaacgtcagtggaatggctgagaatatcactttatcttgtgcgtttagtccagatactggctgaaaacgatgattccgcacgtcatccatgatgtgactgaatgtactccatagtgaacgatcactatcaccagatacttcattagttactcgagttagtatctcttcagcaacgaggggactgagtccagtaaaagtgttcacgatccagcgtttgggagcttcttcggcctcgatcgcagtttgatacgaggatatgaaggctgcctcttccgtttctaatggattcagcttgttttgtgcaggaggctccgtgtattgaaagccgggcataatgacccgatagctgctgatagacggtgtgacatgatgaatgccatccagcatcacgcctgtttccgggtcaagcaaaataatgttgctgtgtctacccatcagttcaatgataattcgtttgagtgaaatatctcccagttcatcacgttgacgtatatccatgtgaataatacgctccatgcccacctgcgtgattttctcaataacgcctccttcgcaatgcttgcgaaggagcatgcaaaacataggggcttctgtcggattaagaaagctttgttctgtaaaatgtacacgcgggaaggtcggattagccgacagcagcagctttacgcttccgccttgtgcccgcagattcagcacgatatctcgatcatttggctgatgtatcttattaatgcgcccgccccggattccttgcagttcgtgtacgatagcgcgggttacgattccgtccaatgccataattatgttctcctttgaagcaaatgtattttcgccttccttctatgatacataactttgggacaaaacttaagcggctttgtgatatttcaggtcctgtccgaatagattgaatctagaaagtctgtccagcttatcagcaatcgcggcacaaaaatataataacgggcagccatcctacgcacaaccgacggaaacggactatctgaccgggagggaattggggagaatggaacaagcacactggcaccaattaagcaatgaacagctttcaacaagtctggaagtcgacccgaagcagggtctttcggaggaacagcttgcggaacgaagagaaaggtcaggatggaatgagctgagcgaggggaagcgagtttcggcaatcttgctgctgctcaatcagttcaaggattttatgatgcttgtattgatgggagcgaccctgatatccggactgcttggcgaatatttggacgcgatcaccattatagctattgttgtactgaatggaattctcggctttgtacaagaattcagagctgagcgttcattgcgagctttgagacaactgtcggccccaaccgccaaagtgttgcggggcggcaaacgaattcaagttcaggccagagaactggtgccgggtgatattgtgctgctggaaagtggtgatcgcattcccgcagatgtaaggtggttgagtacgaacggctgtgatgtagaggagtccgccctgacaggtgaatcagttccggtgagtaagcattgccgccctattcatgccgccgaagtaccactcggggatcaaaaaaacatcggttttatgggcacgatgatgaccagaggaaccgcacaaggaatggttatacgtacaggtatgagtaccgaaatgggtaagatcgcagacttgattgaaaatacggagtcgcaggagacaccgttgcagcacagattggagcaattgggcaaaattttgattatcgtagcgttggcgctaacggtgctcgttgtcgtagcaggcattttacatggacagccagccatgagcatgttcttggctggagtgagcttggctgtggcggctataccggaagggttgccagctattgtgacgattgcgctcgcattgggtgtgcagcgtatgattaaacgaaaggcgattgtacgtaagctgccttctgttgaaacgctcggctgtgcatctgtcatttgttccgacaaaacgggtaccctgacccaaaataaaatgacagtcaccaagctatggctggacggtcgtttctggggagttacgggagagggctatgacccacacgggcatattatggacagagaccttcctgccgatcttaaaaacggacaatctctgcgtagactactgcaagccagtgtgctttgcaacaatgcggaaattgttcaagccgatacagaggagctacgttcgaaaaagaaaaccaaagagccgacgccgtccgccgtttgggaactgaagggtgatccgacggaaggagcgctgatcacgttagctgccaagggcggagtcacgcgacaagggctatatgagctgtacacaagggaccgagaatttccttttgactcggatcggaagcgaatgtcggtactcgtacgccaccagggaggacacattgtctttgccaaaggtgccccggatgtactgctgggtcagtgttcctatattttatgggaaggaaatgtcgttccgttaacgggtacgctgcgccaaaaggtactggcggctaacgaaggaatggcctcggaggcgctacgtgtacttggtgtcgcttaccgtgatatccgctcgcatgagcgtgtctccacggttgaggaggctgaagcacagctgatctttattgggctgacaggcatgattgatccgccacgtcgtgaggttcgcgaagccattggcaagtgccgtcgtgctggcattcgcactgtgatgattaccggagatcacggtacaactgcagaggctattgcacagcagctgggcattctccagcgcggatcccatgtgttgacaggacaggaattgtctgcgatggatgatgcggcgctggacaaagccgttgataccgtctctgtgtatgcacgagtttcgccggagcacaagctacggatcgttaagtcgctgcaaagacgcggacatgtcgtagccatgaccggagatggtgtcaatgacgctccagcgataaaggcgtcggacatcggtattgccatgggcattacggggacggacgtgaccaaagaagcggctgcgcttgttctgagtgatgataatttctcaaccattgtagccgcaattgaggaaggacggaatatttacgagaatatccgtaaatttatccgttatctactcgcctccaatgttggtgagattttgacgatgttttttgccatgatggccgggttgccattacctttgttaccgatccagattttatgggtgaatctggtgacagatggcctaccagcgatggctctgggggtggaccagccagaaaaggatcttatggagcacaaacctcgtggcgcaaaggaaaatatttttgctcgtcgattgggctggaaaatcattagtcgtggcttgttgattggtttatgtacgctagcggccttctggctgacattacgtattgcaccggatgacgcaggacaattgatcaaagcacagtccgttgcctttgctacgctagtcttggcacagttaattcatgtatttgattgccgcagttcccgttctattttccatcgtaatccgtttcaaaatagttatctcgtgcttgccgtgctctcctccgtagtgctaatgctggtggttatgtacgtgcctgtactgcaacctattttcaaaacggtaccgcttggattgcgtgagtgggcgctatccattgtggcagccgggattcctacgtttcttatgggagcgggaagtgtatggggcggtcgacgcaaccgtcgtcgcggcggaaatacacacttttcagcagggcgtacgaagttttcagcctagtaatcgggtcatgcataccgcatcgctttcccactattgccctgtatgatatcatgggatcaaagcttcatgaggaacatgatatcagcagcaacggcggaggtaagctatggaattcacaaaaatgaacggtctaggtaatgattttatcgtttggtttgggcatcaggatttgccgtctgacgcctcggaattagctgttcggctatgtgatcgacattttggtgttggcgccgatgggttggtatatatattgccgtcagaaaaagcggatttctgcatgcgcatcattaactcggacggctcggaggccgagcaatgtggtaatgctatccgttgtgctgccaaatacgtatatgaccgtaaacatatcaaccgtgaacagatcacgatcgagaccctgggcgcaggtgtgcagcaggtggaactaactgtagagaacggacttgttcgtatggtgaaggtagatatgggagagccgattcttgagggtttaaaaattccaactacactagagcggactagcgtaattaacgagcctattgaagctggaggaagtggttttcgctttacggctgtatctatggggaatccgcactgtgtcatttatgtggaggatgcgccaagctttgatctggaagcctgggggccaaagctggaatgccatccgttgttccctaaaaaaacaaatgttgagttcgccacggtacgtagccggaagcatatagatatgagagtatgggagaggggagccggaccaacgctagcttgtggaaccggagcctgtgctacgcttgttgcttctgtactaaacggatacagcgatcgtcacgccattgtaagcctgaagggcggcgatctggatatcgaatggagcgaggaagataatcacatatatatgacgggcccggctgagatcgtgtacgaaggtcgtctgttctgaatcatgtgaattataaagatagcgtgtaactggcctatgaatcgtatagaagtgagtgaaaagaagaccttagaggtcagaagaccttagaggtcttctttttttggacttacatgcccctgtatacaaggaatacgatgaagaaggcaatattctgtctttttttggcgcctgaacgatgtataatatagaaaatgaaaaaacaataaggaggccgttcatagtgcggaaatttcgttggatttcagcagttgcagtcctcatatttgtagccaccgcgcttccggttcaggcggcgaccattcctgctgccgcggaaacgacggacaagcaggttggctcgctaactccgacagtggtaagccgtttagaaaaagcggtgcaagaactcattggttcaaagacagcatttcaatttgacgatgtgacagatatggggaaaacctggattgtagagggcgaactggaagacggaactgctacgttgcagacagaatataataaagaaaaaaacagagtggattctacaaccatacgatataaaataagcagcttgggaaaggcgatgaacgcgccactcaagacgaaagtgctaaacagcgccaaagcgtttgacagcaagcgtcctctgcagtttgaagcattttggcgggtcaaatccccttatcagtccaacaagccttcaaattactgggtgttttggggggcaggagaacaagcttcctcgttgtatgtggatgtggatcgaggtaacgctattaccatcaacgcggactatgccctgaagcaggtggaccctgtgttactgaaccgtgcaatgaacacatttaagcgtgtgagtggacagcgaatcaaggtacagcacgcttcacggtacaaggacgagacgaagggactttcatactggtcgtttgaggatgcaaacgaggcgagtgaggtcaaaattagcgcggtaaccggtaaagtgctggccgtatccacctatggggtagactggaacgatgacgcagatttcaaaaaaacatttgcaagcccgaagtatactgcctcagaagctttgaagctagtcaagcccaaggctcagatgttgtttaatatcaatttgaccggctataaagtgaaagttcaagggaatcaatatacgttctccaaacagcaaaagggaacggattctattgtggctaaagtgaataaaaaagggactttttacgcttactctctccattcttccgatgggaaaatgtagtaggaaatagaaaagataaattaagccgcttcactcctgatatcatattgtcggggagtggggcggctttttttgtttttggcttatgtttgtagtctctttatgttacattagtatgaaaataaagagcggggtggagcagaggacatgaaaccggatttgcgtactgtgctgaatcgtgaaattattgtcggagacggcgcaatggggacttttttataccagctaggatttccagtaaatacgtctttcgaagaactgaacatcacttcgcctgacgttatatcagacgtgcatggtcaatatttaagtgcaggagctcgattgctggagactaatacattttctgcaaatgattataagttagcccggtttggattggaatctaaggtagaagagatcaatcgtgccggtgtgagaattgccaaagctgcggccggacctgaacattatgtggtaggtgcggtgggttccatatgtgggggcaaacggcttaacatatcaaagctggagctggcaagaaactatgagcagcaaattgatgcccttctctccgaaggagtcgacggcattttgtgcgaaacgttttattcactggatgaaatacgcatcgcgcttcacagtgtacgtaaatacagtgacattccggtaatttgtcagtttgcagttgatcaggttggtcgtacccaggatggttttttagtggcggaagctttttcggtgctgcgtaatgagggggcagacatccttggatttaactgtcactcgggtccgcagggaattatgagtgtaatggagcagctggacggtcctttgtctgtaccgctgtccgtatatccgaatgcgggactagcagattatgtggacggtcactatgtatacggtgcatcacctgaatattttggagaatgtgccaagtcctttgtagacctggggacgaggctgctcggtggttgctgcggaactacaccggaccatattgcagctatctccaaagccttgaaccgtttgcaaccgcctccgctggctttaaaagaagctttgtcgaaagagtcctttcaagtggcagagcagattgcagatgaagaggaacgaggaaatggcagacataccagcgagcccaatattgtggatctggttaaggaacgacatacggtcattgtagaactggatcctccgcgcgatctggacattacaaggtttatgcaaggtgctcatgcattgaagaaagcaggggccgacgcgcttacactagctgacaactcgcttgcagtcactcgcatgagcaacatggcgcttggacatttggtcagtattgaaacaggcttgcgcccattaattcatatagcatgtcgtgatcgcaatctgattggtactcaatcccacatgatgggttttgacgcgctcggtattgaccatgtactggcggttactggagatccggcgcggttcggtgatttgccaggcgccagttcggtgtatgatatgacctcttttgaaatcatacgcatgatcaagcaattaaatgatggtgtcgcattttccggtaagccactgaagcagaaagctaattttgtggtaggtgccgcatttaatcctaatgtcaagcatttgggtaaagccgtacagcggttggagaagaagattgcctccggagccgattatgttatgactcagcccgtatacgaccacgagttgattgcagccatcgcggaagcgacacgacatttggaagtaccgatttttatcggtattatgccgctggctagtgggcgcaatgcagaatacttgcacaatgaagtaccagggattcagttatccgatgaggtacgtgcacgtatgtctggtcttgagggtccggaaggacgagcaatgggcgtgtctattgccaaggagttactcgatacggcaatggaacattttaatggaatctattttatgactccatttatgttctatgaaatgacagctgaactgacttcttacgtatggcaaaaatcaggccgtgcacaggcccccttgtttcgactataataatcaattacaatagtataatggatgtgatgccgatgtcattgagtatgaccggatacggtcaagccatccttcattatgagggctataaagtgcgcttggaattgaaatcggtgaatcaccgctattgcgaagtgatgatgagaattccgcgcgaatggactcgatacgaagatggcttgagaagaacggttcaacagcagattaaacgcggccgtatcgatgtcttcatccacagggaacgtgatgaagaacagatgcccgccgcgcggttgaatgacactgtggtgcaggcttacctgcatgcagcggagcagctggcggatcgttatggagtgaaaggaacgttagggataggcgatattcttgctttgcctgacgttctgggtgagcctggagaggcttgccatggagatgaagaggactgggaagagcaactacagcgggctttgaatgaagctttgcaaggtttactggagatgagaaggcgagaaggcgggcatttggcgcaagatgtggaatcccgtattttacgtctggaatctctgcatcatgaaatgacggtgctggctcctcatgttgtgagcgactaccgtaacaggctgaaacacaggcttaaagagcttcaggacggttcatttacgcttgatgaacataagttcggaatggagattgcgttattcgcggatcgcagcaatattgacgaggaacttacccggcttcaaagtcactttggacagtgcaagggattactgctgtcagacgagccggccggtcgcaaattagattttttaatccaggaaatgaacagggaagtcaacacgatcggctccaaggctaatcatctcacattggttaatttggtcgttgagatgaaagcagagctcgagaaaattcgtgagcaggctgcaaatattgagtagctacctggtagcggcacggctgcaagagtcacatgtatagggggaaagacctgaatatggcaatcaaattgatcaatattggtttcggcaatatcgtgtcggccaaccgaattatctccatcgtcagtccggagtctgctccgatcaagcggattatacaggaagccagggaccgtcatatgctaattgatgctacctatggccgccggacgcgggctgttattattacagacagtgatcatgtaatcctgtctgcggtgcagccggagacggtcgctcatcgcctatccactaaagatgatgacaatgacgaataaaaatggagtgtactatggctaagggattattatttgtaatatccggaccttcgggtgtcggtaaagggacggtaggcaacgcattgcgtgacaagctaccagagataacatactccgtttctgctacaactcgaacacctcgttcaggcgaacaggatggagtgacctatttttttaaaacgcgtgaagaatttttgggtatgattgaacgagatgaaatgctggagtatgctgagtatgtagggaactattatggtactccacgtgattttgtagatcagacccttgcgcagggaaaagatatttttctggagattgaagttcagggagcgctaaaggttaaagaaaaatttccagaaggcatattcatttttctgcttccgccttcgctagacgaattaaaggatagaatccggggacggggcacagaaactcaagcgaccatagaccaccgtatgtcggtagctgtggatgaaatgaatttgttgcgtcactatgattatgcggtcgtcaatgatgagattgatttcgcttgtaaacgaatagaatccattattatcgccgaacattgtaaggttcatccttaaacgagggctttacatatgccaagcgtacttaaagagaaataatactgtataagctgagcttgaaggtgtacactggagttcagcttatacagtcccaaaactacatgaagaggtgtctattcgtgctgtatccttccattgatgaaatgatgaaaaaggcagatagtaagtattcgttggttgtagcggcttcacgtcgtgccagacagttgcgcgagggtgaaaagacgactctcaagaatcctaaatcccacaaacaggttggagtggcgttggaagagatttacgcggatcatctgcgtcttgaaagcggcgaagacgagtaagaattatacacaactattataaccgggcgcaatgccaattcctttgacaaccgcaaggttgttatttttttaggtcagggggagttaacgatgttgaagggaaaagttattattcttggtataactggcggaattgctgcttacaaaggggcagcgctgtgtagtaggttgacgcaaaagggcgccgatgttcatgtgattatgacggcctctgccaaggagtttattaccgaacttacgctgcagtcgctctctcgtaatccggtgtacagtgacacatttgatgaaagagagccatcagtcgtatcccatattcatctggcggatgcggctgatttggtgcttgttgctcctgcaactgcgaatattatcgggaaaatggcgcatggtcttgctgatgatatgctgtctacaacgttgttggctacaacagcgcctattatggtggcacctgcgatgaatgtacatatgtacactcatcccgcagtcatgcaaaatatggagacgcttgtatcacgtggcgtgaagatgattgagcctggtgaaggattactggcttgcggttacgttggcaaaggacgtttggaagagccggacacaattgtgcaaaccatagagcgtttttttgatcagcaagctcaggaacaaaaaaccaccatcaagtctgaaccacgatggtttggtgacgcatctatggcggctcaaatgcctgagtcacttgtgaatgagaatgaatcggtgctttcaggcaaaaaagtcattgtaacggctggaggcacgatcgagcgaattgatccagtacgttatatcacaaatgattcatctggcaaaatgggctttgccattgcaaaagtggctcaggagatgggtgcagaggtgcacttgattgctgccaataccagcgcggaaccgcctactggtattatgcttgaaagagtccagtcagctgaagacatgtacgacgctgtattaaagcaatgggaaacgagcgatatggtcgttatggctgctgcagttgcagattatcgaccacgtgagattgcacagaccaagatcaagaaaaaagatagtgtatttacgctagagctagtgaagaacgtcgatattttagaatcactcggacggagtaagaaacatcaatttttaattggctttgcagctgaaaccgaacatttggagacgtatgcgatagataaattagaacgtaaaaattgtgatttgatcgcggcaaacgatgtaactgtgaatggtgctggttttggcgtcgatacgaatgctgttcaaatttatgaccgaagcgggatcgtagagcgtattcctgtacagtcaaaggaagaagtcgcgcgtaagttgcttactatagccgcgggacgcatgggtggggtgctgcattaatggagacgggcaatttagttgccaaggtcattgtcgatgtacctgccaaggatacggaccgcaccttcgattatctgataccagactcaatgagaccttggattgagccgggtagtcgggtagctgtgccatttggcaaacggacggtgcaggcttttgtcatctcggtagtcccagctgatgatccaccgaaatacagaatgagagcgatccaggaactgctggatttggtaccacccttatctgccgacctagtcgaactgggcaaatggatgagcgaacgttatgcttgtaatcaaattatggcactgcaagtgatgattcctaccgcgctcaagggcaaagcagaacgctatatctcaattgcggaacagcatgagttaacgcatccacaacgtactatacaaccgaatcagggcgatgaactcgaatgggcacttctgaccgacgatggtatgagtgatccgacggagcgtcggattgtaagcttcattcaggagaaggagcaagtcccattgcagcaactcagtcgacgtttccctgaggaagcggaggttattaaatccctgttacgccggggtgtgcttcaggaaagtcaagttattaaagacaaacttggcaaaaagaccatgaaatccgttgatctggctattggcatagacgaggcatcaacggcgctggagcaattttctgccaaagcgcagcgtcagcgggaggtacttgcttttttgctggaacgtagcgagtttctgcctctgtcgctgaaggaagtcatgacctcactgagtgtctcggctgcaacggttaaggcgctggaagataagggctatgtgttgctggaggatgtcgaagtgttccgcgacccctatcggggcagacacttcaagcctacagagccactccctctcacagcagagcagcagtcggtatatgaacggattattcgccagctggacacacgtgagcaaggagcttatttgttgcatggagtcacagggagcggtaagacggaaatctatctacaaacgattcagcgttgtatcgagcagaatcggcaggccattgtgctggtacctgaaatatcgttaaccccacaaatggttgagcgttttaaaggccggtttggcgatcaggtagcagtgatgcacagtaggttgtccgggggggaacggtacgatgagtggcgcaaaatacgcgaaggccgtgtgaaagtggcgattggtgctcgctcggcagtatttgcgccttttcgtgagttaggtcttattattatggatgaggagcacgaaacgtcctataagcaggaagagacacctaaatatcatgcgcgtgatgtcgccattcgcagagcccatcagcatggggctgttgttattctcggctcggctacaccgtcgctggaaagctattatgcggctcgctcacaaagcaacgacgagtttgcgccgttgctgcttgaaatgccaactcgcgcattggggaacacgttacctgaagtacatatcatggatatgcgtgaggagctgcgtgctggcaaccgctctatgttcagccgtgcgttgcataatggaattgcagagcggttagagcgtaaggagcagacggtactcctgttgaatcggcgtgggcactccacgttcgtcatgtgccgtagctgtggctatgtcgcgggttgtccgcattgtgatatttcgcttacgtatcatcagcggtcgaacaatttacgttgccattactgtggctattccgagcccgtgcctcagacttgccctgagtgcggtagtgagcatattcgctatttcggtacaggtacccagcgagtggaagaagagctggcgaagctattccccggtatacgtgttgttcgaatggatgttgatacaacaacagaaaaaaatgcccacgaaaagctcctcaagcaatttcgtgataaaaaagcggacgtgctgctcggtactcaaatggttgccaaaggcctggactttcccgatgtgacactggttggtgtcattactgcggattcggctctcaatttaccggattttcgggccgcggaaaagacttttcaactgttaacacaagtagctggacgtgctgggagacatcaattgccaggggaagtatttgtacaatcctatactccagagcattattcggtgattcacgcaagtcgccatgattatgcttcttttgtgagggaagaattgaaacaccgccgcaatttgcactatccaccatattgtcgtcttattttggtgaccttttctcatgaacaactcccggtgctggtccggctggctgagaattattcagcaacactacagggacgagccagacaacggggatggttcgggaatatggatcgtcttacatcggatgtactcgacattttgggaccagtagcttcacccatttcgagaatcaagaatagataccgatttcaatgtatgataaaatggcgtggaaatatcgatgcgattagtttggctcagcaagtagctgatgaaatggccgaatcagcacaggcacaaaagttgctgattagtctggatgttgatccgcaaatgcttatgtagagtgttgccacaaaagttattagcacaattaatgcggacaagccgtccgtacataggataatgtagcagtcgcgtttgtgatgaatacagttaggcctaaatgaagcataaagaggaaggtgttctgttgtcatgtcaattagaattatagtgttggagccggatgacgtattgcacaaagtagcaaaggaagtcactaaaattacgcctaacgtgcaaaagctgctcgacgatatggcagatacgatgtatgaagcggagggagtaggtcttgctgctccgcaagtaggtattttgaagcgtctcatcgttgtagatgctggagatgagcatggtttgattaaaatgattaatccagagatcgtggccgaagaaggggaggaattgggtcctgaaggctgcctgagtataccagggttgaacggggatgtgcgtcgtgccgagaaggttacagtcaagggactggaccgcgagggtaaaaccattaccgttacagcgacagggttgctttctcgtgcttttcagcatgaaattgaccatttaaatggaattttgtttacggatattgcagaaaaagtatatgaggttgcgctggaacagccaggaccgaaccgtcagataggagagtgaggttcgatgagtcaagacattcgtattatctttatgggtacgcctgagtttgcagtgccatcgctgaacatgttactggataacggttataacgtggttggtgtgattacacagcctgataagccacagggacgaaaaaaaatattgacgcctacaccagtcaaggaagcggcagaaaaacgaggattacctgtactgcaaccgacccgcctgcgtcagccagaagcggtggctcaggtggcagagctgcgtcctgatctgatcgtaaccgcagcctatgggcaaattttgcctaagtccgtactagacctgcctcggttcggctgtctgaatgtgcatggttcgttacttccccgttatcggggaggtgcaccgatccagcgtgcgattattaatggtgaaactgtgacgggtgtgacgctgatgtatatggcggaaggactggacactggcgatatgatatcgcgagttgaggttgctatagagccggaggatacctctggtacgatttttgagaagctaagcgtagctggagcaaagcttttgcaggacgagctgcctaagttgctggcaggccaatcagaccgtacgcagcaaaacgaggacgaggcaacttatgccccgaacctgaaccgcgaggatgagcgtatttcgtggagtgccaatgctcagcagatatacaaccggattcgcggcctggttcctttttccggtgcgtttacgctttgggaggaaaatgtttttaaaatttgggctgctgagcagcctttcataaacagtgaagtgagtggctcaaatgttccagcacccggaacggttcttcaattgactgctcgtggcattgaggtgcagacaggcgaaggaactctttggctgactcaggttcaaccggctggcaaaaaggttatggatgccggaacctttgcgcgcggcggacagatgaagccaggcacggtgctcggatgagcgggagtcactcccgccagggaggccaaggcaagggagtgggtgccagatccggcaagactcgcaatcagacggcgcgggaagttgcacttgatgtgttgaccggtgtggagcaagagggtgcatatagcaatcttgagctaaatcgtcggcttcagcaggcaggtttatctgcaagtgacgctggtttggcgacggaacttgtatacggtacaatcgcacgccgaaatacactagattatttcctgaataaatttgttcaaaaaggaacggccaagcttcaggcttgggtacgttcgttgctgcggatgagtgtgtatcaggtggtttatctggatcgagttccagatcatgcagtcgttagtgaagcggtgaccattgctaagcgtcgtgggcatcaggggatttccggtatggtcaacggcgtgctccgcagcatgttgcgtgagccggacaagctgcgtattcctgacgatttgtcaccagaggaacggatttcattagaacattcccatccacagtggctggttaagcgctggattaagcaatacggtgcagatactgctgaggctatctgtcaggctaataatgagccccctgcggtcagcgtacgggtgaatacgacaatgaccagccgtgatcagctgctggacgagatgcgctcaaaagggcttgatgccgttccttccgcagttagtccctatgggattgttgttcgtagcggtggaaatatggcgcttacctcgtggtatacggacggcttgctgtccgtacaggatgaaagctccatgctcgttgccgaagcagtcgctcctgagcctggcatgctggtactggattgctgtgccgctccaggtggaaaaacagctcatatggccgagctgatgaaggatcaaggccggatcgttgcgaatgatctgcatgcccataagcatcaattaatccgtgaacaggctaatcgacttggcctggatgctgtggaaacagtcactggtgatgcgctagaactgaaagaacgctatgctccagcttcttttgaccgtattttactggatgcgccatgctctggctttggagtaattcgtcgtaaaccggacctgcgttggagcaaaactgcgcaggatgttcgcgacattacacagcttcagcatgagttgctggatagtgtggcgggattgttgaagccaggtggtattctggtgtatagcacatgcacgattgaaccggacgaaaatgaaggacaattgactcagtttttaagcgaacatccagagtatgaattggcagagggtcattcctttccggacgtgagccacgaaaaggatagtattcagggaggctcggtacagctgttaccgcagcattttcacagcgacgggttttatatcgcgcgcctgcgtcgggtgaaatagcgcggaagagaattccaggcagcttcccaccagtatttccacattccgccggaacatttccggcggttttttgcatgaagatgaaaaatttttacccctccagggatttgtgctaaaataggaagaatgaaaaatacgatctacgatcaaacagaacttaatgaagaaggaacgggtgcaaacattgatgaaaccttttatatatgatttaactctggaggagcttcaggactgggccaagaacaatggcgagcctgcttttcgtggcggacaaatttttgactggctgtatgtgaagcgggtcaatgatttcagcgagatgacgaatttgtccaaggcgctgagagagaagcttgaggagcaatttagttttgtgacgcttagtgaaattacaaagttggaatcaaaggacggtacagtaaaattcctgttcggtttgcacgatgatcatgccattgaaacggtcattatgagacacaattacggaaacagtatttgtgtaacgacgcaagtgggatgccggattggttgcactttctgcgcatcgacgctcggaggcctcaaacggaacctgacagctggtgaaattactgcacaggtagtacaggctcagaaaattttggataaaacgaatgaacgagtgagcagcatcgtgattatgggctcaggcgagccttttgaaaactatgaagcgaccatgacgtttttgcgtacaatggttcatgaaaaaggtctgaacattggtcaacgtcatatcacggtgtcgactagcggtattgtaccgaatatttataaatttgccgacgaggatacccagattaatctggcaatatccattcatgcgcctaatgatgcgcttcgttcgaagctgatgcctgtaaatcggcgttatccctttaaagatgttatggattctctacgttactatcttgctaagacggggcggagaatttcgtttgaatatgccctgattggcggggtaaacgatcaggcagaacatgctgaagagctagcggatgtgttaaaggacatgctgtgtcacgtcaatttgattccagtcaatcatgtgcctgagcgcaagtatgtgcgcacatcacgcagcgatatttttaatttccaacgtattcttgccgaaaaaggcgtcaatgtgacgatccggcgtgaacagggtcacgatattgccgctgcttgcggtcagttgcgtgcaaagcatatggagttggggtgaaaccatttgatcaaaacagttcatgtcagccatgtcggacgtgtacgttcggtgaatgaggattctgcttggatcaggcacttggagcaaggctatattcttgggattgttgccgatggtatgggggggcatttggccggtgatacggccagccgccttgcggtagagacacttgccgctgatttggcgacgctggagagcggattatccgcacattctttgacggcggcgctcagcgacgctattttgcatgccaatgaagtcatcttccagacggctgcacgcgatgacaagtatcataatatgggaacgacagttgttgcggttttactaaacgatgcatccggaattatcggacatatcggtgatagtcgcgcctatgtcatatccaaaggagcggtacgtcagcttacagaagaccatactttggttaatgagctgttcaaaaacggtcagatcagtaaggaagaacgggagaaccatccccgtcgcaatgtgctgactcgggcgctgggtactgattctgaggtgaaagtggatattgactccattgcgctggaaaaaggcgatgtactgttactgtgtagcgacggattaagcaatctggtaacggaagaacaaatcagtaaagtagtaggtgccgcagagaatcctttggaggagcgtgcggatcgtctgctacatctggcgctgcttgccggaggagacgataacattactgtggctttgtttgaattgcccgatgacacggtttcattgagtgaaaaggggtgtgacgcatgatcgggcacctgctagggggaagatacgaaattattgagcgcatcggtggcggcggtatggcgctggtgtataaggctcaagacattttgctgaatcgcaatgttgcagttaaagtgttgcgccagcaatttgttcatgatgaggaatttattcgccggtttcggcgtgaggcgcagtctgcggcctcgctttcgcattcgaatgtggtcagtatttatgatgtcggccaagaggatgaaatccattatattgtaatggagtgcatcgaaggtaaaaatttgaatgagattattaaagaacgtgcgccattgcaagtggatgaagcagtacggattgcatcccagatttgtgatgcgctggagcatgcccatcaaaatcagattattcaccgagacattaagcctcataatatattaattggacgtaatggacgggttaaggtaaccgattttgggattgctagagccgttacgtcaacgaccattacccagacgggttctgttgtaggttctgttcattatttttcacctgagcatgcaaagggtgtcgtcaccggcgaaaaatcggacttatattctttaggtattgtcttatatcaaatgctgacggcgcagctccctttcctgggagaaagtccaattagtgtagcgctcaagcatttgcaagaggaatttgaggaaccgcgtaaaattaatccgttgattccgcaaagtgtggaaaatgtcattctaaaatccatgcgcaaaaatccagaagagcgttatcaatcggcagacgagatgctaaaagatttggaaacctgtttgctgccgggacggcgtaatgaatccaagctggagtttacacatttggatgatgaggatcaaacacgggttattccggctattaagcctcaacaattagggatgtcttctagcggggatgatgtacctgctcaaccgcgtgagtctgaacagcttccgagcaagcaatcgttcaagaaaaatagaaaaaaagcgattttgtgggtaacactagtgttggtgttacttctgtgcatgggcggagtggtgtactatgtgcaaagtgtactggtcgtgcctgaggtaaaagtaccaggtgtattgacacaaacagaagaccaagcgaaggttaatctcagtaaagcggggctactcattgaggagccaatccagcatgaatacaaagaaggaatcgcgcctggagttgtattttatcaaagctatcctgcagattctttagtcaaggaaggaactaagattagtctgaaagtcgggattgccaagccgctcaccccgatgccggatgtcaaaggccaaagctacgaaaatgctgttaagctgctgaccgcccagcaaattaaggagacgcagattcagcaaaatgagcagttcagtgatcaggccgcagggaccgtccttagtcagacacccgctgcaaatgagccatttgataaggattcagtccaggttgtgcttacagtcagcaagggagctgacactgtaaaaatgccaagtctcgtagggaagacgcagagtcaagcggaaaatgaggtcaaaaaggcaggactgaaggttggctcgattaaagaagaatttagctatgagcaggaaaaaggaagagtaaccaaacaatggccgtcagaggcaggcagtgagctgccaccaaatacggaaattacgatttatgtaagtactggttacccgccagaagcgattacgctggcatttaatgtgcctgttgcgcccaaggaagaggggaaaaatagcaaaattcgtatcacttatacggatgcacgtggagaaaatcaggaatggggaagccgtacgattaatacgacacaggtgttcactatcaacctgctaatggctccgaacaaagacagtgttgtctcagtatttagagatggcgactttattgatacgtatccagtctcatatattgaggcgaaaaatggaacggtgacgatgccccaaattgctccgcctgccggaacttcaccaacggatacacctgatggtacttcctcgcagaatggaagtggaaacggcgaggaaggtgatagcgggggagcttctaatgatagtggtaatagtggaggagacttgaacaatcaggagggcacgggaagtaatggtgacccttccgcctttgttcctggaacgaattccacgggggggacgcgcagtgagttggcggttagttataaaaacaacccaggccacgcttcccacaaaaagaaggaaaaagtgattgaggctgttcagcatcagtaaacttgcaataggaagatgctcaacctgctatacgcaatgaaacttgaacattatgaaggaggacatcttacacatgcctgaaggtctgatcgtcaaggcgcttagcggatattattatgtctccagcctggatcaggatgggcgtccggtatctggcgaagctacggtacaatgcagagcacgcggcatttttaagaaaaaagagattacgcctcttgttggtgatcgggtcgtttacgaactgactgaaaacggggaaggtatggtcaaggagattagaaagcgtacgacggagctaatacgtcctccggtagccaataccacgcttgccgtgctgctgttttcattgcgtgagccggatttaaacctgcctttactggacaaatttttagtccatattgagcacgccgggctggatacgattatctgtctgactaagcgcgatttgtatgaaggcagcccttcagaggatgacaccgtgctggccgttcaggaaatataccagaagatcggttatgaagtgctggtaaccagtgcccgtaccggagaagggacggctgagcttaagaagctattggctggtcaaatcagcgtgttttccgggcaatcaggtgtaggaaagtcttccatgcttaatgctctagaacctgggttaacgctggagacgagcgccataagcaataagctgggccgaggaaaacatacgactcgtcatgtggagctgattcctctagacaacggaggatttgtagcagatacaccggggtttagccagctggattttctggagctgggtgtggatgagctatctccctgttttcgtgaattccagcagtatgcggaaggatgtaaatttcggggttgtatccatattcacgagcctggttgtaaagtaagagaggccctggaagaaggacatatttcacagggacggtatgatagctatttgcagttctatcaggaattaaaagaaaaaaagcggaggtactgagtatatgttaaaaatagcaccgtcgattttatccgctgattttgctcgcttgggcagtgaagttgcggaagctgaggcaggaggggcagactggattcatgtggacgtaatggatggacattttgtatccaatattacactgggcccacctatcgttcaggctattcgtccgcacacgactcttcccttggatgttcatctgatgattgagcatcctgaacgctatattggcgattttgtaaaagcaggagccgatatcatcactgttcatgctgaggcctgtgttcatttgcatggtgtccttcacttgatcaagcagcaaggcgctctggctggagtggctctcaatccaggtacttcaccatatgcgatcaaggaagtgctgtcaaatgtggatatgattctggtaatgacggtcaatcctggctttggaggtcagtccttcattccagagacgttaaataaaatcagacaaatccgtgcttggttgaacgaattgggtcgtccagacgtacatatcgaggtagacggaggtattgcggaggagacggcaccagccgtatttgaagcgggggctgacgtgctggtggctggtagtgcggtattcggcagagcagaccgcgcagcggctattgctgcgattcgggacagtgcagcacgtttgtccaagtgaagctgaccgaagcattgtggatgactgtagcgagcatggcgacggggttgacccttagctgtttctcgctagtgaaggctccttggaatgccgttctttcacttttggctgttctaattgtcctgttttattttcgaaaaaatgaacggcgtggtttacgaataggttttgtggtgtgcagcgtactttattatatcctgtttattttcatactctcagcatatctctatgttcgcggacttgtctgatggtatagcctgggatggttgtgcataaatatggttacatgagcgggattctcatgtagcctttttttgtggggcacaacccttgacaggttgcataaactacagagaacggatgcaggaggatgatggggagggtgaggcatgaagttttacacaatcaagctgccaaaatttctgggtggattcgttaaagccattttgaatacattccagaaaaactgaattcaacgtaatgtaaacacaggatgtaggatgaaagctaagaggtacacagggcacgcttcccgggcataacagataggtagctcggcagtaaaaggttggaacgcacgggaaggtgcctgacattttgttttcctgaaccagatggatattactttcgaataaccaaaaaagcacccgtttaaaacgaggtgccttttgtttataacgatatttttttacgactacacgcgagtcactttaccggctttcaatgcacgagtgctgacataaacgcgtttcggtttaccgttaacgagaatgcgaactttttgtacgttgacgccccaagtacggcgattacggttgttagcgtgagatacgtggttaccgctgccaggctttttgcctgttacagaacatttacgagacatgattccacctcctattctgaaaataaccaaattccatatggaatgggtctctcttcaggccgactgggtcagccggactttgtaagtcactaacctgaacaaaacaatacttaaatataatatcatagtcaaaaaagctccgtcaactgattcaaaaactttatttatttctctttcgcattatagtacaatatgggatagttattgctgcgattattttgtatttaaatggaatgtgaattcttattccagtcatgccggcggttcagaggcgggactatagttatcattccagccgatgatttatgttgggtagttgactggtttttcattttatatgacctgtagaagagcgaccagacgtgagtacaagagcttatgaaagtgtgacattcgtattcgtcgtctggctttagtataatttaattgaacctgtaggcacagctggataaggtgtggtgaaggttgatagtaaaacaagtgtattaagctaggaaggggaattctcttgagtaatcgttctttgaatggaacagattttaccgcaatggttttagccggggcggaacaattacagcagcatgcggaacatgtcaattcactaaatgtattcccggtgccagacggtgatacgggaaccaacatgaatttgacgatgagcgcgggcgtaacggaattaaagaggggggattcttcctccatcggtgtcatgtccggcatattatccaaaggtttgctgatgggagcccgcggcaattcaggggttatcctgtctcagttgtttcgtggcttcagccgttacgctgccccatacgaggaattgaatacccttcagttcgcatcggcattgcagagcggggtggatgcggcctacaaggcggtggttaagccggtggagggtacaattcttaccgtggcgaaggaagcggccaagcatgctgtatttttctcgcgccggacgaacgacatcacggaattgatggaagaagtgcttgccaaagcgaaggaaacgcttgccatgacggaggacatgctccctgtactgaagcaagtaggagttgtagattcgggtgggcaaggccttgtgtatatttatgaaggctttatgcaacatcttggaagcggcttggtgacgtctccaattgcaaaaagtgataatgtacgcccggtttttgctcctcacgtatcggagagacctactgctactgcagttgttccttccccagatgcgccgatttctgcgcaagcgaagctcgaaacggataatattgaatttttgtatgatatggagttttttattaatcgacaattgggcgatgcgcaaggtaccgattttgatgaggaagccttccggaaagcgttatccgtagatggtgattctattatcgtaatttcagacgatgatgtcatcaaggttcacgtgcattctaaggctcctggtgaagtgctgaatttggcactgcgctacggagaaattacacagattcgtattttaaatatgcgcgagcagcatcgtgatttgttgtctgcgggtatggatgttgctcctgagcctgagtggtttgctgaaataccaacagagcctgcacgtgaggaagagccgtctgagccccctgctcatgaactggcatcctttggttttatagctgtggcttccggtgaaggaattgctgatattttcagaagtttaggcgtcgatgttgtcctttctggcggccagacaatgaatccgagcacagaggacttcgttaatgcggcgcgctcgattgcggctcaacatatttttattcttccaaataattccaatattattttggcggcagaacaagcgcgtgaactgctagagatggaacgtatggtgtcggttattccgagcaaaacaattcctcagggcattgcggcagcatttgccttccaggaggaagaggcttttgaggtaaatcaggacaatatgcgtgacgcagtcacccgggtgaagtctgggcaagtgacctacgcggtacgggatacgacgcttgatgacctgcatattacagccgggcactacatcggtattcaggattccaaaattgtagcgaccgaggaacacttaatggcaacgtcccgtcttttgctagcgaaaatgctggtgaatggcgatgaaattgttacgattctcacaggttcagacgcaaatcaagaagacacagatcagcttgttgcatggcttgaagaaaattatgcggatgctgaagtggaagttcatgaaggtggtcagccaatttatccttatttgttctcagtggaaacctgatgtgctttagcacgcccatggaagtccacaacaaaaggaggtctgactgatgagcaataccatcattttgacggatagcacggctgatattccacaagaattagcagaccgtctcggtatagttgttgtacccttaacagtgatgttcggcagcacagcttacctggacggcattgagatgtcagcgtcgcagttttacagcgaactagtacgggctgatgagctgcctacgacgtcacagccttcaccagcccgttttttggagacatacacgacgctgttggagcaatacgccgagagccaggttatctctatccatttatcctcgggtgtgagcggaacgtatcagtctgctctgctgggcaaatccatgctggagaagcatgaacatagagtgactgtggtggattccaaatcagcttcatacggatacggcatgctagtggtttatgcggcagagctggcggctgccggacactccccggctgatattgttcgggctgtggaacgtcgtggggagcgccgttgtttatatttcctggtggataccctggaatacttaaaaaaaggcggacgtattggcaaggcagcggcaatggttggtacgttgcttaacattaagccgattctttcgattgacaaagaaggtattatttattcggttgataaggcgagagggcataaaaaagcgacagcacgaattattgaactactggagcgggatttaaaaggccaaaaaattaatattgctgtgggtcatacggcagatcgctcagcggcagaagcgttcgtggctcagctggcagagcattttgagctgggggatcgaatatatactgaacttggcgctgtgattgggacccatgtagggccaggaacgattggcatttttgtatggccggccggagatgagaggtaatatgctgcaattggatcaaatacctttaaaacaaatacatggcgtgagtgctctcaaagagggagagcttcacgcttttggcatttctaacatacaggacatgctggaatattatccgtttcggtatgaagattaccgactgcgctcgctaagcgaagtgaaggacggagataagattacggtacaggccaaaattatgggcattccggtgcttcagcgttacgggcgcaaatcaaggttgacttgtaaattgatggccgaggattggatgtttaccgcgacatggtttaatcggcatttcatgaaggagcagctaacctctggtcgtgaaattgtggtgactggtaaatgggacctcaaacgtatgcagatgactgttgcagattctgagtttcctgataaaggagtagcccgctcggggacgcttcaaccggtgtactctataggcggcaagattacgcaaagctggatgcgaaaaacgatgaatcagacgctccagcagtttggtgaaatgatccccgaaatattgcctgagttgcttgtacgcaaatatagtatgatgccgcgcaagcaggctattacgggtatacaccagcctcaggacaaccgtgaggggcaagaggctcgtcggcggatggtgtatgaggagctatttttatttcagctgaaaatgcaggcattccgggcgctaaatcgtggtcgagcggacggggtggtacatacggtggataacgccacgattcgtgaatttgtaagggctttgccttttgaattaacggatgcacagaagaaggtagagcttgaaatactgcacgatctacgctcaccttattgtatgaaccgtctgcttcagggagatgttgggtcaggtaaaacagttgttgctgccatcggtttatttgccacagtacgttcgggttttcagggagcgctgatggtgccaaccgaaatattggccgagcagcatatgcggtcgcttcacaagctgtttgagccctttggaatcagtgtgggcctactgactgggagtacaaccgggaagaagcgtaaggagctgctagctgctctccaaatgggtctgctggacattgtagtaggcacccatgctctcattcaggaagatgtatattttcgccagcttgggcttgttgtaacggatgagcagcatagatttggagtgaaccagcgtagtgtactgcgtcgcaaaggctataatcccgatgtgctgacgatgacggccacaccgatccctcgtacgctggccatcactgcgtttggcgatatggatgtttctacgttgtcagagcggccgaaggggcgtattccaatttccacctattgggtgaagcacgaactgatggatcgggtacttggttttatttcccgggaggtagatcagggacggcaggcttatctgatttgtccgttgattgaagagtcggagaagctggacgtacagaatgccattgatttgcatattcaaatgcaacaggcttttccacattaccacgttgggctattacatggacgaatgactcccgcagaaaaggaagaagttatgcgttctttctatgcgaatgaggttcagttgctcgtttcaacgacggttgtggaggtgggggtagacgtccccaatgcgacgctaatgatcattatggatgcggatcgttttgggctgtcccagttacatcaattacgtggacgtgtcggacggggagcacatgcctcgtattgtgtactgatcgctgatcctaagtcggaggttggtcaggagcggatgaaggttatgaccgatacggacgatggttttgaggtggctagacgcgatctggatttgagagggccgggtgacttttttggcaccaagcagagtgggctacccgagtttcgtttagcagatatggtagcggattttgaggtgctggaaaaggcgcgtgaggatgcaactgatctgatcaaggatgcgtccttttggacatctccgcagtatgaagcactgcgcggttatttgcaaaaagagcagattttccaaggggatctcatcgactaatccaccatgaatcatgaggttgttctaaacgttttaaacagataggcacaatggacaggctggccgtcatatatttgggaatgaccgaatgatatgggaggtgtggcaacattgagctatcagcaatatggaatcagtccgcaactggtggagcggattaagttgaaaatgaaaaatcgtgcgctcaaggatcgggttaagcagcagatcgaaggtgtgactaaagcggacctgcaaaataaagctaaggtgcgtcatcttgtgaagactacttctgctattttaaacgagcgtttgacggctgcgcaggaggagcaattgaccgccttcgtattggcacaaaaaattgatccgtccaatacattccatctaatcaagctgtggggaatgttccgttgattgctatttgaagaggtgcttcgaagcgctctccatgttttttttgaagcacagataaaaaaaggattgcctgatatcaggcgatcctttttggtttgttttagttagttcattccccgggcaatagctagtgtgagcttatcatgagattttttatttgtaatgaccgccaattttgatagaccgttccatggcctgcccggcatctgttaacgacgatgcgcgcatgatgatggactgaccgtaccgatcctttaaagtgtccgtcaccttttccaaagcacgggatcgctcctgatcctcaaaaaaatccagttgatacagttgatcatccaccaatccgcttaaagtaactcctgcgcgcttcacaggcatatgattccaaaaagtataaaagatttttttaacggtttcatataccttttgggtatggtttgtaggatcgggtatcttcatttgtcgggagaatccggttggtgcctcgtagggactgcatatacaatgaacagtcacaaccgagcccatatatcctttgcggcgggcgtcccgacacacctcctctgttagttcaagcaggatggtttccacttccgcaggctggagatagtctcgaggaagagtcatcatatgaccgatggatttgggaggtgtattaaatgtttccggcttgaccgggctgtgatcgatcccgttagcagttcgccatattacctctgccggaatatcggactgcttaccgaaatgagaccggaatttgtcctgtagccgaggtaagggagtacgtgcgatatctccaatggtgtgtagtccaagcttctccaaatgccgttccattcgtgaaccgatgccgaacataagacgtgctggctggggccatagcaacgctgcaatatcggatgcaggtaacaagaaaatgccactgtcattttttttagcccatatatctgttgcggttttagccagcattttgttggagccgataccaattcgaatccatactcctgtttgtgccagtaccttttgctgaatttcacttgcaatactcaccggatccccgaacagggagaggcttccgctcatatccagaaactgttcatcaatgctgaaaacctcaaccaaatccgtatattcattataaatttctgttatttttaatgagacatcgatataatgctgcatacgcggacgtacaatgataaggtcaggacattttttcaccgcttctcccagacgttctgctgtagatataccgtattttttggccagcggacacgcagctaaaataatgcctgaacgaagtgcagggtcaccggccacaacgagtggtttatgttggtatttgggttcatctgctttttcgatgctggtataaaaactttggcagtccgataagaatatggttctatttctgcgttcctccaaaaataagacctcctttcctgatatgtgtggatcatccttccaaaatattcttgaatgtatactcttatagtagtattatatacagaacaagtgttcctaatacaaatgtattttttggaacgttacagtttacggaaaacctaacatggcgtatcataatatcttgagcaaaaacaagtggaaatgaatgaatattgaggggagaaaaccatttttatgaacccaaaacgtcgaccatcatctcaaaaacgcagtaggtggcgtatttttggcagagttttgctgattaatatcaagtggttctcgtttgcgggtgtacttggagtgctatttgctggaggtcttatatccggttatgtagcggcactggttcatgatgaacctgtacgatcacgtcagttgatatatgaaaaggtaaatgagaacgctctgaccagctttgtattttttaatgatcaggtaactccggttggaagaatgcgcatggaggaggatcgacagctcgttgatctgaaggatgtccctcagtctattgtggacgccctcatttcaacggaagacagccaattttatgagcatcgtggtgtggatttaaagggaacagcgcgtgctgttaaacagaagcttttgaatgaaaaccaccaaacaggcggcagcacactgacgcagcaggtagcccgaagggtttttctcagtctggataagacggacagccgcaaggtgaaggaaatgctgctggcactgcgtatggagcgttttatgggtaaggataaaatattaacggcttacttaaacaaaatgccctttggtaatggttccgctggttacaatttatatggaatcaagtctgcttctttagggattttcaatgtaagtgatctacataagcttcatattgctcaggcggcttatttggcaggccttccccaactgccatctgtttattccgcttttgatggtaaagggaactttgatgaagaaggcttcaataaagcgatggagcgccaacgtgtcgtgttgggaagaatgctggcaacaggtaaacttacgctatccgaatataacgaggcgcttcaatttgatgtgaaagccactcttgcgccacatcgcgaaaaaagttataacacattcccttatttaatgctggagacagagcgggaagccgcccaattgttagcgctccagcaaaatccggatatcacggcatccgagatttccaagcctgagcatgccgagcttcttcaaaatacgcgagaagagttgcaacggtccggatatcgaatttatacaacgataaataagagaatttataacaatatgcggcagattgcagccaatccacaaaacttttctccatacagtaagaagaagggattagagcagattgcagcaatcatgattgatcataaaacaggggctatactcggtatgatcgagggcagggattttaataccgagcaaatgaactatgcaactcaaatgacacgtcagcccggttctgccatgaagcctattgctgcttatttacctgctttggaaaagggctatactcagccagccggtcttattgatgattcacaaatcatattgaaagacgggcgtaaaggttatcatattcctaaaaattataacagacggtacgaggggcttatgacagcccgtgaagcactcaatcggtcaatcaatatccctgcactgaggctgttcttatatgaagttaaaattccaaacgcttggaattttgtgcgttctcttggaattacgacgattcagccgcaggatgaacatgctcagacaggggttctaggtggactaagcaaaggggtatccgtcgaggaactgaccgcagcatatggaacgattcccaatatgggtgtatataatgcacctcatctgattagcaaaattacggatgccaacgggaagatcatatatgaatttaaaccgcagacgaagcgtgtatattcgcagcaaaccgcatttttgatgacggatatgcttaaaactgttatatcagatccgaggggaactggtaaacgcctgcaaaatgcttttaaaagctacggtgccattgatatcgccggtaaaaccggtacaacacaaaactttggtgatgtgtggtttatggggtacacacctgacgttacactaggcgtctgggctggttaccgccaacaggttaatacattatctcaagaaggccattccagagcacagtcagtgtgggcactgatcatgaatgaggcggtcaaggaccagcctgaactttttaagaataagcactttatacggccggaaggtgttgtaagagttacggtttctagccttacaggtaagctgccagggcgttattcccgtcaatcgggtcaacttgtgactgactggtttaatcaaaagtatgtgcctactgaagttggaagagaacggcttccgcgttctgctagaccagtggtcccgtccaaaccagatatcaaggaaaaagaagtcccagaggttgaggtacctgcaatagatcaagagaaaattccaccagaggaaacggatcctgctgttcctgaagcagacacagagatagaaatgcctgatgagaataacgatgtgccatcaacagatacttcgcaaccttctgttgaaaacgaacaggggactccttctgaatcggaaagccagagtgagactcccaaaacccaatctgatgaagttatttatccagaaataatatctgatcaacccaaaaactaaacgacaggaacggcttagtttaaaatgccgttcctgacaatgtctacagtgacctgcggatgaaaacggacattgggatattctttattccaatctacacttttccatactgctggatgatgagcgatcaactgtctgcctacgccaaaggcatcacatccattttcctgaagtgtacggataatttgttccgcatcctgggtcatgatttcggaaagttgacggtttagacgccgtacgttagctttatcttgaagatgattacgtgcatattcaacaatatcgacaggcaatttcaggttaagctccacatcaatttgtccatcgcgctgaactttcactttaaggctacgtttgacattctgaatgttagcctgatacgtaataaagttttgcacatcaccgacagatcctggatgtatcctttttacaaagcgagctgtatatttccactttccagtcatcaggacatataaaacaccttgctcattacttaggcttcctgtgaatttttgtccgtgaaataaggcaattccacgtgctgtaatatcttctccttctttggaaagatagggaagcacaaaatcttgacccggatcaagcattggggggagcagtgtctccagtgtcatttccgggaacatacacatttcctcaaggcttctgatttttttggttataaattcgccaattaagaggttacctatgcctttttgatctattatttctccagctaatccatctacaatagctaccttgacatgggaagtcggatggtcaggctcacgatacagcacatccagatagggatatagatcttttcgagccaagcttgtaccatacagaataactccgtatttgaaaaagcggatatccccggttactttagcccggattttgtctgtgctttgccgaacggaatgaccggtgcctgagtgaatttcattggtgcttttaccttgattgctttgagaatcgtctacaacttctagcgtttgcagcaacatgccttcaggagtgagatcataagccgatgcatttgccattcgggcatccttcaaattgtcctgatcccagcagcctgttataaaaatgagtagagttagcattccaagcgctctgctctttttttccatgtttcaggtccctccttttttttgaagagataggataggatcagcagcagaaaagggaatacaattaggaaaagataagcagaattattggctatggaaccaataagctcgaaatcttctcttcgttgaggcaaataggcaatacaacatgaggcgagcacaacaaagggaaccgcctttttgtgactcttttgcttgaatagatagcttattccgtaagacgccgcataataataaccacttatagcaccaaagatcgaaatgagccaaatcggtagaaaaataaaatcgacccgatccatcgttcccagtggaatggatctgagcaaataaatgactggctccggcattaattcaagctgttgggggctgaatacggttgtacaggtaaatacagtaaaacaatacaatagtaccacgatcgcgttagctgccaaaattgacttgagcttgcctatacttttgccctcaaccatgggaaagacgacaagaatgaactcaaaaccaaacatcgctagaagcgtttcttttgaaccgacaataatacggggccatcccgcctcagtcagaggtagcagataaagcgggttggactgctttataccatagctaattaacagcatcatgggaaaaatcagaaatgaaattaaaacaagcactcgagcaattgttcttaaattttcgcgaaccagatatatgctactgaacaaaaacagagcaagtatagcccaacggggagtatattgcagcatccagcgattgatgacgtcatatgcgttcacaagaacggaggtacccataagcagatagtaagcaatgtaagccacagtcaatgcttttccaatccagcaaccagtaatttgggttaatatttgataaatcgaagaggagggaaaacgtcttagcagaagccagcacatcaaaataatgagttgaatcaaaaggccgccaataatgacagatatccaaccccctcctttagctgaaaggttcatctgatagggaagtgacaaaatgtctacgccaatctcaaacttgatgatgagaaaaaaagttgacccgatgcaatggtactttctttattcacgtcgtttccagctcctagagtcgttctgctgcttcaatttttgggctcgggaatcatatggtcgctgatgaaatgtccaaattggaaagcggataaaaacatctttcatatcaccgagccggaatggtgcaagaggagcaaagtaaggcgtaccaaaggtctccagcttgcaaaggtggatagtaagaaaaagcaaaccgaaagcaatgccaatgtatccaaacaaggctgcagcaatcatcatcggaaaacgaaggatacgaaccgctgagctcatttcatgagaaggcactaaaaaagaagaaatggctgttaacgagacgacgatgatcatcgtatacgacacgagaccagcccgaacgatagcatctccgatgacgagaccaccaacgattctaatagtttggccaacccgactgggtagacgaaccccggcttctcgtagcacctcaaagatcaattcaagcagcatagcctccacaatcgctgggaatggaacattttccagtgattttttaatggtatgcgccaactctagtggcaaaatagctggatgaaaagcaatcgtcgcaatgtaaatggcaggcagcgtaaaagcgatcaaaaagctcatcattcgaatcgttcttagaaatgaactaataatccaacggccgtgataatcatctggactttgataaaatgcaaaaaaagagacgggagctattagagcagtagggctaccttcagccaaaatcgctatccgtccctccattagattggcggtcacacgatccggtcgttccgtgctgagctgttgagggaagagggaaaaagggttgtcctcaataaactcttgaataaaaccgggggggagcaccatatcggaggagatcgctttaattctcgttttcactgctttcactagctcaggattagccaagtcttgaacatagacaatagcgattttagtccgggttttagatcctacatagaagtagcgtacaaccagcgacggtgtgacaatttgtttgcgaatcagattcagattgatggataactgctcaatgaatccattgtgcggtccgcgaataaccccttcgttttctggttcgtccgtactgcgagcatatgtcttttcggaagaaaggataaaaaattcttccgccccatttatcataaaaatgcaatatccctgaataagtgaatcagcagcattttgaaggtcgatgtctttttgactgcttaaggtggtgaacatttgatgagagactgcatcgattttctcatataaggcactcaggatatgagtttgaatcatctcctgatctacgagcgaatcaatatagagcagtataccgtctttgccgtcaacggaaattgcctgtttttttaaatcatccgtataaaaaagggcttgctcaataaaggaaacatttctgtttaattcaacggaagctgcgtcatgtccagccaagagagccctcctttttggatgagataggcataatgtgtgccatatggattgaatttatccatgatctggtgacttatccattcttgaatcaccttcacttcgcgtaatgcaatagttttatactagaatttaggttgaaaatgggaaatgggttggttattttgcaaggaatgaaatgtaatcgtgcaagaactagagactagattacaagggggcttaatcttgcgtcggatcaattcctagatagtgtcccagtttccgccggacctcgctgcgggcaaaggatgaaagcatgaaaaatcgtctttgatagccgcggcatatatacaaaacctctacgccttcacgatttcggatttcgctgtatattttaacccctagtgttttcattcgcgcctttgtctctgataattgaacagctacacgctgttgtactccagtcaggctacgaacatacaaatcaggcatttttagaggggaggtatgtataatacgaatgtctcgttccagcacatccagcacaagagttagaagtacacagatcttgactagccctgcgtcttcttcagaaggcaaaggagctttattcttgtggttcagtgtcttttggcttggcataaaaatctcctttactccgagtaagaatacaatatataatcattatatagaacgtgtgttctgcttatgcctcatcataggtatttttccaaggctaaagcaatcctcaattattggaaaagtggtaaagagcgatacccatgtgccattgtgtaaagaattcttgagtttatcgccaatgacagtcaaacagagtttatgttaagctaatggataaaaacttacataaaaggggagatcgttctgactgcggtcagcctctactatttaacttaagaaagtggagaaagaaggtatacatattgtcacgttcgttatatgcagctttattattgttgagcctcatttggggcggttcgtttatgtttatcaaggtgttgttgctacatcaagtaggaccgtggactattgtatttcttagatccagctttggacttatttttatcgtcttattaatgctacttatgcgcaggccgtttaaaattaaaagcattccgtggaaatcggttactctggtagctttggtcaacatggttttgccatggacattgatcggttttagcgagaccaaaatagctagcagcatggcctctgtattgaatgccaccacgccaatatggaccatgttggtggggcttgtttttttcggagctatttttcatcggatgcagtggttaggaatggggctcgcttttgtaggaattattattttattgggtattaatcctgcatctattatttctgttgatcctgtgggttttgggtgtatgttgcttgcgactctctgctatggatttggaacacagctctccaaacgttttctctccaatctttccatgtatcaggctacctttgcgacactgtttggtgcggcggtagggggtggcattatgatgacaattgtggagagacctaatttgtcgattgtttctgatccaggtgtattgggttcccttatagggctgggagttttaggatcaggagtggcatatattttgttcaactacatgattttgcgggggagtgcggaatttgcttcttcggtgacgtattttgtgccagtaagtgccatcgtatggggctttttgctcctgaatgaacatatcggctggaacgttctgaccgggctggtccttatacttggaggggtgtttatggctaaccgacgtagaaccgccaaattaagtggataataatctaaacagaaataaaatacgctttgggctatattaaatgtacattcgccaaaccttcggtataatacgttaattcgcacatacaataaagcatgctcacacataaaataaaatatggtgtagcaaaaaagcaagctgtttagcaggtgacaaggtgtggtataataaattatagaattatatgcaccacagaaatgtcggagttttattccacaaaagaaaggatcaggataccatgtgtccccgaaggatacttccccaaaggacgatttggaaacgatttgatctgtcttatacttagcttttccgcggagtaacgtcaagttgcgaaagccaactctgcggaagaggggattgtacatgcgaaggaccaagtcctccaggcacatcttatccggtagcttccgtaagagtgggttcatccacatcaaacttacgagaaaccgagggagcctgtatgaggaaaacttacgaatctatcgtgaacaatggagcattgagacagattgctgtcatgctgctcggaacatgcattttagcttttacgtactatcacattaatgctcagaatcatttgtcagaaggcggatttgcaggcttggcactgctgggacattacgcgtttggcatatctccagcatggagtatgttgctgcttgatattcccgttatattgctggcatgggtactgaagggcagaagatttatgctgcttgcgttaatcggagccgtcgctttttcactgttttatgcaggatttgagaagtattcgactctggttatagatctacatggaaatctgctgatagctgctctactttgtggggtgcttacaggtttgggagccggaatcgtactgcgtttcggtggagcaaccgggggcgatgatatcttatctctgctgatcagtgagtggcgcgggtggaaaatcggcaacgtgtttattgtcagtgacatcatcgtattgggattatcactgttgtatctgcctatgaaggaaacaatgtttacaatactggctgtgtggcttgccggaaaaataattacatggacgaccacgttccaactgcaccgacctgtgaaaaaggtactgccagcggctattcccgctaaaaaggtagttgccaaaacagtgccggtcgtccacagccttcgtcaataaggaaagggtgttacgtcaggagagaaatcttctttcgtaacaccctttcgctgtattcagcttctatcaggaaggttttaaagtagaatggatgcgtccatcccggtcatgaataattgcagaaatctgttggcgttctacaaaactttgagcctcatcaatcgcctcatttttgtgtttaaaggttgaaatgggctggttgtgtccctcttctttgattgcccagcgatcctcgtacggcaccacatgaatgggttccttctcatcggaagaagcggaatgatggtcgtgtacattttcgcttgaatgctgtttttcatgttttttaggtttctcatcttgctcggctggatgattatcgttccattcctcggcttgggaagtggcaatcgcaatcgagcgtccttcttcatagccgtcacggagtagagcgttagcaatatcaacggctttttctcgcaccctaggttccaggtttttcatggatggagggtaatcatgtttgttccaaggcatagttgcacactccttatagcggatgatgtattatgtattacccgttgtcggcttaaacaaacggaaatcaaagaaatgaatatattgtaaaatgtatcttgagaaaaagcgtataatggtgtgcagaatacgaggaaaaggagtgaagcatttgcttgcctggggttttgtttttttgctgactatcattattcatactacagatagcttgtcctatgctctccggcttggtggtttgcgagcgcgtcggattggattggcgttaaccgttgcgggaatgctgctgttggtttcacgcacctctaacatggcgcaggggcctttactcggagggatggtcgatcaggctaaagctgcagcacaagtgggcggaacggatattagactggaactatatatgcatggggtactgctggcagcaaccgttggaaccatgcttgctattttactgtatccaacagtggtacgcatgtcagccagatggattgtgcatttggagcataccggatctattccggctttggtgcgtcatttaatgctgcgaagtcgctggaagcatgcaggctactacataaagcgccctacctggtccatgctaacctcactgattggcggagcgatacccaagcgtctaattattctgaatatagctgttactgccatttatacaactggagtagtatctgctttatatgcatcattcctgtggcctgctcaaggtacagccatgtcaatgtcgtcaggtctaatcaatggcgtcgcaacggtattactgaccttgttaattgatccaagattggcggttctgtcggagaaaacgctacgaggggagctacccttaactcggatgaacagcatgtacggctggatgatcatctcgcgtttggcaggtactttattagctcagctattgctagtaccgctagccatttggcttggatgggtaatgagttaaattgctagcctacgtaatgatgtgcagccattcccaaaaaggctggcccgtgatcatctattaaagatagatcgcgggccagccccaatgattctatggctacttacttttcaaataatgacttatatgctccgtatccttcacgctccaaatcttcttgaggcacaaagcggagcgcggcagaattgatgcaataacgcaaaccatctggacctggaccatcatcgaatacatgccctaaatgagagtcagcttcacgacttcgcacctcggtacggatcataaaatggctgagatcggttttttctttgacattgtagctgcgcagcggacgggtaaagctgggccaaccgcaacctgcatcatatttgtccaatgaactgaacaagggctctcctgatacgatatccacgtaaatgccttcaccctcatgatcccaaaactcattttgaaaagggcgctcggtcgcgtttttttgtgttacttcgtattgaataggcgtcagccgatctttaagatcggatttatcaatcttgccggaccaattttgctcgataaaatcttcacgtcccgaacctttgcggtagcgtttgtaatgagcggggttcttcttatgatagtcctgatgatattcttctgcttcataaaaagtggccgcaggcagaatcggtgtagcaatcggcttgtcgaagcggccactttgagtcaaagcttctttagaagcttctgccttgattcgctgctcttcattatgatagaaaatagccgtttggtaggatgaacctctatcgtgaaactgtccaccttcatccgtcggatcaatctgctgccagaagagctccaacagtttttcatacgggaatacttgtgggtcaaatgtaatctgtacggcttccacatgtcccgttgtttcagaacacacctcttcataggtaggattttcggtatgtccccctgtgtatccagatctaaccttcaaaataccgggtaattcctcaaaaggggaaaccatgcaccagaagcagccacctgcaaaagttgctttttctaccgtgtgtggattgttggtgctcatatttgtcactccaatctgagaatgtttaattagttgttatttaaatagcttacaattaaattatatacgggatttttggaaaatccaacgaaaggtcagaaagcaacccgtagtgtaaatggctatgtcctaaaaatcgcaatgaaacttcctacagagacggtggcaaactcatcgcattatgttctgttggcgcgttgaagcctttttcggtagagtataaaggcgccgcccaccagtgcagtatatagcaccaaaatgagcaaaccggtaattgggtgttctgcaaaggtgccgccagcataagcatacaccgcaattgcgggaagcttgccaatagcagtacctaggataaagctccagaacggaaaccctgctactccagcgtatacatttaccgctgcttgggggatgactggaatcaggcgagccagcagaacagcagcaaaaggttccctctccatgactcgattgaagcgctccaatgcgggaacccgcttcaaataggcacgtcctttgtcacggaacagggtacgtactgcagtgaaaacgaccaacgcagccaatgtagtgccaagccagcagatcagagcaccttgccaggggcctgcggcataagcaatggaggcgataatcagcttgtaaggcacaaacggaattagcgcgaataaaaatgcgagtagtagcagaactggaaaggaggtctgcttgtccgcccaggcgagccaatcatatctgtagataaacgcgatgcaaagcagcgaaacataagccgtgacgagtagccattttttcatttacatacctctttcaatatccctgttcggcttatcgcttatacagaaaaaaatagggttcacattcccaataatgtgtgctatactgccactaacagaatagttcccaaaggggagtagctcaacgagtaaagtcgtcattacgggatttttaatccccggctttattggcaacgtaatgttgtaagcgagacctttgccaggattttaggaatccgggtaaatggtctttttttgatgccgaatttgggtcaagcgccgtttccggattccgtgaaatggcgcttttttagtataaagcgctgaactatgtacagtataacaaataaataaaaaaggtgggagaaacgtatggattttttgtcaattgagtttttaaccgcattagtatccatcattatcattgatctggtgctagctggtgacaatgcgatcgtaatcggtttggcggctcgcaatgttgataaggctaatcaaaagaaggtcattatttgggggacggtcggagcggtcatcattcgtgtgattgctacagtgctggtcacgtatttattgcaaatttacggattgcgtttgattgggggactcgcacttatctatattgcctataagttgctggtcgaagagaaaaaacatgaaatttcagctacgaatcaaatgtgggcagcgatccgcacgattattatcgcggatacgatgatgggcctcgacaatgtacttgctgttgcgggagcagctcatggaaacatgctgcttgttatactgggtctggcaatctccgttccaatcatggtgtggggaagtacgattatcttgaagctgactgaacgttacccagtagttattacgattggtgctgctgtactggcttatactgctgccaaaatggtggtggcggaaccgctgattgcgcactggtttatgaacggggtcgttaaatacggctttgaggttctggttgtggttctggttgtagccattgggatgcgtgttaaaaaaattaaaagtgaaaaaacaagaaagcaagcgcagcacgcctaagctaacttacactgaagtaaacttagctgaagctgaacgttcatgccatagaggctgttccgttaggtcctccaactggaccgggagcagtctcttttctttgcttgtcagcagacttccatgtaaactagacaacagatgaatgagtgattagaggtgggaacgatatggacaagcaaacgaagacaagagtagctattgcaggactgggtggtattgctcgaaaagtatacttaccgttactggcagcacaccaaggtgtagatattgtaggtgtcatgaaccgttcacaggagccggtgagttccattatggagcaatataggttgccaagaggaacgacagatgtgaaggagctgctagcatgggaaccggaagctgtatttatacatgctgcgaccgaagctcattttgatctggttatggcgtgtattgaaaaagggattgccgtgtatgtcgataaaccgttgtcctatgatgttcgtcagaatctggaaatgaccgcttttgcggaagcgcaggccgtgctgctggcggtgggctttaatcgacgttttgccccgcattatgtagctgctaaagcatggttagaggaagcaggtggattcagtcaatgtgcggccattaaacaccgtactggatatgatcgaagaccggcggcacagacggtttatgatgatttaattcacatgcttgatttgcttttatggctgggtggcgatgattatgagctgctgcatagtagtctgaatacgacgagtgaaggatatatggatgctgcgttcgggaccgtacgtttggggaatgctaccggaagctacagtatgagtagacaggcaggagctgacatagagaagctggagcttcacggggcaggacggtctgttgaagtaacaaatatggaacaggctgtttttatgcaaaaaaatcattcaccactaacgcaagcttttggaagctgggatacgattttggaaagacggggattcaccggagtcgtaaatcattttctggagcatattcatcgtccagaggagtgtgctgtacgggctgggaaagtattggatagccatatgctggctgacgagctgatcagccgtttgagtaattaatatggaacgtccgaacgtgatcttaacagtccagacagacatcaagaattaggttgaaggagaaatgaatgaatggaagaagataaccgtggtaaacagctagaagaagccatcattgaaaattataagcaagaagaagatatgatgatccttgtgtttgcgcaatggtgtatcaatcatgagttggagccagaggaactatatagtgaagcatatccgcatcaggatagcaacgagcgtctgctacgagtacgcaagttgactgtatcgcgtgaagaagcgggtgatattccgctggatacggtattaggggtactgtccatgttcggaaatgaggacttggcaatggtcgtatctgaggcggctgcgagccttccgtcggaacggaaataagactagccagaataaagaatatactgttatcatttatggcatatcatttatggcatcatggactcaactatatttacttaagacattgttgatggggagggtaagcttacgatggaagatatacctgtgccaagtacctgtaaaggctgtgaaagagatatctcgatatcggaagagcaaattaccagaattctaaccaacatgagacccaaaatggaatgtgtaaatgatgaagtgtacgaagccagactgctggcctgctcacaatgtgaagagttaatgtccgggcatacatgtggtatcagcggaagtattgttcgtgtacgtgctttggcggcagctcaaaattgtcccagttaccatggttcacgctggataggtacagcctaaaagctacaatcctcaggctcgactgaacctggattacgggttaaaatagtcataccttggtctgccttaatggcaggctttttggtttgattggacattatcttaacgattgacaaaaagtagacaataaaatatattaaacacgtgaaatgtttttgtttaattattaacatttatattaatatttgctaaaagtattgatgcgtaaaaattatgatcgaaagaaaatcggtggtatgattgatatttgggccaaaatgaaagcgcaaacatttgtgcgggtgttccaacaatcttaatatttttggggagggtttgttgtgaagggttctattgttgttaataccgattggaaacaagggattattaataaaaacatttatggacaatttgctgagcatcttggacgttgcatttatgaaggcatatgggttggagaggactcaccgattccgaacacaaacggaattcgtaatgatgtggtggaagccctgaaaaagctgaacattcctgtgctgcgctggccgggaggatgttttgccgatgaatatcattggaaagatggtatcgggccaaaagaaaaccgtaagagaatggtaaatacgcattggggcggtgtggttgaaaataatcattttggcacacatgagttttttcaattgtgcgaactgttagatgcagagccttatatttgtggaaatgtcggcagtggtacagttcaggaaatgtcggagtgggtagagtacatgaccttcgatggagagtcccctatggctgcatggcgtcaggaaaacggtcgtgagaaaccatggaagctcaaatattttggagtgggtaacgaaaactggggttgtggcggtaacatgcgtccagaatattatgccgacctgtatcgccgctatcagacatatgtccgtaactatggcgagaaccgcatttatcggattgcaggtggggcgaatgtggatgattatcgttggacagaagtgttgatgcgtgaagctgggcatcttatggacggtttgagcctgcataactatacgatcccgggaaactgggaagggaaacggcaagcagtcggttttgatgaagcggaatggttcgagacgatgaaaaaatcattgcatatggatgaattgattactcgtcattcagccattatggaccaatatgatcctgacaaaagggtcggactgatcgtcgatgaatggggaacctggttcctgactgaaccgggaaccaatccgggcttcctgtatcagcaaaatacgatgcgcgatgcgctggtagctgggctgcacttacacattttccataatcaccatgaccgagtacagatgacgaatatagctcaaatggtcaatgtattgcaagccatggttctgactgaaggccctgctatgctgttgacgccgacctaccatgtatttgaaatgtttaaggtgcatcaggatgcgcaagcactggctgttcatgtaaaggtaggcgattatgaatatgacggagattccatctcacaagttagcgtgtccgcctccaaggcgcaggatgataatattcatattagcttttgcaacgtccatccgggcgagtcggcaaacttgaatttggagctaagaggactggaagagattaaaaaggtcagctgtgttgtccttgccagcgatgatatgcaggcacataatacgtttgatcagccagagcgtgtgaaaaaggaagctttcacatcctatcagctgcaaggtcagcatttggatgttacactgccaccaatgtcggtagtgatgctgacaattgctccgtaaaaagctgggtcgtggtatgtaagcagtattcactgctattggttatgaacaaagagagcgttcaggtgaacgctctctttgtcctacaattgctcgcggtgaatcaccctgaattctttgggcgacataccgaagcgggaacgaaatacacggtgaaaatacgtgtaatttgcaaatcctgacgattcggcggcttgttccagtgacatgggactgaaaatgattcgttctctcgccatgttaagcctgatgtccagcgtgtactgcataatgctcgtatcgaatgtttccttaaacagatgtactgctcgggatacgctgataccgacgtgtgaagacacgtcatccagtttgaagttagaggatgcgttttcttcaatataatttttaatctgatacgcaagatagttatgatgagtagcgataggatgatcggatagcatacggtcaaactccaaacataaaatgcgtatgtaataacttgatatttccgggtaaggattagaaatacgtcgttgctccatcacaagctgacgaaataggccaagcagggcttctgtgagctgaaccttaattctgttgggtcgtttatgatggttccaccactcatctacccaggaaccaccgaaaaaaatgtgataatctccactttccacgacctgctctcccatggggtttaactcactatgaatatctagttcataaggctcggtaggattgaatagcagtaggtcacccgcctcaatccgtgtcatttccccgttaatgcgggcctggcagcgtccatctgtttgcaaacggaataaataatttttgatcccatcaggctggttcgaataaaagggctttcgatggaaggaatagcctgcggtaagaacctgacaaggctcgacgatagacatgatgatgactcctttgggctatggctgtttcaaatattgaccagattgttcatgttttaatcatattattcattttaaacgaaacagaaatagaatactatgtgaactgtaaagcttacatgttagatgagaaagtacatgttggaggccaaggagtgtgacgacgtggaacaaatgaaggccgggattatcggatgcggtactattagctcggtatatcttgaaaatctccaaaatagcccacttattgaagtggtggccgtcgctgatttactggatgagagggccaaggagagggccgatgaattcaacattgaaaacgtatacaagtggaagaattgcttcgttagcctgagattaagcttgtatttaatctgaccatgcctggcagccatgcacggtcagatgtggcgatactagaggcaggcaagcatgtgtacagtgaaaagcctttggcgcattgaaattcacggaccatcgtgccaatgctgaactggcctaccatgtgttagaagccatgcatgcttttcagcgctcatcattggaaggcaatcacattacgatggaaaacacgttcaaaccggacgaggatttgtattatggaacagatataatggagaattcatcctaatttaaagaggtgaaggggaatggctaaagtaggattgcaattgtacacagtaagggaagagcttgaacaggattttgaaggtacattgcgcaaggtagcagagcttggctataaaggggtagaatttcatacctttttcggacgcaatgccaaggatgtcagagcgcttttggatgagctgaatctggaagttgtcggaactcatatacaatattctcgtttgctggatcatttggatgaagagattgcataccacaaagaattgggaaataaatacctaatcgttccttatttaaccgaagaacagcgacagtgggatgaactttttgctaatttggatcgtattggtgaaaaagtgaaagaacagggcttgatactggcttatcataatcatgattttgaattgacagaaaaaatcaatgatcgcccggtattcgatgctttatatgatgcggtttccgatgatttgttacaggtcgaaatggatacttgttgggtatactatgggggctatgatccagtggaatacatcggacgttataatggacgcctgcctatcattcacttaaaggatatggcacgtgacgagcaacaaaaagcagtaactgtagagcttggcaaaggcgaagtacagcttcaggccattacagacgccgctattcaggcaggtgtggattggatcgtcgtagaacaggatttctgctcaaactctccaatcgaaagcattgaaaccagcattaaatggctccaacaatacgcagctcagggaggaaatattcatgtctaaaacactcaaaatcgggattattggttgtggagggattgccaacggcaaacacttgccgagtcttgccaagcagaagcgtgcagaaatcgttgcattctgtgacatcattcaggagcgcgctgaagaggcagcagaaaagtttggagttgaaggctcgcaagtttatagcgattaccgtaagctgttagaaaataaagacattgaagtcgtacatgtatgtacacccaacgactcgcactcggaaattaccgtagcggcgcttgaggcaggtaagcatgtgctgtgtgaaaaaccgatggctaaaactgcagagcaggcacgggaaatgctcgatgcggccaaccgtacaggtaagaagctgtctattgcgtatcaaaaccgttatcgtgatgatagtttgtatctgaagcaattggtcgaacaaggagagcttggagacatttatctgggcaaagccattgctctacgccgtcgcgcggttccaacctggggagtattcttggatgaagagaagcagggcggtggcccccttattgatattggcacgcatgcactcgacctgacactctggctgatggataattacaagcctaaaagcgtactaggttcaaccttccataagctaggggatcgtaaagatgcagcaaatgcctttggaccttggaatcctgaggaatttaaggtagaggactcagcttttggttttattacgatgcaaaatggagctacgattgtactagagtccagctgggcattgaatgttgtagagtttggcgaagcgaagacgctgttatgcggtaccgaaggcggagccgatatgcaggatggattgcgcattaacggggaaaagaacagccgcttgtttgatacgaaaatagatctggatgcaggcggtgttgccttttactctggagaaacggaaaatgaagcagaccgcgaagcccgtctgtggatcgaatctattctggacgacaaagaacctcttgtgaagccggaacaggcactggttgttactgaaattttggaagctatctatgaatcggctcgtacggggaaagctgtctattttgactaagcccgtaattatcccgaatagaccatcattataatgaaagcagcttttttcacatatgatacagggagggatttcttttgaaacttggagtatttatggtgttgtttggaggacgttcgctggaggaggcgctggattatgtggcttctcaaggattggatgctgtagaaatcggtacaggcggcaaccctggggataagcattgtaagccggatgagttgctggagaatgatacagcgctcaaaaatttcaaaaaggcagtagagtcccgcggactaacgattagtgcgcttagctgtcacggcaatcctctccatccgcaaaagcatttggcccaggctgatcatgatacgtttcttaaaaccgttcgattggcagaaaagctggaagttccagttgtgaacactttctctggctgtccgggtgatcatgaggatgcgaaatatccaaactggcctgtggctccgtggcctaatgattttcaggaagtgttgaagtggcaatgggagaataaaattattccttactggaccgagacggggaaatttgcagcagatcatcatgttaaaattgggctggagctacacgggggcttctccgttcatacaccagcgaccttgcttcgtttgcgtgaagctgcgggagaggtcattggtgctaatctggatccgagccatatgtggtggcagggaattgacccagtgcaggcggttcaaattttgggccgagagggagccattcaccattttcatgccaaggatacgacgattgatccgatcaatgtaaataaatatggacttaccgatatgcaggaatatacgaaaatgctagatcgtgcttggcagttccgaactgtgggctatgggcatgatgtaaaaacctgggcagatattatcagtgccctgcgtctggtgggatacgattatgtagtgagtattgagcatgaagatggtctgatgtccgtggaggaaggctttactaaggccgtccacaatcttcgccaggtactgattgaagaaccgctgagcgagatgtggtgggtctaacctaatagggggaaatgttgatgattaacgtcaccatttggaatgaatatttgaacgaaaagttgaatgatgaagccaaacagatatatcctgacgggatacacaaagcgttggctgacggcctggcaggagagggatttgccattcgaacagctactctgcttgatgatgccgagcatggtttgggagaagatattctgaattctacagatgtgctgctgtggtgggggcataaagcccacgatcaggtgagcgatgaagttacggcgcgtgttgtcaagcgagtgcaggaaggaatggggttgatcgtgctgcactcaggccatttttccaagccattcaaagccctaatgggcactagctgtgacctgaaatggagggtggcaggtgaacaggagattatttggtcggtgaatccgtcacatcccattgcagaaggcatagatgccaaaattttgttgaagcaggaagagatgtatggcgagttctttgatattcctacgccggatgaactggtatttgttagtaactttgaaggcggcgaagtatttagaaccggatgtaccttccgccgaggtagtggtaagatattctatttccgcccaggtcatgagacctatccgacttattaccagcctgatattttgaaagtaatcgccaacagcattcgttggacttctccgacaagtattaacaaaccaatatatggtagaagtgaacctgtaagacctctcggtggagtgttggtataatgacaatcatcacatatggatgagtgtataatgaacagattgataggcggaacctcttgggattccgcctttttgtatttaacgatttagacatatacctgctgtgttagtttgttgtataatcagttttggtcatggcaactttatcggcgcaggtatttaatttaagaagaaagtgttttctttcgggataaagtatgctaaaatgatatatactaacaaaaggaaagctttatcaaaccgaaatgcaaaagaaggtgaaaaatttggagagtcaaccgcaatgtacaaaaatgtgtccgcgttttgaaaccgccttttcatgtttgggcaagcgttggaatggattaattattcaatccatgatgagcggtcctaagcggtttaaggatatttccaatctgattcccacaatgagtgacaaaatgttatcagagcggatgaaagatttggaaaatgaaggaattcttacacgtcatgtatatccggaaactcctgtccgcattgaatacgagctaacaaccaaaggccgtgcacttcagccggttatggaacagattcaattttgggctgaggaatggattagatgagcaccaaactaaataagcgtttctcatagcaaaacagccttttcctaggaaaaaggctgtttttttattttgtgtataggactacttatccatatcacagaaatgatgtgcataggtagcacggcttaatagcctttgacgcgccctgcaactgagaataatgctgctgttgcacggcggggcacacgggtttgaatatccagcgcggccgaacggaatgtacccagacaggaatggcaaagtcttcctgcataaataggggaacggcaggactcacaaggataatcgagctgactgtatgtggagggaaacttgcctgctcttacccagtctgtgagtaattctataggtgtgccggttacatcactgagctggcgggtatgagtagaaggatgcttccatagatagttagaacagcggtctaagaatatattttcttcctgaatacaagtactacacaggtttctaaggttctgacgaaaaacggaaccacattttgggcaattagaagtatgtatctccatagaaaccagtcctttgtatcgaagtatagtgaaattttgaaatttattagttacatattactatgaccttatacctatatcaatctttatttatggaatcactgatctaagtgtatgttggagtctgtgttgacataactctgttacttatgtactattacttacataaagttacttaatgaataaaataaattattgaagacaaggggatctttatatgatgccatctttatttttggcccacggctcaccgatgcttgctattgaacagacggactatacttcatttttagagcaactggggaaaagtattcgtcctaaagcggttgttatctttactgctcattgggaagcgcaaacgttgacgatcagttcgatggatgacgtgtacgataccatttatgattttggtggtttcccaccggaactgtacgcggtgaaatatccagcacatggttctgtcgaactggccaataagctggaaaaattatatgaacaaaagggtattgacgtacaaactgatcgggtgaggggactggatcatggatcctggacattgttgcatcgtatgtatcctgaggcagacattccggtagttcagatctctgtaaatccatatctctcgcccaaagcacaatatgtcattggtgaagtgctacgtggactgggagaacaggatattctggtcattggcagtggcgtgactgttcataatctgcgtatcgtcaaatggggggaaacgaaaacagaaccttgggctatagattttgataattggattattgaaaaagtgcaaagtagagatatagaggctttggatcactataaaagcgaagcaccgtatgctcgtcaggcggtaccaagagcagagcactttataccgttgtttattgcgatggggagtggaaatcctgcaaacaaagtcaagatcatccatagaagctatgagatggggaatttaagttatctatgcttacagttttaaaagtgtgttgccagaagaaggactattgttaaaatgcttcgctactgcttctgtataagtaggggagtggaaataaattagggagtgttataagctataatggcttttaacactcccttttacataaataacgatttattatatccggcaaatctcacgagggcacaattcacaatgacacacgccttgcagcatttccaaatccttgacaacaatcatgccgttatcgtattctactgcatttttcttacgtaaatcactaagcatccggtttacgctttcccgagtcgcaccgatcatattagataagtcagtatgagtaattttcttatgaatcaggatatgttcgccgtgaggctcaccataggtattgcatagacggatgagtgttgaacataaagcacctggcttgccgtacatcatcaaatcgcggaacttagtctgagtaatgcggtgatgcgaacccatccatttcataaagtcaatcgcaaaatcacaatgctggcaaataagcagctccagatctgtatgatcgattacgccaatatcactgtcttccagaacctcagcagaaaaggaatgcttagtaccgaaaaaaggatcggcttgaccaacaagatcaccgctttgatacatatatagaataagttccttaccttcatccgttgttttggttactttcacgcgtccgcgcttaatataaaacagcttatccgctgtatctccttcccagaacagatgcgagctttcaggcataactcgatctttcatcatcacttgcaaccggttgaagctggcctccgagaagcaacaggtgttgccgcgggcttccattacatttgtagggtttctcatcgtccatttcccctttgtatcctatgttttttatctgcaacttgatcaattcaaattcattatatacctgcgcaatgcgtttttggggcaagaagagggggtaaaagtggcagaattccaaactttgtgattaaattcacttcataaaataaaattttaaatagattgtgaaaaaaatcacaatatatcttgaaaagctgtgttacgatcagtgcgtgaacaagagatagtacacgagataacaggaggatgagggaaatggctgttaaaaacgaggttatccaaaaagagcaaagcgcagagcagtatattcaaacgctgattgaccgggggaaccgggcacagcaagctttcatgagtatgaatcaggaacagattgacgaaatcgtacaagctatggcactcgcagggatggataaacacatgtacctggcgaagatggctgttgaagaaacaggacgcggtgtgtacgaggacaaaatcaccaaaaacatgtttgcaacagaatatgtctatcatagtatcaaaaatgaaaaaaccgtcggtgtcattgaggacaatgattttgacagttttcaaaagatagcagagccagtcggcattatcatggggatcactccagtgacaaacccgacttcgactacgatgttcaaagcgctgattgccattaaaacacgtaacccaatcattttcggtttccatccatctgctcaatcgtgtagtgcggaagcagcccgcgtcttgctcgaagcagctgttaaacatggtgctccagctgattgtattcaatggattgaagcaccttcgatggataagaccaatgtactgatgaaccaccctgatgtggcgctgattttggcaactggtggatcaggcatggttaaggcggcatatagctgcggtaaacctgctctgggtgtaggcccaggtaacgtgccttgctttattgaaaaaacagcagacatcaagcaggctgtgaacgatctcatcctctctaaatctttcgacaacggtatgatttgtgcttccgagcaagcggttattatcgaagagccaatcttcgaacaagtgaaaaaattgatgattgctaacggctgctattttgtaaataaagaagaagcagctaagctcactcaaggagctatgaatgtcgagaaatgtgcagtgaacccagctatcgtcgggcagtctgctgtgaaaattgctgaaatgagtggtattacagtaccagcaggaactaaaattttggtcgctgagattgaaggggtaggaacaaaattcccattgtctgcggaaaaattgagtcctgtattggcttgctataaagtaaaaaatgcggaacaaggtattcaacgtgctgctgaagtcgtggaattcgggggcatgggccactcgtccgctattcattcgaacgatgaggacgttatcgctcgcttcgcaaaccgtctgcaaacaggacgtatcattgtaaatgcaccttccacacatggtgcgattggcgacatttacaacaccaaccttccttcgttgacactcggttgcggttcgtatggtcgtaactcgacttcgtcgaacgtatcggcagtcaatttgattaatgtgaaaagggtggcgaaacggacggtgaatatgcaatggttcaaagtaccttccaaaatctattttgagaaaaactcgacacagtatcttgctaaaatgcctgatatcacacgtgtagccattatcacagaccctatgatggtacaacttggatatgtagatcgtgttattcattatctgcatcaacgccaaacaccagtagctatcgaagtgttctctgaagtagagccagatccatcgacagttacagtagaacgtggtactgaaatgatgagacgtttccaaccggattgcatcatcgcactgggcggcggttccccaatggatgcggctaaaggcatgtggatgttctatgaatatccagatactgatttcaataatttaaaacaaaaattcatggatatccgtaaacggatttacaagtacccacgtctgggccaaaaagcacaatttgtagctatccctacaacctcgggtacaggttccgaagttacatcgttcgcagtaattacggacaaaaacctgggcgacacgaagtacccactggctgactatgagttgactcctgatgtggcaattattgacccagtgtttgtatattcgctacctaaaacagctgtagcggacacaggtatggatgttctgacacatgctatcgaggcttacgtgtccgtaatggctaatgactacacagatggtctggcaattaaagccattcaattggtattccaatacctagaacaatcggctctgactggtgataagctggctcgtgaaaaaatgcataatgcttctacacttgctggtatggcatttgctaatgcattcttgggcattaaccacagtcttgcacataaatggggtggacaataccatacagcgcatggccgcacgaatgccattttattgccgcacgtcattcgctataatgcgaaaaaaccgacaaaatttgcttcgttccctaaatattcgcactttgttgcggatgagcgttatgcagaaatcgcgcgcatactgggactgcctgcacgcaccaccgaagaaggggttaacagcttgatcgaagcgatccgtaaaatgaacaaaacacttggtatcgaggaatcgttccaacaaatcggtttcgatgcgaaggatttcgaatcacgtgtagactatctggctgaccgcgcatttgaagatcaatgtacaactgcgaatccgaagttgccactggttactgagttggctgatgtctatcgcaatgccttctacggacgttttgaccaataatataataggtacgaagaggcttgtgaaaaagcattttctcgttcaataccgatgcaggctctctatatagagggcctgttggtttgggaagggaggtgaacggcaaggctaaggatataggcgtgaagctagggaaaataaagtgacaaaaatcactcatattgtgatttttgtcacatactacactctatcattattctacaataagggtgtaagaaaggtcccgacactgagcgtaaggcatcggtgaaaaggccgggctcaagaaatagctttatcgtgaaaaaaatcacaagtccggaagaccaaacaatttggagggatttacatgtcggtgattgagagagaattacaagagcaacaatctggctggagaggttttaaaaaaggcaaatggactaaagaagtcaacgtcaacgattttattgaaactaatatcttaccttatgttggcaatgaagaatttttggttggtcctaccgccaacacaactgcattgtgggatattgtatccgatcttactaaaaaagagttggcaaacggcggcgtgcttgatgtagacgtgaatacgccatccactattatttcacataaaccgggttatctagaccgggataaagagcaaattgtcggtgtacaaacagatgctccattcaaacgctctttgcagccgtttggtggaattcggatgatgatcgacgcttgtaaagcctatggttttgaagtaccagaaagtatcattgatatcttcactcatattcgtaaaactcacaaccaaggtgtatttgacgcttatacagatgaaatgagagcagcccgtaaagctggtatcattactggtctgccagatgcatacggtcgtggtcgtattatcggtgactatcgtcgtgtagctttgtatggtgtagccttcttgatccaagataaaaagctgcaactgaaaagccttgaagttgattccatggaagaagacgtaattcgtcttcgtgaggaaatttccgaacaaattcgtgctttgaatgaactgaaacaaatggctgctgagcacggttttgatatttccaaacctgctaacaatgcgaaagaagctttccaatgggtatattttggatatcttgcagcaatcaaagaacaaaatggtgcagcaatgtccttaggacgtgtatcttccttccttgatatttactctcaacgtgatatggaagagggtacaatgacagaagaacaagctcaagaactggtcgatcattttgttatgaaattgcgtattgttaagttcttgcgcacacctgactataatgaactgttcagtggagatccaacttgggttactgagtccattggtggtatgtccgtaactggagaaactcgggtaactaaaaacagcttccgtttcctgcacaccctctacaatctgggacctgcaccggagccgaacctgactgtactgtggtcggaaaaattgcctgaaggcttcaaaaagtattgtgcgaaagtttctattgaaactagctccattcagtacgaaaatgacgatctgatgcgtccaatttatggagacgattatggtattgcttgttgtgtatcggcaatgaaaatcggtaagcaaatgcaattctttggtgctcgtgccaacttggctaaagctctgctgtatgcaattaacggtggtaaagatgaaaaatctggcgtccaagtagggcctgaattcccagccattacaggtgaagttctggattatgaagaagtgttgagccgcttcaaacctatgatggaatggttggcaaaactgtacatgaacactttgaatgttattcactacatgcatgataaatatagctacgaacgcattgaaatggcgttgcatgatcgtgatattctccgtaccatggcttgtggtattgcgggtctgtcagttgctaccgactccttgagtgccattaaatttgcaaaagttaaaccaatccgtaacgaaaaagggattgctgttgactttgaaattgaaggcgaatacccttgctacggtaacaacgatgaccgtgtagataacatcgctgtggaactggtagaaagcttcatgagcatgattcgcaagcataaagcttatcgtaatgcggttcctactcaatctgtactgactattacttccaacgtggtgtacggtaagaaaacaggtacaacaccggatggacgtaaagcaggcgaaccgtttgcaccaggggcaaacccaatgcacggccgtgataaaaaaggtgctttggcatctctgagttccgtagccaaattgccttatgaacacagtctggatggtatctcgaacaccttctccatcgtgcctaaagcactgggtaaagaagaagaaacacgcaaaacaaaccttgtttcgatgatggatggctactttggaagccacgcacatcatctgaatgtcaatgtgtttgctcgcgaacaactgttggatgcaatggagcacccagaaaactatccacagcttacgattcgtgtttccggctatgccgttaactttatcaagctgactcgtgaacaacaattggatgttattaaccgtactttccacggtacaatgtaaataagtattacaatgacgcacgcatagcggatgcgggaaggatgatgcaacatgttgaaaggtcacatacactcattggaaaccttcgggaccgtcgatggtcccggcatccgcttcgtgctctttatgcaaggatgcttgttgaaatgtcaatattgccataacccggacacttgggccttgaatgaaggtaatccgatgacgttggaggaggtattggctgagattgagccgtatttagcctattaccgttcttcaggaggcggattgaccgtatccggtggagaaccgacgctgcaagctcattttgtcgcagagctgttcaaagaagtgaaacgtcggtggaatttgcacacgacactggacagtaacggatttaatgacgcgggccgtatccatgaactgctggacgtaacagacttggtgctactggatattaagcatattgacaatgacaagcatattaagcttacaggcaagtctaacgaccgtatgctgagtacggctcgctggttgtctgagcaagggcgcaaaatgtggattagacacgtatttgtaccgggtattcatgatgacgagcaagatttattgaatttgggacggtttatcggaacgttgaacggagtcgaaaaattcgaaattttaccttaccatcaaatgggtgtttacaaatgggaaatgcttggtaaggagtatccgttggagggagttccatctcctacagatgaagaagttcaacgtgcatatcgactcattgaagagggtcgtctggagactgcaggaaagaatactgtctgtcgtccatcataatgtaaatggctcaaaagctatttcctagtaatgaagccgccgccacatcaggtcagatgggcggcggttttttgttgttgaattttttgcagtcacaggagaaagttccctttttttcatgatcagcaaaatttccagaaactttttaacaactgacgcgtctaatagtatgactttttacgggaatgataataatttggtgatagaaggagacagacaatgaatttcaagaaatggaccatgctcaccgcccttgcggtagctcaggtggccgcagtagcccctgtaggagcagaagcagcatcaacaaccgttcaatccaccgattcggttagcgcacagcaggctcaggccaatgttgctgattcaggcgttcagaatagcatcggagatcaagatggaactagcacacgaaatgacacggtgacacctaataacacaggcgtatccaatgatccattgactggcctgcctacggatacaaccaacggatcgaacgtttccattgatgtatacggtggagacggaacgatcaccaatcctggtggagctccaacatccatgggtgctaatcaattgattttgtacttaaacagcgcgaaaatggaacaaaacggacaggtgtacacagcaactcagccgatgaccgtgaaggacggagtttcctatgtagctatccgttcacttgtcagccgtgtcggattgcagtttagttatgacactgccaccaaagaaaccgtaatcacacaaggaacaaatgtcatgcgcttcaaaacagacagcaaggtttatacggttaacggtgaagccagacaaatgaagggaccggcttttcagcaaaagaacgtatttatggtgccattgacctcgattacacaggccttaaatattccttatactgtgaataatacgactaaacaagttatcatggatttgaatcagaaacctaaagcttccttcacggttcaacaaaaagatatctatgcgggcgaaacccaagttacgtatttgacgaaggaatcttctcctacaggtcttccgattgtgaaccaacgttgggaaggtaagcaggacgtatttcaggagccgggtacatatgtagttacctattctgttcttgactctgctgggaactggagtgatccttactcagttacaattacagtaagaccaccaaatcagccgccagtggctctgtttacaactgataaaaaagagtacaaaatgggtgagaaaatcaccattaccgacctgagtacagatgatgagaatgcaatcactaagcgtgattgggagaataagaaacttgccttcttccaaccaggtgatgtaacaatcacactcaccgtgactgataaacacggcgcaacaggtaccaaaagtgaaacaattaaaattacgaatgaattgctgtacaacgaagatgatttcaataaaatcttcacaccatatggtgataaatatacagtagacggcagtcaggtgcctaccatggctaccattcctttgactagtacatcttctccgcgtcttttgatccgtgctaacagcccggaacgtgtattccaggacggaattgtgtatcaggaaaccggatcaggcagcacgcgcatactcgtccatcatgtgaatgaaacgggtcgagatgtgaaaatgtacgtgattgcaactaacaacaatattactcctgccaacatgaatgtcgaaaattctggttttgctggaccatctgaatttgccacggctgcgggtaaagtctcaattcaacgatattttcaatccatgcaggatggaagcaagcgttctagctcagttctaaatcctggcgaaagccgcattattttagaggatttgaatgcacaaaaaatcaagcaaaaacaagtcatatctttgttatctgatttgtatacggatcaaccgattcaatacacggttattgtgttagatgcaaatgtagatccgttaaccgtgttgcctactctagctaaactgcctaaggacggtattcataaccgtggaacatacgctaatgcagatatctcgctcaattataccgaagaggttggtaaaacagctcaacgtatcgttcttggtgataataaggtagatccgaacctgattggtacggacggtctggacggctcttctgcttccaatgccggtaattttggtgttgtatataaagttaaattggatcatgtagcgccgtattcactgattacgttcaacccgcgtggaggcgaatattccggctatgcgatggtaaacaatcaggttgtgggtatcccgacgaacggcgcagtatgggctccaaatgagatgagtgtgctgtatcgcacagggcatatcgaggaaagtgtagagatgtatttcactgctgctgcaggaagtaacttgccggtttccgtagtagttatgcctttgccagctattaaaaattaatatgaaataaccggtgctgtttaccggcttagaccttgagtctcgtcattcaccgtttaaaagtcgatgtcacttgcagaatataggcgttctcctgctgcgaatttaatcgtagcgccggagagcgtctttttcttatgtatagatacgaatatctcttataatattgactttaatcgtggtataataaatagatgcaagcctaagcctgcatcagaaaacctgaaactacagacaggggagggtgaaacgcatgctgacaaaggatgagattattgcaacaatgtccgctcaggggctgcgtattacagatcagcgcaagacgttggccacgttattttccgagaatgaagggtatctgtcccccaaagacgtttatgaatatatgggtaagaagtacagtggacttagctttgatacggtttatcgtaatctgcgtgtaatgcaggaattgggtgtgttggaacaggtatcttttgaggatggaatgaagtttaaggtgagctgtaatgagcatcatcaccatcaccatatgatttgcttgagctgtcagaaaacattaccgatttctttttgtccaatgcaaatgacagatacaacggatcaattccaaatcgtcgagcacaagtttgaaatttttggttattgcaaagattgtcaacagaagaatgggcatactgatagtaattcggatgggggattcagacagacgagcagtcacactcacagccacgggggctactgaaatgaaaatcaccacacgcagagtggcacaggctccgattaagttttatcgttcctatatttcaccgttaaagccggctacctgccgattctatccaacgtgttcggcgtacgcgttggaggcggtagaggtgcatggtgtactcaaaggttcatggcttgctgctaagcgtatagccaagtgccatccctttcatccgggcggcgtagatttggtccctcctgcaaaaaagggaacagataggtctagcgaagatcgtttggctacccactccaagaagggtctgacttgacagcgctatgcggatttggttatattttggttaatattgttttcctgcgaagggatgagtagggtaaaccgtccagtacagagagccggggttagctgcaaaccggtctggagcgaagcctgaatatggtcctggaggaacctttttcgagcgtatttgccacagttattagtgcttgggaggcaagcgtaagagggaggcgtgttccagcgttaatgggcggtcagatgtgaccggtgaagcctgtagtctgcgaggatacaggaaaattgggtggtaacgcgtgaggtgactctcgtcccataggggcgggggtcttttttgtgcccaatttgtgccaaattcatgaattggagtaccatcatgtcagcagatcttatcgagctgccgtgaacaaaacaggaggcaacatacatgtccaatgagaacacattttacattacgacaccgatctattatccgagcgacaagctacatataggtcatgcttacacgacggttgcgggagatgcaatggcccgttacaagcggctacgtggttatgaagtgcgctatttgacaggaacggatgagcatggtcagaagatagagcagaaagcgagtgcagcaggcaaaacgccgcaacgtttcgtagatgatattgtggcaggtattcaagaactgtggcggaagctcgacatttccaatgacgattttatccgtactacggaggaacgtcataaggctgtcgtacaggaaatttttgatcgtttgctgaagcaaggcgatatttacaagggagaatacgaaggctggtacagcatccctgacgaaacgtactacacagaaactcagctggttgacgtggtgaaggacaccgaaggcaatgtggctggaggaaaaagcccggatagtggacaccctgtagaactggtcaaggaagagtgttactttttccgtatgagcaagtatgctgatcggttgctgcaattttatgaagagaacccacagtttatccagccggaatcacgtaaaaaagagatgatcaataacttcatcaagccgggtctggaggatttggctgtatcacgtactaccttcgattggggcattaaggtgaagggggatccgaagcatgtcgtgtatgtttggattgacgcactttccaactacatcacagccttgggttatggctcttccaataccgagttgtatgataaattctggcctgcaaatgtgcatatcgtaggtaaagagattgtaaggttccacacgatatattggccgatcatgctgatggcgctggatcttccgttgcctaaaaaagtatttgcacatggttggctgctcatgaaagacggtaaaatgtcgaaatctaaaggcaatgttgtagacccggtgacgttgattgaccgttatggtctggaccaacttcgttactacttactgcgcgaggtgccttttggggcagatggaacatttacaccagaaagttttgtagatcgagttaattcggatttggcaaatgatctaggaaacttattgaatcgtaccgtggcgatggtagataaatatcttgatggcaaggttccggcttatgaagcgaatgtaacagcattcgacggagctttggaagacatggcaacatcgacttatagcaaagtagaagaagccatggaaaacatggagttttctgtggcattaacggcgattagccaatttattagccgcagcaacaagtatattgacgagacgcaaccatggaatttggctaaggatgaggcaaaacgtcgcgaattgtcatctgttatgttgcatttggtagaaagcttgcgcatcgcttccatcttactccagccattcttaacccgtgctcctcataaaatttgggaacagctcggtattagccaaggtgagctgactacatgggatagtggcaagcagtttggtcgtattccggaaggaacgcagctggtcaaaggtaatccgatcttcccgcgtctggattcagagcaagaggttgcttttatcgtggaagcaatgaccggggggaagaaaccggaagaagctacagcacaagctcaaccgcagaatgcatctgaggagagccaggaagcgccggaggcaaaggaagagattggcattgaggattttgccaaggtggaactgcgcgttgctcaggtcgttgcctgcgagcctgtgaagaaggccgataaactgttgaagctccaacttgatcttggttatgagcagcggcaggtagtatcagggattgcgaagttttatacgcctgaagatatcattggacgcaaggtgatctgtgtgaccaatcttaagccagtaaaacttcggggagagctgtcgcaaggtatgattttggcagcatcacatggagatcagcttacgctggccaccgtaccggaaggtatgccgaatggtgcaattgtaaagtagtacactatgtaaaaataaaagaacgtaatgagcgtatgtccgggaatcattcttcctgggcatgcgctttttggcttgcatcatattttgctcccgctacacgtatgttttagtaggcagggcttgtttgttcgtgttcacttaagacaggtgggagggtatatgatgacaaatatcaacgccgggttggcgatcgtagccggactggtttcttttttttcaccgtgttgtttaccgctgtatccatcttatttatcgtatatgacagggatgtctgcgcgtgaactggctgaaggaaggcacaaggccgaggttcgttatcgtacgatgggacatacacttgcttttgtattgggcttttcggtcgttttctattcactgggtgcaagtgtggggttgcttggagaatggtttgctaattatggggatacgctaagagtggtagcagggttacttattttactaatgggactggtatctcttggtgtggtgcgtcctttgattctaatgagggagcataagcttcgctggacatggaagcctgccgggtacgccggttcctttgtgatcggaattgggtttgcggcaggctggtcgccctgtatcggtcccatgctaacagctattatcgctttggcggcagtagagcatcacatttggttcaagctgattacaggctatgcgcttggctttgcgattccattttttgtattagctttgctggcaggctctgttcgactatcctctcgctatacctccatcctaatcaaaacaggtggcatactacttgttatcactggcattttactggtaacagatcatatgactgatgtaacgctatttttacaacggattaccccagattggatgctagttatgtgaaatattcaatacgacttaaagggaaatgttcaaaaatgcgctctgtgataaactctcgtagtgcattttgttgttcatcgggataaacatatttgttttgtccccagcggccccattttttcttgcgtttctctatgtccatctccagcttggttttcggataacgtttctcgatgacagctttggatgttttggtgaagcgatgctgaattaattcgaacgtcaaatcttttgtagcatgctcgggtaaggtttctcccaatttgcgcagcaactcgccgtagccttcttcccagccgtcataccagatgatgggtgcaatgatgaaccccagtggataaccggctcgtgcgattttgcccgcggcttcaatacgttcctcgaagcgtgaagttgcaggttcaaactgtttaataacataatcggaattaatgctaaatcggatgcgagtatgaccattatgtttaatatccagcaatggatcaacatgatgatatttagtaacaaaacgcagacgaccaaattcctcatttgccatgaaacgaatcaagtctccaagcgttccggtgatatgctccaaaccaaccggatcggaggtacaagctgcttcaaaacgggtaatttcaggcgcacgctcctcgatataagctttagctgctgataagatatcgtcagtgttgacatatacacgaatatacggttttgctcccaaggttgtttgtaaataacagtagtgacagtgccccatgcaaccagtcgaaatggggatagcgtattcggcagagggcttggattggtcaaaagtcaacgttttacggataccgactaccaaagttttttttgccattcggtacttttcaacttcagtttcacctggtaaattggtaattcggttgtgagaggtagtcatccgatacggaatatccttggctttaacccaatccataatacgctggcccttgggataattcagtgcgtctggctcaaaatacactaggtcaggcaaaaatggcttggttcctctggtttggacaggagtacgctcaagcgtagacatggctaacgctcctttcaaaataaatccacactgctctggtgtccaactttaacattttgcccgcagaaataaaccgatacaggacaacgatattagtgtgcccggcttaaattgaacaaatcgtggcaatagctgtgagtgaagggatgagacttgccaatcggcaatgataacatgtatcattacatagtaggtttaacgcaggaaatgaaggcggtaagcgcccgttcaataacagaaaagagggaaacaagtgccaacgccaagcatggaagattatttggaacgcatttaccaactgattgatgagaagggctatgctcgtgtctcggatatcgcagaggggttagaggtgcatccttcgtctgtcaccaaaatgattcagaagttggataaggacgattatcttgtatatgagaagtatcgcggactgattttgacaccgaaagggaaaaaggtcggcaaacggttggttgatcgccatcagttattagagcaatttctggatatgattggggttgacaaggacctgatatataaagatgtggaaggtattgagcatcatctcagctgggattctattacccgtatcgaaacattggtcgaatattttcgccgggatgaagatcgcttgcgccagcttcatgatatacacaaggaattgagtggagattcctaaaaagcatctgtccttacggacgatgcttttttatttgtcccgaccgcaacaaatatccggttattagcgtctatccattatatagcaggacaagataggggttaaaattaacagggttagcggaggattgtaataatatgaatcgaaagaaaatagtggcgttggctgcaggtctactcttagcagtgcagactgccatcgttcctggagttcaagcagctccaactggtgatattgaaattatattggacggacagtccctgcaaagtgacgcgtcaccttatattgtacagggagccaatgttacgatggttcctttgcgagtgattagtgagggattgggcgctcaggtcaactggtcggaatcgtccggtacggtaacgattacagcacagaacaaaaatatatctatggagaacggtgcacaaagcgctacagtgaatggcaagtcagttcgactggatgcctctgcccgtatgacaagcgggagagtcatggtgccactgcgttttgttggggaagagttgggattaaaagtggattggcaagcttcaaagcgagtcattacgttaagcagtggtaaggaaggtgtctctactggcgggaacacttctgcgggaagcagcggctccatatcagatacgtctgcatctggcaatcagggcagtgtaagtacagatcagggagctatcgatgatgagcaggcggttgtcacttcaccgtcaacgtctactagtgagaacggttcaagttcttcacaggcaactgttgttcaggtaaaggcttcaacttccatgcgtggagcatggatttctaccattaatggagattggccttcttccgctgcccgaagcagctccgagaagcaaaagcaggagtttactaaaatgctcgatgatttgcaggggatgggcatcaatgcggtatttgttcaggttcgtgccagcggtgatgcgctctatccgtcgagtctcgtaccatggagcaagtatttgaccaacacccaaggtaaaaatccaggctatgatcccttgaaatttatgattagcgaatcgcataagcgagggatggaatttcatgcttggtttaatccattccgtgcgaattctacaggaacaaccagcggtttggctgcaaaccatgtggctaatcaacacccggactggattgttaagaatggtagccaattatacatcaatccaggaattccggctgcacgtcagcatgttattgcggcgattatggaggtcgtgaacggatatgatattgacggcgtgcatttggacgattatttttatccttacagcgggacttttgatgatgatgcgaccttcagagcatataatgccaacaaaatctctaacaagggcgactggcggagagataatgtgaacagttttgtccgcgatttgggcaaaagtattcacggcagcaagtctaaagttcaatttggaattagtccttttggggtatggcgtaacaaatctcaggatttaacgggttcagacacgaaggcaggcgttacagcgtacgatacgacgtttgcggatgtaagaacctggattaacaaagaatggattgattatgtagctccacaaatttactggagtatcggtttcccggcggcgggatatgacaagcttgtcgcatggtggtccaatgaggtcaaaaacacagatgttaagctgtatatcggtcattctccgtataagatcggcacccctgaaaagggctggcaaacggctcaagagctaattaagcagcttgaactgaacgaaaattataaacaggtcagaggcgatatttactttagtgcacagcatttgcgtaaaaatccatacggactcattcagcttcttcaaaattattatcaaatgtgatataaattggatcatataggttctatttgggcctccgttctcatacataagcagtagaactgcttactcccaagagaacggaggttttttgatctatgctgatcaatgctgtgttccagggtggaggggttaagggaatttcgctggcgggtgcagttaaggctgcggaggagcatggaattgtattcaatcgtttggcaggtacatcatcaggttctattgtagctgctttattggcggcgggatactctgcggatgaaatgaaagccgtaattgagaaaacccccttggtcaagttgttacgacgttctccagtgttcaatattaagtgggttggaccagcagctcgtatctttcttaaaaaagggctctactcaggggaggcactggagcactgggtacgtgagctgttacgagctaagggagtgcgtacgttcgcggatttacctcctggcaaattgcgcattattgcatcagatattacgaatggacgcattctggtgcttcctgaggatatcaaacgttttggtatcaatccctcttcactggaggtagctaaagccattcggatgagcacaagtatcccttatttttttgatcctgttatgttaaggcttgattctgcacttgccaagggaaagactttttctcagcaatttgtatttgtagttgatggggctttactaagcaatttgcctttgtggctttttgatgagcctgtaaatgaacgtgaggccaaaacgattccaacggtagggtttcaaatggtgggcaaaacgggtacggagaccaaagtttcttatatacggggtccattgaccatgctgcaggctatttttgataccatgctatcagcacacgatgagcgatatattgagcaggagaatcggtatcggacgattaagattccaacattgggtatccgcactgcacaatttaacatttctacagagcaaagtgatttgttgtatgcttccggtgtgcaggcaggggatgcttttttccacaaatggagcattacttcttaccagcagcagtatagcaagtaccaattgatgaaggataccatgtacgctatgaaataaacactaactcgcagttaaagttaatttaaaagggtgtaaaaaggagcctcttcccggtcatatttgaatacgcgggtgatggctcctttgtgctacattttaaaggatgtgattatcattaatgatatttaggttgttcttcttcattttttcccttggaaccctcaatcacatgaaaaggatacgctttgcgcttgcctgtagtttgctgcttacgtgcgttggctgttttggccatggtgcgcacagagggtttgattttgggagtacggctacgttgtcctggaaggtatttgtatagcagaaatataactgcaaaaacaaggacgggaattagtaaacttataagaaagccccagcttcctctccatagcatatccacaattccatatgcacccaaagcaagggtaagccagaaaataacggcatgtctgttcattattcactcatcctttcacaggatcaaggaccggactgttgaaggtctcctttacaggtacattttccaactcagcatccaattcaagcatacgcttaaatgaggcaatagatacctccacttgatcatcagtcggttctttggtggtaagtagttgcaaccacagaccggggtaacctaaataacgaagtaccggaatttcacgaagggcattggttagcttgaggaattcaaaagaaagccccagtacgatcggaagtagtaaaagccgttgccccatacgttcccacagactatcgtaggtaaataaggaatagacaagcaccccgatgatcacagtcagcataataaagctactaccacagcggtaatgtagacgactgtatttctgtacattggccggagttagttcttccccagcttcgaatgcagtaattactttatgctctgcaccatgatattgaaacaatcgtttaattaacggagtttgggaaataccccacaaataagccagtaacagaatcagcttaatagctccttctgcgaggttatgcaaaatttggctgtgaaacaagctaccgaacaggaaattctctacaataaccggaacgagagtcaatacaattttgccaaacaggaatgacaaaataccgaccgccgccacaccgatcatcatactcagactccagcgagattcttcttttttcttttgctcagcgcgttcttccggatctacttcatcatcagcatacgcatcggctgaatagtttaaatgcttggtacctttggcgctggagtcgatgatgcttacaatcccccgcaataaaggtattctgcggaatttggatacccaggattgctccttgcgtggtacttccaaatatgtgatttcgccagttttgcggcgaactgccgtgacattgacacgcttgccgccgaacatgacaccttcaatgactgcctgaccgccgtagctcacaggcttggatgcttgtgacaaccgtctcacctctcttaatacatgcttttttgtatattgtatcgaatttggaagggaatatctagttagatgaaactggtatacccacaggcttataaaaaaagcatttatggagcgtcagactgctcacataaatgctaatcattataaaaccgaatgaatatttggaaacaacctattgcgtaatcgccccgacaacctggtcaaccagcccttttgaagagagagggccgccaaacgtccatgtcgtaccgctcagtgaataggtacgtttttctttaacgaaatttagaccgttccagactgaattatttttcataggtgcgccgaaaacattatcgtccggctgcacaatatagataaagttgctgtcctgaacggcagacagagcttcaatgcctacagttgaaaagccatactgttcaactttgctcggtttccaatcattaatcataccgatcttcgccagtgttgccacgacgactgaattatctgaaaacatacggaggctggccgcattttgcgaagtgaaagcctgtgtcagtatataatgataatccgacttgccagcagcggcgagcttttctttggcttcagcataatgctgatccagttcggcaagcacctgcttagctttgtcttcttttccaagagcgactgcgatgctattaaaaatttctaccattttatcatgatcgtagccgttaccatcgttcagattatattcgatcgtcggagcgatggccttgagttgatcatagatagcttcattcccatcaacattggaaatgatcagatccggcttcaatgcagcaatcgcctccaggttcggctcgttacgcgtaccgacatcgaccacgctgctgcccagagccgcctccggtgtcacatacaccttgtagttggcattgtcagcattaccaaccggctgaacgcccaatgcaatcaaatcctctgtaaatgtccattccagtactacgacacgctgtgcgggcttgtcgagcgtgatctcaccacgattatgctttaccgtcacaggaccggtcgctgtgtcagtcggtttgctacccgacgtgggtgcctgatctttatccgatgctttgtcggctgctccgcaacctgccaaagtgagcgtaaaaaccatcaataataaaatgccaatgagtccctttttcatagagcattctcccgtatatatgtttttggaaaatgataatgattatcattttcatcattatattatgataaaggattgaaattttgtcaatgcaaaaaacgggtccgaacgcttaactggtaagctgctattattctgcattccggttcattgttaaacgatcctccttttgagcatactacctagcaaaatgggaatgcagaatccgatggaagtacatgtatcttcattgcaatagtctttaccatgaaaaaagtttgcatcttgaaaggggattaaacaacatgagtgaaacctactctatacccaagataggccatgaacaggagcagtctcgcgaatctcaggatcaacgtaatcataacgacagtggtggaggcaggcagcagtcaggcaaaatacatacacctctcattccttttgcacttgagttgggtttttttgcgggtttgctctggggattgctgcggtggctgttttataagttgcactttacggtagtagcgcctggctttctcgcagagccttttttcaagcattcgtttatgaacaccatggcggggcacctagtagggctactgttttttattgcattatccgtcgtagcttcactggtgtacactctgttgctgcgcagatttaagggtcctttacccggaattgtatatggcctgatttggtgggttgttttatttgtattaacaggtcctaagttagggatgatgaatcctcctaatcggttaacatggaattccttatatacggaaatttgtgtgtttatgctgtggggactatttatcggatatactgttgctgtcgagtatacggatgaaagaaagcgcgagcctgagaaagctgagggctgaacgtaacaaaaacttctcaagcgcctattccctgtgttaaaatagcatttggttatttgacagaggggagcggaatgaaagatgaagaatgaccgggtgttaaagctgcggcaggcgctgggcgagcataatctgcgggctatgctaattactagccctgtcaatcgtcgatatttgacaggcttcacaggttcggcgggttatgtgctgattacggaatcccatagctatttgctgactgactttcgctatatgacgcaagcgaccgaacaagccgaaggctttacggtggtgcagcacgctgcacaggtcatggaaacggtgaaagaattgctgtcttcccatcagatcagcgaaacaggcttcgagcaagatgcggtaactgttgcgacgcataaagcttatagcgaagatttgtcacctatttcactggttccggtgtcgggcattgtggagaagttaagagtgtacaaggatgcagaagagctggaagtgatgcagcgggcagcggatttggcagatgctacatttgcacacattttaccttacatcaagccaggtgtcagcgagcgtgagctggatctggaaatggaattcttcatgcgcaagcagggagctacatcctcttcatttgacacaattgtggcttccggggttcgttcggcattgcctcatggcgtagccagtgctaagttagtacaagcaggcgagctgattacgtttgattttggtgcgttgctggatggctactgctccgatttgacacgtacagtggctacacaaggggatttggcgccccagttgcgcgaaatctacgatattgtacttaaggcgcagcttcacgcactcgaacatattaagccgggcatgacaggccgtgaagcggatgcactgacccgggatattattgcgagccatggctatggagacaatttcgggcacagtacaggtcatggtctgggtcttgaagtacatgaatctacacgtctgtcgaaggcgagtgatgatattctggagccgggtatggtggtaacggtcgagccaggtatctatgtccctggattgggtggtgtacggatcgaggatgatatcgttattacagatagcggcatcaaagtattaacacattcgagcaaagaatttacagtcgtttaataacgataacagtcctgtaggaggggtattttagtgattaacgttaatgattttaaaacaggtttgaccgtcgaggtagacggagatatttttacggtgctggatttccaacacgtaaaaccgggtaaaggtgcagcattcgtacgctccaagttgaaaaacttgcgtaacggtaacaccgttgaacgtacattccgtgcgggtgaaacgatcggtcgggcacaaatcgaaaatcgtggtgtatcttatctgtacgctagtgcagacgaccatacattcatggataatgaaacatatgatcaattcacattgtccagcgatcaactgaaatgggagcttaacttcctgaaagaaaacatgaatgtaaatatcgtcagctataacggcgaaattctgggtattaacctgcctacaagcgtggaactgaaagtaatcgaaacagagccaggcattaaaggtaatacggctacaggtgctaccaaaaatgccaaactggaaacgggtttgaatgttcaagttcctttgttcattaaccaagatgacgtattgttgattgatacacgtgacggcaaatacatgtctcgcgcataaaatttgcaacttttagatttcctctgtcctttttaagggcaggggatatttttataagcactaatattaaaaaacattggctccacacagcactttcgtattatactgaactaaagttatgccgcaggatgtcacgttcagtcgtttggtgccatctcaaggttacatactgttgagtctgagggagtgaatatcgttgtctttgtatgtcatgaaattcggaggcagttccgtcggtgacacggagcgcatgaagcgcgtggcaaaacgcgttgttgagaaacagagtgaagggcatcaatgtgtagtggttgtttccgcaatgggagacacgacagacgaactgattgaccaggccaaattgttgaatgagcagttgcctgcacgtgagttggatatgttgatgacgacaggtgagcaaatttcaatcgccttattgtcgatggctattcagcagttgggtcatgaagcggtatcgtttacgggatggcaggctggtttccgtactgaatctgactttggtcgagcacggattacggacattcaacctcagcgtgtgctggatgcactgagcagcaacaagatcgttgttgtagctggtttccaagggatgtctgcagagggagacattacgacgctgggacgtggtggctctgatacgacggccgttgcgctggcggcggcgattcaagcggatgcctgcgaaatttacacggatgtggacggtatatattcaacagatccacggatcgtgaaagtggctcgtaagctaaaagaaatttcttatgatgaaatgctggaattagccaatctgggtgcagctgtattgcatcctcgtgcggtagaatatgccaaacataaccgggtaccgctgattgtgcggtccagttttaaccataatgaaggaacggtcgtgaaggaggatgcagtaatggaacaaggcgttgtagtcagtgggattgcatatgataaaaatgtagcaagaatcagtattttgggcgtcgccgatatccccggtgtactggcgagagtattcggaacactggcggcagctaaaattgatgtagacattattgtacagagcggggtcgaagctggtaaagcagatttctcctttacagtagctctgacggatcgtgaagcagcactgaagacgctggaaggtattcgtggagagcttccgtaccgtgaagtaacgtctgaggaaaacctggtgaaggtatccattgtaggtgcaggaatggttagccatccaggtgttgctgcgcaaatgtttgccgtactggcagagcaaggcgttagcattaaaatggtaagcacatctgaaatcaaagtatcgtgtgtaattgaagcgggtaagcttcatgaggttattcaggcgttgcatacagcttataacctggacaccgaggagcaagcgtttgtgggtggaccgcaagaccgtcgttaataactgcaacgtgatctagacatgaatatgtctaatgtgaacgatgctatgacaggtaaaggttgatacattataagtcctctatttatagtttgataaatcatagaatacagcagtaggttaagaggttgttccatcagtgagagttagactgaggggcagcctcttttttgctgaatctatcttttctacccaagggtatcccttagccgacaaggctttgagaggcccttttttatttgtgcgaattagagaatggtgctttaacaagcgggggaaaggtctgttgagcgttgataggagttagcaaaagtttgcctaggctttcaatatattttcggcataaaaagcgagagtcaaccatagacttgtcttaaagaaaaaggacaactgtgagggggcggcatcggtatggaatggctggagttatttcctgaaccgttgcacggtatactcggaaggctttcggaaacggtatttaagcaactggaagaaatccgggttagggaaggaaggccgttggaaattaatgcaaatggtgatcatcattttgtaacgtttgcgggtcggctgactttgaaccatgtagaagcctataagcctgaccgtgaggatgcccaccgactgctggattttatcagcaatcattccctgtataccatggaagaggagcttcgtaaagggtttattacgatccctggcggtcatcgtattggcttggcagggagaaccgtgctcaaccgaggacgagtggaacatttgagggatataagcagctttaatgtaagaattgctcgtgcaattcctggcatagctgatcggatattgccttatgtagcagatcgaatgtccgggaaaatccggcacaccctcattttgtcccctcctcagcatggcaaaacgacactgcttagggacttagctcggcaactcagttacggagggatggaaagcaatggggggcgacggaatggactcaaggtaggcattatagacgaacgctctgagatcgctggcagtcacaaaggtatccccggttttgatgtcgggcctcgcaccgatgtattggacggatgtccgaaagcagaaggcatgatgatgatgatccgctcgatgtcaccggatgtcctcattgttgatgaaatcggacgaccggaagatgcggaggcggtgcgcgaagcgcttcatgcaggcattgcagtcattgcttccgcacatggtcgcgatgtggctgaaatggcgacccggcctgcttttgctggattaactacagggcaagagctgtttcaactctacgtcatgctggagcggacgagccggggcgtctcattccggctggcagatgccaagcaacgcaggattacactgcctggagaagggcagaatgggggcatctcctatgcttaagttgctgggtgccgccttggttatactggccgctacgcttgcaggctggcagcgggcaaggcagtttgcgatgaggccgcggcaaatcagggagttgattcttgcgctgcaaagactgaccaccgaggtttcctacggggtgtctccgctaccagatgctttcgccaagacaggagagcccttgcgagagccgctgcgcactctctttcagcaagcctcacgctggatgcacccctcttttggcctgactgccagagaaagcttgcataaagccattgaagactcgtggagccgttcctctatgaagcaagccgagaaggaagcgatgcggcagcttgcttacagtcttggaaccagcgaccgtgaagaccagatcaagcacattgcgctgaccatccagcagttatcccatgaggaagcgcaggcgcaggcagatcaggtgaggtacgagcgtatgagcaggagcctgggactgctgatcggagcattgatcgtcattttgatctattagcggggtgctcgaatgaatttagaagtgaatgcgattttccagattgccggaattggcattattatcgctatgattcataccgtattaaagcaaatgggcaaagaagacatggcccactgggtaacggtcatcggtttcgtcgtggtcctgttcatggtggtgcgaatgctggataaccttctgcaagagatcaaatctatctttctttttcagtaggtggacacatggaaatcattcaggtggtgggcttcgccctcattgccacagtcctcattttagtcattaaggaacagaagccgatgtttgcctttttgattgcaacagctgcgggaatcgtcatttttttgctgctgattggcaagatcggatctgtggtttctgtactggagcgactggctcggtcttcgggcatggatatgatctattttaaaaccgtattgaaaataatcggtatcgcttatattgctgaatttggagcgcaaatcgttcgggatgcaggtcaagacgggattgcttccaaaattgagcttaccggaaaggtactcattatggtgctcgcaatcccgattatcagcattattattgataccattctgaagctgatgcccgcctgagggggtgatgccatgaaaaggctagggggcatgccgaatctcaaagtaattgcgatgttgttgctatgtctttggtgtgcctcagctgcggtcctctttgcagatacaccgactaacgaatggatcagacagcaggcggagcaaatgcccaaagatgaagtagaacattattgggacgggctcatgcaggaatacggcggatttttccctgatcagaaaacgccttccttcatggacatgctgcttccaggcggtgaaggattcagcataaagggtgtattgagcgctatagctgattttttcatccatgaaatccgagtaaatgccaagttgctcgtcaccatcgtcatgctcagcattatgagtatggtgctggaaacgctgcaaagcgcttttgaaagcaaacaggtcagcaaagtggcctacgctatcgtatacatggtcattatcattctggcgattaatagctttagtgtagcgattggttatgccaaagaagcgattgatagcatgattcacttcatgatggcaatgttgcccttgttgtttaccatgttagcctcgatggggaacgtcgtaacagtttcggtgacccacccgctgattgtatttatgatcaacacagtcggaacagtcattcatacgctggttttcccgctgctgttcttctcggctgtgctgtacttggtcaactcgctgacgggcaaatacaagctgacccagctagccgatctgatgcggaacgctggagtagcagtgctgggagtgctgctgaccatatttctgggagtcatttcggtacaaggcttgacttcgtcagttactgacggattaacgatccgcacagccaaatatattacaggtagctttgttccggtggtcggcaaggcgttggcagatgcgacagatacagtcatttcggcttcgctgctcgttaaaaatgccattggtctggtaggagtcattattattttgttcctgtgcgcctttcccgctctcaagattctgacactggctctcatttataaagtgacagcagcgatcatgcagcctttgggtgatacgcctatcgtggaatgtctggatgcaatcggcaagagcatgatttatgttttcgcggcgctggcggcagtgggattaatgtctttccttgcgattacagtcatgctcgcagcaggcaatatgacggttatgatgaggtgaaccaatgcatgtaaaccaacaaggggggaggggagtgaagtgacctggctgggaggctggcttaaggaactggtgctaatcgtgttgctggcttcttttgtcgatatgatcttaccgagccgatctatggaaaggtatgtcaaactcgttctcagcttgcttattttgctgacgttgctgtctccggtcgtgcgcttactgagtagcagcccctccgaggttctagggcgagcattggatcttcaacgtcaggctgagacaggcaagagggaaccgacattggaggagattttagcaaaaggcagccagttgaagcaacagcaagaacaaagctccatgcaatgggccggcaaagaggtagctaaggaaatgaaaggacagttggaacaatatactgggttagcaattcagtcggtccaggttacccttgcaaagattcaacagaaggaatcggagctggaggcaggaacgggtgtccagtcggtagtggtcaaattggcagagcagcagccagaaaaagaaaagaacaacacagacgtctcgcctggtgcagatgccaagccgataatggtggagcctgtagccgaaaagacagtgaatattcgtgtggaaccgacacatacaaaaaattcagaacttaatgaaggaacgcgagaagaagatcgtaatcctgataaaactgctgaggacggaaagccaacggatacgaaagcttttggcttaattacaggacttctacgtgaaaaatgggggatagacagcaaaaatgttcaggtggtttcttcgcaggatggaacacatgaatggtaacaggaggtgagcagaaatgagcaaatggctgaaaaagctggagcaatggctgggtggaggggcggatggggcgaaaagattcaactcatttcgttggctgcttatacttggccttatcggtgtagcgatcatgctttttaattcattcgttaatgtgaaaaaggttgatccagaaaacgtaggccgtgagccgcctggcgtgatgaaaaatgagcctacgttagagacaacaacaggtgaagaaagttcctttgccgggatcgagaaggtttttgaggacaatatgaaacagatgctggagcagattgttggcgtaggaaccgtcgatgtcatggttacggtagattccaccgaagaagttatcgttcaacgcaatgtaaaggacatgcaggaagagaacaacgagacggacgccaatggcggacaacgacacactactcaatatacacgtgatggcgagattgtcacctatgagtcatcaggtggccagcacaccccgattgtgacaaaaaaagtaaaaccgcaggtgaggggagtgcttgttgtggctatgggggcagaaaaccctacagtgaagcagctaattgtcgatgctgtacagaagggactaaatgtaccttcctacaaaatttcagtcgtaccgcgcaaacaggggtaatttggaatttaagaacaaagaagtttatattttaaaccattaatgaatatggaggacggaacatgaataataaaagacaaaccgtttggctggtgtccatgctgagtttaatggtcgtgctgtctgcgtattatttgtttacggaggactcaagccctgcaaatccaccagtagccgatagcgagcaagtgagcaaggttaagcaggatgctgcacaggaagcaacgacgaaggcagaggaacaattgaacgaactgaaggtaaatgaagtagtgacgaatggagaagtaactgatggagcatcagcaacttccacaaaatcggatacggcttccacaactgacccagcaacagaaaactcaaaaggcgataaagatacggcagctacccctactactgaaccagcgacatccgatcaaaacacaactgcgactaaaacggacgcgacagcacaaagtgacgacaaagcagcctctacagccaaaaccgaccagcaggtactggatcaagtggcaaccgatcaagctgcccaacctacagcagcagctgtgattgacaactatttgctggaacgggacgtggaaaatcagaagaaaaatgatgaactgactaccgcaatgaacgacagcacaccaaagaaagccgcggaggctcaaaaggaattacatgtacttgaagataagcaggctaaaattactggaattgaagaagagcttcagcagcagttcgccaatgcggtcgtccgtgaggaagatgctgataaatacaaagtagtggttctgagtgaaaaattggatgctaagcaagcggtaacaattgttgataaagtcatgaaggaactggacgtaacgcaggataagatcagtgtccagtatgttacacaataagacaaaaaacgcgaaaaagcccggatttctgcattattccgggctctttctatttttaatgattgtgatataatacataaagctgtttcaacaatgtaatcagcaaccggcaaaatgctgaaggagtgattaatagagatgtttaaattaagcgagattaaggaattgatcaagctggtggatgaaacgtctgtgcatgagcttgaaattgaaaatgaaggaactcgcctgttgatccgaaaacctggcaaaagcgagatcgttacggtacaggctcctgtggcaacacctacttatgcagtggcaccacaagctgttattccaaatccacaagtacagtccgatgttggacctgcaactgctggggaaccgagggaatatgcaagcaatctacataaaatcgtatctccgatggtaggcactttctatagttcttcatccccggatacggctccgtatgtaagtattggcagcaaagtgggcgaaaaaacaacggtatgtatcattgaagcgatgaagctgatgaatgagctggaagctgaagtgaagggcgaaattgtggaaattttggccgaaaacggacagttggtcgagtatggccagccattgttccttgtgaaaccggagtaaaaagcttgtttgaaccctcttttgagggttcggcaagactgctcccagggaggtaaagtcatgacatttcaaaaagtattgattgcaaatcgtggagaaattgcggttcgtatcattcgcgcttgccgcgagatgaatatttcgacagttgccgtatattcggaagctgacaaggattcgttacatgtgcgtctcgcagatgaggcttactgtatcggaccgacgctatctaaggacagctaccttaattttacgaacctgatgagcgttgctacattgactgaatgtgatgccattcatccaggttacggatttttggcggaaaacgcagacttcgctgaaatttgcgaatcgtgtaatattacgtttattggtccttctcctgaagccattaacaaaatgggagataaggccgtagccaagcagaccatgaaggatgccggagttccggttattccgggttcagacgggctggttgaggatttgcaggatgcgatcagcatcgcacgtgatatcggatatccggtaattatcaaggccacagcaggtggcggaggtaaaggtattcgtatcgccgaagatgaggataaccttattcagcaaatcactaccgctcagcaggaggcgcaaaaagcatttggcaacgcgggtgtgtacctagaaaaatatttgaccggtatgaaacatgtggaaatacagatcatagcggacaagcatggtaatgttgcccatttgggcgaacgggactgctctgtgcagcgtcgtcgtcagaagttgttggaggaagcaccatgtcctgtaatatcgcaggatgttcgtgaagaaatgggtcaggcagctgttcgtgcagctttggccgttcaatactctggtgcaggtactctcgaatttttgctcggcccggacaataatttctatttcatggaaatgaatacacgtattcaggtagaacatcccgtaacagaaatgattaccggtgtagacctgattaaggaaatgatttctgtcgctgaaggacatccgctttcctttacgcaggaagaagtcaccatcaatggttgggcgatagaatgccgtattaacgctgaggacccggatcgcaattttatgcctgcaccgggtaaaatcggattttatctgcctccaggcggtcctggagtacgggtagacagcgcagcatatccaggttatagcattcctccttattatgactctatgatcgccaagctgattgtgtgggcacctacacggcaagatgcaattgccaaaatgaagcgggctttgtctgagtttgctattgagggcatacccacaacgatttcttttcatcagcgcttgctagagcatccgacctttattagaggcgattttgatattaaatttttggaggaaaacgaagtttaatcggtatatttcctcagtttgtcataatgaacgccaaatgatatagtatggataataagtgagcatgtctgctttgaaatccaaagctggaatgaaacttattttgaccgaaaggtgttgaaggtatgagcacagtgccaaccgaattcgaacgtacagaaattggggagattcaaattgccccagaagttattgaagtcattgccggactggctaccgttgaggtaccaggcgtagcgggaatgagtggcggatttgctggtgggtttgccgaactgctaggccgcaaaaatttatctaaaggtgtaaaagtggaagtcggacagcgtgaagctgctgtagacgtttccgtcattattgagtacggtaaccgtctgcctgaggtggctgctgctattcagcataatgttaagcgttcgattgagaacatgacaggtcttaacgttgttgaagtgaacgtgcaaattcatgatgttcaattcaaaaatgccgaaaaagtagaagagccggaagtgctgggcgccggacgggttaaatagagcgatactttgtacaaacccccgacccttatgggtcgagggtttactctaatttaaggaggctgtgcgtttcgtggctaaagttatggacagacttctgctgttcttgtacagcttaagtatcggaattatttccattctcgccatcctcctcctgagcggggccattccgtatgttttaagtattgaggatgagcgagtggtgtggtttaccagcctgattattgcaggggttctgttgttattgagtcttcgttttttttatatctctattcgacggaaccaaaccgtacagcattctattgatcaacgaacggaatatggtgacattcagatttcagtggacaccattgaaaatctgtgcctcaaagcagcttcccgatttcgcgggatgcaggatttgaaagcacgcgttcgcgtgttggaatcgggacttgatattacgattcgggcggttgtagacggggaaagctccattccggtgttaacctccgaggtacaaaagggggtacacgatcatgtggaagaaattacaggaattcctgtgtccaatgtgtcggtgtacatcgctaatgtttctcagtcacccagctttaagagtcgtgtggaatagaggtgattttccctgatgccctggaaagaaatatggggaagttacaagggccggatcatggggatcacggctggtatttttttcggttttatttatttgtgggcaggcttttggaatatgttgttctttgcattgatggtgttcatcggatatacgctaggaagacgtagcgattcagcgcttggttcatttctcccttggaaggaatggggcgattggttgtcgcagcgttggcgtccttttaaatgaaccctgtgatacgtgttctccaaaatagagctgtagcttctttgcgcccaacgttttggaggatgcgttcacaggtttttttgtggaaattggttagaatgaaaaatagatataggcaagcgtaggaggcagggcatgaaaagacgtctggcgagggaattagcggtacagagtatgtaccatatggaaatgaatgaagtggatgcggcagcagccgtggacatgttgcttcaggaagccgctgaggaaaacgaagcggaagttgtcgttaaagacgcggcagtgttaagagcgtatgttttagagcatgtgcggggtacgtgggagcacaaggaagccattgatgggctgttggtggattatcttaaaggctggcagatcagcagactttcacgtgtagatcgtcaaattttgagacttgcggcatatgagatgattttccgtgaggatgttccagccaaggtagctgttaatgaagcgattgagttgtcgaagcactttggtaccgaggaatccggtaaatttgttaatggtgtactgggacgagtgattcaagaactggagcaattgaaagcacgtttttaagtagagactactgaatcaggttggagagtggttaaacatgtcagcaccgatcattgatggtaaacaaatctctcaggatattcgcgcaagcattcagcaagaggtcattcgtctgaaagagcaccgctttcaaccgggactggctgttgtattagtaggcgaagatcccgcttcgcaggtgtatgttaaaaacaaggaaaaggcgtgccatgatctcggctattactcagaggttcaccggttggcagcagatacttcgcaggaagcattactggaactagtggacaagctgaaccatcaaagtactatccatgggattttggttcaactgccattgccaaagcatattcatgaaaaagctgtcattgacgcgattgcagtggagaaggatgtggatggattccatccggtgaacgtagggaatttggtcatcggtgacgatagtctattgccttgtactcctgctggagtcattgagttaatcaagcgtgctggagtggagattgctggtaaacatgcggtagttattggtcgcagtaatatcgtaggcaagccagtgtctttattgttgcaacgtgaaaatgctacggttacgatgtgccactcccgtacagcgaatatcggggatctaagtcgacaagcggatatcttagtcgttgcgatcggcaaagccaactttattgatgcttcgttcgtgaagcccggagcggttgtgatagatgtggggatgaaccgtctggagaacggaaagctggcgggggacgttgattttgagagcgtgaagcaagtgtctggtccgattacgcctgttcccggcggagtaggcccgatgacgattacgatgctgatgcaaaatacgcttgtagcggccaagcggtcgcacggtttggcataagggcagctgcctatggctgaacaacgtatttactctataaaggacctgaatcgttatatccggatgaaactggaatcggatcaggtgctgtctgatgtatggatacgcggggaaatttctaattttacgcatcattcgagtggtcacatgtactttacgctcaaggatgaggggagccgcatacgttcgattatgtttgcaacccataatcagcggcttcccttcgtaccgaaagaaggtacgcgtgttattgcccggggaaacgtatccgtgtacgaacgagatggacaatatcagttttatgcgactcaaatgcagcctgatggtataggaagcctttatttggcttacgaacagctcaagcaaaagctggatgcagagggactgtttgatactgctcgtaagcgtaatctccctgcccatccggcaaccattggcgtgattacgtcaccgaccggagcggctgtgcgtgatattattacgacacttcaacggcgatacccgcaggctggaatagtgttgtatcctgtgcttgtacaaggaaaaggtgccgcaccctcgatcgtcaaggcaattgaagctatgaatcgtatgcaagaggttcaggtgatgatcgtcggacggggaggtggctcgttggaagaactgtgggcgtttaatgaggaagcggttgcgcgcgccatttacgcatcggtcattccggttatttcggcagttggacacgaaacggattttaccattgccgattttgtggctgacttgcgtgcagcaacgccaaccgcagcagctgagttggctgtgcctaatcaggcagagctacgggatcagctgctccagcgtgagcaacgcctgcgcaacgccctccggcagcggctggaaaccagccgcgaacgcttggcgagacttcagcgttcaccagtcctgctgcacccacgccgctatatgctacagcatgcagagcgaatggacatgctgcatcagcggctaatccgcgcagtgggtaaccgttcacgcttaaacgcagaaaagaatgcacgtatgcgtcaggtactagagcggtttaatccgcgtgaacaaattcgttcggcacgcaagcagacggatatggcgcaacgtcagctggagtctgcgatgcgtgctattacgaaaacgggacggcagcagttgcacacgggaattcgtcagctggatgcgctgagcccactcaaagtcatggcccgaggctatagcttggtatacgatgagcaggagaaacggctgattaagtcgctcaaagacgtacagccgggagattccatcaagattaaagtgagtgatgggcagttggactgccaagtatggggaatgaaggaggacgcgaagcacggtggcgaatgaaacggaattgaattttgaagcggctatggccgctcttgaagaaattgtcggacaactggagcatggagacgttcctctggagcaagccattgatttgttccagcgggggatgaagctgtctcagctttgcagtcaaaagctggagcaggttgaacgtaaaattgaaatgatcgtggaagaggatggagatttgcgcaagaagccttttggcggcggattagatgaaaacggcggtgaagggcttgaatagaccgtcgttcaaggaatatttgaccgggacggcggatgcggtttcgtctgcactgaccgagcagttcccggccgattggaacattcccgatgttcttcgagaatctatgaattattcactcaccgcaggcggaaaacggctgcggcctctgcttgtgatcgctgctgctgaagcattcggtggaagcagggaagctgcgttgccagtggcatgtgcggtagaaatggtacatacgtactctctcattcatgacgacttgcccgccatggatgatgatgattatcggcgaggtaagctgacgaatcataaggtatacggcgaggcggttgccgtccttgcgggtgatgctttgttgacccatgccttttacagcattgtgcaagcaggacgacgtcacggtgtttcatccgattcgctgttgtccattgttgaggatttgtccgaaatgagtggcgcgcggggcatggtaggcggacaggtcgccgatatgtcaggcgagcaaggaatgacggggatcgaggaactggaatatatccatcttcataaaactgctgatttaattattttctcgctcttggcaggtggacggattggtggggcggacaagagtcaattagaggcgcttcgccgctttggacgagacttggggctggcttttcagatacaggacgatatactggacctcataggcgatgagagcaaaatgggtaagaaaacgcaaagtgatgttgagcaggagaaggttacctatccgtatttcattggtatggacgcatctttgcggcaggtggaggaactcaccgcatctgctaaaaaagtgataacagagagcggtattcccgattcttctcgtttgctggagatagcggattacctgatgaagcgtgatcattagttgcgttagagctgttttgacttgtctgcgtttaagcacagttaaaaagtgtgatataatacttgttaactttacacacaaacttgaaggaaagcggggagatatgcgtgctgcttccacacataaagcaaccaggcgatctgaaatcactgtcggttgaggagttggcttctctagccgaggaaatcaggagctttttgattgagaagctgtccgtgactggggggcatctggcatcgaatctgggagtggttgagctcacgatcgccctgcattattgctataacagtccaaaggacaagatgatttatgacgttgggcaccaagcctacgtacacaaaatattgacagggcgaatggaccgttttgatacacttcgtcagcgtgatggactttgtggttttgtaaaaagaagtgagagcgagcatgatgtttgggaagccggtcatagcagcacttctctgtcggcggcaatgggaatggccttggctcgagatttgaagggcgaggacaataaagtcattgcaatgatcggagacggagcgttgactggggggatggccttcgaagcgttgaatcatatcggtcatgagcgcaaaaatttaatggtcattctgaatgacaacgaaatgtccatagcacctaatgtaggggccatgcataattatttgagcaaaatccgctcagaccgtcattatttgcgagcaaaagatgagctggaagttttgctgaaaaaaatacccgcgatcggcggtaaacttgccaaatcggctggccgtgtcaaggacagtcttaaatatatgatggtgcctggtgtactgtttgaggaactgggacttacgtatctcggtccagtggacggacatgatttgtcgaagctaatcgaaaccttccagcaggctgataatgtcactggccctgtattggtgcatgtcgtaacaaccaagggcaagggctataaacctgcggaagcagattcacacaaatggcatggaatcagtccctacaaaattgaatcgggtcaggtactcaaagctgtaggtaatccgatgtatacggaaattttcggtcgaacgttgattgagctggctgagcaggatgagcgcatcgttgcggtcacccccgctatgcctggcggatcaggattggtaccgtttagtaaagagtttcctagccgtatgattgacgtcggcattgctgaacagcatgcagctaccatgtgtgctgcgttggcaatggaagggatgaagccggtgtttgcggtgtattccacttttatgcagcgtgcttatgaccagattgtgcatgatatctgtcgtcataatgcgaacgtaatgttcgcgattgaccgtgcaggttttgttggggctgacggggaaactcatcatggcgtgtttgatgtggcattcttgcgtcatatcccgaatcttgtgcttatgatgccaaaggatgagaacgagctacgccatatgatgaaaacagcgctcgactatgaagatggtccaattgcttatcgttacccgcgtgttaatgtggttggcgtgccgatggataaagaattacaggctattcccatcggcagttgggagctcctgcgtaaaggcgagggctttgctgtaatcgcatcaggaccgatgctccaggtggcgacagaggctgcggaggcgatgaaacgggaaggtttgcaagtgggcgtcgtgaatgcccgtttcctgaagcctttggacgaggatatgttgcgtgagctggctcgtcagcatacgaagctgatcgtattggaagaagcttctgaagcaggaagcttgggtagcgctgtactggaattttacgctaaagccgaaatacaagaggcacaggtgcgcctaatggggattcccgatctgttcgtggagcatggctccatcaaagagcagcgtgctgaagtaggtcttaccattgaagatgtatgcttaaagctgcgtaaatgggctgctgagccagcatatggcatgggacaatccgtatagggtaacttgaagtgaagaccatgacgtttataaaaagtatgacaagagcagcctggctgcctaaagggagattaacatgtctgttccgaaggaacgcattgatgtattacttgtagaacaaggcttttttgaaagccgtgaaaaagctaaagctgcgattatggctgggctagtgctggcggacagcgaacggatcgagaaggcggggatgaaggtaccacgcgccagcgaacttaaagttaagggttcggtgcatccgtatgtaagccgtggaggattgaagctggagaaggccatccgtcaatttgagctggatatgaagggcaggacaatgctggatattggctcgtccactggaggttttacggattgtgcgcttcagcatggagctgaatacgtatacgccattgatgtgggttataaccagctggattggtcccttcgtaatgatgaacgagtatgcgtaatggagaaaacgaatttcagatatatgacacccgcggatttgaatggttccgtgccgaatttcgctagtattgacgtttcctttatttcattacgtattattttgcccccgttgcttgccttgttgcatcaacctgctgatattgtagctctaatcaagccgcaattcgaagctggacgcgaaaaggttggaaaatccggtgtggtccgtgatcctgctacgcataaagaagtgttgcagaccattctgatgtttgcacatgagcttggacttacgctgcaaggtttggcttattcgcctattacaggtggagaaggcaatattgaatttttagcgcattggcgtttggatgggcttcctgctgcagaatcgcagctggagaagatggatttcagaccactgattgaacgtaccgttcaggaagcaggtcagacttttaataatggtccatcgcgtaagtaacattcaggggttctccatgagttctgtgaacttaagggaacctctttttggtgtgagggattgattatagaactcacgttcgcctataatgagatgtacaaaggaaaagggattttacatcttgtcctagaatatgtccatgaggtgatcggtccatggacacaagatatgatacggttatcatcgctgtaatcggggtgatattagggatatgggctttgtatagcctacgtgcctggttgaaggagccagggccgcttgtactaaagacgataccgattaacgaggacttggacgaagggcctgtcacagacctactcgaagaagcaggatatgaagtagtgggcgggaagatgaaaataccgcttgcttttaaagtgaatggacataccgtgtatagccgtttgtttatagactacgtggctgtacgaaacggttcgacatatatggtcaaaacgtcacgccgcaagaaaccaatggagtggagtggtcctgatttaagggacaggctcatgccgtatttattgctctatccgggttgcgcgggtgtattgtacgttgatacggacgagcgaagtattcgccttattacattagtggaagacctcgaagaagaggaatatgaaggttaatccataggaggattatatgaagggtcaacgacatattaaaattagggaaattatttcacaacatgagattgagacgcaggatgatctggttgaagcattgcgtaaggctggttttcaggttactcaggcgaccgtatcacgtgatatcaaggagttgctgctcatcaaggttccaatggacgatggcagatataaatattcgatgccttcagatcaacgttacaatccggcccagaaactgaaacgtacgttggtcgataactttttgcatattgactacacaaccaatctgattgtgatgaaatgcctgccgggaacagccaactcgattgctgctttattggacaatattgaatggtccgagatcatggggacgattagcggggatgataccattttgattatttgccgatcggaagaaaacagcgaagctatcgtgaatcgtcttatgggctacatttcctaattataatggctacgcatattaggcgttttaatttgtacatcatagaggtgaaagaacgatgctggtcactttgtctatacggaatttggcggttgtagaggccgtcgatgttcatttttataaagggtttcatgtgttgagcggggaaacaggtgctggtaaatccattattatcgatgcgcttgggctgattgcaggcggtaggggctctgctgatttagtgcgttacggttgtgataaagcagagatggaagccttatttgaactgccggtaaaacatccagtttggaatacacttgaggaacaagggattaaggctaatgcagaggagcatttgctgattcgtcgcgaacttacggttcaagggaaaagttcttctcgaattaacggccagatggttaatttaacgatgctgcgtgaggtgggtgagcaactcgtcaatatccacgggcaacatgagcatcaaagcctgctacgtgcagatcgccatctggcgctgctggatacgttcggtgattcggtcatcggtccggtcaaaacgctttatcgggagcgttacaatgcttttgtcaaagcggaaaaagaagtaagagaactgcaaagctccagtcaaaaggcttatcagcttttggatatgtaccgatttcaattagaagagatcgctgcggcggagttgaaattgggagaagatgaattattggcagaggaacgggtcaagctatcccatagtgagaaaatgatggatgggatatcaggagcatacgaactgctaagcggcagaggtggactggatacgatcaataacgtgttgtccagattaaacgatgtccaaagctatgacagcaaaagccttcagcccattgcggagcagattcagtctgctttttaccagttggaggacgcagcattccaattacgttcttatcgtgaggatattgaatttaatccaggtaagctgcatgaagtggagcaacgtttgaatcaaattaccggattacagcgaaaatatggtgatagtatagagcagattttggaatactatagccgtatcgagcaggaaaccgatctgctggaaaataaagatgagcggttggagcagctcattgcaaaacgggatgagttgctttccgatttgcttgagatttcggaagagcttacagaagcacgcgaaatttgtgctgaagagcttgcagagcaagtggagcaggagttaaaagatctgcagatggaaagaacgtcactcaaggtgcgcatcgatccgattgaagatccacgcggatatgagtataaaggtctgaaggtaagacctaccaagcagggcattgataatgcggaatttcttatttcccccaatccaggtgagccactacgtccacttggtaagatcgcttcaggcggtgagctatcacgtatcatgttggcgatgaaaagtatttttgcgcgtcatgatcaaattccagtactcatttttgacgaggtggatactggggtgagtggtcgtgcagctcaatccattgccgagaagctatatcgtttatcttccgtttgtcaggtcttttccattactcatttgccacaggtggcatgtatggcagatcatcagtaccttattgagaaaaatgtccatgatggacggaccatgactcaaattgagggacttacggaggacgggcgtgtcaaggaattggcacggatgctgggcggtgtggaaattaccgaaaaaactttgcatcacgcacaggaaatgctgaatttggcggaaggaaagaaagcctgaaaagagcggctggcgtaatgtttaacagttataaaagcctgggggcaaggttaccttataggtacgcaattggcgaccacctttactcgtcaagcgaaagaagcaaagggagcgtgacagccattgaatttttactccaggatcaaattgctcggtcttttgcttgtttttcttatgtgttctatcggtaacgctcagcatgtgcaagctgcgctgcctccacaagcttctttggacttgttcggctctaaaagcatgaggacaacccaagaaagtgtagttcccgatttaaaagtatacccgggggggcagacgattggggtcaaagtaaaatcttcaggagtgcttgtcgtcggtcaccatatcattcaagaaagtaatgatcgtaaggtgtcacctggtgaaacagcggggattcgcttaggggatcggattacacacatgaacggcaaaccactcaatagcctggcaagggttgctgaggcagtagacgaagcaggtaagaataaaaagccgctcgacattacactttgtcgaggagagcagacgatttccacgaagttaacaccagcatatgatcaagatgataaagcgtggcggcttgggttgtacattagagactcggctgcaggtgtaggtacattaacgttttacgcaccggaccaaggtgtatacggggcattgggccacgtaattaccgatatgaatacccaaacccctattgtcgtggggagcggagagattgtgcagtccaatgtgacgtcaattgcgaaaagccaaagtggggaaccaggagaaaaacgcgctcattttctcaaagatcatcgggtattaggaaatattgaacgaaatacgaatttcggaatttttgggaaaatgtcagatgagccgcaatatggattgtattcaactcctattccggtggctcttgcgaatgaagtaaaggaaggaccggcagaaattttgactgtactggaaggtcaacaaattcagcggtttcaggcggaaattgtacacatttctcagcaggacaaaccagcaaccaaaggacttgtgattcgcattgtagatccaaagctgttggataagaccgggggaatcgtgcaaggaatgagcggtagtccgattattcaaaatggtaagcttatcggggctgtgacacatgtatttgtgaatgatcctaaatcaggttacggttgttttatcgaatggatgctgcgcgatgcaggaatcatgcagaataacgtaagcttgaaatcattttctaatcttaaggcgagctagtggccttaagatttttttgtcgaaaagcaggggaataactcatatttgcaagataaagaatcaattataatagaaagtataaaaaaaataaataaaaataattttcgacagaaggaattcataattcgatgtcgaaatcatatactccgacaagaaatatttatatactgtaaacagatatcacaatggaatatcactcaatgaggaggaagtacattgcaaaaaattgaggtattgttggctgatgacaaccgggaatttacgaatttgcttgctgaatatatttccgatcaggaggatatggaagttacaggaatcgcctataacggcgaagaagtgctccaacgcatcgcagaatcccgcaacatacctgatgtacttattttagatattattatgcctcatctggatggtctcggtgtattggagcgtttaagagaaatgaacctgactccacagccgaaaatcattatgctgactgcattcggtcaagaaaatattacacagagggccgtacagctcggggcatcttattatattttgaagccgtttgacatggaagtgctggctaaccgtgttcgccaattagtggggccgcagttagttagcagcagtccggtgaccatttcatccatgcggtccaacgttgtacctatgggtaagacgaaaaacctggatgccagtatcacggccatcatacatgaaattggtgtaccagctcacatcaagggctatcaatatttacgcgaagccattacgatggtgtacaataatatcgaaattttgggagccatcaccaaaacattatatccggcaatcgccgaaaagttcaaaacgacggcatctcgcgtagaacgcgccattcgtcatgctatcgaggtagcatggacccgtggaaatatcgacagcatttcacacctgttcgggtacaccattaatatcagtaagtccaaaccaaccaattcagagttcatagcgatggtagcagataagctgagaattgagaacaaggtgtcctgaaagggtcagaatgattgatgaagcaagggatttttgtggttttacgtttatcaatgataattgcagggatggctattaatttccaaaacagccgacccgatccgataaacttctgaatagtagacaactaataccgcctatttattggttcttccaagaaccagtaaataggcggtattttttataaacgattttgaatttcaattggacaatttaaagttttcttcaattatcatcattttcatgctatcagtggtcgttctattaaggtagaaagttgttaaaatactgaatgatatcggtctgctatcccgtagtatttatccttaattggaaggtggaaagaaaatgaattcaatagagtataaagagttttataataagattggaaaaatcaacggatggaatttcagccatgtgaaatgtatctccgaaggagtaaaatgggacttctacaatgaagtagcgaagacatgcaagaagtcggatatattgcttgacatcggtactggcggcggggaagcgattttatcaatagcagattctgcattacttctagttgggattgaccattccactggaatgattgaaacagcaaccaagaattctgctgaatcagacatagcaaatgttcgttttctccagatggatgctgaaaatataaattttcctgagaatttctttaatgtaatctcttctagacattcgtgtttttatgcaaaagaaatagcaaaggtgttagtaaagggtggtatgttcctgacacagcaagtaagtgaaaacgacaaattaaatattaaagaagcgtttggaagaggacaggcatggggtgctaagaaagactcgttaaaagctcaatatattaccgaattaagtgacgcgggctttaaggacatacagtcatttgaattcaatgcaaccgaatattatcagactcctgcagacttaatatttctcttgaaacacacatcaattattcccaacttcggagaagaagaaattgattttcaaatactccaacaatttattttggacaatcaaaccgaattaggaataaggacaaattcagaacgatttatggtgattgctaggaagtaaaacataaagggatacccgttttttgggtattgggtatcctttttttaagtttgatggaatgagcgaataaagattttcagcatcgtcctcgctaaatggcagaatcattgggaattatgagacataatacccttcacactgtttataaaataaacctgaatcagttgcactaaccatcacgaagaaaaatttcccttttgtaaacagttctgaaattctctttaaatttgatataaacaatgtgtcgtttcttgtcgatatagtatctaatataaagagaactgaggagcgaatatatgaaatttaacattcgaacaaaattgatattgggttttcttgcggtaataatattattgattgtcattagtacaacatctatctcaaaaatgaaaaatttaggcgacacttcgatggcaattgatagccattggatgccaagtgtgaccatcctgggaacactaaatggtgatatatctgatgtagagcggatctcattaaacattattgtagaacgtgacccagaagaaatggagaaggttcaggccgaatatgataagattttaaaaaaggttgaggacgatcgaaaaatatacgaaaaattaattgctacccctaaagaacgtgaaatgtatgaagaattctccaaaaattatacggagtatttggctaagttgccagaaatgattgaagcggggaaagctaatgattacactcaatcaagcatccttcatcaagagtcctataagttatggtatagttcaaacgatatgatcagtcagctcattaaattgaatgcagatggatctaaacagactacgaaagaagctgttgacaactttatttcaggtagacaactggtcatcgttttgagtatagcagccgttatattagcattgatcatggcaatcatcatagcccaaattatttctaaacctatcttgcgaatcagtcgtgctgctgaaagtatcgcatcgggtgatcttacaagtgaagctatcattgtgaagggcaaggatgagatcagtacgttggcacattcctttaatgtcatggttgagaaccttcgtgaactgattcaatctgtgagtaagacgactgagctggtaaccacttcctcagaagaattgacggccagcgcagagcaaaatagccaagcttctgcacaaataaccgaaacggtgcaagaagtagctactggaacaggagaccaggtagatatggtgacgaaatcgtcccaagctattgaggaaatgtctatcggtgttgagcaaatcgccatccgcgcgcaaaatgtattcgcatctgcgcaagatgcggcccataaatcggctgaaggtaaccagatgattcaacaggcagttacgcagatgaatgccgtgaatgattcgatgaatggattggcagatctcatggctggattgggagagcgctcagacgaaattggcaagatcattgatgttatcaccaatatttctagtcagaccaaccttcttgccttgaacgctgcgattgaagcggcccgtgcaggagaacatggtcgcggatttgctgtagttgcaggcgaagttcgcaagttggctgaacaatcggctcattctgctcaacaaattacggagcttgtgggattgattcaaaaggatactacccatgctattgaagcggtagcgtccaacgggaaggatgtcatgacaggtcgtgaagttgtacaaaatgcaggcgcatcctttgaactcattcaggaaaccgtaaataaagtggccagtgaaattgaagaggtttctgccggatcagaacaaatgtctgcaagtactgatgagattgttggttttgtcagacaaatttcagcgattgctgaagaagccgcagcagggacacaacacgtatctgccgcaactcaggaacagctggcatctatggaggaaattgcttcttctgcaagaaatctgtcccaaatggcggaagacctgcaagggcaaattggtaaattcaaagtataattcgtatactgctttttatgtttaagaggaactagctgctctattgtgagcggcttttttctgtttttttttattaatatattgtgattaaagggtggagatatgaggagcctgtaattggaacgatatgatataatagtgggaaattctttgggttggagtgacatgatggataataagactgaacttaaagcaagtgaactacgtcagttagcgatagacaaaattatagctacaccatttttgagtgattttaaatatctgaaaagcagaaaagttttgaaaaaagaaaccaaggaatttatatttgaaattagttttggtgcgactaaatatggtgcattaaaagtttatattatcgtagaatccaaaagaataaaaaagaagtatagtactggcgcttgttttcacagtgagttgattgctctcaccaagaaatatacggaaaacagggattaccttgtgtccacagaagctgaaagagaacgggtgatccaagagatcgttgaagatatctacgctttcgcgttgccctttttcaagcgatttgaacatgtagaaacactagcagaacaagtacataagtcaggctttttaccgcatcgcaaacgctttgataagtttaatccgttgacgaaaagattcattgatttttattatcaaggggagtaatgtagccatctgggccatttttattctcaccattgggcagtagataagcattatgataaggagaacgatcttcatagaggggatattatcgtttttcagaaggatgatgtacaatttgtaaaacgggtcaatgtactcctcagggaaagatgatttacctaatatgctcagttagaggcgagtcggatgttgcacgggagggtacgatttttatatggagacaatcggatgaacagcacagaggctgtatacacgggtatatttcaatgaataaagctataggctaagtcatcgcattgaacgggctagtggtattaacccaattgattctaaagcaaaggcgggaatgagagcatgtggaatagtctgacttgggtgttcttcggcgtgttgttggtggcattgggttggattgttaaagtaaggcgtagttccagcagcaacaaacaattgaatgaacagcggggcagtaatgtcgttgaatttcgtcctcgtaagtccgctcgacaatcccgtaccggtaatgaatctaagtctaaagtgtcttccggtccacgcacgaatgcaaaagcagcaggtattcaggcccaaactgggtttggactgtctgactctatccagggcacaggcaagcaaaaatgctccttttgtaaaaaagaagacaaattaaccttctatgcggatgacaatggatcgctgtatggggtatgcaaagagtgtaagcataaggcggaaagacaggatatgttgccactttagtctatacagacgattgaggaccatcattaaaagaattcttttaattaataaaaactcccaaccgatgtagtaaattggttaggagttttttgtttgtattttacattgttatctaatttgcctgtcaattagttcctcgagtgcatccgctatgtgatctggtccataggagagctcttcccggcttaagctcaaccaggcatggcgctcatccatatcaaatgcagtctcaagccaaccagataaccctctgcccctgcggtctacttctacaagcacatgcacaccctcgggttctaactgcataatcagctctagctcctcgatatcacgtgcatattctgatccgggcgtaaattcaaattcctgtacgtacggaacgccgcgtcccagcttaggatgacgttcgcaggtggaggagcggaatcggaatcccaacaggtgaaccgcctcaaacactgtattcatatagggatgtggctcgattttgagtgaatcacgatcggtcgggtccaaagccatgccaatatctaatgctgtttccagccagacgggctgtttggcgtgagtaacaggagtttccaacggcaatctgaaggaaaaaggaatttcaagctcctgtccttgttctagatgaaagccgtcagataccttaatccgtgcaatgcagcaggtgctgatagtttttttatcatcgtgctccacgatatattcagtcttgagctcaatgtcaattttgccgatttcctgatcaattttgccgcctttgatgcgcatgatgccactaagttcttccccaggcacatatacagcttgatccaccagcgtatcgactttagctgaaccgattcctgcgcttgctaagattttgttaaaaaaactcattattccgtccccccagataatctcatggtcatgatatacaaacgaaaactaaaaacttgtacagcttaaccggatatacggggcaatggttcgattcgttccaaaaaaatgcaagaaaaaagtcactggtactcacgtagcatattgcagcttgtcgatctacctgtccactaatcgcagttcactttatgaggaggtataaagcaatttcgacaacgaggctcataagcctcagagtcgccgatcatcacaataggtcccacagtggaaggtttaccatttaccatacgttgcgtaaatactgcttccgagctaccgcatacagcgcaaaaggaagtcagcttctcgatgtcatccgccatggcgagcagaccaccgacatagccgaactccttgcctcgataatccagattcagcccatcggcaattacatgcttgccgcaataagctagctcttgtacgagcgacataatatgacgactgaaaaactggacttcgtcaaaggcaaccacgtcggcatcttttgtttcttgcaaaatacgctgaacgagctcatctgtaagttttcttgggatagagatagcgggcagccgatatccgatccggcttactatttcgtcctcggcatagcggttatcttcagcgggtttgtaagctatcactttacgatgcccgtattggattagtttttgacagcggcgaatcaattcgccggatttttcactgaacatggggcctgtaataatcgtaattcgtcctgtaggcaaagcgaattcccctctctgtaacatgtacataacactgtaaatcttcttctccgaaagaaaacgccattatagattaccataaccagccgtatacagactagagaaaatatattgattttcgacatgtttttgtatgtccattcctaaaacgtaaatgtggtcgtcattgctctgccgccgcgggcatgatatggtgaagcgtagtggaatgaagggaagagtgaaaggcatggacgaaaaaaatacggattatagtgccaaaaaaggagcattactggagcaagggctgatcagcccgcaagctctagaactcatcacggagctggagacagagctgaactttctgcgcaagcaaaatgaatcatttcgcaaggcgctgcgagccaaatcagcacaaagtccaaggatgtctaccaaattacgagatgcgctgtatgaatgatatggaaagaaatctggattaaagggttagcttttttgtagcctatgcctaaacgctatattttgtacagtgaaataaagagagtacaataagctatatataatcaattgttattggaggagaaacatgactatacattgtgatgtcgctattttgggtggaggaaccggggggtatgtagcagccattcgtgccgcccagctaggcaaagaagtggttatcatcgaaaaggacaagcttggcggaacctgtctgcaccgtggttgcattccgagtaaggccttgctacgcagtgcggaagtatatgccacgattaaagaaagtgcacaatacggtatcgagacatcgggagcacagcttgtatttcccaaggttcaggaacgtaaggaagccgttgtggaacagctgcatcagggcgttcaatttttgatgcgtaaaaataaaattacggtactgagcggtaagggacgcgtgattggtccgtctatattttctccaaaaagcggggcagttgccgtggaactagaagatggtgagatggaaacgattgttcctgcacatctcattattgcaacaggatcacgcccgcgtgtgctgtccggactagagccagatggcgaatttattctgagcagtgacgaagcgttaacgatggaagagctgccagcatccctgattatcgtgggcggtggtgttattggcgtggagtgggcttccatgctaaatgattttggcgtggaggttacggtggttgaagctgcgaatcgacttattcccactgaagacgaagacgtttcgcgtgaaatgcagcgcttgttaaccaaacgtggtgtcaaggtgctgacgggttcacaagtgctggctaaaacatacggcaaagatgaggaaggtgtgcagattgacgtgcaaaaaggggaagaaaccgaaaccctcagcgcttccaaactgctcatttctgtagggcgtcaggcaaatgtggaaaatatcgggctggaaaatacggatatccgcgtagagcgtggctttatctcagttaatgaacatttgcagacgaatgaaccacatatttacgccattggggattgcatcggcggcttacaactggcgcatgcagcgagccatgaaggtttgcaggcggttcatcatctggcgggcgaagattttcacagtgtacctaaccatctgattccgcggtgtatttatacacgtcctgaagccgcaagcgtcggcttaacggagcaagaagcccgcgagcgtggacatcaggtgaagacagggaagttcccttttcaagctatcggaaaatcgctagtatacggcagtcgggacggcttcgtcaaagtagtggccgacgagaagaccaatgatattctcggtgtacatatgatcggtacgcatgtgacggacctgatcagcgaggcggctcttgcgcaactgctggatgctacgccgtgggaagtcggacagcttattcacccgcatccgacattgtcggagattttgggagaagcgatgttggccgttgatggacaggcgattggcatataaacgtttcaaataaatcggtgcttttctttttggggagaaaaggattataatggagttagtcaaagtttagtaccaggttttaagacaagatggtactaggtactggaagtaggatgtttgacacttaaggaggtgcctcaatgagttctaaaggcgctgtagacgctggcttcagacatgaacagctgggacttactcacggacaagttattgatatgtacagatatatgttgcttgcaagaagatttgacgagcgcaacatgctcctacaacgggcagggaaaattaatttccacgtttccggcattggacaagaggcggcacaagtaggtgcagctttcggccttgaccgggaaaaggactattttcttccctattatcgggattatggattcgtgcttgcggtaggaatgacgccgcgcgaactgatgctgtcggcatttgctaaggcagatgatcccaatagcggtggtcgccagatgccaggacattttggtagtaaacggctgcgtattgtgacaggctccagcccagtaacaacacaggttccgcatgcagtaggtgtagctttggctgccaaaatgcagaaaaaggattttgtatcgtttgttacgtttggagaaggctccagcaatcagggagattttcacgaaggctgtaactttgctggtgtacaaaagctgccagtcattattatgtgcgagaacaatcaatatgcgatatcggttccgattcataaacagttggcaggcaaggtaagcgatcgtgctttgggatatggatttccagggattcgagtcgatggtaatgatgcattggcggtatatgcggcggtgaaggaagcacgcgaacgtgctgtccgcggtgaaggtcctacgctgatcgaagccatgatgtaccgactgtctcctcactccacctcggataatgatctggcttaccggaccaaggaggaagtggatgagaactgggccaaggatggcgtagcccgtatgaaaagctacttgatcgaatgcggcatttgggatgaggccaaggatgcggatctgtcggctgagctgctgctcgaagtcaaggaagcgattgaatatgcagataaagcgccttttccaaagcccgaagatacgctgctgcatgtgtatgcagatagcgatggggagggccggtaacgatggcgattatggaatatattgatgcgattcgtcttgccatgaaagaagagatggagcaggatgaaacggtttttgtattaggggaggatgtcggggtgaagggcggcgtctttacaacgacaaaggggcttatggaccaattcggtgagcaacgtgtcatggatacgccattggctgagtcggctattgccggggttgcgattggtgcggccatgtacggaatgaagccaattgccgaaatgcaatattcggacttcatgcttccggcgaccaatcagattattagtgaagctgctaaaatccgctaccgctctaacaacgattggaactgtcctgtggtaatccgcgcgccaatcggtggtgggatctttggcggtttgtatcactctcagtgtccagaatcgatcttttttggtacgccgggtttgaaaattgttgctccatttaccccttatgacgcaaaaggattgctgaaagcagccattcgtgaccctgatccggtgctgttttttgaaaataaaaaatcctacaagctgatcaagggtgaagtgcctgaggatgattatatcgttccgattggcaaggctaatctattacgtgagggtgacgatattacggtcatcggttatagccagcctttgcattttgtcatgcaggctgctgaggaattggagaaggaagagggcattaccgcacatgttgtggatttgcgcacactccaaccgctggaccgcgaagccattgttgaggctgcacgacatacaggtaaggtattaatcgtgcatgaggacaacaaaacgggcggcatcggtgccgaggtatcggctattattaatgaggaatgtctattcgagctggatgcgccgattgagcgtctatgtgctcctgatgtaccagccatgccgatcagtccaccgatggagaagttttatatgttaaacaaggataaagttaaggaagccatgcgccgtcttgcaatgtattaatatagggcagattggacgaaaagcattccaaaagtatagcggggtagcggaaaaacgcgccctcctatgatgttaaggagttgaaaaaatgtcagaccaaacacaatggaacgacgtgaccatgccacaattggcagaatcgctcgtatcggcgacaattgccaaatggctcaaacaacctggtgaaacggtagagcaatttgagccgatttgcgaggttattacagataaagtgaatgcagaaatcccatccacgttggacggcattatgggtgatctgttggcagaggaaggtcagacagtagcggtaggagagttgatttgccgtatccagacgaagtcggctgcacctgcggcggcatcaggggcgacacctgttgcaccagcatctcaaagcaccgtacaaacacaatctcagcagagtgctggatcggatcagtccatgagaggacgtttttccccagcggtgcaaaccctggctgctgaacataatgtggacttaagccaagtaccaggcacgggcatgggggggagaattacccgcaaagacgtactgaattatgtgcagcagggcggttctgctcccactggagtatctggacagccgactgcgacgacatcaggacaaggctctccttttgcaggaagacagcagtctgctactcagcacggtacaccgattcaaaatatggaccctgctattccggttcgtaacagtgggattcatttgacggaggctccaaaagctcctgtgatcgaagttgaaggtggcaacaacaatagatccgagtattttattgatgttacacccattcgcagtgcaattgctcgcaatatgcgacaaagcgtttccgaaattccacatgcttggacgacgattgaggtggatgtgaccaacctggtgatgctccgcaacaagatcaaaaacgaatttaagcaaaaagaaggaattaatattacgtatctggctttccttatgaaagcagtcgtgaatgcaatcaaggaatatccgattatgaattcggtctgggcagtggacaaaattatcgtcaaaagagacatcaatatttcgctagccgtaggtacggaggactccgttcttacccctgttattaaaaaagcggatcagaaaaatattgctggattagctcgtgaaattgacgatttggcacgtaaaacccgggaaggcacgctcaaactggacgacatgcaaggtggaacgttcactgtaaacaacacaggctcctttggttcaattttatcttatccggtgattaattatccgcaggctgccattcttacctttgaatccattgtcaaaagacccgtggttattgatgatatgattgcggtccgctcgatggctaatttgtgcttgtcgctggatcatcgcattttagacggagtgatttgcggacgattcttgcaacgggttaaagaaaatctagaaggctacactttagatacgaagctgtactaatcatccgaacagtgggggaaatgtacggagaggaagtgacaggccgtgaacagacgaccgcttgatgtaacctatacgaataggatggaatatgcccatgcatgggatgtccagaaggagattgtgggaaagctggatgcgggagaggcaagagaaacgcttatgcttctccaacatccgccgacctatacgattggttctcagcggcatcctgaacatctgctcctcacaccagagcaactgaaggagcagggaatcagcgtctttcagattgaccgtgggggagacattacatatcatgggccggggcagcttgtcggatatcctctacttatgctcggcaaccgggaggcgttgaatctgcacggataccttcgaagtctggaagaagtgatcatccggttgttggcatcttatggagttgagggaagccgtaagcctgaatatacgggggtatggatcgggaatcttaaaattgcggccattggcgtcaaattcaacaagtgtaagcaccgtcggggcttcgtaaccagccatggctttgcctttaacatcaaatcagggatacagcatgagggctttgagggtattgtcccgtgcggaattcaggaatacggtgtgacatcattggaggactgcatacagaagcctatatcggtggagcagattgcgaaggaaattgtaccgtactttgaacagcaattttcatttgttgcgcaatggcaaacgcattctttccaataaagtaaggcgggctattgtgtatctacacgtaagcccgcctgtttgctttacgtaacagctcgtccactcgaggcctcaatagtgccttagagcagccggataccttgagcgataatttattatagtggcataataaacggctcaattaccatgaacagcgtagaaccaatcatagctgcgagcataatgtagacgaaaaaacgaacccattttttgttcgacatgtgtaactcctttaggataggtttaagtcatagataagaacatctatccgtattgtagcgtaatcgggaaagagaggaaagtttaatgacagtaaaagtagtaaaagaccgaatcgtacaggaatttatggaactcgtacaggtggatagcgaaacgaaaaatgagcaggaaatatcacgtgttctaaaagaaaagtttaatgcactcgggctggaagtaatggaagacgattctcgtgaaagaactggacatggctcaggcaatctgatcgtcacctggaaagcggaaggtgtagagcaagcacccaaattgttttttacctgccacatggataccgttactccgggtaaaggcattaagccacagttgggtgaggatggctggattcgtagtgacggttcaacgattctggggtctgacgacaaggcgggaattgctgctttgttcgaggcgattcgtgtcgtgcgcgagcagaatattccccatggtcaaatccaattcgtgattacggctggcgaggaatctggattaatgggtgcacgggcgatgaagccggaagtgctagattctgatttcggatatgctttggattcaaatggtgaggtcggctctatttgtatagctgccccaacgcaggcacgtattgaaatgaagataactgggaagtccgctcatgcgggggtaaatcccgaagatggcattagtgccattcaggtcgcttctaaagcaatttctaaaatgaaactaggacggattgataaggaaacgaccgctaacatcggcagtttcgagggcggcggcgcgacaaatgtggtatgcgattttgtattgatccgtgcagaggctcgtagtattgtgcaagaaaaggttaatcatcaaatccagcatatgcgtgaagcgctggaaaccaccacacgtgaatttggtgcacagggagagttccgcagtgaagtcatctatccagcattcagttttacggagcatgatgaagttgtacaggttgctcagcgtgccattcaaggactgggactggcaacgccaaccttccattccggtggtggctcagatgctaatgtattcaacgggcttggaattcctacggtgaatttggctgtgggctaccagaacatccatacaacagaggaaaagattaaggccgatgacctggtgaaggttgctgaagttgtcgtagctctgattcaagaaaccacaaaataaatttgtattatacacttgcaacatactgaaaaaaggttcaggttaaagacaggaacagcgttccttcgtctttagacctgaaccttttttggaacagctagcgaagcgatggtggctgtaggtccatgttccttttgccattgacgcaagagtgcttgaatctgccaggctttaccaacgatatggagggtgctttcagtacggtagcttttcatttctgcatctcctcaggacaggaagtttgttattctaccaccagcatatgtacaaagtggacaagttagactaactttggtgataattaataaagaaagatagatatgaaggaggaaacttaccgatgaacgagcaaacgaacggacaattgaacaatccaacaaacgatgcacatcgcaagccttattccaatcctgcgctggaggaaaagaccgtgtccacacagcctatctttgagggaaaggtcattacattacaggtagacacggtagagcttcccgacggctccactggcaagcgagagatcgtaaagcatccaggtgcggtggctgttttggctctacatgaagggaaaatgctggtcgtggaccagtacagacaggcgatggggcgctgtgaggtagaaattcctgcaggtaagctagagcggggtgaagacccgatggaagcagcggggcgtgagctgagagaagagacaggttatactgctaagtcgttgaagctgctgcactccttttatacctctcctggctttgcggatgaaatcattcatctgtatgtggccgaagaactggagttaggtgagatggaaccggatgaggatgaatttctggagctgtttgaggtgacgctggaagaagcacagacgctcattcatgaaggacggataagtgatgctaaaacgattctggccgtctatgcatggcaactccgccaacttacagggagcttctaagcgtatggatgaaaatatagtagaacttaacgactactttgcagacttgcatattcatattggcagaacagagaagggaaatccggtcaaaattagtggcagtcgcgatctgacctttgccaacatagctaaggaagcctccggtcgcaaaggaattgggctgatcggtatcattgactgccatgcacctaatgtacaggaggatattcatacctatttacatacgggtgaaatgaaggaaatcagcggcggaggtatcgcataccgggatacggtcattctccttggcacggagctggaaatacgtgctgaaggtcgtcctgagacgcacgtactggcctattttccagatctggtggcgatggaggattttacccaatggctggcccggcatatgaaaaatgttaatctcagctcacaacgaatctatgcaccgccacgcgagttgcagcagcaaatttacggacgtggaggcattatggtgcctgcgcacgtctttactcctcataagggcatatacggcagttcagcggctcgtatggaggaactgctggatatggagctcattagtggggtggagctggggctgagcgcagattcatctatggccggtttgatttcggaactggatcgcttcagctttctcacgaattcagatgcccattcacttgggaaaatcggacgagaatacaataaattatcactggcaaagccgtgttttgatgaattcagaatggctttggagcggcgggaaggacgacgggtgcgtgccaattacggattaaatccgaaactgggcaaataccatcgttcttactgtcaaagctgcggtacgattattgacgagcaacagatggcggatgaacgttgtcctgactgtggtcataccaagcttgtgcgaggtgtgttggatcgaatatggagcattgccgaccgtgagcaacccatgattccgccccatcgtccgccgtacatttaccagattccactggagtttattccaggtctgggcaaagccaagctgaaccagctattggctgcatttggaacagaaatgaatattttacatgaggttacacaggaggagttagcagcagtcgtgggtaaagtgttggcagagcaaattgtgctttcacgcgaggggcgactgtcgcttgtatccggtggtggtggaacatacggcaaaatagctaagtcctagtaaagtcttgtccctctaaaggcatatcagcgtctgcttgttcataaccataaattatcttgccgctggcttggcacatcattcgtgatgtttgatctgcagcgaaagctgccccatttctagccatcagccatcggattacggttgttttttggacaaacaagcagatgaaaggggcaggacgccgatgcaatggtttcgtcatacgttaaaggatcagacgccgtattatgttttcttggctgtgctgtttctggtgggagtcgtctttggcgcacttatggtaaacgcactctcgctggagcagttacaggatttgtcccgttacctgaaggatttttttgtaacggtcaatcaaaacgaacagggcttcgctgattcgcaggcggcctcgaccttttgggatagcgtatctttacatctgaaatgggtcggcctaatttgggtgtgtggcctttcggttattggtctaccgggcattcttgtattgaatttcctcaagggtgtgctaatcggattttcagtaggttatatggtggggcaatattcgtggaaaggactgctattttctttggtttcagttgctccccataacctgctcgtgattccggtactgctcgtctgcagcgtggctgcgatgactttttccatccatatgatcaaaaccaaaatactcgctacccggccgtcagacggaatgctgcgtccgttgctgtcttacgcaggattgactgctgtgatgatggtgcttcttattggtagcgcgtcctttgaaacttggatcaccccggttatgatgcaatgggtcactcctatgctgacagcttccgtgtcatcttgatccgtttcaaaatgtttgactttatttgtatagaccccctataataataggagtgaaaaaagtgcagtaggcagtagctttgcagggggagggagacacatggaagcacggatcgaaaaaattaagcagcaactgcaatcccagggctacaaactaacgcctcagcgggaagccaccgtcagagttttacttgagaacgaagatgatcatctgagtgcggaagatgtatttatgctcgtcaaagagaaagctcccgaaatcggtctggcaaccgtataccgtaccctagaactgctaagtgaactgcatgtcgtggagaaaattaattttggtgatggcgttgcgcgttacgatttgcgcggcgatacaaccaaacatcaccatcaccatttgatatgtgtgcagtgtggcagtgtagatgaaatactggaagattggcttggaccattggaggagcgcctggaacgggaatataattttaccgtagtggatcatcgtttggacttccacggtatttgttatcgttgtaaggcgaagaacgatacgactgctcagaaatctttgggcaaatccaaaaaaaacaaatctcaggactaaaagctgactacccaagctctcaccgacgaagatgcgttcgggagagcttttttggttcgggatctgttgttcgggattaagcggtataaaaaggaatagcttgtcatacccttccatagagagtcctaattagggccatattctggggaaaaggcggctgatccacatggtactatcgttgcggagaggactaaaatggctgcgtttggtaatcttgttcggggtactagcatgtatgttcttttttagcctcaggctgtttacagattggataacacctgtagatcattaccgaataccggaaggacatgcagttaaggtatttggcggacaaaaagtaaatgaagggtccgagcatcgaatagcagtgttggaacgtttacgtttcttttactggtatggtgaatagtctaagtaatcggtcttgatgagcttatgaaatgaaggcagcacacgaagaagcagacgctgagactgaaccgctgtatgcagaacaaggagacttttggaactcatgaaaatgtacattcaacctttcgctcaatatatggaagaggaaaagggtttgtcgcgcagcactttggaagcgtatcaacgagacgtacagcagtttgtcgagttcgcagaaagctgtggtattgagcagccggataatgtccaacggtcacatctggtactgtatttgggccatttgaaggaacagggaaaagctgcggcgacgatatcacgtagcgtcgcctccattcgctccttttttcattttcttatccgggagggaattacgatccatgatccgtccgttctgctggagttgcctaaagcgactaaaaagaagccctcggtgctaacgcaggatgaggtagagcgtttgctggccgcgccagatgtgactgccccgcaaggggtgcgagacaaggcgatgctggagttgttatatgcgacgggcattcgcgtatcggagctgattgcccttaacgtgtgtgatgtgcgcaccgatctgcgctttgtgcactgtggcggcgaggcaggcaaagagcgtgttgtaccgatcagccgtgaggcatcacagtgggcacaagcctacatggacgagcagcgtctattattgctgagatccgggcagggtgaagaagctcaggtagagcaggaagccatgttcctgaacgtatctggacagcgtctcagtagacagggcttctggaaaatgattaagaagtacggccaggaagcaggcataagcgaggatatcacgccccacacgctgcggcattcctttgcggtacatatgctggaaggcggagcggacttacgctctgtacaggaaatgctgggtcatgctgatctgtcaacgacgcaggtatatgcgcagacggcaagacggaatatgaaggaagtatatgaaaagcatcacccgcacggcggcaaccgcacttctcatgagaggaaagatcgaacgtaacgatactttactttcatagaaaatgtgataatgactataactttacgattgtacaagtcaggagagatactaatgtcaacagccaaccaagctacaattcaggaagcagcagaatatatccgtgccaaaagcggaatacgtccagagattggtcttattctgggatcgggtctcggtattctggccgatttaattcaggatggaattagtattccttatcaggatattccccattttcctgtatcgacggtagaaggtcatgagggagaattgctgttaggcacgattgaaggtcgcgctgtcgtcatgatgaaagggcgcttccatatgtatgagggctatggcccgcaactgacggctttcccagttagggtgatgaagcaattggggattcaaagtctgctggtgacgaatgcagcgggtggtgtaaatacttcctacgaagcaggcgatctgatggtcatctcggatcatcttaatctgacaggacaaaatccgctgatcggaccgaacgatgccggtctgggcgttcgttttccagacatgtcggaggcgtacagccgccgcttgcgtgaaattgccaagcaaacggctaaccaacagggcttcagcctgcaagaaggtgtatatgctggattgctgggccctaactatgaaacgcctgctgaaatcgttatgctgcgtacactgggcgcagatgcggtgggtatgtcgaccgtatctgaggttattgtagcccgtcatgcaggtattgaggtactgggcttctcctgtatcacgaatatggccgcaggcattctggatcaacctttgtcccatggtgaagtgatggagacggcagagaaggtacgtgagcaatttttaaaacttgtgctagcgattattccacaaatgtagattggggatcatgttcaagcgaagcggtggacatatatcccaagaaccccgtatccgaacgccttttgttggcgtgggtacggggttctttttcacatacagcggttgagctgagtatgatctcctaatgaagaggctgtgtgctcaatgcagttgaattcgctttttctgctacagccagtttatgttgttcttgcaccttgatcacaataaccataaaaataatccagtaaatagatagcgagttcaggaaacggctgtccgttatattgttcaatacgataaaaaggaaaaaaaccgctgccgtcagccatgtatacatatctgctttaccaattctgaatttaaataaagtggttatggcgagtgtaatggttgccagtagtcctgtaaggcccacatcgatccacagatctcggaaaccgctatggctgcttgtcagatcaaatcgaattccattcgcatagatactgggccgggctgcccagtaggagccgtaaccatgtccgaaccagtaatggctctgaatagcaccaccaatcccctgccagatttccgttcttccagttaaggtcgttgtttttccaaattcggacgcaatcgcatctccataagtaaagatgaataccaaacccaaaagaacgagcaagcaggaagagctaatgaagaaaccgcgcaatgcaatgcttcggattctcttgaatagcaatataaacaatataaatacgaagagcgaagatgtcagtaccaaagaggtggtagattggcacttgatgagcaataaggcattgagtaagatgaagccaatatgcaaaactttatgtttacccctgaaaaagtaaataacatgtgaaacaaaacttaacagagagagagttccaagtgtatttttatgaccagagatgcccttccatagcccagtatgttctacgccaccatgaatagcaaaggagggaacgagcaaaacggcgagtagattgagtatgctcaaaatacttaacgtaacgactaagaggcgaatgcagccctgtgttgtataatgggtgaccaaatagagcccgaaggtagagaaggtaagaaatttgagaaccatcagcaaggaagaggtctgctcttgttcagcccataaacaggaggcagcgatgtacagcatgagtaaagtcagcaacggattgtcgactaaggttgcgatcaatgacttgagtgaaggtagtagcatggtatagctgaacaacagaataagcagggaaatcgtgataactctgggggacaaaccctgacaagcataaggaatcgaaaaagccagtaaaccagctacggtaagtacatgtttcacgatttcaccacctagatacattatgtatctataatatacaaaacgtatcttcttgtacaataataataaaatatttattttcatttttctcaagcctagagcaagccctattgtgcatatactcagtccatgctaagaaaatgaagaattcttcggcttggttaaaaaggaactttttacgtttttaaacatgggggtgttcgggtggcgaatcattttacagaccgtttgaagttgaatttgagtggtacaggcaaagacttaacgccgcagcaattaaatgaaaattttaaaaccattgaaaaagaattcattgaacgcagtgcaaacgtaagttggtttggagctgctggtgatggtattcaggatgacacggcagctttgcaggagttgattaataagacccccgattattccattcttcacatccccagtggacgatacaaaataacctctaccctacagattcgcaagcagggtgtgcgcatttttggcattcataagggcagataccgacaaggcaaaggtgttacgtcgattgaattttatggtacgggtccttgttttcaaattggagatgaaagtctaccatcgtttagcggatttcaaaatgtgcagtttcatgacttatcgatccggtacgagggggctgagagatccacattaaataatccgttttcgcagtcagtgaatcgtggatattatggcaaaggtactttaggtattcaggattggaagggcggtggagttgccctagataacgtcctaattgagcattttgaaacggctttttggggctacgaaagtgatgtgaatttatttaaatgcacggagattaattacaataaaacagggattcacttgcagaatagaagttcacagtttactagcatagcgctttttacattggggaacgatacggcattggatctgaacagctccaacggagccagatttttggctagccagcacattaaggatggaagttccaatgatattcccattctaattaatgattttatgaacgctgaatttataggttgctggtttgagggactaagcagagagcataagatgacagtgccttcttttattcagattggtgctaccaaagaaacgaaaaatgtggccttgcgtgactccattttagcgatagcggacaaattcgatgacacccaatccgtatgtaactattttgtggatgtggtcattggcaaaaaagttttggtggacgaggtgggagggtatccccgtaatctaaagcagcttatttctttctctggtagctcttccacacagcaggtgacacttcgctcacatttggattttagctatagcaataatcgttatgacgagaacaatgggacagggcaggctttgctgctggttgagaaatactcgaacaacgggattgaacatttggacgaaacctttgttaaagcctacttgggagcaaggcaaaatctccccgcaggtagctggcagaaggtaaagttcaatcaaatcaaccatgatgagctgatcgaattcgacgcggcgaatagccgatggcgagccaagcgagctgggaaatacagaatacaagtttacatttcgaccgaccctcaagtggatggtaatcgcacacggctggcacttcacctgaatgatgagcagcttgccgggagctccgcctatgcctatctcgatgatagggttatcggcggactgaactatagtgcattgagtggagcaatggaacttagactggaagcgaattcttttattgatatacgggtgtttagtcaaaatacaatggatattttaccgggtggcggtatcacatatctcaccgtaagccgaatttaaaccattatttcacagacgatagatgttctgtcgttttatatattggaaaatgtgcaccatgctcactcagcttggtgctatttgatgtttttatccatatggaatatttttctttcattctgacgacaatggttagcagcacgcgaataggccggagggttaagtaaatgggctccggtgctttacgccaatatgttgaggagggaaccgattgtgaagaaaaaagtggtggcgttcatcctggcttgcctggtagccttgactgccgtccctgtcggcggttgggccgaagaaagcatacctgaaagcaaaaccaaagagggatcagcggctgagctagctccccaggctctctcggcgatcctgatggatgcagatacgggcacagtcatctatgaaaaaaacagtcgtgaaaagcttcctccagcgagcatcaccaagattatgacgatgttgctgaccatggaggccattcaggatggcaagcttaagctgaccgataaagttcgtgccagcgaatatgcatcttcaatggggggctcgcaaattttcttggagccgggagaagaaatgacggtcgatgagatgctgaagggaatcgcgatggcttccggcaacgacgcttctgtggcgatggctgagaaaattgcagggtctgagcaggcttttgtcgacatgatgaacgccaaggtgcagcagctcgggctcaaggatacccattttgccaattgcaacggtttgcctgtcgagaatcactattcttctgcgcatgatattgcggttatgagccgggagttgttgaaatacccgcaaattacgaaatatacgggagcctatcaggactatttgcgcaaatcctcggtaaaacccttttggctggtaaatacgaataagcttgtccgtttctatactggagcagacgggctgaaaacaggctatacgggagaagcaaagttctgtctttccgctactgcgaagcgtgatggcttgcgtgtcgtagctgtcgtgcttggggagccgaatacgaagatacgcaacaatgaagtatcttccatgttcgactatgcgttctctcaatatacaatgaaatccatatacaagccgggtgaattgctgggtagtgtaaaagttgaaaaaggcgtattgccagagctgaaaattcaggctgatcgttcttacagcgtgctggtgaaaaaaggtggcaataaacaaacgttgcgtcatgaattacaactggccccaagcctcaaagctcctgtccgggctggtgacccagtcggtaagctggtcgtctatcaggatggacaacgtcttaaggagtttaatatcacttcgcctgtggctatcgaaaaggccggatggtggaaattgtttaaacgtaccatgtcgaacctattttctttgtagattttacggggttttcttctagttttgtcggagggcaggaatcgtctgcggctacgtagaaatccttgtccaagaccgggaggagagtgagtaagcatgaacctgcaaattgaaatggagcatcaccggggggtactgattgtaaggttgtctggtgagcttgatcaccatacgtcggacatggtccgtatgcaaatggatgaggcgattcagcgtcggcaatgcgagcatattgtgctcagcctgaagaatcttcagtttatggatagctccggccttggcgttattttgggacggtacaaactgatcaagcaaaagggcgggaaaatggcagtctgtgatgtcaatccgccagtacaccgactgctggatatgtccgggctgttcaaaatcatgcccatatatgacaacgagggaaatgcgctcacggaactggaggtagtgtcatgagagaaggcacgggtaacaatttcatgagcttgcagtttgctgccaaatcggagaatgaggcatttgctcgtgtggctgtcgcggcatttatttccaggcttgatcccacaatggatgagctaagcgatttgaaaaccgtggtgtctgaagcggtgacaaacagcattattcacggttatgacagcgacccgtcaggtgtcgtaacgatcaaagtcaggattgaagcggacgtgattacgttggttgttgaggacgcaggccgaggaattgaggatctggaacttgccaagcaacctctatatacgtccaaacctgaattggaacgctccggcatgggctttacgattatggaaaatttcatggatgagtttgaagcagtcagtgagccgggcggaggcacgtcggtccggatgaagaaaaggattgaatccaagaaagctttatacaattaggagttgatcctatggaagcaggaggaaaaaaaacttcgcacagctatttggaggatgcggaagtcaagcggcttattgcactgagtcaatccggtgataatgaggctcgtgagacactggtcaatagtaatatccggctcgtctggtctgtcgtgcagcgctttatgaaccgggggtatgaacctgacgatctttttcaaattggttgcatcggcttgttaaaatcggtggataaattcgatctcagctacgaagtcaaattttcaacatatgcagtaccgatgattatcggtgagattcaacggttcctgcgtgatgacggtacactcaaagttagccgttccttgaaggaaacggccaataaggtccgaaaaatgaaagacgagctatccaaacggctcaaccgtctgcctacagttaaggaagttgctgatgagctgggagtgacaccggaggatgttgtttttgcgcaggaggccaataagccgcctacctccattcacgaaacggtgttcgaaaatgacggtgatccgattacacttatggatcagattgctgacgaatcacaggaaaggtggttcgacaagctagcactcaatgaagccattggcggactatctgagcgggaacggttgattgtgtacctgcgctattaccgggatcagactcaatcagaggttgcaagtcggcttggtatttctcaggtacaggtatcacggctggaaaaaaagattttacaactgatccgcgatcagattgcccaataataacagtcaggatcttagtgaaatccttatgcttacgtatttaaaaagggtattccaaagccattttaatggccaggggtactcttttttgcgtgggataaaagacaatacacagaataggtttcctcgcttcgttccatactaatcgataattacgaggataaggaggggatcggatgactcatagtccggctcctacagtagctcctattgtctacttgcggctccgcagccgtgtccgcatgatacaagggcaggatttacatttgggtgatgtagcccatctgctgactaatcctgaatgggaaaaggatctgcttgagcttgttctcaagcgcccgcagcaccaggacggtaatctgatactgatagacatgctgcagatcatagcaaaaattagagatcatattccgggggtcatagttgaatctctcgggaagccgcatgtacttgtggaactcgtggagaaaccccgtaagccgtccaaaatactgtttgttttggtatgggtgcttctgttttttggctctgcgctgacaattatgaattttcatgccgacgttagcatgatggaggtacaggttcggattgtagagatgattacgggacataaggatgagcatccgtacctgtttcaaattgcttattcgatcggcatcggctttggcatgatcgttttttttaatcacttgttcaagaaaaattggaacgaggagccaacgccgctggaggtggaaatgtatctgtaccaggaaaatgtggatcagtatgttgtggcagaggagtatgaaaagatggcccgtttgcacacaaaggataagaaaccatgatatttgtacaggctgcacttcagattatcttaggtattgctgggggccttgcggtgggtagcggtgtaattgctttttttattgtgctcgatatcatgccgcgattagcacaactcacccgtacgtataaaaaatcacgtgcatacgaaaaggcaatgattataggttcagtgctggggactgtggtcgatttttggaacatctgcttgccactaccgggcatatttacatggatacctgggttattttgcggagtgtttattggtttgctcgccgcggctttaacggaggtattgaatctcctgcctatactcgccaagcgactccacatgaccgtgtatatgttcggcctattaatggcaatggtgcttggcaaggtgacgggttccttatttgactggtttgtatacaaccgttaacaacgaaagcgaagggggcaaggaatatggatcgcagagcggatcaagagcatcaggagcaacatcaagaagacaggggaatcggaaaggaatatcatactgacggagaagagttgagtccatggaaggaaaagcaggcgcaggaatctgcgcgttttaaacacaaaaaagagagtgagcggtctgataacgtagaggagtccgttcgctactggcaggccgaagatgatatatcgccgagaatgaaggataataagaatacacttgaaacagtattaggcttgggggagacctttgatgttgtattcagggaaatgacactgggtgggcgtcataccggatatctgttcctaaatacctttgcgaaagatcagatcatgcttgaagtgctaaagcgtctcacctatctgacgccggataatctctcttcggatggactacaagcgtatttcgaaaattttattccacatattcaggtggagaagacagataagatgtctgtcgtcattaacaaggtgctgacagggatgagtgcctttttcatggaaggcgaacgtttttcccttattctggatactcgtaattatccggtgcgtagtccggaggaaccttctttggagcgggttgtgcgcggtgcccgcgacgggtttactgaaacaatgcttacaaatgtaagtctggtgcgccgacgtttgcgggacccaggacttaaatttgaggctatgcaggtcggacgccgaacccgaacagacgtatgtttgggctacattgacgatattgtggataaggtgatggtggatactgtacgagacaaaattaaaaatgttaatttggatggtattcctctggccgataagcaattagaggagacgattatcaataaaggttggaatccatatccattagtacgatattcggagcgaccagatgtcgttgcttcgcatattatggaaggaaggctcgttattttcgtcgatacctcacccagcgtgatgatcttgcctaccactttttttgacttgtgtcagcatgcagaagaaaatcggcaaaccgcttttatgggaagttatttgcgctgggtacgttttttaggcatatttgcctcgatgtttctgcttcccatgtggctgctaatggtcatcaatcccgaattaaaaccggcgtttctcgattttatcggtcctcaaaaggaagcacatcttccgctgattgcccagttcatcatcgtggaactaggggtcgatctcatgcgaatggcggctgtgcatactccgacaccactggcttccgctatgggcttgatcgcagccattctggtcggtgacatagcggttcagacgggacttttcgtgaatgaggtcgtgctgtatatggctgtcgctgccataggaatgttcgcaacaccgagctacgagctagggctggcgaatagactgattcgactattcctgctggttgctgttgcaatttttcacgtaccgggctttgtcgtgggtacgacactgatcattttgatgctgacgctgcatcggtcatataattcttcgtatttgtggccgttcattccttttaatgccaaagcgttagcttccatcttgttccgcatgcctgtactagatgcgcctaaccgcccgtcatctaacaaaacgagggacaatacgcgtatgccccatacggatgccgacacagattcgaactcaggcaatggacaggagcattaatataaatgatctgcataaaaatccattgttcttgatgttttttttgctatactggtgtaaacattcgatggaatatgactagcttgttccagaaagagaggcgccagaacatgtatttgcatggaagcagtaaaattaacagcaatggacatttggaaatcggcggttgtgatacaacacttttgaaagagcgttttggcacaccgctatatattgttgacgaacagttagtccgccggcgctgccgggagtatatagaagcttttcgtgaaaccggattgaagtttcaagtcgcttatgcaagcaaagcgttttgtgttatggcgatgtgcgctttagctgctgaagaagggatgtcgcttgacgtagtttccagtggagaattgtttactgcgctacaagcagggttcccggcagagcgaatccatttccacggcaataacaaaacaccggaagaaattgaaatggcgttagatgcgcaaattggctgcttcgtcgtcgatagcgaaatggagttgcatttgttgcaggcccttgcctccgagaaagaacagcaggtgaatatcttactgcgggttacaccaggggttgaggcgcatacgcatgaatatatggccacaggtcaagaagattcgaaatttggctttgacattggaaacggtacagcacgccaagcagtggaacaggctatcaagctagaccatcttaacctactgggggtacattctcatatcggttcgcaaatattcgaagtgaatggcttccaaatggctgctgaacgggttgcagctttttccagagaaattaaggaacagcttcagttttctttcaaagtgattaatctgggtgggggatttggcattcgctacacagaagaggacaccccactgaaagtatcaacctatgtacaggctatcggcgaagcggtgaaaacttatttttcaggactttacgatgaacttccagaaatttggattgagccgggacgcagtattgtaggcgattcaggcacgaccttatatacggtaggaagcatcaaggatatcccgcaggtacgcaaatatgtctcggtagatggcgggatgacagataatccacgccctgcactgtatcaggccaagtatgaagcgatgctggctaatcgagcgcaggatacgaacgaagagacggtgtccattgcgggcaaatgctgtgaaagcggcgatatgctgatttgggatgtagagctgcctcgtataaatagcggcgatttgctcgctgttgcctcaaccggagcctacaattactccatggcgagtaattataaccgaatacgtcgaccagcagttgtatttgtcaacaacggtgaggccgagttggtagtgcgtcgggaaacctacgaagatatcgtacgcaacgatgttgtgccacagcgcttgattcgtgatcaagctagtccagtggttcagcccaacgccaagattaccgtttcgtcctgattttagaattgtaagatcaagtaggccattgagtcggtaataatacaccggggacaatggctcttttttttttggacaagactttgctaagcgcggcaattcatagtaaactggaacttgatgttatttagttctcaaaacaggttgaaaaggagatacaaacaatgaaaaaaggtagaatagatcttgaaaacggcggtatcgttgaaattgactttttcccagaagaagctccaaacaccgttgctaactttgaaaagctggcaaacagcggttactacaacggtttgagcttccaccgtgtcattccgggctttgttgctcaaggtggttgtccaatcggtaacggtacaggcggtcctggttacacgattgactgtgaaacagctacgaatacaacaaagcatgccaaaggcgttctgtccatggctcatgcaggtcgcaacacaggtggcagccaattctttatctgctacgctccacaaccacatttagatggagtacatactgtatttggtaaagtaaccaaaggtatggaattcattgatgctgtaaaacaaggcgacaaaatgaaagaggttaaagtatttgacgtgtaattttaccgttaattacatgatctttttcaatagtattgcacctaagccgttctgtctttggacagggcggcttttgttgtcttttgtttgacggtttattgattttcgcaatcacgtaggcattacagtgcgtaagatcacattcgaaaagtaagtgttgtgatagcctttcgataagaatgcattttccatttattttatatgagtattcaaactcagtaaggattggaaaagaagggggcttatcacattgtctattttaacgcgcacaaatcgactcggattttttgaaatccggctggaatccattggtggactcggcgctaatctggctggcaaaatgttggccgaaaccggggtacttggtctggggctgaatgcttcaaatttttcgtcctacggttcggaaaaaaagggaactccggttaaaagcttcgtccgcttctgtgagccggaggtcgatattcgggatcacagtccgattgagcaaccgcatgtggtaggcattttccatgaaacgttatacaaaacggtaaatgtaatcagcggactgccagcggatgggattgtagtggttaattccacgcgtccagcagaagaaatacgggctgatttgggactggtatccggtacactagcggtggtggatgcgatgggcatcgcactggaagagcggaccaaactaaatacgtccatgctcggtgccttgttccgtgtctgtgatttcctggacccggaagcgatgagatcggttatacgcagtacctttgaaaagaaaaatccactgttagtggaacctaatctccgtacgtttaaccgggggtatgaggaaatggaactgcacgtatatccagttactgatgacgcagaggatcgggtctttgaacgtccgcagccactgctgggatacgaaacgcaactactggggggcgttattgcaactcagggaaacagcatgacaagagatgttagtggttcacgtcaggggtatgtgcctgaatatgaagctgataaatgtacccattgtgccaagtgtgattcgatttgcccggattactgttttgtatgggaagagcaagctgacaaacgcggaagaatgatgccatttttgcaagggattgattaccagtattgcaaaggatgtctgaaatgtgtagatatttgcccatcgggggcattaagctcgcgtcgtgagcaatggggatgggcggaacagaatcgagttgcccaccaatttccggtatatgaaggagggcgtgcgtaatggcaaaactggaggaagaactcaaacagacaggcgccgcgcaagtgacaacgttcgaatccggtaatgaaatggcagctacggcggctgcgcagattaattatcatatgatgggatatttcccgattactccatctactgaggtagcgcagtatttggatcagatgagaacgagaggtcagcataatattaagctggttgcagcagacggagaacacggatcggcagggatttgttatggagctgccgcagcgggagcgagggttgtgaacgccactagttcgcaaggtttcctgtacatgctggagcagttacctgttcagtcaggtacccgttttccaatggttatgaatctggtgacacgagctgtcagtggtcccctggatattcgcggggatcattcggatctgtactatggtttgaatacaggctgggtcattttgacggcaagtacaccacaggctgtgtatgatatgaacatcatggcactaaaaatcgcagagcatagcgatgttcggctacctgtaatggttgcatatgacggtttttatacgtcccatcaaaaacgtaaagtgcaatattttgcagatgctgagaccgtgcgcggttttgtaggtcctaacccgaacttaaattatccgaatattactgattttgatcatcctgttaccgtaggtgcgcatatgaacggtgatgacctgacgaataatcatgttcagctgtccgaagcactgaagctgtcagaaggagtatatgagcaggtagcagcagaatatgccgctttatccggtcgggaatacccgattttagatctgtatcaaatggaggatgctgaggtcgcggtattcctgttgaattcggcggctgaatcggctaaggatgtggcggatcaactccgtgcgcgcgggattaaagctggtgtgatacgtccgaatatcatccgaccgttcccagccgcacaactgcgggaagccttacgtgatgtcaaggcgctgctggtaggtgaacgtgcagactcgtatggggcagacggcgggaatttaacgcatgaaattaaggcggccttgcaggaggacccactgaatcggacactcgtgttgagccgtatctttggcttgggcggcaaggatttttatgcggaagatgcagaggcgttcttccagcttgcgattgaggcggcagaggccggacgagcggagaagccctttgattattacggtattaatccgggttcaccggacaaggtgatgccgcaagttatgcagccgccacgtggcaatgcataccgtacgggcctgattcaggttacgccggacgaggcgaccgggaagctcaaagtcaaggtgccacccctgcggtcgttgacaaccaaaccacgccgtcttacaccaggtcacggggcttgcccaggatgtggggcattgtctgcgctggaactgtttttcaaaggtattgaaggggatattgtcgtgttgttccagacaggctgcgtatatgtgacgacgacagggtatccctatacatcacacaaacaaccgatgatccacaatctttttcaaaacggggcagctacactttcaggagcgctggaagcttatatggaaatgaagcgccgtaatgaaattgaaatgtcggacgatccaacctttatcatgatcagtggtgacggtgggatggatataggtatgggttctgcgattggcgcggctctgcgtaatcataagctgatcatgctggaatatgataacgaagggtacatgaatacaggttcacagcaatcatactccactccggttggtcacatgaccagtacgtcgggtgtagggaaaatgcaaaaaggaaagcaaggacatcacaaggataccgtgcaaatcatggctgcttgtaacattccgtatgcttttacagcagctgaaagtcatccgcaggatatgctgcgcaaagcagccaaggctcaatggtatgcgaacaacgtgggtacggcctatggtaagatcctgtgcgcctgcccgctaaattggaaatccgaagatagactgggcaccagcattgtgggcgctgcagtcgagtcttgtttctttcctttgtacgaaatagagcaaggcagtacgacgattacgtacaatccagaagacaagggaaaacggattccagctgctgaatggttgaaattaatgggtaaaacgaagcatcttctcaaggaggaggctacgctggctacctttgagcaggagattgagcgtcgctggactatcctgaaaaagaaacatgaaatttcagagctataattacgttttttgcataatcatcgattaacattgttagccgctgttactgtagtggttcaatcaagattctttgcggtttattgcgcaaggaatcttttttgtcgtttatgggttgaagcataaaaaaacaggtaatgatttccgatataggagtggaggcctataagaggcacgttaaaaagttttcttctgaattttaagatgcaatgaggtgcaggtaatgattaagctgaatacagttgaaataatcgaaattataaagaagcagatccctaaggttatgaacatccagccagtggagctaaagtttacggatgattttggacgggcatcgttggcagcgacagaacacaaattcacgctgacgaaccagcattattctgccaaggtgatggattgcgtgttagaaacacaggtgcgccccattttaatgtgcgaaattatttattttctgaaatgcgagtttattgacggacatgttgatgtgcgactggattatgaagcatgttctgaggaaggacggggaccggttgcttcggccgtaattacctttgatcatgcaacagagttgggagtcgaggaactggccgatctgattgacttggcgcttcatatgaatgataaaacctggtttgaagaactctccagccaatatgtcaaaaccaaagcaggagcttctattagataacttgctttttttagaagtcggtgctaatatacgtaacaagtttaatgttaattcaattaaataagagcaagatccttcggggcggggcgaaattccccaccggcggtgatgacatgtttgtggatcgtttttgtgagaaacagcatggcttagtccgtgacccggatgctgaatgatcggcagaaggtggacctggtgcaaatccgggaccgacagtatagtctggatgggagaaggatacgaagcgcatgtgcatgacgtgacatgtgccgatttttagcatacccaattgtgcgtacggcttatttcgttgtaggacagcatcgggcgatagcttgcttaagctttctttttgatggtgttcagagcgtatttggttgtatcctcagtcatgctttctattggcaaacctatgatttcatgtcgtcttaagatgcatatgaactgcgcttgtatactacaaatgtgactctcatcacccccatgacggattgaatccgaactgggggttttttgcgcttatagctgatgaattagggataaactgaaatgtagtggaaaggagtgaaggcatgtttaccggattggtcgaggaagtgggtcgcattcaaactatttccaaaagcggtgaagcgatggtgctggggatttcgggttccgtggtgttgggcgatttgaaaataggagacagtgtctcagtgaatggcgtttgcctgacggcgatacagatcggtacgaaagactttaaggttgatgtgatgccggaaacctttcgcagcagtaatctgaaagagttgagatcaggcagccgagtcaacctggagcgagcgatggcggcgagcggaaggttcggaggacatatcgtgcaaggacatgtggacgggacgggaacgattcgcggggtaacatcagatcagaatgcagttgtgttcgaaattgagcctaaaaatcaaacattatttaaatatattcttctcaaaggttcaatcacaattgatggtatcagcctcacagtcgcacagcgtacgagagatacctttgccgtatccattattccccacaccttatccgaaacggccttacaagccaaacgtgagggagataccgtcaatatcgaatgcgatattttgggcaaatatgtagaacagcttttaaattacagaggtgcagcggaggcggagagagtagaagaagctcctctcagtttggactatttggcgaaacacggctttacctgatattgaagggtaagcctgtttaggagcattcgtggcacaagacataaggaggaaagtgttatggatagaggtagccaaacaagtgcaatggcaaacgtcatagagcatggcgagttggaacatgacgaagagattcgtttggattccatcgaagaagcgttggaggacttaaaaaacggtaaagttgttattgtagtggatgatgaacagcgcgaaaatgaaggcgattttatcgctttggctgaaaaagcgtcgcctgaggtcattaatttcatgattacagagggtcgcgggttggtctgtgtgccaatcacacgacaaagagccgaggccttggaattgcatcctatggtagagcaaaatacagatttccacggtactgcctttacggtatcggtagatcatatgaagacaacaacgggtatttcagcggccgagcgctccttgactgtacgcgccttggcggacgaagcagtcacaggcagtgatttccgcaagcctggtcacatgttcccgctgattgctcgcgatggtggtgtcttgcagcgtgctggtcacactgaagcggctgttgatctggcccgactcagtggcttcaagcctgctggggtcatttgcgaaattataaaggaagatggctcaatggcccgcctgcctgatctggcagtggtcgccaagcgacatcaattgaagctgatcagtattcagcatttggtggactaccgtcgtcgtttgtcattgtaaaaatacatcttggttccaagtaaatctgaagtattgtccgaagtccctaaataattaaactaagagaggttgattaaacatggcacgttttctagaaggtaatctcatatcgaacggtttaaaatatggtattgtggtaggcagatttaatgagtttattacgaccaagctgttaagcggcgcaattgacgcacttcaacgacatggtgcacaggaagatgaaattgatgtagcctgggtaccgggtgcatttgaaatttcactgattgcacaaaaaatggctgcaagcggcaaatatgatgccgtaattacgctgggtacggtcatccgtggttctacttcacattatgatatcgtctgcaatgaagtggccaagggtgtggcagcgagcagcctgaaaacgggagttcccgttatttttggtgtagtgactacagaaaacattgaacaggctattgaacgagcaggtacaaaggctggtaataaaggttgggattctgcactggctgcgattgaaatggccaatctcggcaagcaattttaatgataggaatagctgaatagaacggtataaactgcaaggtgaaaaagggattggattgttaagcaaggcgatgacgtatatactacagaaagagggattgataacgtagagcataagtgctatagggaaaggtattgttgaatgatgattggagtaaggcagggggaagcacattgacagtcgtaaattacaagctggaaacattcgagggtccgctggatctactgttgcatctgattgataaagccgagatcgacattcaggatatcccgattagcgatattactgatcagtatatggcttttttgcacagtatgcaggagctggaactggacattacgagcgagtttctggtgatggcggcgacgctcttatccattaagagtaaattgttgcttcccaagccacctgtgatggaatatgacgatttggatttttatgaggaagaggattatgatccacgtgaggaactggtccgcaagctggtggagtatcgtaaatataaagggattgctcgccatctaagtgaacgtgagtgggagcggagtctaatttatggcaaggagccagaagatctaagtgcattcctgcccactgaacccgcaaatccggtgcatgggctgcatgcaagcgatttggttgcggcctttcagcgtgctttgcgcaaagcagaacgacgtacgacggtaacccgtgttcatcgggatgaaatatcagtcaaggaccgtatccggcaagttattggagctttagagatggtggggaatggaggacggctgctgttctccaagctgatgcatgaggatatgtatcggcatgaagtggttgtgacctttttggctatccttgaactgatgaaaatgaagcaaattttctgttatcaggagaagcttttcgatgatattgtaatggagtggagaggggatttacgggttaatggattatctgaagctgaaatcaattattgagggactgctgtttctcgcaggagaggaagggttgtccaccaagcagatcgccgacattgtagagcagcagcaagagctggttgaacagtgcctggaagatatgaagcaggacatggagcaggggggaagaggcctgcaacttgtccgtattgccggtcattatcagcttgcaactttatccgaacatgcaccttactttgaaaagctcgcatactctccggcacgtgcctcactgtctcaagctgctttggagacgctggccattgtggcctaccgccagcccattacaagagttgaaatcgaagagattcggggtgtcaaatccgagcgggccatacatacactggtcaacaaggagctcattgaagagaaaggtcgagctgaagccatcggacggccaatattgtacggaacgacgaaatcatttttggattatttcggtctgggctctttggcagatctaccacaaccggagttgttcgaagattcggacaatttggaggaagagactcaattattgttcgagcgtctggagagcagccagtctgcagccaacgatctggatcttgaatcccaataaagttcatccggatcttgcggctcacttatgtaaaatttcaaatagacagccagtcctcaagtatttaggggctggctgttggtattttaagatgcatgattttccggcgaacggtcatactatttttgccatgatatttatagcaaaaaggtagggaggactcgccagtgtggaaatggatcagtatcgccatcatcgtcgttatattacttgtgctggctattctgctctctcgtattcgattgaagctggatattgccaaacatgacaatgatgatcgggcgcatctagagatcagatttctatacgggatgattaaaataaattacgatgttccggccattctcataacaggtttgaaaaaagggcttctctatcggcttgatcgcaacaaaaacatacataaaacggatgcttccgtggatagcggtaatattgatacagaaaaaatcaagcaatttatatatgatatacgggttttgctcaagggaacgaaatccttcaatcgatggttgcgacatacattggcacatgtgacgatgtccaaaatggagtggtccaccaacattagtcttgctgacgcggcttatacagctacctcaaccggtattttgtggggattaaaaacgaccttgatcggttttgcttccagctttgtgcgcatggattgtacccctaagctgtatgttgtgccgtattgggtggatcgcttgcgttttaccaccactttgaactgtgaagcaaacgtatcgctcggctatttaattttctccatgctcatcttagcttaccgcatatggcgcgttccgggtggacccgaggcatggaagcgggtttttttcaaaaaaaatgaagatcttcaagctaacaatgaaagataaacaatgaagtgtggtgaaactgaatctttctgaactttaggatctcagtgtcctccagattaagacataaccgaatcggatgacatacatatttccttgaacccctgcgcacaatagcgaaagaaaaggcaatctacgcttgagataagcagaggaggaattaatcatgtcagatcacccgattcaagggctcatgcaaaccgcaatggaaaacatcaaagccatggtagacgtgaatacgattgtgggagacgcggtggaaacacccgatggttccgttattttgccaatcagtaaggtaggatttggtttcgctgccgggggaagtgattttaacgtagacgaagaggcacttcatacttcctcggcttccggtaatcatagcgggaaggaagttcatccttttggtggcggtagcggtggtggtgtatctattcatcccattgcttttctggttgttggcaaacagggggcacaaatcgttccattggacaatcaaacgcatctgattgagaaactcattgactctaccccatacctgattgataaggttcagtctatcttccagaatacaggcggcaacgtgcagactccacctccacaggtacctgtagatattaatattgatcaaagtaattctggaccggcttacttgtaaaagtcattggaaatgaaaagcgttctctccggaaggtatcccaaagccgagtataggctaaggaataccttcttttctgcttacacttggccctatccccgaatatactgccttcccccaatgacagcatgtatacggtgactgtattcctggtgatacaaagtatgcagcgacaattcattttttcgatttccttcggtagcgaactgcgataagtagatgaagtccggatagaccacttcattcgtcaaataagcagataccgtggcttccggccgacgatgttgattcagggaatcgataatacccttcgccggcaagatgccaatcccatgtccataaaacaagtcttccttcagcttaacgacattttctcctttccattccaatgtttcagatgacacatctggattgttgaaatacagaatatcgccaggagctgctttataactcccttgctgctgtatgagcctgaggtcactgtcataatgccagtcatacagcagcatacctgcaaaaatccgattaaactcactttccagaatggaatccagcactcctttgtacagcacaataaccatagctgttgcacattcaaaagcgtattgatgaccgtttaaaaaaatgtctctgattccctctcccggagtgacacctgctttaatctgaaaaccacccttttccgttaaatcccaaaattgctggttgcaacgtgcggtagcaaaagtggcaaaggatacaccgcttcgatgcaatgcttctgcggactctacaatccgcgatcttaaaatcatttcaaactggagacgcagcatgatgtaacccccccgatccatatttaactttggtaactaatatatatgtactcgggagggcaagttgcttggtttacgtagaaagaaagcaaaaagagagcggctaatggctgtcccgtaaaggaattttctgttataaaggtggacatactttgaacagcttggacatagaatggtacaagacttgctcaaaaccggaggaatccaaatgtttaaaaaaaagcaacacattcacgcggaccacagccatttcttgaataaggcacgcgcatttgttttgccgctggtgcttctgcttattttttcattgccgcttacgttgctgagtccacggcccgttctgggagcgataaaaacagaagcagcgccgcccgcaataggaacccatgcacaggctgcttctttaattgatgtcacatcaggaagaatcatatattctaccgagggtgaccgggagctacgtattgccagcctgaccaaaattatgactgcaattgtggccattgaacatggacgcttgcaggaccgggtaaaggtgagtcctaccgcgtatgccaaagaagggtcctcgctttttctgcaaatgggtgaacaaatgtcgctggaaaatatgctgtacggcttaatgctccgttctggtaatgatgcagcctctgccattgctgagcatgtgggggggacagaagagggatttgtccatttgatgaatgacaaggcggttcagcttgggctaagccatacacattttgctaatcctcacgggctggatgccgagggacattattcctcagccaatgatatggcccggctaactgcttatgcgctgcataatccaacttttgcccgtatcgtaaaaacagaactgaaaaaagcaccgaatcccaacgattcttgggactactcatggcacaacaaaaacaaaatgctgcggctgtatgagggagctgacggtgtgaaaacaggctttaccaaaaaagcgtttcgctgtctggtcagctctgccacacgggacggtcgccagctcgctgccgttaccttgaatgacggggacgattggaacgatcatgcacgtatgcttgattacggattccgatattatccgctcatcccgattacggacaagcagcaacctatcgatggttacccactattaacaggtacaagctttgcctatcctttacatgaaggtgagaagacccagttgcacaaaaggctggtgttgtataaaaattctgcttctgcagacagagcggacgtatcttttggcttacgagggcgggtcgaattcctattggaaggtaaacttatcggttctgttcctgtgtatgaaaaaggtagtaagctgcctgctcaaagtaccgtacatccacagcaagaggctccaactgcacaagatcctgcgaacaatactcagcaacaaggttggacgagcagatggaacgaaatcctaaaaaatttgtttggagcctagggcaagcaggaaattagagctgggacgtgtcacatcattgggaaaaggaggaatcagccatgattcatctcatatgggtggctttgatttgtattggatttgtatttgccgccgcgcagggaaatattgaggtggtgacgaaagcagcttttgacggggcaactacgggggttacagtgtgctttggactgataagtgtgctggtgttttggatgggcatgatgaggctggctgaagatggtgggctcttacagaaaatatccaagctgctttctcctttggttgcctttctcttccctgatgttccgcgtaatcatcccgctatgggttacattttgtccaatatgagcgccaatttgctgggtctggggaatgcagccacaccgatgggaatcaaggctatgcaagagttgcagacgctcaatccagataagcaaaccgccacaccagccatgtgtacgctgctcgccctgaatacggccagtattacgcttattcctacgacgttgatcgcgatacggcttaattttcattccgcacatccggcagaaatcgtcggtacgacactggtagcgaccgcaatagccacctttgccgcaattgcggcggaccgttggtaccgtagtcgagaattgcgccgccgtcctccagcgattccgccgtcccagacatccttggcaccactcacctcatcagcaccaacatctgctgcctcttcaacgacgctgcccgtatcttcacctgccgttccgcgaacgggaatcacggctgccaagggcagggacaccacttggaaaggatgagggaggcatgcttaattttataaacctcgtatcgacttgggccattccggttattctcgcttttattcctttatatgcatatgctaaaaaggtacctgtctacgattcttttgtggatggagccaaagacggcttttctaccgccatcagcattattcctcatctcgtaggcatgatggtggcgattagcatttttcgagcatccggcgctttagactatttgatctcctgggtaaccccatggattaaacactggggtgtacccggtgaggtactgcctttaggcttgcttcgtccattgacgggcaccggttcacttgcgttcacgacggatctaattcgcacttatggcccggattccatgatcggtcggatcgcctcaacgattcagggcagcacagacacgacgctatatgtgctaactgtatattttggtgcggtaggtatccgcaatggacggtatgctttgaaggtaggactattttcagatgtggttggttttgtggcagccattgccatttgcctgcttgtattttaatttctgcatcgttttttgaacgggggttgtgattttgctcatggatgggtatcattagcatgaggtgaattagcgaacatggaaagattgcagaaaatattggcccaagctggtgtagcttccagacgtaaatgtgaagagcttattcaggcgggcagtgtggaagtgaacggggttgtcgtaactgaactgggaacgaaggcagaccctgatcaagatatgattacggtaaagggacgcccgattaaaaccgagaaaaaaatctatctgatgatgaacaaacctaaaggagtcattacgagtgcttccgatccggaaggccgtaaaatcgtgtcagactatctgaaaggcgttaaggaacgcgtatatccggtagggcgtctcgattacgacaccgaaggactgctgttgcttaccaatgatggcgagttcgccaatctgctcacccatcccaagcatcatgtgcccaagacatatgtggcaacagtcaaaggcgttccgcatggtactgagctggacaagctgaaaaaaggaatcgtgctggaagatggcattactgcaccagccgaggtagaatataaagacgtagatcctaatggtaaggagtctgtgatccaaattaccatttatgaaggcagaaatcgccaggtaagacggatgtttgaagccatttcacacccggtcatcagactcaagcggattgccttcggtgatcttttgctacaaaacttgaagcgcggtctaaccagacctctaaccaaggacgaaattaaccgtctcattcaacttgccaaatcagacaacacgaaaaagaaacggacaggacgggggtcataaccccggcctttttggtgtaaagagactattggatgagagtaaagtttgaccaagcacgggaaaatagtaaaatagagagaatggtttttttagcgaaggggctgggaatatgtcagaacaaagcaaccgcatattaattgtagatgatgaagaacgcattcgccgccttctgcggatgtatctggaaaaagaaggatatgcaattgacgaagctgaggatggtgagattgccctccaaaaagcgactgcaagcgattacagcattattttactggatgtaatgcttccggggatggatgggattgaggtgtgtacacggctgcgtcagactaagtctacacctgtaattatgctcactgccaaaggtgaggaagtgaaccgtgtacaaggctttgaagtcggagccgatgattatgtggttaagccctttagcccgcgagaagtcatttaccgggtgaaggcgattttacgccgttcgtcggaaactgcctttttaacgaaagaggcggtaccaagcaatagtattgtttttcctaatcttatcattgagcatgatgcgcaccgggtaactgcgggcgggattgaaatcagtctcacgcctaaagagtacgagctgttgcactatttggcagtgtcgccagataaagtcttctcgcgcgaagaactgttgaaagatgtttggaattacgaattttttggtgatctgcgtactgtggatacgcatgtgaaacggcttcgtgaaaagctgaataaagtatcgccagaggcagcggctatgattacaaccgtgtggggcgtaggttataagctggaggttccaaaataacgtgaacttctggagatcgctggtaggcaagctgtggatcaccatcatttgtcttgtaggctctgtgcttatttttctagggctttttttattgccgtacatcaacagaaattttgcggcgtatgaatcgacggaaatcaagcatttgttcacctatacatgcattgtcggatttttattgacgaccttttttgccttattcctttttactaaaatcacacagcctatgcagctgttgattcaggcggcgaatgcgattcgtgagggaaggtatgatactcggctttcgctggtgaccagtgacgaaattggagaactggcgaaaacttttaatcatatgtctacggaactggaagcaacgatccgcagtctgaatgaggagaaaaaccatttatccagcgtactgcgaagcatgtctgatgccgtaatcaccttcgacagaagcggacaaatcatcttgacgaatccgccggcacaaagtctgttggatatctggaaaaagctggagtggcaggagcgtgatctggaggagtttggagcttctgtacctgagcctttgcagtctctgttccatactgttatggacaggggagaggatgtcggagactatatccatgtcaagaagggctcctggtcggtgcagatggcgcctctgtatacggataatgcaatccgcggtgcagtagctgtgcttagagatattacggaagaagtgaagctggagaagatgcggagcgattttgtggccaacgtatctcatgaaatccgtacacctttatctatgatgcagggctacagtgaggcgttgctggatggcatggcgggttcccctgaagaatccgaggagctggtacaggtcatccatgatgaatcattacgcatgggaaggttagtcaaggatctgcttgatctggcccgaatggaggctggtcatacagacatgcaccgacaggaagtggatgtgaatgagctgatcgagcgtgttcaccgtaaatttacggtacgttcaaaggaacagggactgacactcgattaccatgagcaaggccaacgtttactgctgcctgaggcagatgaagaccgactggagcaggtattgaccaacttgctggataatgcattcagacatacacccggcgggaaaaaggttactattgcggcggatcgaattttgggagaacggcatgagttaatccgtattcggattaaggatgaaggtgtaggcattgccagcgaggatctaccttatattttcgaccgcttctacaaggcagataaggccagagtacgtggtgaggataaagggactggtttggggcttgctattgtcaagaacattgtagaggctcacggaggctctgtctctgctgccagcgtattgggggaagggacggaatttactattttgctgccgatctccaacaaaacaaagctgggttcgtaacagaattataagccccagctgatataccccggtttgcaggcatcctcggaagagggtgctttttgttgaaaaatcaacatttatcttgttcaacgtggaacatcctgtttcatgcatgatgattgctctcatgacagataacggtataagagaaaaagacgcctgggtagccaggcgcctctctttattataaaaccatggacttctcaatattgtctggaactaatttaatactacttcttgggcagtatttagttctggcaaaccaacgagttgaatcagcacgtcttttggcacggctttatcgacggtcaggatcatgatggcttcaccgccgacaattttacgccctacttgcatggaagcgatattgacgccgttctcccccagcaaggtgccgacacgaccgataatgcctggtttatcattgtgggagatgagcaggaaatgagcttccggtgccacatctaccgggaactggttcaaccgaacaatacgttcgccatagcctgccagcagggtgccagatacacgttgctcttcgccgctctgcgtcttgagtgtaacggtaatcaggttggtaaaacccttggttgcgggcgcctgagatacgacaagatggatgtcacgtgttttggccagatgtacagagtttacaatgttcacatcgctgcccagatgacggctaagaacacctttcaaaatataccgtgtcagcggctgtgtatccacagaggacaaatcgccagcgtaatctacctgaatttcacgtacagcctgattcgtgatctgagcggcaaagctgcccagcttttctccaagcgagaaatatggctgcaattgcgtcatgacgttggatggtactggaggcatgttgaccgcatttttaaaaggctcatcacgcaaaatatgcagcacttgctcggacacatcgatagctacattttcctgagcttcgacagtcgaggcacccagatgtggtgtgacgataattttcggatgactcaggaatgggtgatcctgtgctggcggctctgactcgaatacgtcaaaggctgcaccggcaacgataccttcatcaatggcttcaacaagagccatttcatcgataactccaccccgggcacagttgatgatgcgcattccttttttcatcacttcaaactgtggacgagcaatcatatgtttcgtttccggtgttaatggtgtgtgtacggtcataaaatctgcgttgcggataatttcgtccacgcttgcaagcttaatgcccagcttctcagcgcgttcttccgttagaaatggatcatagccgaggatgctcatgccaaatgctttagcacgtttagccacctcactgccgatacgtcccatgccgaggactccaagtgttttgttacgcagttcgacaccgaggaatgttttacgatcccatgtaccgccaatggttttggcatatgcctgtggtatatgacgtgctagagccatcatcatcgcaaaagtgtgctcacatgtcgtaatcgtgttgccgtcaggagcgttaataacgataatccctcgttgtgttgcagcttctaggtcgatgttgtccactccgaccccagctcgccctacaaccttgaggttcttacctgccgtcatgatgcgttcggttacccgagtttggcttcgaacgagtaatgcgtcatagtcaccaataatttgaaccaattcatcctcgctgagacctgtgttcttgtccaccgtgacatcgtctgcatccatcagctgctggatgcccaggtcactgatcggatcggatactaacactttaaacatttggtttcctcctcaaagttaacttcttttatggacaggatgtacttcaaactgaaatacattccataaagaacatgaaaaaacttgaaatgcttctaaaagtacaggagagcggtgtaaaatactagtgtgataacgcattgacgcagaaaagggatgaaatagtattatgcaccaaactgacgatcaaaagtcttacgcggaggcgctttgcggttttcgggcatcaaaaaaacccccgaatcacatactatctccatagtaagggacgagagttatcgtggtaccaccctaattcgcagccatttcgcaatggactgccttcagcggtcataaaatgaccgaaaggataacggttttctgccgattgcatctaatgccgggaagtattccacagacctcggtgcaataactcaggagcgctgaaagtagttacttcgtcaccggcttccacccaagcaccggttctctgaggacgaaatcaataccttttctccatcattgttgttgtcgctaataattttttcataatgtatcatggcttacatgggcatgtcaataggacatgcgacatgtgtggatagccggctagatatatagctacagaatgcagaaaattaagatttaagtcttcttgaatccgcccgactttttggctatgatgctaaagaagactatgcagaggactaactaactatgaaaaagcttaaaatgaaatggaaaagagcgcaaattcatgaattgaacgaccgcttgctgctttacaatttgtatctaactcaggggctgaccctgctgattggcgcaatctggatattttttcagaaaagaaatgtgttagaactatttgcattgccgaacactctgcacgtcttatggtggggattgggattggccgccgctatgttacttgtggatctgttgctatcccggattatgcctgaggatgctatggatgacggtggtattaaccaaatgctgtttcaaaatcgtccggtgtggcatattatttgtatagcagctatcgtctctatctgtgaggaactcttgttcagaggtgcaattcagtacagctttggtccttattggacaagcattttgtttgcggtgattcatatccggtatttacggcattggattcccactggctgggtttttcttagcagttatggattgggctacatatatgtgcagaccggtagtctgtgggcaccgatcatttgtcattttgtgattgaccttatatctggcttagcgttacgttttcggaggtatgaagaatgaatcaggaacttagcagagtgcagacctatggtagccgtcgaaatggtcgcaaaggcaaggaggaggacaggtcaaaatctaaaccagttcgctcccgtgcttcacggcccgtgccagaattggctcacgttgccgctgtaccagaagttgctgtgacgatggaggatgatactcctgccagtgagtaccgaacgcgggcagaaatgtttccgtcccgccgtattcgggtaagcaagtggtttttaaattttttgagtactctttttgtgctgattactgcagcgttactgtggtggggcatcaagggtgcaccacccatcagtgaaatgctttggtaaaggcgcaaaatgatacggtaaaaaggcctccgtctccgcatgaatagcggagagtggaggcctttattgcatcatctacagttaagactgagtatacgcaagtctctatttgctggcaggaacctcaatgctttgaggatcaacaaattggtaccccttttgctcaaggcgtgtcaatagactgtccagagcctcagctgtccatggcagttcatgcatcaaaatattgctgcctggatgaagttgttccgttacgtttttgagaagtgcctccgttttattaggctgattctttttcattgtccagtccagagaaccgacggaccatgtcatgtataggagaccgttttccttggcgaccttgcgacctacgtctccgccggcaccatgagggggacggaagaatacgggggcttgtcctgtaatgtccttaacaactttttgtaccgattcaatctgttttttgacctcaggctcagatttattcttcagcacgaggtgatcccagctatggttgccgatgggctgtccacggtcatggataagcttaagcaactcaggatgctcttttacacggtaaccgtttacgaagaaaatcgctttcgctttgtgtttatcgagtacatctatgattttgttgatcatggctgcttccttaggaccatcatcaaaggtcagtaacacgacttttttttcggtgccttgttggttaggaattacattgtaggctttgttcaagtgatacattttgttattggtagttgcagatgtcgcagttcctgtttcgttgctttcgctggttttgtcattttgtgcattgattttatctgctgagttatgatcatcactgcctgcttgcttactgctgctttttggggaagagacgctgctctgatctttggcgctgttacttgagtcagacgctaccgaatcctgctggttgcttgttgccgcagtttccggcttgattgcagtgcaagcactaagcagcagacatgcggtgaacaaaatgactgctgtttttgtacccattatttcatctcaccttcctgtattttataccgtatgagtttggcactactgacgaacactattcttgattctaccacaaagggaggttctaattgtgaaaacatcttcatttttcctgggaatcgtcttgggcgctgtcgcaagctccttgatctcccgcaaccgcaacatgttgggcttatccatggacatgggtggaaaaaaaagcggcaatttagtgcagaaagcccgtactaaaatgatggacgcggcattccccggaatgggcgagataacgctcaataaagaagacacccataaggatcaagaccatcattcaccaacagataaaaccgctcataacgcccatactgccaagaacaaagaagagaatatgaagttgattaaagacttcatcagaacaagtcccgatgttaagcgtgaggtcgagcaaattttgaaagaaactcatacagccgtaccgggattgtaacccagaaacctttattccgaatcattttgcggcttttttgtaaaagccgttcaaatgattcttttttttatctttttattgcgtgcatttacgattataaaatgataacatgattacatagaaccattttcatcacaggcatcataattgcatcataatctgttaataacactcggctgccaggaggagggtccagtatgaaaatagaaagattaagtcaggacaagatacggattttccttacctttgacgatttgagcgaacgcggtattcaaaaagacgatatgtggcaagaaattccaagagttcatgagctgtttaccgaaatgatggatcaggcatacagcgaactgggcttcgacgccacgggaccgttagctgtcgaagtctttgcgcttcctgctcaaggaatggttgttatcgtcacccggggaaaatacgaccatcaacagtatggttcgggtcccgatgaggagcttccagaggaagtctacgaaatggaagtcacgctggagcatagcgattccatcgtttacgcgtttagcgatttcgaagtactcatagaagcggctcatatgcttcgtagtaacactacggaagcaggtaagctgtatcattatagaggaaaatggattctgcacttggaaccagaagaagtagaggagtccaagcttgcggctttaattgcggttcttgctgaatttggagaaggctcatccgttacaccagctatgttggaagagtacggcaagctggtcattcctgagcaggcagttgctgtcatctgcactcattttgacagccgttcttgattcgttttatcgaaagtgatatcgaagtgaatttgtcggctctgcgctaaagcagggccgactcatttttatggagggatgatcggtgcttctgttttcggttttagcggcagccacagcgccgggtctcgccttattgatgtatttttacttgaaggacaggtatgattcggagccactgcacatggttattaaagtgtttttgctcggatttttggtggttcttcctgtcatgatttttcaacgcgggctgctgctttggctaggggatcacacgttaatccaggtgttcggcatttcagccggagtggaagagttttttaaatggtttctgttgtatcacatcatctataatcataccgagttcgacgagccttatgatggtattttgtatgcggccgcagtctcactcggatttgcaacggttgaaaatctgttatatgcctgggcgggccatgcttcgattagcatgatgctgatgagatcattgctaccggtatccggtcatgcgatgtttggtgtaatgatgggctactacatggggaaggccaagttttcagagggcttaagaagcaaatacatgttgctgctgtcattggtgcttccatggttctggcacggagtatacgatttgattttaacgaaattttcgcatgactggatctggtttatcattccacttatggcatttctatggtatggaggaatggcaaagatcagtcgagctaataaccgttctccttttcgtttgttaaaacgggaagaaaaggttaatatgtaacgaaatgggacacactgatctgacaaacctgttagagaaagaggtgtcttttttttgcgtataaaagtaagaattcattgtaaaagatgtggggaacgttttgtgctgagaggacgtatagagcaaggacagattcagaccggttttaaacgctgcatttgcgataactgtgagtttattgttgaagtcatggaaaaccatgcataagagagcattcttcttgtcacactatcggtagtgtacttgaagaaaggagactcccaatatgtataagcgacttagtgccgtattgttcccggtggttaccctgatgatgataggagcatttgtgtggggttatcaacaaagccagatgagaaaagaggtgtctcttcaggcaaatagcatgtcgataaaagcggaaaatcaataccagcgtgcgtttcacgatttgtcgtttcatatggatcagctgcattctcaactcgggaacgcggttgctgtccataatacttcacacgcgatgcaccgcaaatgtttgatgaacgtgtggaggattgcaagtgaggcccaaaatgaggttaatcagttgcctctgaatgtaatgccttttaatcatgccaaggatttactgtcacatctatccgcgttttcgtatcagaccgctgtccgtgatctggatcacgagcctttaaacgagaaagaaatttcgaacctgaaaacgctatataacaattccaaagaaatttcgaaaaacatgcaggaagtgcagcaaaaggtccttagcaaaaatttgcgatggatggatgtagatatggcggcaggttcgcaaactggtccgaaggacaacaccattattgatggctttaaaaccgtggacaaaaaggtggaaaactacaaggagctggattggggaccgtctgtagccagcatctatgataaacgctctgtgaaaaaattgagtctcccggcagtgaatgcagaacaaattaaacgaaatgccgctgaatttacaggaaaaccggaaagtcagatccgtgtgaacgaaaacggtaaaggaacggaatgggcatcttatacagctaccctgctaaataagaagcaacccgtggccagtatggattttacgaaaaaaggcggcaagcttatttcatatcatgacatgagagcagtaggccctaaaaaagcaacacgtaatgaagcgattcgctatgctagtgaataccttgaacaaaaaggttacaaaggaatgaagccagttgcgtatgatgagagcgggaatttagctaatattacatttgcgagccaacaaggggacgtgattatctatccagaaaaaatcacagtcagatcaggccttgataacggacaagtgatcggttttcaatccagtgattatgtgtatgaacatagtcatctccgccgcattccgcaagcgaaattgaatttgaatgcagcacgagcaaaattgaatcctgagtttcgtgaaacttaccaccgtaaagccttaattgaaaatgaactttcgaatgaagttctgtgttatgaatttggtggtaaaatcaatggttccgtctaccggatatatattaacgccaatacggggatggaagaaacgattgaagaggttaaagattcagatgaacctcaggttactgcaagtaatgcgtagttgattacatgaaaatgaatcaatagtcactcaaaacctccttcatgaaggaggttttttgtgctttagtcatagatcgaacaaataaaatgcttaatataggcacaaagtcgtggtattatataccttaattagagcttttaatggacaaggatggtggatcatttgtttcccaaaattaatgatgtgttatacatacaagtggctggtactgaccataaggacgagatttttgaatttaagtctcgtattgtggaagaggagtcacagaactttctaattgaaattcctatgtcacaaacaagtgggcatttgaaaaaattgtttctaggggaagaactgtctatattttttatgagcgagggtgggattaaaaattattttaatacccacgttacgggttttaaagaggatatccttcggatggttcgtatccacaaacctgctccagacagcatcagcaaaattcagcgccgcaactttcttcgggttaaggccaacttggaaattgcagtaaagcatggtgcgaacgagtccagatttgtagcagagacacatgatgtaggaggcgggggtgtttcttttcacacccagggaactcatcatcttgaagaaggagaatcattgtcttgctggattttagttccatataaaaacggtactcaggagcatgttccgttccaatctgaaattgtgcgcattcagcagatggaaaacggtcgcaaactcattatgctgaaatatgaggaaatcgctgatcaggagcgccaaaaactgattaaatattgctttgaaagacagctggaattccgggggaaatcttaatcatccgaaatttttcttttttagtaaacctgtcgcttattttgcatcgcctataaatgtgtggtataattttcacgtcgcaggcaatgcctgcttttttcttgaggttaggttaggaggaattccctgttggcaaggcaacatgtatcttcaagtaacaaaataaatgtagccattgatggacctgctggtgcagggaaaagtacagtggcccgcctggtggcgaaagcactttcttatgtatatgtagataccggagccatgtaccgagcagcaacgtggtacatgatgcgtaaggaaattcctgcagaaaatgtacaaaaagtgcttcaacatgtacctgagctggtgattgaattagtaccggaccccacaggccaaaaggtttattgtaacggggaagatgtaaccactgtgatccgttcgatggaagtgactagcaacgtgtcacagtattcaagtattgctggtttacgtacacgtttgactgaaaaccagcgtgagatggctgcacgcaagggtgtcgttatggatggtcgcgatattggaacaactgtacttcccgatgcggaagtcaaggtgttcatgaccgcaagtgttcaggaacgtgcctctcgccgttttaaagaactgagcgaaactgatgatatcactctggagcagctagaacgtgacattgcggcacgtgacaagcttgacgaggagagggaggtatccccgcttcgttgcagtgaggacgccatcgtgctcgatacgactcaaatgggcattcaggatgtcgttgatacgatcgtatcttattgcttaacggagaaggatggagagatcagccaatgatatatactgtatgcgccagtattttgcgtctcatttaccgcgttctgtttagacttgaggcggtaggcagggaaaatgtccctgctgagggtggagtgctgttgtgttctaatcatattagtaatcttgaccctcctacagtcggtattttgctgaagcgaaaggttcactttatggcaaaagccgagctgtttaatgttcctgtactgggtccactaattgggaaactgggagcttttccagtcaaacgcggtggtgtaagtaaggaatccattaagctggcattgaacattttgcgtgatggtaaggttatggggatctttcccgaaggctccagaggagctgggggaatcggtaaaaagggtgctgcaagctttgcgctacgcagtggagcggctgccgttccggtcgccattattggtgattacaagcttttccgtaaaacgaaagtgttatacggtaaacctgtcaatttggacgcttaccaaaagggtgccgatatcgaaggagatccgcttgaacttgcaacagaagcaattatgtctcgtattcgcacgatgaaggaaacgggtaagcctacgaataactgaaaggcttgcatgaattgtgtctaagctcggaaaactagaacaaaagtttatttatgttttgaactctgccatgcgcaggtttaaataaatggttttttttgaattgaggagggtattgacatgtcggaagaaattaaaaatcaagaagctgctgaagcggcaaatcaagacgagctcgatcaaatcgtctccctgaaaaaaggtgacaccgttaagggtacaatcgtgaaattggaagataaccaagcggtagtaagcattggatataaatacgatggagttattccaattcgcgagttgtcttctggtttggataacgcagaagaagcagtacaagtaggccaagaggttgaagctagaattatcagcattgacgatggcaaggaaaaacttgttctgtccaaacgtgcaatcgacagtgaaaatgcttgggaaaagttggagcaactgttcgaaagcaaagaagtatttgaagttgttgtgaatgatgtcgttaaaggcggcatcgtagtagacgtgggtctgcgcggattcatccctgcatcgatggtagaacgccacttcgttgaagatttcagtgattacaaaggccgcacattgcgtgttgttgtaaaagaactggatcgtgaaaataacaaagtgatcctttctcaaaaagacgttctggaagcagaattcgaagccaacaagcttaaagtaatggctgagctgaaagaaggccaagaaatcgtaggtacggttcaacgtcttactcagttcggtgctttcgtagatgttggcggcgtggacggtctggttcacgtatctgaaattgcttggactcatgtcgataagccttctgatgcagtttctgaaggagatcaagtgaaagtgaaagtcttgaaagtagatcctgaaaaaggaaaaatcagcctgagcatgaaagctgcacagcctggtccttgggaatcggctgctggacaattcaacaacaatgacatcgtaacaggtgttgtaaaacgtctggttaacttcggtgcattcgttgaaatcgctcctggcgtggaaggtttggttcatatttcccaaatttcccacaaacacattggaactccacaagaagttctggaagaaggacaagaagtgaaagttaaaattcttgaaatgaatccttccgaaaaacgtgttagtctgagcattaaagaaactgaggaagctcctgaagctgctcctaaagcggaaagagcaccacgtgcatctcgtgcacctcgtgaggaactgaataatcctaacgtttccctcaataattccggtctgagcattacgctcggcgagcgttttggcgataagctgaacaaatttaaatgagtttaaatcaatacattttataataagcataacgtacaccatcggcggacccagagggttcgccgattgttgttacgtgaccatatcgctaataggtatgttttttgctatgatgatagcggaagaattgacaggaggagtgaatttatggcaagacccgttgtggctatcgttggtcgtccgaatgtgggtaagtccactatttttaatcggattatcggggatcgtttgtccatcgtggaagataaacccggaatcactcgtgaccgtatatacggtatatcggagtggaatggtaaatccttcagtattattgacaccggcggcattgagattgatggtgaggatgtcattttaaaatccatccgtatgcaggccgaacttgcaatagaagaagcagatgtaattgtattcatgagtgatgcgaaagcaggaattacacagtcagatgaagaggtagctcaaatgttatatcgttcgggtaaaccgatcatcgtagctgtcaacaaggtggacaatctcagtcgcgccgatctgatttatgagttttattcttatggatttggtgatccaattgctgtttctggtagtcatggaacagggataggcgacctgctagatgccattacgtccaatttgcctgagctggaagaagatcactatgatgaagacgttattcgtgttgccttgatcggccgcccgaatgtaggtaaatcttcattggttaacgccattctgggagaagaacgggttatcgttagtgacattgcaggcacgacgcgtgatgcaattgatacaccttttgaaaaagacggtcaaaagtatgtgctgattgatacggcaggtatgcgtaaacgtggcaaagtatatgaaacgactgaaaaatatagtgtaatgcgtgccatgcgtgccattgagcgtgcagatgttgtactggtcgttattaacggcgaggaaggcattattgagcaggataagcacattgctggctatgcttatgaagcgggtaaagcgtcgctgtttgtcgttaacaaatgggatgtcgtggacaaggacgataaaacgatgcaccagtttgaaacgaaaattcgcgatcactttctatttatgacatatgctccgattgtgttcttgtctgcaaaaacgaagcaacgcctgcaaaagctgcttcctgttgtacagcatgtggcacagcagcatgtattgcgtattcagacacatttgctgaatgatgtaatttccgacgcggttgccatcaatcctccaccaacagacaagggacgtcgtctgcgtattaactatgtgacccaggttgctgttaagccgcctacgatggttgtattcgtaaacgatccagaaataatgcacttctcgtatgagcgttatctggagaacaaaattcgcgccgccttcaattttgaaggaactccaattcgtatctttacacggcgcaagtctgacgaaagttaggagcgaataggttgattttacaaatcgttgccatcgtactcagttacttgcttggctctgtcagctttagtttgctgtatggaaaattaaaaggaatcgacattcgccagcatggaagcggcaatgccggtgcgacgaatacgctgcgtgtgcttggaaaaggcccagctattctggtactgctgctggacgtacttaaaggggttattgcagtgctaatagggcactggttaggtggagaatcatcctgggtatcgggtttgtgcggcattgcagcgattgcgggccataactggccgatatattttcacttccgtggaggaaaaggtattgcgactgctattggtgtattggcatcgcttgccttactgcccgcactatatgccggaatcattgcgatacttgcaatcgtaatgacgcgttacgtatccttgggatcgctcatatttgtcattttgactccttggatattactcgttcttggttttgcatggccgttattctggacggctctaatcatttgtctgttcgctgtgtggagacaccgtaccaacatagtcaagctggtacgtgggaatgagaacaagcttggctccaaaggaggagatcgtcttgtctgagaaaatagctgtgctggtcgctgggagttggggaacagccctggcttccgttcttgcggccaataacaacgatgtctctgtctggacgagaaacgagcagcaagcagctgaaatcaatgagaagcatacgaatgagcattatttaccaggctccattttgtctgaccgcatttcagctacaactgatatgcagactgcggtatctggtgctaaagcagtgattatcgtatctccttcggctgctgctcgtcaggtagcacgtagtctgaaagctcattttagcaaggatatgctggtagtgcatgccattaaaggttttgaaactgaaacgcttaaacgtatgtccacggtgatctcggaagaactggaagtcgctgagggtgatattgctgtgctgtctggcccgagtcatgcggaagaagtggtgaggaaatgtcctacaacggtcgttgtagcttcctccaatgagaaggctgcacaagccgcacaggggctgttcatgaactcctatttccgcgtctatacaaaccgtgatttgctcggcgtggaactttccggggcgctaaaaaacattatcgcattgggtgcaggaatgtcagatggacttggtttcggtgataatgccaaagcggctttattgacccgtggattggctgaaattacccgtgccggagttgagatgggggctaacccactaacctttgccggcctggctggtattggcgatctagtggtcactgcaacgagtcgtcacagtcgcaactggcgtgcagggtcactattgggacagggccaacagcttgatgctgtgctggaatctatgggcatggtcgtagaaggtattcgaacgaccaaagcggcatacgccatctcccaaaaattaggtgttcagatgcctattacagaggtgctttatggagtgctgtttgaaggacgtgacgtccgtaaggctgttgaggcgctgatgggtcgcgatcctaagaccgagatggaagtcatgccacttcaaacttgggagcaatggcattcttaagggctcggatgagctttaataatataaaggctgtctcatggtagatttcttctataatgagatagccttttttagttaggcgtttggcatgtcttatgtacgcttaatcaccttttgtctctgcctctcatagactgagttgagcaatggcggaggaggggagattgtgaataaaaactttccgaaagatgcattgaaggccattaacaaaaaaggcggcaaaaacatatccgaaaatgcagtgaaaaagctggcaggcacggtaaaggcggacacgcttcaaagcgaagcgcaactgcgtcagcttatcaagcaggtgtctgcgatggccaacattccggtgtcggaagatacagtaagggatatcgttggtgccgtcaaaaagagcggaatgaatccttccaatatggaagcgttaatgaaaatgatgatgaaaaaatagaccgctggccgtacgccggttagtattattcaccgtgaaccgggaaggttcgcggttttttttatattttggagcagctaacctcttttcagtacacaaaatatcgaactgccctgtcgaacatgttataatgatgcccatcaggaaacggaaggaaagacagcaaaggaggaaacgatgttgaaggaggcaatatcatcagtgttagtggacaggcttcctcacaatctggcagttgcgctgagtagcttggctgagagctggtcaacagtgtcggttccgtggatgttgggcgggagctgttcattacttgtgcaagaagttgaactggatagcctgcctcgggacattgatatttatgcggatattcatgccgcaaagcagcttcatgcgcaccccctgggtatgagtatagatcgacagcaggttgaccgtagcggctcttacgtttcattgctgagccactatgatctggagggatttccagtcgagttggtgggaggatttgaggtattatgtgacggagcgttataccgcttagagatcgagcgactactttggtcgactggtgttcagcttgagctggggagtgcttcactgcgtctgatgccgctcagtcatgaactgttattcaatatattgcgaaatcgacccgaccggtacaaagcgattgccgatgtcatgaagcgcgacccgcgacgtcatataattgtaatgaagcagttactagtcagtaatatttggaatgaggagcaattggacaagcttgcagaacttctgccttggccagagttgcactctgtcatccagatgggcaatgaagtataagctgtgtgtattaggagaagacgactggaggaccgttcatgaatgtgcagattacgttcaagccgtcagacaggcgcgtacaggtcggtcagggtacgtcattgcttcaggctgctcgtaaagcgggtgtatatattcccactcgttgtgacggaaaagcagcctgtctgatgtgtaaggtacaaatatcaccggaatgggctgaattcgcaggtcaacccagcgatgcagagcagcggaagctgggacctttactggatgaaggaatacgcttatcctgccaggcccgtgtccaaggcgatatggaggtaaccataccggaggataagctcaaggcggctatcaggcggcaactggagcgtcaggcgatggatgatgaactgtggtaatgccgattatatcaggagaataaaaaaaggatggtttccgacgactctaaacagtcaggagaaacatcctttttttatttagtctagcgacaaagtcatgggagagccttgccccgcatatattaggtgagtggacccaaacgtaaaatatcgtttctgcaatgatcgctctgtcgtaatctagttttcaaaaaactaaacatattttacggaggggatacatatgatggtatcagtccaaatgcatgtacgagtttacgccgtttcgccgattccatcagtctcctgaatctcggcggcggacgacttccgggcattttaaaggctgttctgccgcatctgggatcaagcagttggttgaacacgaagcggatgctctttaagcatttttccttcggagacttttgaggaggggatttcattggagaaagtggacatttttaaagacattgccgaacgcaccggaggagacatttatcttggggtcgtcggcgcagtccgaacaggaaaatcaacgtttatcaagcggtttatggagacgattgttctgccaaacattacaagtgaggcggaccgtgcccgcgccgtagacgagttgccgcaaagtgcggcaggaaagacgatcatgacgacggagcctaaattcgtaccgaataatgccgtccagatcaaagtaacggaaggactggacgtgaatgtacgtctggttgactgtgtaggatatgcagtagaaggagcaaaaggttacgaggatgaaaatggtccaaggatgatctccacaccatggttcgaagaacccattccttttcaggaagcggcagaaattggtacacgcaaggttattcaggagcattcgacgctcggtgtggtagtcactacagacggcacgattgcggaaatcccgcgcagctcttatgtagagtcggaggaacgcgtcattgaggagttgaaggaagttggcaaaccatttgttttggttatcaactccacgcatccgcgcagtgatgaaacactccagcttcgcagtgagctggctgccaagtacgatatacccgtcatgacactcagcgcggcgactatgacggaagatgatgttacaggcgtacttcgtgaagtattgtatgaatttccggtgcatgaggtgaatgtaaacctgccgagctgggtcatggtactgaacgaagagcactggctgcgtagcaattatgaaaattccgttcgcgatacggttaaagatattcgacgcctgcgtgatgtagatcgagtggtcggccagtttatggaatatgaattcatcgacagggccgggttgagcgggatgaatatggggcagggcgtagctgaaattgatctgtatgctcccgatgagctgtacgaccagattttggtcgaagtcgtcggggtagagattcgcggcaaggatcatttgctacaaatgatgcaggattttgcccatgccaaacgggagtacgaccgcttcgctgaagcgctggaaatggtcaagacaacgggatatggcattgccgcgccgtcgttatccgagatggcactagacgatccgcagttgattcgtcagggtacaaggtttggtgtgcggctcaaggcaacagcaccttccatacacatgattcgggtcgatgtggaatcggaatttgctccgattatcggaacagagaagcaaagtgaggagcttatgcgctatctgatgcaggattttgagaatgacccaatcaaaatttgggagtcagacattttcggacgttcgctgcattctattgtacgggaaggcattcagggtaaaatcgccatgatgccggacaatgcacgctataagctgcaggaaacgctgggtcgtatcattaatgaaggctccggcggtctcattgctattattctttaaggctaagccacatcaaaaaatctttaagagaactaccgtggagagcaatttgctctctacggttcgcagaaaacaaaataatagactgacctccaaaaccagacaggggtagctatggacgagaaaataaagtcctagactacctctgtttttattgagcttttcgtttctcggagcaggatgtaggttcaaatataacaatccgattaatgagtttcacaagtggtggcatcatggaagggaattggaagcattgcccaactgttagagcgaagttctccggtaaagcagtgctccaaataagttagatgtgatcgtcctcgtatttaaaataaacaaacagaattgtatcatcggactaggctccgccttgatttcaaatttaagcagcaaccgttttccggtattccatcgggggggcggttgtttgttgtgttttggcctataaaaccagaaatttttctatatttaataaaacctatttacatacttggtttaaagcgatatattaagtatcaaatttgaatcattttgtggattgaacgagggggaaatgaaatcatgaatatccaaaaagagctccaaagaaacaaaaagctagggctaggggctatcatgctactggtgctggttttgctggtcactgcatgcggcgtgccgaaaacagagagcggcactcaagggacaagcactgcgggatcgaatacaacaaacggaaaaacggacaatttaaatctaaagggtaaacgggttgcgttgatcatggagtttaacacgggcacattttcgcaacagtatgttcaaggcgtggaagaggaagttaagaaatttggcggtacgctgactaagtttgtggcagataacgataaggctaaaatggcttctctgcttgatagtgcgattaaccagcagtttgatgtcattttgactgatcacggtgatgcattgctggagacagggctgaaaaaagcaatttcccgcaatattccggttatcgtgttcgatgctgccgtcaatgttccgggtgcggtagtgctctcacaggatgaccaaagcatggctgagttgacgctggagcaaatgaaaaaggatatcgtcggcaaaggtaacattgtgaaagtatgggttgctggatttgcaccgatggaacgtcgtcaggttgcttatgatgcatttttgaaatccaatccggatattaaagaaatcgcgacttttggttcggctcagaatcctgcattagatacgcaagccaaaatggaagctgtattaaagcaatatcctaagggcgaaattacagccgtctgggcggcttgggatgaatttgccaaaggggcagcccgtgcgatccaacaagcgggacgtacggaaattaaggtctacggcattgacatgagcgacgaggacttgcaaatgatccaggacccgaaaaatccttgggtggcctcggcagccgttgatccaacagatatcgggcgcgtacaagtgcgctatgcatatcagaagctgcatggggataatccggaggagaaagtcgtattgaaggctgtatatgtgcaacgcgaagcgctgccagataagcaaatttccacatccgagctgtcccaatatgtggagggatggggccaaagtgagcagggctataaggattggatgaaggaatatgaaacgtccaaataaaatgtttgcatcatgcaaaaggcgcgcttcggcgcgcttttatcataagcaggcgtgagggggcaccatgagttcacaagtatatacattggagatgaagaaaatcagcaaacagtttgctggtgtagatgcgctgcaagccgtggattttacggtgcagggtggcgaaattcacgctctgctgggtgccaacggggcagggaaaagcacattgatgaagattttgtccggtgcgtatcgttccgatcagggagttatcgtagttggtggcaaggaactaaacattagttcaccgtgggaggccaaaagagcgggaatccactgtgtgtatcaggaggttgattcagcgcttgtgcctcagttaaccgtcgctgaaaacattgtaatggacgatttgtctgcacctgatggtcgatggtgggctgcgccgggggctatgcgcagacgagcgcgtgaggcattagcacgtctagaggtagatattgacgtacgacgatatgtgtctgaactgacgttggcagaaaaacaacttgtacttatcgcacgtattctgacacagcaagcaaatacgatcatttttgatgagcctacggcgccgctcagcgaggaagaaacgcgacgtttgttccgtacaatccatacactcaaggatgagggggttgcatgtattctcatcacacaccgattgccggaggttatcgaacacagtgaccgtgttacggtgatgcgtgatggtgagcgcgtgttcacggggcctgcttctgatttaagtgtaggcgacatcgttacgcatatgcttgggaaaacatttgaagaggaattcccaaaaacagaggtaccgattggtgaaacgatattggaagcaaaagggcttcacaaaggattacgagtgcacggcgttgatttacaggcccgacgtggtgaaattctctctattgtgggtttggttggtgcaggcaagacagagctgtcacgacttcttacaggagcagacaagccggataagggagagctgacctttaaaggtcgctccattcgattgagagagccagcggacgcggtagctcgaggaattgtgtccatacccgaggagcgacgtaagcagggggtgttgattgaggagagtgtggaaagaaacctcagccttccgcttttggacaagctgagtgtccttggtttcatcagtcggcgtaaagaacgaaataacggcaatgggattgtcgcctctctcggtattaagacgccttcactccgccagaatgttaaatatttgagtggcgggaatcagcaaaaagttgcgattgggaaatggctgcattccggagcggatgtatttgtttttgacgagccaaccaagggtgtggatataggggcaaaaagtgatattttccgtatcattggccagttggcggagcaaggaaaagcaatcatctatctaacctgtgaatttgctgaagggattggcattggtgatcggattgcagtgatgtatgatggcaaaattataaaggaatttgcgcggggcgaagtggaacaggaacagcttctgttgtatgccagcggcggtgaagaggtgcattcatgaaggaaaaatggttaaacgtctcatttcgttacggtgccgtagttgtcattataggtgtattggcgtttttttcatctacattaccttatttctggacttatgataatttaatggatattctaggatcgattgccattgttactttcgttgccattggtgtgacgttgtcacttatcgtggacggttttgacctgtcggtgggagctacagtatctttgacaacggtcgtttcagcttctttgatggtctggtatgagcagcctgttgcggtggtcattattgtgtctctgattgtcggcgctttggtaggactgttaaattcattattgatcattaaattgcgtattcctgatttgctcgcaacccttgcaatcatgtatattgtaagcgggattcacaaaacgtacgctcagggctataccatatacaatcatatgcagtttcccgatggcagcaaggcgccgggggagatatctcctgcatttcttttgctggggcaaggtaaatggttgggtatcccgatttcggttattttactgttactggctgtggcggcggtgcatgttttcttgacctatacaaagcatgggcgtcaaatgtatgtaacgggtggaaatgaggaagctgctcgtctgtcgggcatacgggtaaaaaaagtccgtactctggcctatgttgcttcaggcgtatttgcggcgattgccggtattttgtatgcttcgcgagtaggctcaggccaaattgacgcgggttcccctttgctcatggaggcggtagctgcagtattcgtcggtttttcggtctttggtgctggtaaacccaatgttattggtacatttattggtgcggtattgatcggtgtgttggttaatggactaacgatgatgaatgtgcaatattttgcccatgatattgtcaaaggagtagtgctggtacttgcgctggcggttactttttacgtgttaaaccgtcgtcgtacttgaaattgtctgtggactgtattactataaaccttgttccacgcaagaagggtgccataaaacgccagtttcggcctatattgcggaggttaggtatattctatgtatatttaacgacgaaacggaaacagatgataacattatggaaggcagtacgccgcccgggttattttatacaggcgacctcatatcggtcattaacaccgataaccttaatgctggactacacttgaattgggaggtgaatattatgaataaaacggatttgatcaatcaggtttctgaaagcactgaattgtccaaaaaggacgtaaccaaagcaatcgatgcagtatttgaggcgatctctggagcgctgcaaagcggagataaggtgcaactggtaggttttgggaactttgaggttcgtgaacgttccgcacgtaaaggacgtaacccgcaaacaggagaagaaatcgaaatccctgcgagcaaaattccggcatttaaaccgggtaaagcgctcaaagacggaattaaataagatttcttacatattcccaatgcgctgaaaagaccgtgaatttgattcacggccttttctttttgccctgtttacttcgtggtagaggtgctatggtctgaagaagaggaagctgttctggcgtttcgcgaggcataagcgatcagcaccaggggttcacccgttagctcagcaaattcatgctctagctgttgaagccgttcgatttgggcagggctgagattggcgggaagatagtttttcatcagatccgttcctttctttaatggatggactgcacggatagtatggctcgggacacgctaattgttgcaggtagctcgggaagcatgtagttgacaaaactagcttgaatctccatcataaaaagtatagcttcggctctcagggaggaaaaggacatggaagataacgtgacgggtagcagtgagtacgtcgtaattaaagcgaaaagcaacggatgtcaggtttttggtctgactagaggtcaggatacacgcttgcatcattcagaaaaattggacaagggcgaggtactgatcgtccaatttacggatcatacttctgctattaaaattcgcggcaaagccgttgtgatgactaagcacggggtagtagatacggaggattaaaatgcaggcatagcctgcttttttttgttgtagaatgagagtgaggacctttactgtagcaagcccacattatgaggtagaggtcaggggaggctctgatgaaaccttggattgtattcggtggctccattctcataaccatcgcagcagctgtgttgctgccgtccttacaggtgctggactcaggaaccgcagcagttcgtgagacacaggcgacgatttcgcctcagcaacgggtgctgctgtcggatgacaatctggtggatacgctgaacgagctgccgttgaccacaccgattgcaagcgcaagctgggaacattcagtcctgaccctggatgtcaagctgtccaaggaagaaactgccccactagagatttatcaaaacatggcggagcttgccgcttttagcttttacggaacgacgaatgtacggcaattgctgcttcgggtggtgacgcaggacgaatggtcaggagaacggcatttgctgcttgcatcagatatacgccggaacgagtggacgaacgaggcattggaacagctgagaagccgggaaggcgcggaattgccagaggaattgaaatcccgtttccgcattacagtaacgcccatgtggcaaaacaggtttaacggtgtatatacagattagatatttctgccggtggacctacagtactttagtcgcgaatcattttaaattgtgatataatataaggcattgcaattatttgagtatagcagaaagtcatgtctcggaggcttaggatgaaaccgtatcgcgtaccccaattagcaaggaaatatgtggaatacgacatgattcaacaacatacggaaatgccggcttttcctgacagccgtacccgtttgatgtttgtgtttttgaaccggaatgcgcaggagctgcatgccagtgaggacgaactgtacgcattggtaacctcacttgtgcagatggggctggatacgcatgatatgattgatactctatccggtatacggagcccggaggagatgcgttccagacagctgaaagtgttagcaggggactattttagcagtcgtttttatcagttgcttgcactggcaggccgcatcacggccatttcgaagctgagtgatgctgtatgtgaagtgaacgcagggaaaatgagtctgtactggggaatgaagcaattccgattggatgcaactcagtatttaactcagatggttcgtttcaaaaaggagctttttttatcattcacttcacttgtagcagaacaggatcaggaaatttggaagcagcttctcaacaaatttgccctctgtgataccttggtggaggaatgggggaagcggacagaaccggacaagtcccgtttcggatatatgttctggcatatttatagtaacggggaccggaacgagcaggtattgctttcagagagtggtactgacactgaagcatggcgtaagctggttctgaaatacaaagccgaggatgcgatactggacaagcttcgcacggcagttacacacatccggcagatcctgtcagatgatcaaaatacggggatcgaggaatttgaacgcatgcttgagcctttcctgaagctgctaaatagtccgcacccagttgtgagggaaggttaggtgaacgtgatgggatcaagcgacaccaagccgaaagaacaattcgttcatggcgtgtttgaaagtatagcaggtaaatacgatttgatgaacgatatactgagctttcgcagacataaggcttggcggaaatttacgatgaaaaaaatgaacatgcatcgcggcgatacggcaatcgatctctgctgtggcacatgtgactggacgcttgcgatggcgcgtgcaagtgaaagtggtcacatcgtagggctggattttagtcagaacatgctcaatgttggcgagcgtaagattacatcagaatcccgtgaaaagcaaattaagcttgttcagggcaacgcgatggaactaccttttgaagataattcatttgattatgcgacgattggtttcggtctgcgcaacgtgcctgacctgcgccaagtgttacaggagatgcaacgagtcgtcaaacctggcgggcaggtcgtatgtctggaattgtctaaacctacttggcagccgttcaaggggatttactacacatattttcaacacatcttgcccatgctcggcaaattgttcgccaaacgttatgagcagtataaatggctccctgattcgttggcgctttttccaggaagggatgagttggctggcatcttccgtgaagtcggattgaaggatgtccaggctcattctctcaccggaggcattgcggcattgcacattggaatcaaggagagtcagcatgtttaagaaaattgctatttttttggaaatgattaaaattgaacatacgttatttgcgctcccatttgcattcatgggggctgtattggggtctgttgtcgtgacaggcaaccttccctcctggccgcagatcggctggatcctgctagctatggttggcgcacgtagcgcggcttttggcttcaatcgtatgattgaccgggtgattgacgggaaaaatccgcgcacagcaggacgcgctatcccggcggggttgctcaaatcgagcgaagtggtgattttcattatcgtcagtttggtgttgttattctgggcatcattcaagttaagtccgctggcgttcaagctgtttccgctggccttttttatgctcgttttttattcttacaccaagcgtttcacttggctttgccatattgtacttggtctgaccattggtttggcgccactaggcgcgtgggttgcagtaacgggacaaatagatttgactgctatcgtactatatctcacgattgcattttggacggcgggatttgatgtaatttatgcttgtcaggatatagattttgaccaatacgaaggagtttattctattcctgcccgttttggtgtagcaggtgcgctgaacatcgctcgggcattccacgtcattacggcgatcggatttattgtattgttctttattgctgatttaagctggtggtatctggcgggcatgattatttcgtacattattttattttatgaacactatatcgtatctccaaaagatttgagtcgattgcagacggcattctttactatgaacggtgtacttagcactgtcgtatttgcctttacactgattgatttggtggtgcgtcaatactaatgaataatcaggtgagcggacatcaaggcaaacgaatcgttattggcattacaggcgcgagcggaagcatttatggtgtgcgactggtagagactctgctggacttgcaatacacagttcacctgatcgtttccaatgctggctggcgggtgttgaaagaggagttgggctggaatgtgactgaccgggaaggggctttgaatgaacaattcggaggccgtcccggttctcttgtataccatccgttcacagatattggagcttcgattgcgagcggctcttatttggtggatgcgatgattatcatgccatgctcgatggggacgttgtcagcagtggcacacggttcgtccgataatctcatggcgagggcagcggacgtgatgatgaaggaaggtcgtccgctgatccttgtgcctcgtgagacgcctctacatgccattcatttggaaaacatgcttaagcttgcgagactcggcgtcaaaatgattccggctatgccggctttttactttcatccgaagacgctggatgatattgtgctgttcctcgtaggcaaagtattggacagcttgcgtatagaacatcaactgtttacgagatggggggattccgatgccgacaccggacaccaagacaatcacaatcggaaaaattaaatatacaaacgcttggcctatttttcatttttttaatccttctaagcttctccattcggcggagatggtatctaaagttccagctgaattgaatcgaggtatgctgactggaagtttggatatcagtgcgatgtcttcctttgcgtatgcatcgggtgctgaggaaatgcttttgttgccagatttatccgtcagtgcagatggtcctgtgcaatccattttactattttcacgcaagccgctggacgaaatcaaaaacggaaccattgcacttacgaatacgtctgctacatccgtgaatttgttgaaaattttgatgcaaaaggcatgggaaggtcaaccttcctattttgactgtgaaccggatcttgacttgatgctggaacaggcagatgcagggctattgattggagatcacgcaattaaggcatcttggcgaagtgaagatctgtatgttacggacctcggagaagagtggaagcgctggacgggctacagtatgacttttgctgtatgggcagtacgacgtgctgttgctgctcagaatcctgccgcggtggctgaaattgcgagtgcgttccgcgcaagtaagcagcgtagtctgtcggacctgacgcctgttatttctgaagcatgcgaggaaattggaggtctgcgagattattgggagcgctactttactaatctgtgttatgattttggagagaagcaacaacaaggtttagagctttattttcagtatgcgcatgaactggggctgcttgaccgacgagtgaagccgcttctctggagtgacaatacgctgacacgggtgaaagaatgaaacgattggatttgtttggtttattaaagaaggatatgaactttatagaagaagagttgtaccgcagtatcgacagtacggagccgttgattaatgatacgtcgcttcatctgcttaaagcagggggcaagcgtttgcgtcccgtatttgtattgctgggaggcaagtttggagaatatgatctggacaagctcaagcgtatagcggtacctctagaactgattcattctgcctctctcgttcacgacgatgtgattgacgatgcggaaatgagacgcggtcaacccaccgtgaagtccaaatgggacaatcgggtggctatgtacaccggagactacatatatgcacgtgcgctgtctattgctgctggactgccgaatcccgacattcaccgggttctgtctaaagcgctggtgcagatgtccattggtgaaatggaacagattcgtgatttttttaatgtggatcagagtgtgcgtaattatttgcttcgcatacggcgcaaaacagcattgttgattgcggttagctgccagttgggagctatggctgcaggggcacgggaaagtatcaattccctgctgtacagctatggctataacgtaggtatggcttttcaaattcaggatgatctgctcgatctgtgtggcacggaaaaaaagattggcaagccgccgggcagcgatatgagacaggggaatattacgcttccagtgatttatgcgctcgaacagcctgagctgcgtgcagatctactggctgaaatccgccgcattcaggatggggatggacaaggagatgcacgcaaagcggtggatatgatcaaaaaaagtgaaggaatcgctaaagctgaaattctcgccgaccgatatattaataaagcgctaaacgcgctggacttactaccggatgtcaaaacaaaaaagacgctacgcgatattgctcattttgtaacacgccgctcctactaaagttgtgttttgggtttgctgtgacaaaatactttaaccgtttccaagctttctgttacaatacagtttagtactgtataaatacattagattggattgggagtgagccgatggatcgtacttttttgatggttaaaccggatggtgtacaacgtggactgattggacgtatcatcagtcgtctggaagacaaaggcttcaaaatggcggctggcaagcttgtgcaagtatcaagagaacaggcagaacggcattatgcagagcatgtgggcaagcctttttttgaagagcttgtaggctttatcacatcaggccctgtgtttgctatggtatgggaaggggataacatcgttacgctctcccgcttgttgattggtaaaacacaagtaaccgaagctcttccgggcacaattcgtggagactttgcagcacatacaccgtttaacctcattcatggttcagattcaccggagagcgcagagcgcgagattgcaaattttttcctgccggaagaatccgttcggtatgaaaaaagtgtggcgacctgggtataagtttaattacgtatgaagaaggatggtagcatgacggatatggaactgggtcagacggaccccgattacacagcgtttatccgcaaaatcaaggacagcacaggtattgatcttgcacaatacaaagaagcacagatgaaaaggcggttaactacgcttcgcaacaaaaacgggtttcccagttttgtttctttttatgatgccatgatgaaggaaaaacctctattctatgaatttctggatcggatgacgatcaatgtttcggaattttggcgaaatcccaatcggtgggaagtgctgcgggatacaatcttgccacaactgcttgtaggaaagcagaagcttaagctgtggagtgcggcctgctcgactggtgaagagccttatagcctggctatggttctcgacggtaaagggattttaggaaattgctccattacagcttccgacattgatgatggtgcattggcaaaagccaaggaaggtaaatatttggagcgttcgctcaaggatgtacctgagcaggtagctagcaaatatttcaagccggatggtgcgatgtatcgaattgatgatcgtttgaaacaagccgtgaaatttcaaaagcaaaacttgctgctggatcggtttgaggatggctatgatctcatcatctgtcgaaatgtaatgatttattttacagaagaggccaaacatacgttgtatcaaaagtttgcagccagtcttcgtcccggcggtgtgttatttgtcggtagcacagagcaaatcttttctcctaaccaatatggtctggaatcgacggaaacctttttttatcgcaaaaaagcataagcctgcgtatatcatccaaagttttgtaggaacttatttatatctttgagtaattgatggttggcttatcagcaaagcacgtcctttagcccctttggctaagaggcgtgtttttgtttatctgcatacacgtggcttttcttgtcaaagaaaggtgcgtatactataatgaagcacagttaaagattttagcgatgcacagtttaacagtttaaagggggaacgcgtcatgagtttacgttatttaaccgcgggggaaacgcatggtccccagctaactgccattgtagagggtatgccgagcaatttaaaattggattttgaggaattgaattttcagctgcaccgtcgtcagaaaggatatggacggggtcggcgtatgcagattgaaaaagatacggcgaaaattgccggaggcgtacgtcacggctacaccacgggtgcaccgattgcgctggttgtggaaaataacgattggaagcactggcagaacattatgaatattgagcctattgaaggcagtgatgaagaaaaacgtcgggttcaccgtccacgtccgggtcatgcggatttgaatggcggaatgaaatacaacctgaaggatcttcgtaacgtgctggagcgctccagtgcacgcgaaacagcaattcgtgtggcatgcggcggtttggcccgtcaattgctggctgagttcggaatcaaggtggcaggtcaggtcatccgcattggggaaatcgaagctccttaccgtgatctgccgattgatgagctgattgccgtgacagaagcctcctcggtgagagtaaccgatccagaaaccgaaaagaaaatggaagcatatattgatctgatcaagcaagaaggtgattcagtcggtggggtagtggaatgtatcgtagaaggtgttccgattggtctgggcagtcatgtacagtatgatcggaagctggatgcacgtattgcacaaggcgtcatgtcgattaatgcatttaaaggcgtggaaatcggcattggctttgaagcaggagaattgcgcggttcacaggtgcatgacgagatcctatatgatgaggaacgtggatatcaccgtcgtaccaatcgtttgggtggttttgagggtggcatgacgaatggaatgccagttgtggttcgtggcgtaatgaagccgattcccacactttacaagcctctgcaaagcgtcgacattgatacaaaggaagcgttcactgcacaggttgagcgttcggatgcatgtgcagtacccgcggctagcgtagttatggagcatgtggtagcttgggagattgcgaaagctttgctagaaaaattcggcggggattcgattgaagagattcgtgcgaatattgcatcctacgaagaacaactggggcggtactaagatgagtatgctgacggtacagcttggggaacgttcttatcctattcatatcggacgagggctgctacgtcgagccggagagttgttgaaggaacgaggaattgcgcaaaaaagcccgttgttgattgtttctgacgaaaatgtagcgggattctacttggcaacattggagagcaatcttcaggcatctggctacaagacagtgtcctttgtcgttaagccaggtgaaacctccaagtcgcttgctgtatttgagcaggtcataacagcagccattgagggcggcttggatcgcaattcagccgttattgcacttggtggtggtgtggtgggcgatttggctggatttgtggcggcttcttatatgagaggtgtcaagtttgtacagatccccactacgatccttgcccatgacagtagcgtgggcggtaaggttggcatcaatcatcctttggcgaaaaatatgataggagccttccatcaaccggagcttgtgttgtatgacgtagatacgttgtcaacattacctcctcgtgaggtatctgcggggcttgctgaaatgatcaagcatggcttgatctgggatgctgatttcgcccagtggtgccgtgaccatgcgactgatttacttgcgctggatgcgacagctctggagtacggtctggaaaagggatgttccgtaaaagccgaagtggtgtcgcgcgatgaacgagaaaatgatttgcgcgctattctaaacctagggcatacgattggtcatgcgattgaagccattgcgggatatggtgagtttttacacggggaagccatttctattggtatggtcggctccgcacttttgggcgtgaagctgggggcagatccttctttggcagatgaaacgaaggatatgttgtcttcgctacggctaccgacctcccttccgtcacatctcgatacagatcggctgctggacgcgatgatgcatgacaaaaagttcaaagaaggcagcattacttttgtcgtcccacgtagcatcgggcacgtggaggttgtgaaggatatttccgtctcttacatccgacaagttattgaacagttaaaagagggggcgtaacgatgtacaatcggggaattcgtggcgcgacgaccgtagtgaataatgaagaaaacgaaattttggaagcaacatgccaactactggaggaaattgtatcctacaatgaaattcagccggaggatattagtaacgtatggattacggtgacccatgacctggatactgcctttccagccaaggccattcgtcagcttgatggctgggatatggttccgctcatgtgtgcattagaaattcctgtggcaggcagtttacccaagtgcattcgtttgatggtacaggtgaacaccgataaatcccagcgtgaaattaaacatgtatatttgaacggagcgcaggcgttaagaccggatctggcttcccaagggaaataagcgcccgtttttaaagttgatggttgccaaagtaacatcccatgagatatagtgtgtgtagcagagttaagtagagtagagttagccagagacagagttgagatgagaagagtgcagccttagccaattccatatgagattacagagaccggcggtagcaggtaagcttttgtctatgaagagatattcttctacagagaagcttatttgaagcaacctgcgtgtttatacaaaagggatgagtgtatacttatctatttgctgtagtcatttacatatggagcattcttataatttcaataactgacagcctctaccttaccggtagaggcttttttatattctctcctatggttctgcgccaatttggaaaggaagtgatctcatgttaacgccgcatgtggagcaagtgataacgatggcgaatgaatttaacctgattcctgtgtacaaaaaagtgctggctgatatggagacgccgattcggattttccgtcggtatgccgagcgggaccgtgcctttctgctagagagtgtagagggaggcgaacagtgggcgcgacattcattcatcggtacagacccgtttctaatggtctcgggtaaaaaaggacgtttaatattggaacaacacggtaaacggcaaatattaaacgacaagccgattgaagcgctcaaagcattacttcgtaaataccgtagtccgaaactgaaagaaatgcctccatttacaggcggggctatcggattttttggatatgacctgcttcaatattatgaaaagctaccagagcattcggtagatgatttgaatatggatgatattcgttttatgttctgcgatcaagtcattgtttttgatcatgtgaagcagcaaattttgctggtgggcaatgttcatgtaggcgaagggttccgcgatgaggacattcgtgctgcttatgctgacgtggaacgcaagttggaggaaacggcacagtatctgcgcaagcagtctcagcctgagcgattaggatcagcctccattcctgatgatgtggaactgggtgagatccaatccaatgtgacgaaggaacagtttatatcaaacgtagagcaggcgaaggagtatatccgctccggtgatatttttcaggttgtactatcccagcgttttcacattgatacagaggcctcacctttacaggtataccgcgtgctgcgcacgatgaacccgtcgccttatatgtattatttgaaaatggatgacgagatcatcgtaggcacttcgcctgaggcactcgtcaaggtggaaaacggccgggtagaaacccgtcctattgcaggaacgagaccgcgtggggtaacggagacagaagatgtggcacttgctgaagaactgttaaacgatgaaaaagagcgtgcagaacatctgatgctggtcgatttgggaagaaatgatttgggccgtgtatcacagtttggcacagtcaaatgcgatacgtttatggagattgaacgctattctcacgtcatgcacattgtatccaatgtgtcgggtgagctacgggaggacaaagattttttcgatgctttcctgtcttgtctgccagccggcaccgtatcgggggctccgaagctacgagccatggagattattgctgagttggagcgggaagcacgcggaccctatgcaggggcgattggatatttaggcttctcaggcaatatggacgcttgcattacgattcgcacgattgtgtttaaaaagaaccgggcctatgtccaggcaggcgctggaattgtgtgggactcggttccggaaagcgagtatcaggagacggtgaacaaagcaaaggcattgctgaaggcaatccgtacggcagaagtgatgttcccggcaacgacacagccctataacagcgtcatcaaccaggattatttgtacactccgtaacacacaaaaatctgattttgaggaggagacgacaatggaacgacatgacatgatgcaagtggggttaagccggatcattgagggacagcacctttcgcgtacggaggcccgtagcgtaatggaacagattatgagtggaagtgctacacaggcgcaaattggcgggctgctgacggctcttcgcctcaaaggggaaacggtagatgaaatcactggttttgccgaggctatgcgtagctacgctagtccagtgcaagctgaagaaggcagtggtcgtctgctggacacatgtggaaccggaggttcagggattcacaagtttaatatttccacgatatccgcgatcatcgcagcttcggtgtctgtacgggtagcaaagcatggcaatcgttctgcaagtggccgtgccgggagcgctgatgtcctggaggcattgggagtcaacattcatttgacgagtgatcaggctaggtcatgtctggaccgaatcggcatctgctttttattcgcacagctgtatcatccgtctatgaagcatgccgccgcgccgcgccgcgagctgggtgtgcggacggtattcaatatgctaggtcctttgacgaatccggctggtgcggatcggcagctgttgggcatttatgacgccaacaaaacggaagtcattgccgaggtattgaaccagctcggctccaaacgggccatggttgtcagtagtctggatgggctagatgaaattagtatttcagctccgacacgtgtatccgaactgaaggacggcaaggttcacacgttcgagcttcatccgtcggatctgggcttgcagacgcattctcttgatcaggtgctgggcggcgacgcacaggttaacgcagatatcatacgacgaattttaaacggagagcatggagcttatcgggatgttgtgttagcgaatgcaggagcgtgcatttatgtatcaggtgcagcggctaccttgacggacggagtagcacgagcggcagaagccattgactcgggactggcaatttccaagctggatcaattaatacaggcaacgggggaatatcaatatgtatcttgacaaaattgtggtgacgaagcgacaagaagtggagcagcttaaggagggttttcaaataagtaaagctgaacgattaattgctgatttacctgcgacgagaggattcgaaaatgcgatcgcgagcaaacgcaatcgtccgctcggactgattgctgaggtgaagaaggcttccccatccaaagggctgattcgaccggatttccatccggtggacattgcacgtgcatatgagggagcaggagcggattgcatttctgtactgacagatgtgacatattttcaggggagccctgaatatttacagcaaattcgcgatcaggtgaagattccgctgctgcgaaaggattttatcattgatgaacggcaaatatatgaagctcgtctgctgggagcggatgcggtgctattgattgccgctatcctggaaccccgtgtattagggtcttttttacagattgccaaggacctcgggctggacacgttggtagaggtgcatgacagtgaggagcttaaagcggtgctggagctggggacagcaaccttaattggcgtaaataaccgaaatctgcggacattcgagactcgtctccagacgacagaggagctgatctcactaattcctaaaggggttacgttcatcagtgagagcggaattgcgggaccggaagatgttaattatctgcattcggtaggtgcacacggtatcttggtgggggagcatcttatgcgcaaggaagatgtaggacaggctgtagccgaattgatggacggggttaaagcatgaacaaaacgggcgtaaaaatttgtggacttcaaagcgttgaagtgctaaaatctatggtaaacttaccggtcgattatataggttttgtgtttgctgacagcaagcgccggattgacggcgtacaggctggaaagctgcttcgcgtaatagatgaatggacctcaggcagcagaccgcgtagcgtgggtgtatttgtgaaccctggtgatgcactgttaaatgatgtgatggagaaagcacccttggatgtcatacagctgcatggacaggagagtccgcagcgctgtcgggagattagggagcattttggtatacaggtattcaaggcatggtctgtggacagtcaaggacaaacagaacgctcggcggacgaattggatgcctatgtcgggacaattgacgctttattgctggatacatacgatcccctgtatggcggcggctccggaaaaacgtttgcgtgggatcgaattcctgcctatcaggcttggacccatcaacatggaattcctttgtttgtagccggcgggttgactgccgataatgcggaaaagctggttcatgagtatcatccccatgggctggatgtatccagcggtgtagagacgaacggagtcaaggacattgcaaaaatcacagcattcgtagaaagggtgaagcaggcatgacacaattacctgataacaacggacgttttggaacatttggaggacgttttgtaccggaaacgttgatgaacgcactgattgaattggaggaatcctaccgtaagtacgcggatgatcccgagtttaaagcagagttgaacgggctccttaaggactattctggtcgggaaacgccgctttattatgcggagcgtctgagtcagcatttgggcggagctaaaatttacttgaagcgcgaagatttaaatcataccggtgcccacaaaatcaataatgcattagctcagggattgctggcgaagcgtatggggaaacagaaggtcattgctgaaacaggcgcaggacagcatggtgtcgcgacagcgactgtggctgcgttgctcggattggaatgcaaggtgtttatgggcgaagaggatactgtgcgccagcagctgaacgtctttcggatgcagcttttgggtgcagaggtcattccggtgacatcaggtacacgtacacttaaggatgccgggaatgaagctttgcgttactgggtcagccatgtccatgatacgttctatattttgggttcagctgtcggcccgcacccgtatccgatgatggtgcgggacttccaacgtgtgattggtgatgaaacacgtcgccagatcctagagaaggaaggcagacttccggatgtcatcgtggcagcgatcggtggcggaagcaatgccatcggcatgttttatccttttattgaggatcagggtgtcgcattgattggcgtggaggccgctggaaaaggtgtcgaaacggaattccatgcagctacgatgaccaagggaacacaaggggtcttccaaggctctatgagttatctgcttcaggatgagtatggacaagtgcaacctgcgcattccatctcggctggattagattatccaggtgttggaccggagcattcatacctgaaagatattgagcgggccaaatatgttccgatcacggatcaggaagcgctggatgcacttcagctcctctgccgtaccgaaggaatacttcctgcattagagtcggcacatgcagttgcgcaggtcgtcaagctggcacctacgttgacggcagatgatattatcgttatttgtttgtctggacgcggggataaagatgtggactccattatcaagtatttgggaggaaatccgtcatgaatttaattgatcaggcgtttggtcgccttaaaaatgaaggcaaaacggcattaattccttttctgacggtaggcgacccggatgtggatactacaatagagatcattcggctgttagagtcggccggagctgacatattggaactgggtgtaccctattccgacccgctggctgacggtcctgtaattcagcgcgcgtctgagcgtgcactgaaacggcaaatttccattcgcacgtgcatggagacagcttctctggccagagcggcaggttcaagtctgccttttattctgttcacgtattataaccctgtattacagatgggtatggatgctttctttgcaggcttgcaggagcacggtatcagcggtctgattattccggaccttccgcttgaggaagcggaggagctgggaggacgggccgcagaggtgggtgtgcatctgattcctctggtggctccaacttctgaacagcggatcgaacgaattgtccgtcaggcccgaggatttgtatactgtgtatcctcgctgggtgtaactggggaaagagcctccttttttgaaggtatagaggactttatcgcgcaggtcaaacggcatacagatattccggtagcggttggcttcgggatctctactcaagagcaggtagcccggttttcaaacatttgcgatggagttgtggtcggcagtgcaattgtacgtcaggtggaggaggccattccattgctgaatgattctgcgcgcaggcaagaaggtcttttgcaaattcataattttgtggcacaattaaagcagtaactgtcaaaatagaaagtaataaatatgttctgattggatagaggaggtaggggcatgcaacctaaaccgcatattgtacatttgccagtatatcagcccggtaaaccgattgaagacgtaaaacgtgagctgggactcgatgaagtcatcaagctcgcttcgaatgagaatccgtatggtagctctcccaaagtgttgcaggccattcagcaggagtttgccaacattagtgtatatcctgacggaagtgccgtagctttgacacaggcactagctaaacggacgggtttaaaagaggaacagtttatctatggctgcggatctgacgaaattattgcgttgattacgcgtgctttcctccttcccggggaagaaagcattatggccgatcagacattttccgtatacaaaagtaatgtggaaattgagggagcggttgcagttgaggtacctttgcgtgacggtgtacatgatttggatgctatgctgtctcacatcaatgaccgtacaaaaattatttggatctgtaatccaaataacccgacgggcacgattgtacccgaagcagagctgattgcgtttttggaccaagtaccaaagcacatcatggttgttctggatgaagcctacgccgagtttgtgacggatcgctcgtatcccgacggcattcgtttgttgccagcgtatgaaaacctggttgtactacgcaccttctccaaaatctatgggcttgcttcgctgcgcattggttatggtatgggagccgagtcaatcattcgcttgataaatcaggttcgtgagccgtttaatacatcacgggtagcgcaggctgcggccattgctgccttggaagatcaggaatttgttcaagaatgccgtgatcgtaatgcagagggcagagcttatttgcaaaatgagctcaagcgtctggggctggagtctttcccagcacatggtaattttattatgctggatgtacgtcgtccatccggtgagatattccaggagttgcttcgtaaaggtgtgattattcgcgcaggtcatcataaatatccgacatatattagggtgtcggttggatcacagccgcaaaatgagttgtttattcgtgtgctggaacaggtcctgggggcggaagcggcgaaagtacgcctataatttccgcagatgggatttgataattgatgaagattgccattttcggcgtgggactgattggtgggtccctcgcactttgttttaaagggaagccggatattactgttgtcggccatgcccatctccctgaattgatggaaccgatgttaagccgtggtgtcgtggacaccgcgactctttcggttgaagaagcggcagcggatgccgattttatttttttatgcgtacctgtgggcttattggagcattatctcgaactgttaagcaagctaccgcttaaaacgggttgtattattactgatgtaggcagcacgaaatcggcaattgccaaaaaagcatcagaaatttctttgcgcaacgcttactttatcggtggtcatccgatggctggttcggagcgttccggtgtaaaggctgcttccgcattgttatttgaaaacgcatattatgtgctttccccggcagagggtgtgcctgaggaagcatacagttcactggaacgtttattaaaatatactagtgctcatgttgtgcgtgtccaacctgatatgcatgatgatattgtcggtgcgattagccatcttccgcacattattgcagcggcgctggtgaatcaggtgcgaaagcacaatgatgaaaatccgttgtaccgtacattggctgcgggcgggttccgtgatattacacggatagcctctagtgatccggttgtgtggcgggacatcttactgagcaatcgtgaagttttactaggcctgttggaagaatggaacggacagattgagcgttttacccatttactgagaatacaagacggtgagggaatcgctgacgagtttttgacagctgggcacttccgcagtgaactgccagagcgtcgcaaaggagtcatcgtctccacgtttgatctgtatattgatgtaccggataccccagggattatcgggcgaattgctatggaactggggaatcacagcattaatctgagcaatatgcaaatcattgaaagccgggaggatgtcccaggcatcatgcggctttccttccgtcaagagcaggattgggagcgtgccaagactctgctggattcgatggggtataaagtggtggtgtgaagggtggagaaagtatgagtgttcgttaaggaggtacaccgctccgcgatccatttgatcttatgatcgctgttgcagggggattctctggactttttaaattatctaaaggtaagaatccccctgcaaaggcgaacgctacgcttctctagattcaaatggatcgctgcgctacggatcgccttaaaagtactatgctttctgggagtgaaataataggaaaagttttaaagcggatgaagaaactttcgcccgcttttttgttatttgaagaacaaatgagacaatccttctcactaattattattaaagaaaacaaaaaaagaccacccgggtaaagccccgggtggtagctacttttagtgaagtagctgagtaggataggagtggagagaaaccatactgtacttttattatatgtatacgttttcattttgtcaataatttttttgaagcgttttctttttgtgtttttttccttattgatgtatttgaatagaacattttcaatggggttgtcatttaatcttgaaaaaatttaaaatcccctgaaaagctgtataaatgaatcaggtaccagcgttagggaggcattgatagaaatcgtggggattttggacttttttactgacggacattttgtggtacaatgggtaagtccattttggatgttgaatattgttggggatagcaccgttaatgttggcactacatagggtaagaaaataacaaatgttccatgatgctgtttcatccatttgcgcagagggcgcaactttttttgacctgttcggtatatatagacagaatcgaacgggaaaacagcacatgtatgggcgaggagggtctcactcggatgatgacagattcccagatgattcaggaaatcaaacaaggtaatgttgaggtttattcagaattaatgaggcggcaccaacgtaaaattttagcttttgtttatcatatgctgaaaagttcgaacctggaaatgattgctgaggacttgtgctcagaaacgttttataaagcgtatcggagcctgcactcttttcgcgaggtagacgcatcgttttccacttggttatatacgattgcacgcaatacggtgctaagtgagcttcgcaagcaccgtagcggtcaggttccattggaggagagcggttatgtaccggtagctccatcggatgtcattccggagcaggccgtccttcgcggtgagaaggtagagatggtgcgtgaagcgatcaatagattgcctgagaagcagcgatctgcgctgattttgcgtgaatatgagcaattggattatcaggagattgcgactattttaggacagacggtcagtgcggtgaagtcattgcttttccgggcaagatccagtgtgaagacgcagttggagccttatttttttgagcctctctatgaggaaaacgaagggatgagcagccaatgaaatccagggacactgaggatttgttcgctacaggcaaaaatgtatcgaaacaagactcggagcgcagacgggccaaaagctcgtctgctgggtgggagcatggttcggaagaaaaagagtggaatttgtcaaaagaaaatcggtccgatattcgtgatatttcctttgaaataacagatgaaaagctagaggcaatgaatcgcagagtcatggatcgaatttatgaagaatcaccgtggcttgttccgggcgagcatcgacgtgcgcgtgtgaacccagcagcccgtaagtatatgtctgtatggatcgccggcttcttggccgtatttttatgtagcttcttgtttttgaactggaacggaagctcctctcaggaaaatccccctcaagcagctcctgtcatggacacaggtattttaccgacaggcctgttgaaaactacaagtacatctccacaatatcaataccacattaaagatgtgaatagtggcattatggacccgctggttgctagcattgttcctacttatccgcaatactggatgttgttgtctgtattggcacttgcgcttgctttattttctctgggctggatccatcgggcgagaagggtcagaaattagcaggacagctgggctccaatatgaattcataacaatgcctgaataacaaaacagcggaggaaacgacacgatgcttattggcttgatcagacatggattgacggattggaatgcggtagggaaaatccagggtcacagtgatattcccttgaatgaggaagggcgtcggcaggcacgcttgctggcagaacgattaaaggaagaaccttatcattgggacgggcttattacaagtagtctctccagagcgaaagagactggggagattattgcttctgctctgcatctcccgttgttagagcctgatgatcggctaagagaacgtgcttatggtcaggtcgagggcatgacccaggccgagcgtgaagagaagtggggagtcgactggcatctgctggatctagggcaggaaagcgatgcggatcttcagcttcgcgggctagcttttatggaagccatttggacggaaaatcgggacaagaatctgctggtcgtttcccacggcggttttttggctaatttgtataaggctctgtatcaggaaaaattcacggaacgaatcggcaatttgtcacttagtgtactccagcgtgaggatatggattgggcaccacttttgtataattgcacgaagcatttgcaagagaaaagtgactgtaactcaaaaagttagtaaaagaccaaggcttctacttatcgtaggagtcgtggtcttttttgttttttaattatacctttgcaaaaaaagaggtttagagtctgaacaatccgtcaaagctgtgggtacaacaggtaagaatcaattccggatgacagtccagtgacgaggcgatggaacaatgaatctggcggatatgctgacatttgcggatattgtgcatttgaacagaatcgcggtgtattacgattgtgactgtaaacctaattccaaacatgagttgatccaggggattttgacgaagctcggcagcagtagtttttttgagacgcaggtcaaggagcttaggttgtcagaggtaaggtttttgaacgcgttgctgttcgatgaccgaccgtatttcagcatggaggaattgattgcaatagccaaacagtctgttgaggaggacgagaatcctggtgagcggccaagggatattgtgacccgtctgcgttctagtggctggttgttcaacggttcgacgcacaataccaggtatttgttccaaattccgttggatatgaaggagcgctttcgacgtgttatggtacatgacttccaaaacggaatgacccgggtaagcgaaccgtcgtcgtaccgggatgaagggcatctgctggcagaggatttacggcttttccttcaatacatggggcagcatgaggttccgctaaatcccgagggagcttggtatcgtcgcaatcagcagcagctgatggaacatttgcacattgcggagccgcttttgggtaagggaggatggcgtttcgggtatggctcctcttttaagttttatccagaccgaatggcactactatatgattatgcccgtcactccaagtacattgaggagaaaggggaccaagttgtgctgacggcaaagggagaagcgcatcaggagcatacaattgaggaagaaatgatacagctattcaggttttggttaagattgtataaaggagccgttcctaatttgctgtctctagtctactggattggagaatgtgccaggccctggacgtcctcagagtcgctttttgtacatattggcccactgattcgaccgttttactatgatacgccccgttcggtctttgatcagaggattatacgaatgatgcttcacttgggtatgcttcgtcagggtgaacattcgacgggaccatctgtacagatgacggcctgggggctgaagttggcgggagagtgccgcattggtcggaacgactcgggtatacggctccattgacaagcagcacacatgttgatagaatttcacccaaaatgagagggtgaagttgttgctgattcactataacggaaacatgccacagctccattcatctgtctatatggcagaaggagcaaaaattgtcggaaaagtaacgatcggtcaagattcctctgtatggtttaatgccgtactgcgcggagatatggcgcctatcatcatcggtgaacgctgcaatattcaggacggtgtcgtgggacatgtgaacacggatcagcccctgttgctggcggatgatatttcggtaggtcatgctgcaataatccacggttgtacggtaggcaaaggcactttaatcggtatgggggccattgtactcaacggagcggagcttggtgaatatgctttaataggagcagggtcggtcgttacggaaaataccaaaataccaccctatactctttctctcggtacacctgccaaagtggtgcgcgaattgacagatgcagatttgcagcggatgtcacgaacggcactcagctatgtggcgaaaggaaaagaatataggatctcttaaactcatgttggaggtgcatcctatggataaaatgaaggttacttatgaagtaatgttgggcctgtctgctgaaatggttttggacgaggcattacgtaaacaccggagtgaaaaactctacaaggatattgatgaggcgctagcctccggagatgaagtagcttttcgtcatcttacggatgagctgaaagcaatgagttagaacaatcttaggaatcctgagttggatttcagacgaatctttagttcaagattataatcatcaaacctgactgtagcggcggtcaggtttttttgatacgcttggatatgatatagtctttgtaggatgggacctgtacaaggcaactgtcgtatgaacggaggatgaaggacgtgtcgttatcttatttgtggagccggtcgttcttgacgagccggccttttttgtggctgctgttctggtgtaatctggttggaacggtgtatgggtacatatggtatggggggcagttggaatatacactaaattatcacccaatgtggcagattgtatttgtgcctgatagtccgacggcgagtctgttttttacgatctctatagcatttttgctctattctccgcgtctcaagagcttgaaggtcattcgccagatcatcgaggcattggctgttgtcacgagtgtaaaatatggcatctgggcttcagctattattttttggggagttgcgcaggggggacatatgatatggcaggattggatgctggtggcatctcacacggcaatggcggtcgaagcactgctgttcgtgcgttttttcacctgcaaatggactgctttatgcctagccgcactctggacattgttaaatgatacgatggattatacatttggtatatatccgtatcttccaaagacgctaacggatgatgtaccacaagtgcgtgcttttacctatatgctgacccttgtcagtattatagcggcatggcttgccatgtttgcgcgcaatcgagtgggagtggaagtggagaaatagagatgaacattgttataaaccaaaaagaatatatatttaaaaaaggaaccgtgattatcataaaataagaaagaactttaatcatttagccaaacaaagttttggttttgattttgaagcttggtatcaattgggcttttggaatgataaatatatcccttacgtacggcagggcaactgtgatgctatgtatttgttcgcaatgatagtgtgaagaatttttacactaaattcgggtttgtttcagcacaagaatatcaattgaaccggaaagtaatcataaaccacttggacattaaagttgagaaattgaatctggaagagcagtcggatttaaagttactgaaaaataaaagtgctagattaaatccgtattcactttttgctgcggaaaatagtgaatggctggtcttattctatgcatctctttttttaaagataattttatgtatatacctcaatatgacacgattgtggttgcagattttgagggggataccatttgtcttaaagcaagttctagtctcggtaaccttgccatacagtaaggtgaggagggatgtcccatgattaggggtcaggcgttgcaaattatgatacgtattgtttcgagtgttgttttatctatggtcctgctgctgtccgtctgcgtccctccaggtgtggcagaagcgcgtgatcagtcaaaacccgtaggaaatacaaaagagattgaggaactggatcatgcagctgcgatactgtaccgagatgtgatggacgggaacattgaaaaagcgcgcgcggatgtagccgaagtgagtcgatggtttggcactggacaggtgcaggcagcgttatctgtagaggccattcatgctttgtccggcagcatccttgaggtgcagcaagctacacagtccgtccaagcatcaccggatgaatgggtgaaggctgcggccaatttacgacttgcgacagatgcgcttgcacatccgcgtcagcccttatggcagcagtattataagattttaaaagaagatgttagtggcttgaacagccagtttgctaaaggcaacatgaagggtttcaaagctggagccgcagtgctggaggaccactatgagacgatccgtacagcagcattgattcatggcagaacaagtgaagttgtccgggctgattcatggatttcctacgtcaaaggattgggagatcagcaaaatgcagatgcctcagcgattagaggggcgttggatcagggaaatccgacgtttaatgccctgtttggacgtgaaaaagacgccactgccctggcgccatttatcccgcgtgaaagtgagcgccgggcagaattggcaatcggcatgattgtcctgctggcgttggtctatgcaggttatcgtaaatatcgagctggtttctctggataacgatgcaaaattcgaatattcgcgtcgttggctgctgagccatccatataggttagcccatcgcccggatttccgggctattcctctttgaacccctctccatgtacatcatgcacatcctgtatgataataaacgcccgtggatcaaccgatttaacaatttggtgcaaacgtcgtatttcctgacgaggcacgacacaataggcaacatgcttggcctgcttggaaaatgcacctacagccggaataatagtaactccacgatccatgtccctaataataatatccgcaatgtccatcgtctggtcgctgataatcataaaggctctggcagaataggccccttcttgtataaaatcaataattttggacgcgatgaacacggcgactaatgtatatagaattttttcttttggtatgtaaagtagtgaagcaccgataatgacgatatcaatgaccagcagaatccttcccatactccagccaaacttccggtttagaatacgagcgattatatccgagccgcccgtggtgccgccaaagcggaacacaatacctaatccggccccaagcgtaacccccgcatataatgaagaaagtataaaatcgtgttcagtttgaaatgttcccatccatccgaaatgaatcattttttcatacaaccacagaaaaaaagtgagcgacccgatacccacccctgtatatagaatttgcttgcccccaagcattttccacccaattaaaaataaaggaatgttcagcaacaatgtggagagagagggtgaaatcgaaaaagcataattgagcagcagggtgatccctgtaataccaccttccatcagtttactgggtattataaaataaagcagaccgaatgcatagatggcggtcccgagcacaatgggtaaaatcagtttaagctgttccatggacttggatatcttcatatgatccctcgcagtagcagtttaaggaagaacgacttcatgctgattttgctaaatcgcagttccttatatgtagtatacctttttacgctatctttaaaagactgatgactgtaagttgggatcataagtacacaattaaaaaaaatttgttttaaaatgtgctttacgataacatatgaataaacctgcacatggggggattgcgtgtttcatggaaaaatcattagatgaaattcaacgtgaggtagaccagtatatatctcaatttaaggaagggtattttagccctttggcgatgttggcccggatgtctgaggaagtcggggaactggcgagggaagtcaatcactcctttggcgagaaaccgaaaaaaacggatgaggcggacaattcgattgagctggagctgggggacattttgttcatcacagtttgctttgcgaactcgctaggtataaatttgaccgaggctcatgataaggtcatgcaaaaatttaacacgcgtgacgcgaatcgctggaccaaaaaggacaccgattaggcgttttgtacatatgctgtaccaaaccggttacccggaggtgcagtgtcatgaaggcggaggaatacgttcagaaagcttatcagtgcattttgcagaacgattttgagcaggccgtggaatggtttgaaaaagcaatttcagcccagcctgatcatgcggagcattatttccggtgctcggttacctatgctcgtagtggtcgtttggagcaggctctcgcgtatgcagagcatgcggttcgtctcgctccacagcaggatgaatatgttctccatctgcatgcgcaggaagccaggcagcatacggagaaggccagaaaaatgctggatgtcgacagagctacgccacaggtgcgtcaggatgcgattttgctattggaacgagcaatagccctcgatccgttatgtggggatgcttttttgctgctcgcattgatttatgatgaattgaatgagtataagctagctgtgcaggctgctcgcgaggcggctgcactgtttcctcacaatgtgcagcttgccaacctcatgaagaagttatgccagcagatgaatgaacagatctaacacaaatggatgcataaggagttgtagggatatgtcagaaccaataaaagtggctgttgtaggagcagcagggcgtatgggccgtgaagttgtcaaattggttcttcaggatgaggaactacagcttgtggccgcagtgaacagaacacatgccggcagtgatgccggccttctcgtcggattaccggaagcgggtatcgctattgtggaggacgtggagcaggctttactggatagtcgagcggatgtcatggtcgattttacggggccgcgttttgcgtacgcacatacagcgattgctatcaagtatggagtacgtccggttatcggaacgacagggtttacccccgaacagattaatgaactggacaagcagtgtcgtgagcagcaaattggtggtctgatcgcgccgaacttttcgattggagtcattttgatgatgcggtttgcggctcaggcagcgaaatacttcccgcatctggaaatcatcgaatatcatggtgaccaaaaattggacgcgccatcgggcacagccattaagaccgcagagctgatcgccgaacagcgtgaagagctacgacagggtaacccggaagaggaagaaacgttagaaggatcacggggggggtactatcaagggttccgtgttcacagtgtccgtcttcccggtgtgttcgcacagcaagaagtaatcttcggagggtttggacaatctctgaaaattcgtcaggattcttatgaacgagcgggctatatgccgggtgttaaaatcggtattcagaaggtcatggagcagccagggcttgtgtatggatttgagcattacatcgattaagaatacgcgaatgatttgacgaacgaaattatagaatgaggcaggaggaactttgaatgttaaagattgcatttatagcgcatgaccgaaaaaaggatgaaatggtaaatttcataacggcctatgagcatgtttttacagatcaccagttattttcaacaggtacaacaggtctgcgcattatggagcaaaccaagcttcaaattcaccgtttcatgtccggtccgcttggaggagatcagcaaatcggggctatggttgcacaaaatgacatggacttgattatatttttgcgtgatccgcttatggcccagccgcatgaaccggatattagcgccctgttacgtctgtgtgatgtacaagggattcctctggcaaccaacgttgcaactgctgaaatactggttaaggcgctagaccgtggcgattttgcttggcgtgagctggtacataaatataaaccggggattgaccagcaaggtgatataaaatgacactggacatcttaattttcggagcccatgccgacgatgcagaaataggaatgggaggcacgattgccaagcatacagccgctggtttaaaggtgggcgtttgcgatttgacgtgggctgaaatgtcatctaatggtgatgtggatactcgtatggcagaggcagaacacgctgcaaaagtactcggacttgccgtgcggacgaatctaggtctgccggatcgtggattatatgtaactccagaacatgtagctgcagttacagcagaaatacggcgccatgcaccgaaagtcgtatttgctccttattgggaggatcggcatccagaccatgtcatgtgcagtaagttagtggaggaagcggtatttaacgccaagttgcgacgttttatgccagaaaatcctgcggtacaggtagagcaattatatttttattttattaatgatattggcagaacggatttgattgtggatatcaccgagcattatgaagccaaagaacggtctttgttgagttatgcttcgcaatttcaggcagcacctggaaaggatacagtatccacacccttaaatcagggatatgtggaacgcgtaaaagctcgcgactcgttgttgggtcaacgcaaactgatttcgtatgcagaaggctttgcgtccaaaacgccatatctggttaagctattcacataagaattctatacttgagcattttgcagaatgttaaaataaatcggcaggaaagttatcactgatgagcggaaggaggcagcttagcttgaatgacaaattgaaaattggaattacctgttatccgtcgttgggtggctccggcgtagtggctactgagttgggtaagttgctggcagaaaaagggcatgaggtccatttcattgccaatagcattccgttcagattaggcggggcgtttcagaaaaatattttttatcatgaggttgaagttaacgattattacgtgtttagatatccaccctatgatttgtcactggcgaccaaaatggcccaagtcgcacaaatgaagaatttggacgtactccatgttcattatgcggtaccccatgcagtatgcgcttacttggcgaaggaaatggtgggtgatcatctgaaggtggtaaccaccttgcacggtacggacattacagtgttggcacaggatgagtcgttgaaggacctgattcggctggctattaacaaaagtgacgctgtgacagcggtttccaaggatttgattcgggagacgatagatgcgttggaaattacacgacctattgatttaacctacaattttgtagataaacgggtatattatccacgagatgccgcggcgcttagaagagattttgcccaaccgcatgaaaaaataatgatgcatatttccaatttccgtcctgtcaaaagggtgggagatgtgctggatatatttgaaaaagtgcaacgtaaagtacctgcgaagctgctgttggtgggagaaggaccggatcttccaaaaatccgttgcaaaatcgagaatttaggtctgcaagataaggtcttctttttaggtaagcaggatcagatcgcagaagtgatttctatggcggatgtgctgctgcttccctcggaaaaagaaagttttggtctggttgcactggaagcaatggcctgtggagtgccgacaatcggttctcaggcagggggagtacctgaactcgttgtgcatggaagtacggggtatcttgctgaaatcggtaatactgaggcaatggctgattatgcagtagagctgttgtccgatgaagcgatggcggaacgtttccgtgaagcgtgtctgacccgcgcccgtaccgttttttgtgatgagctgattacccgtcaatatgaagagatatattaccgtgtgttgggacgcgaggtgccggatcttaaaccgatcagcgtttaagagggcggactcgcgtccgttttttatattgaatacttgcaaagggggaaaccctatgaatacaaatacttggcaatatgctgaccaagagatggcatttcatggcagagaggtcatacatacactaaccgcagcaggccacgaagcctactgggtcggtggctgtgtgcgggatgagctattaggaagagccattcatgatatggacttgactacttcggctgagcctgaacaggtcatagcgctattccctcacgtcattccgacaggaattcagcatgggacggttacggtcatgcagggtggccatgcgttcgaggtaaccacttttcgtacggaaagtggatatgccgatcaccgccgtccaacggaagttgccttcgtaaaggatatccgtgaggatctgatgcgacgggattttactatgaatgcgattgcgatggcagaacacggagagcgggtggacccatttggaggagaagccgatttacgagccgctctcgttcgttgtgtaggccgagccgaggaacgttttgaagaggacgggttacgaatgctgcgatgcatccgttttgcctctgtgtttcggttccgtgttgcttacaacacctggaaaggcatgattcggcgcaaagagggacttcgttacatagccatggaacgtgtgcgggtcgagctggaaaagatgctagcgggccctgaccctttacgtgggttggagatgctgagccgtagcggattgctcggttgtacgaaggttccggttccttgggaacaatgtgaagcatgggcgctcaaggggatcgttcaactgcaagaagaactgcggtggggcctgctcttaatgtcttgtagacttacctcagaggcagcggacgagctactaagagcttggaccttttccaacgcggtacgacttcggctggttcatctgctggaatgggagaccgaattaatctacagtgctggtgccatagctggcgattccgatccgggggagtctggcattgtcaacgatgaggcactgcgtcgtagctggattcgactgctaattagactgggaaaagatacagctttagactggcttgatctttacaagatactgcctgcttcattccgcggattaccgccgtgggtagaaaagcatgtggcgaaaacagccgaactggcaagctcgtggacaaagcaggctgtagtcgttcgtatcaaagatttaaatattacaggaaatgaactggttcaggcgatgaatcgaccaggcggaccttggctgggtcagataatggaacagcttttacaagctgttgcctgcggagatattccgaatgaaacagaaacattgcttcaggaagcgaaacgggtgatgagtagtgaataatcatgaaagattgttaggcatactggaggaaggtacatccgattacgtatcaggggaggaaatcagccgccgcctctcggttagccgaacagcagtatggaagcagatcaacaaactgcgtgagttgggctacaacattgatgcctcctcgcgtcgaggctatcggttgatatcccgaccggatcggctagaagtctccaaattggccgatatgttaaatacccaatcgtttggccagcgtatcgttgtactggattcgacggtatccactcagcaggatgccatgcgtttggcagaagagggcgcgccagaggggacagtagtgcttgcagaggaacaaacggcaggtcggggacgtttgggacgaaagtggtattcacctcgtggtaaaggagtctggatgagcattgtgttgcgccctacccagcccttggcttttacccctcagctaacgcttcttacaggtgtagcagtgtgtagggccattcgtcggctgacgggtgtggaggctggtatcaaatggccaaacgatctgctgattcatggtcgcaaagtatccggtattctgctggaatctgcaacagaggatcaacgggttcgatactgtattgcagggattggcattgatgtgaatttaaataaagaagattacccggaagagttatcgcaggtgggaacgtccttgaaaatagaagcagagcgtgaaattgaccgtactgtgctgatcgcctcagtgctggaagagatggaacagctaagtaagttgtatgccgagcaggggttccagcctatagccatgctgtgggaggctttgtccgtgactatgaaccgtagcgtacgggcacataccggacaagggataactgtagaaggtacagctgttggcttggatccttccggggcactcgtggtagatacggatcagggagagcgaattcaggtcatttcaggggatatacaattgtagaagcgaccctagctatgaaaacgaccgaaatcgttctattccctgtgcaaaacttcacgtgaaaaagctgatgctttttgttatactgtgcaggaggcggcatcggacggtccgagctgcactccaggggcacatgctctactttagcaagtttgtaagaccatcataacttcatttgaaggttacgttggattctgctctgagccgaacaggaccgagacagaagggacgatctcaaaatgagtgtcttttttggctgttcggaccttttgatgacgcagatgtacaggcgttcataaaaggttattttttgtgccaaaaaaagatggaagggagccattcgcaatggcaggaaaacaagcactgaatattgtgaaaatgaaaaaaatgaagcaagagggcattccgctcagtatgctgaccgcctatgattatccatcggctaaaatagctgaggaggcgggaattgacatgattctcgtaggtgactcgctgggtaacgtagttcttggttacgattcaaccatccctgtaaccttggatgatatcgtataccattcccgggcagtcgcaagaggcgcggaacatacatttattgtagcggacatgccttttatgacatatcacagcagcgtatcagaaagtcttcagggcatccgccgtctgatgcaggaaggacatgtgcatgctgttaaattggagggcggagctgaaattgctgatgttgtaaaagcaactgttcaggcaggtgtgcctgtattgggacatatcgggcttactccgcaatcggttaatcaaattggcggctatcgcattcaaggcaaggacgaagcggacgcacgccggttaatggcggacgccaaggcgctggagcaggcgggtgcttttggcattgtattggaactggtaactgaggaagtggcaacagcgatttctaaagagctttccattccaaccattggaattggtgcgggacgtggatgtgacggtcaggtactcgtttatcacgatctgattcagtacgcatcgccttatttcagcaaacgctttgttaaaacctatgccgatgtaggtggcttgatccgcagcagcattgagcaatatgtgagtgatgtgaaagggcgggcatttccggccgcagagcatgtgttcagcgcggatgaccgcgttgtggaatccctgtacggtaaggcaaaaggacagacacagggacaagctaaggaaaaggtggaatctcgatcatgatcatcgtaagagaagtggctcagctgcggaaggttattgctgaacgtcggcagcttgggacaagcggaacaaaaaaggaacacggttctacctctttacagcaacataaagtcggctttgtaccaacaatgggatacctgcatgaagggcatgcgagcttgatgcacaaggcgcgtgaaatggcggatacggtggtgcttagcattttcgtaaatccgattcaatttggaccaaatgaagatctggacagctacccccgcgatgaagctcgagacttggaggtagcacggcgcgagggtgtggatattgtatttttgccaactgtagcagaaatgtatccacaaccaacccaaaccaaaattcgagtatccgctttgacagatcgtttgtgcggtgcttcccgtcccggccattttgatggtgtgactacggtggtagccaagctttttaacatgataggtcctgatttggctttctttggaatgaaggacgcgcagcaggttgctgtgctccagcagatggtgactgatctcaatatgaacgtgactatcgtaccttgtcccatcgtcagagaggcggatggtttggccctcagctcccgtaatgtgtatttaagtgcagaacagcgcgagcaggcgttggtgctgtctcagtcactgcgtaaggtgcaagaagtgagcgaagatatagtaacaaacacaattacgattcgtcagctacatcaattggtggagtccaccattacttcctctcctttagcagacattgattacattgaaatattaacttttcctggtctggagccccttcttcccgagcagcggctatgtgatgttcaggaagaagtcatcgtagcgctggctgtgaaatttggcaatacccgactgattgacaatataagaatacaaaaggcggaggtgctttcccatgtttagaacgatgatgaaatccaaaattcaccgcgctacggttacagaagctaacctgaactatgtggggagtatcactattgatgaagatctcatggagacatcggatttgttggagaatgaaaaggttcaaattgtaaacaataacaatggagctcgactggaaacctatgttatccccggaccgcgtgggagcggcgtaatctgtctcaatggtgcggcagcccgtttggtgcagcctggtgatacagtcattattatttcctatgcttccatgtcgaatgaagaggccaaaacatacaaaccaacagtggtatttgttgatgaacataataaaccagcccaaacgatgaacaaagaagtacacgcgacgatcatgtaatgaatgggagtgcggatgaaacccgtcttttaagcgaaaaatgtgagtgtattaatccatctttcataagggcgggatgcacatgttccagcatgtattcgcagaaatgaacagcatgttagatgatatcgtgaagcattacccatcagcccagggctcccgcaggcaggagctgctacagcactggagtctgctgcggagaatgagtgacggaattatggatgagtggctggcctttgaggaaaaaatggtttgcctgcgtgcggccgggttttccgcggagaccgatatgtctgacacggagctgcctgaaaaagagctgccagcttttaatcgggggcaagggtattatcgattactcatgtaccctgaggcgatccaacaatttgagcaggtactacagcattttccgaacagctggcagagtcgcatgtatatgggaatggcctattttcaactagatgatccagcagaggctgtatgccattttcagaaggtgctggacctgactgagcaggcaggactgaaggcggtcatctataatgcgctaggctgtctgttggcaaagcaggctgacgtagaggaggcgcaaaaatgttttgctctcgcacatcagttcgatcctgcgttacccgagccgctgcacaatatggaagcctgtctgtccggtaccgaaaagcttcgatacgacagctccatgatgacctggatgtagttgtcagacaccgagcaagacgatgcatgcccacctctcaggcggcgtgtgcatcgtcttttttggctgtcttaatttccaaacaggcgatcttctgctatgctaatatacagagttattatttttgtaagtgtcataagaaaggattagcccgaatgaaatttgcggtattggattttgaaacgacaggcacccagtccgcggatgacatcattcaagtcggacttgcaattatagatcatgataacagcatttcccgtgtttacggctcttatgtaaaccctggcagatctattcccccttttatcaccgggttgaccggaattacagacgatgacgtcaaggatgctcctgcacttgaagaaatgatgatggagctcgtgcctatgctggacgatgttgtactggtcggtcataatgtggcgtttgattttaattttttgcaaaacgctctggatcggtgcggatatttgccgtttagcggaagaatcttggatacaatggattttctgaaaattatgtttccatcgctatcttcgtatcagttgggttttgtgtcttctgagtttgggctggcgcatgatcgccctcaccaagcagacagcgacgcgttggctacggctgaggtgtttttaaagtgtctgggtgagcttcaagcattacctttgataaccatacagcggcttagcgatttgtttgcagaggaagacagtgaccttggatggtttcttgatggggtgcgtgaagagaaagagcttgatcctattcaggatctggaggggcatcagttttttcgtcagcttgcgctaaaagtggaagattggacggagctagctgctccgcgtagagaagatgacccgaatccactgtcaggtgtttcctttgaggagtacatggatgatgtgcgggacaatttgcgttcatccttgagccaatatgaggagcgcgaggcgcagatacagatgattgagggtgtaaatcaggcactgagtgaagacaagcatctgctgatcgaagcaggtacaggaacagggaagtccctcggctatttgctcccatcgctgtatcacagtgtgaaaaaaggacagcgagttatggtaagtacacatacgatcaacctgcaggagcaattacgcgagcgtgacattcctatgctgaccaaggtgattccgtttccgttccgggctgctattttcaagggtcggggacattatttgtgtctgcgtaagtttgaacataaaataaacagaagagacttcgcgacaccgaaggaagatttaattacagctgctcagatgatcgtctggttgacgctaacagaaaccggtgatgatgaagaactgaatctgagcaaccgtggtggagatttctgggaaacggtggcgagtgattcagagtcctgtcttggtcgttcttgcccatggttccgcaaatgctattatcatcgtgcacgccatgaagcagggatagcggatgttgttattacgaatcactctaagttgtttacagacgtcaaagctagtcaccaattgttgccgagctatgaacatctggtgattgatgaagcccatcacctggaggaagtagctggtaagcacctaggtatgcatatgaaatatttcacactcgtgcatacactgacgcgactgttcaaagacagcaagaatggacaactgccttcacttcgtcaacagttggcgaaatcggggcacgagaagtcgacggattgggcctcaaccatcgatcagatgtatccgctcgtgttagaggttaaggaaacttgggacctgctaagcgacaagctgtttggcatgttgccagaacgaagcgatgcgacaccaggtgaaacaggacagttttcttcccgtctcaaaccttcagccaagcctgcaaagtgggatcaggcgggggctttggaaaatcagctatatgtaacgatgagtgaaattttgcgcaagggtgacaagctgatgctggacgtcaaggaagaacatgacgattatgcggcggatagccttattacagatatcacgggtctgctcaaggatctggcggggattcgagaaaatttgcgcttttttatgcgactcgatgatgaaacaaccgtatactggctcgaagcgagtgggcaattccgcagtaaatcattacaattttatgcggtgcccgtcgatgtgagccgccagttgaaagaaatgttttttgacaaaaaaagaagcattattctgacgtctgctaccttatcggtagataagtcgtttcagtacatgatcgatcagctcggcttgcaggaagccgcagatcaagagcggctgatgacttcgcagctcccgtcaccctttaattacagggatcaggtgctgctggtcattccacgggatttcccaagcgtgaagggcagtgtaggagatgcacactttgtagatatgctcgttagctctctaggagcgactgctcaggcgacgcgggggagaatgctcgttctgtttacttcctatcggatgctccggcaagtgtatgagccgctcaaagaggccttagcatccagcgaaattactgtgctgggacaaggtgtggacagtgggagtcgcagcaagctaacccgccgttttcaggaagccaaagcttctgtattgctgggaaccagcagcttctgggaaggcgtcgatattccggggaaggctctgacttgtctggccattgttcgcttgccatttcaaccgccgaatcacccgttgctggaggcaaaaagcgagctgctccagcagcagaagaagaatccatttatgaagctgtctgtaccacaagcggtcattcgcttcaaacagggatttggtcggttggttcgtacagcgagcgaccacggggtcgttatcgtttacgatacgcgtgtgatcgaatcctattacggaaagcactttttgtactcgttaccgggaccaaaaatggagcatatgccatcggagcaaatggtgccccgcatcgccgaatggctccaatccgccccggagaccgaggcataacggacggacactaagtatgttcgttacaattagggggagcaagtatgaaatcagataaaatttcagaggctgtcgtacggaggttacccgtatatttacgttatctgaatgcacttcacaaacgggaggtggctacggtctcttctcaagagttgggacagaggctagatttgaacccggcccaaatccgtaaagatctcgcctattttggagattttggtcggaagggtatcggttatgatgtttcttatctaattgagaaaatacgccatatcctgaaaatcgatcagcaaattaatgtagtattggtcggagcgggtaatctggggcaagccctttcgaattataacgcttatttaaaagacaatatgaagattgtagcggtatttgatgcgtttccggataaggtagggaccaagatcaatacattggtcgtgcaaccgatggatgaactggaagcgactgtgagagaaaaaaacattcgaatcgggattattaccgtacctgattttgaagcacagcacgtggctgacaggcttattgagagcggaattggagcgatcctgaactttgcaccgactactctcaaggcaccggccaacattcggattcatgccacagactttacaactgatttgcttagcctcgcttattatttggaggacggaaaggaagaaacacaatatgacagtgaataaatggatgattaaaaacggctcttttgccgtaaatggaccagaagctggggtaatccatggttttatgattgtggaagatagccgcattacttacattggcgagactttgccttcgggtgaggaagagacggaagcgatcgatggtaaggggcttttgtttttacctggtctgattaatactcatggtcatgcggcgatgtctctgctgcgtgggcatggagatgacttggcacttcaagtatggcttcaggaaaaaatgtggcctatggaagccaagtttacatctacggacgtgtactggggtacgtcgttgtctgtgctggaaatgctgaaaggtggaacaacgaccttcctggacatgtacgatcatatggatgaggtggctcgtgtggctgaagagtcaggtattcgtgcaagtctgatgcgtggagcaattggactatgttcggaggaagaacagcgaatcaagctggctgaggccgtgacttttgcgcgtaactggcatggtaaagcagacgggcgtattacaacgatgatgtcaccgcatgcgccatacacctgtccacctgcgtttattgaaaaattcgtacaagctgcgcatgatctggatttgccgctgcatacgcacatgtctgagacgatcgccgaagtggagcaaaacgtacgtgactacggtttgcgtccagttgcacacttggataagcttggctttttctcccgtccttcgcttgttgcccatggcgttcatttgaatgacgaagaaatagctttactggctgaacgtggtgtagcggtttcgcacaacccaggtagcaacttgaagctggcaagtggtgtggcaagagtgcctgaattgctgcgtgcaggggttaccgtttctctcggaacggatggtcctgccagtaataataacctggatatgttcgaggaaatgcgtctggcagcacttattcacaagggtgtatctggtgaccctacggcagttcctgcgagtgaagcgctgcgtctggcaacagaatacggtgcaaagtcaattggtttaaaagaagtaggagcgttggcagcaggcaacaaggctgactttatcgcgctggatctgaatcaggcacatttcttgccacgtacagatcttatttcccatgcggtatactcagcaagcgccaaagacgtggttcacgtatgggtagacggtcgtcaggttgtgaaaaacggcgaatgcctgactatggacgaggaacgcatcaaacatgaggcacaagccgcctttgaagggctgctgtcgcgctaattcaggtgtcacatccccttagagaggaagcacgggtttgaaaaataagaaaaagtggatagcggtcgccattttggccgtaatactgatcctggtcagcattttctggtattattcctatgttactcaagaccaggtggctgagaaaaatgccgctatcatcaaggccaagcaatcaggtggtctggttagcacgactcaaacatggaagtctgtgtgggatcaggtatattgggtggttcaagggaaaaatgcacagaatgaaaatataatggtgtgggttccttttcaaaaagtggaaggacaacctaacgtacctgccgcagataatagcggtgttcacaccgaactgctgaagaatggagtcgatgagcaaaaaatgacggcaataattcagcagcagcttccaggtgtaaaaattgtaaggcttcagccgagtgtgttcaatggcgaatatgtgtggcagttgttttacgatgatggaagtcatcattactacagcttttatcgtttctcagatggggtagcgacgggtgtaaaatatactttgcccaataactagctggttgaggattagcagatgtggaatgaatgactagtaaataattgaaagcttaagaaaaagacgtaaatgcgatgaaattcgtatttacgtcttttagtcttgctatgccgtaaagtgggctgaaaaccagtgaagcatctttacctatccatcttctctcctagggcaaattcatctttatggcgggcagcacggagtggaggatttgaatttggagaagaggagcgttcgcaattgccgccggatttaagaatataatcgagaaaaatcggatggcaacagcgatcgtaagatcaaatcctacgctcagcgtctcgcctccaccttaaccaaagattttgcctcatcacaactcctccacacattgccttcgatattagatatacgttatgatatactatattttataagtgatagacaaaaatgatagaaaaaagaattgctgatcggtgtaagatcatgcaatttggttgtttgttgacattcgtcccgtttcttctgggttttacattttgagaggaggatgttgtttgaaattgcgtgcagttcctatcgttgtggcggcagttttggcagctttgctgctatttgggggatggttcatttaccgtcaggttacaatgcaaagccctctggaaaaactggtttctcaatatccaggcgtgacaagcgctcaaatagatattaaacaggatcaggttgtattgaaactagatctcaaaccgcaggcggatgtggccggattagtcgatgtggttaagcaaaaaggacaaaccatcattggcagccgtaccattaagctggatattgaagatcgttccaattcagcactgaatcaatggtggtctgaggctatgtttcctgtagccgaagcgatggaaaataaaaagtatactcaaatttcatctacagttgagcagatgaaaaagaaaaagacgggtatcaaagctgataccgacatggattcgaacaatgtctatatccgactcagcgaagggaaagcgaccaaatttatcgtattgccacgtcaatctcagcaaatgggggtatggcctaatgcctagatggatcaaggaaacattaatcggcatagtgccggtgactattatatttctcgtttttattggggtgaatattatccctcttctagttgctggcgtgatgctcagcggcttgttaatgctcatgcatgcacgtggtggcttggccgtaggtgctgggcaagaacgtaaacgcaaaaaaaatggtccggacaaactgacttttgaggaaatcggtgggcaggaaagcgctaaacaggagttgcgtgaggccctggactttttgaatcgacatgatgaaatttccaagtttggtatccgtccattaaaaggcgttctactcacaggccctccgggaacagggaaaacactgatggcgaaagcagccgcacactatactaattctgtatttgttgcagcctcaggtagtgaatttgttgaaatgtacgttggtgttggcgcgggtcgtgtccgtgagttgtttcgggaggcacgtactcgtgcagccaaggaaaagaaggaaaatgcgattatttttattgacgagatcgacgtaattggtggtaaacgtgagggtggacagcaacgagaatatgatcagactttgaatcagttgctgacagaaatggatggcatttattcggcagatacaccgcggattttgatcattgcagcaacaaaccgtaaagaaatgttggacagcgccttaacgcgtccaggacgttttgaccgtcatattcaagtggatttgcctgacaagaagggccgtcttcatattcttaaaattcatgccaaaaacaaaccgattcaggaagatgcgaatctggacaaaattgctgaggaatcttacgggttttccggcgcacagctggagagcgtgatgaatgaagcggcaatctatgcgatgagacaggatcagaaaatgattgcgcagaagcatctgtcgatggcaattgacaaagtaatgatgggtgaaaagacagatcgagaatcgacgttggaagagaaaaaacgtgtagcgattcatgaactgggacatgctattatggccgaaattgttcgtcccggtagcgtaagccaggtagcacttagcccacgtgggaaagcgcttggctatgtgcgccacaatccacagcaagagcattatttatacaccaagcagttcctggaggagcagatcatgatctcactcgcaggggctacggcggaagaaatgtactatggcggtcgcagtaccggctcaagtaatgattttgagcaggcgctgaatatcgtccatacgatgatgacttccggtttgacttcacttggcattattaacatggaaatggtaaccaaagaagaacttatgcgggaaaatggcgagattatggctgacctgcatacccgaactttggagttgctggaaaagcatcgtcctgtgttcgacaactcacttgacatcctgatgaaggaagaaactctgtctggagatcaatttagatgtcaatttagtgaaaatgctttattaccagcataattttttatgctggttatttttttttacttttagtccgtgctaagatattattatctattgggacataaacatgtatttttcgacaaagaaggatacaatatatgagagtgaccaggaaagggtggagtaaagaatcatgcaatttaaaaaaatcggcgtcatcggcggcggcaccatgggacaggggatttctgaaatgctcgcgtccaaaggaatcgatgtgctgctggtagagcagacaccagagaaactagactacgcctacaatatgattgaaacgagtctggacaaacaactggaaaagtgggcaattactcaagctgagaaaaaattgatcttatcccgtattcaaaaagtaatccatttggcggagctcggcagctgcgatatggtcattgagactattacagagaatctggacgagaagaaagcagtgttccaagagctagattatgtgtgtccaagcaatattattcttgcaagtaatacatccacgctgagcctgaccgagcttgctagctcgaccaagtatcctgagcgtgttattggtatgcactttatttatccagtatcccgtattgatcttgtagaaattattcgtggtttgaaaacttcggacgatacatttgaacacactaaaatgttcgtggaagaaatagtggagaaaaaaggagtcatgatttatgaatctcctggattcgtaacaagccggattatctgtctgctgattaacgaagcggcccatgtacttcaagagggcgtggcttccgctgaagatatcgatgacgctatgcgaatcggctatagtttccaaagcggtcctttggaaatggctgaccgctttggtctagattccgttttggctgctctggagcgtatgttccgtgaattcggcgaattgaaatatcgtccgtccatcgttctgaagaaaatggtgcgtgcaggtaatctgggcgtgaaatcgggcgaaggcttctttaagtacgacaaggatggtgaccggatatgaaaattctcgtaatcaatgcagggagttcttccctgaaataccaattgtatgatatgacggacgagtccgttctggcaaaaggattggtagagcgcatcggtatggattcctccattcttacgcataagccaaccaataaagaagaatacaccgaagttagcgaaattttggaacatactacagccatccgtaaagtgctaaacgcactcacagatgctgaacatggtgtaatctccagtactagtgaaattcaggctgtaggccaccgtgtggttcatggaggcgaaatcttcaaacagtcagcagttgtaacgcctgaagcgaagagtgaaatccgccgcttgtttgacctggcaccactgcataaccctgcttccatgatggggattaaagcggctgaattgaatatgccagatgtaccgcaggttgtggtatttgatacctcgttccatcaaaccatgcctgaaaaagcttatatgtacgccattccaagagtgttgtacaataagtataaggttcgtcgttacggtgcccacggcacttcccatgattttgtaagtaaggaagccgccaaattccttggtcgtcctttggaagacctgaagattatcacttgtcatatcggtaatggtggtagtgtaacagcagttcaaggcggtttgtctgttgatacttccatgggtatgaccccactggaaggtcttatgatgggtactcgtagtggtgatttggacccagcaatcgtaccttatgtcatgaacaaagaagagttgactgtcaatgaagtcaattccatgctgaacaagcatagtggacttttagctatttccggtatcagcagtgacatgcgtgaaatcacagaaggtatggaaaaaggcgaagctaattctacattggcattcgaaatgtatgaataccgtctgcgcaaatacattggatcgtatgctgccgcaatgaacggggtagacgtaattgcatttacagcaggtgtaggcgagaactccatcgttctgcgtaagagagtgttggagcaattgacattcctcggtatcgagctggatgaatcgttgaatgctattcgttctggcgagcctcgccggattacaactgcaaattcaaaggtagaagtactgatcattccaacgaacgaagaactggttattgcccgcgacacgttccgtctggttcagtagttcggttcgaaagtataaactttatgcatgcggacttacgtttgatttccgcatgcaccaaacagcgagagcaaacagcctgacccagggggaagggctgtttgattttcggttaagaggagagagacggtcatgacgaataaaagtacgattgcccaagtgggccgccatgtaggggaaacggttacaatcggcgcttgggtgaacaataaacgatctagtggtaaaattcagttcctgcaactgcgcgatggtagcgggtatattcaaggggttatcgtgaaaagcgaagtgtccgaggatatttggaatgacgccaaatccttgactcaagagagctccctttacgttactggagtggtgcgtgaagaaccgcgtagccaatcgggctttgaattaatggttacaggcattgaaattattcatttgaccgaaaactacccgattacacccaaagagcatggtgtagatttcctgatggatcatcgtcacttgtggctgcgttccgccaagcaacgtgctgttctgatcgtacgggcggaaattatccgtgcggtacaggaattctttaacggcaacggctttacgaaggtggacccacccattttgactccttcctctgcagaaggcacaacagaattgttccacattaaatattttgatgaagatgcgtatttgacacaaagcgggcagttgtatatggaagccgcggcaatggcgctgggcaaagtatattcctttggtccaactttccgtgcggaaaagtctaaaacacgtcgtcacctgattgagttctggatgatcgagcctgagatggcttttgtggatcatgaagaatccttgcgcgttcaggagcagtttgtaagtcatatcgtgcaatctgttctgaaaaattgtgcgaaggagcttgaaacaatcggacgcgatgtttcgaagctggagcaaatccaaggcgaattcccacgtattacgtatgatgaggcgattgccttccttcaaggtgaaggtttcgatattccatggggagaagactttggtgctcctcatgaaacggcgattgctgaaagatataacaagcctgtgttcattacacattggccgactcacattaaggcattctatatgaaaccagacccgacccgtccagaggttgttttgtgtgccgatatgatcgctcctgaaggctacggcgaaattatcgggggttcccaacggattgatgatccagcattgatggaagaacgttttaacgagcataacttggctcgtgaagcctaccaatggtatatggatctgcgcacctatggtaccgttccgcattccggctttggactgggcctggagcgtacagtagcatggatttgtggactcgatcatgtacgtgaaacgatcccgttcccacgtatgctgtatcgtttgtatccgtaaccgatgaccggatcattcgacaagacatcagcggcagaatgggcggagggagtagcctttgctatggaagccggaatggtccagattccctacgccctgctcaagcattatcggacacttcggctgacggatggtgaaatgctgctactgatgcagttgcttgcctttaaacaagcggaacgtaatgaatttccgacatgggaacaattgcagtcacgtattggatgcactgcgaacgaaatcgcactctatttcagtaagctcatgaaagaaggatttttgagaatcgattccgtggaagaccgcacctcatccgtacaattcgaacgttacaatttgacggggctgtaccgtaagttggcagaatgtatgatcgctgaacgtaatgagcagcacgatgaagatgacattttgtttgccggaaagccggatttactgaatggaatatcagaatccccgcttacagaagaacgcaatttgttcacgatttttgagaaagaattcgggcgcccattgtcaccgatggaatacgagacgatcactagctgggtggatcaggatcggtatcccgaggagctgattttgctggctttgaaggaagcggtatttgcagggaaggtacatttccggtatatagaccgtattttgctggagtggagccgaaaccgtgttcgtaatgcgcaggatgccaaagaatacgcccagcgattccgtggtggcggacgcaattgatatatatcggtctaaataggctttaatgatagaggacacaccattccgtcaggagggtgtgtccttttttaaatattttttttcgaaatatgcaggggaaggaaatttcctggcgtctatagtattgggaagggggagagcgtcattgatatagagagaatcattgaacgaatacagtccggtgaccggcaggcgttccgtgagatcgtagagctgtacagcaagcatgtatttcatatcgcctattcggtactgcatgacagcaaggaagccgaagatgccgcgcaggaggcgttcgttcaggtgtacaagtctctcccccagtaccggaacgaaggatttaaaacgtggctgagccgaattgcgctccacaaagcgctggatattaagcgcaaacaggacagacgacccgcagagcttatagacgtggcacaatcccttgtacagctcccttcccgggatgaggatgtgctggcccgtctcattcgcgaggagcaaactgtagaactatcgcaaaaaattgcccagttgccccagcaacatcgggatattattcaagcctattatatgcagggcaaaacttacgatcaaattgcagaagagacgcaggtagctttaaaaacagtagagtcgagactctatcgggcgcggctatggattcgaaatcactggaaggaggaggaatggcaatgactgaccaacaagataaaccgtggattgaagggaaatcgaatgactggcatgcttacattgcaggaacttgcacgatagaagaatctgcccggctggaaaagctactgctggaagacgaacaggcgctgatgttatatcttgttgcactggagcaactggagtcaactttaaaagattattctgcctggatggatacggagcgcttcacagatcaggtaatggccgttcttcccgagatagaagctgaaccgagtcaagttatgttcaaaaaacgccgctggtttgaaaaacctgtgtttcattatgttgtcgccgcaagcctaacgttgatcttgttgtccagtggagcctttgacaaaatgatgccgcaaacagacggaaagccgattcctccaaaagaacgcgtttcttacagtgaagaggtcatgcgagctacaacaacctggctcgataaattaaagccctaaatcatcggataaaggctgagatgaaaaactcaaaaataacaaccttcaattgggaactttatcaaaatcccataaatagaaaggaagtgtagcgatgccttatacggaaagaagcaagctcttggcatttctattgaacattattcccggtgtgggacactattattggacacgaaaagccaatgtgtttgtatacaccattttgtttttcggatgtctggcaggaggattatttcttgcattcgtagtaagagacgaatcgcctttattattcggtatgtttgttgccgcccttttttggggactcagcatgctgcatatcatgattagcttgttgcgttatgatcctcgtgcagtcgctgctccatacccccctcatgcagggctcagtccatatgatttttactcgcaaaatggaccttatggacaggctggtttaacaggggaggtaccggagggggcaacacacgcagatacggatgtaccgggagcaggaatgggatatggcccgggctataataaccattatcaacaaggacactatggtatggcaggatcacctgcttttcaaagaggatcggagaatgaacgcttttttacgattttgctgtcgttcattcctggattgggacaccttcatttggggctaatgcagcgtggtttgtcttttttactgtccttctttggctttggtgcgattcttatctttattactagcattactaacgaatccggatttttggcctttgcgggcgtgttgccgattatttggctgtattgcatgtttgatgcggtgcagcatgtacatcgcaaacaagctggagaaattcttcaggaccggactttgtttgaggaactggagcatggaagaatcgagggacgtcgaagtaaaatgctggctaccattttatccgtatttcccggtgccggacatatgtatataggtttgcaaaagcgcggactccaactcatgcttttgtttttaggaggcatctatgtactggatgtgctgcatctttcactctttttattcttgcttccggtggtttggttttacagtttttttgatgcattgcagcaagtaagccgttatggacgggagccgctgatcgacaaacctgtgatcggtatgtttgcacaatatcaccgctgggtaggcttggggttactattgctgggcgcctattacatcttaatcaacgtactagttcctactctggatcgtctgtttccaaacagagagatttataatttggttgacatgtatctacggacgattatcgtatccttattgttgatcggcggtggtatttggatgatgattgggaattccaaatctaaacgagtaaaggagaagcaatagaatggatactgaattttcaaagagtgaggctcccttaaagggagtccatcatcctcatagcgatggaggaggtgccacaggtatattgggtacatcatctaacaaaaatagctcctctaaagcgtcaaacacgccggcaggggtgtggaaagttggaaggctgtcaatgggacttttccttgtcctgctggggggcgtaacgtttgcctccaagttttggggagcgggcattctggaccaggcgttaacctggtggcctgtcgtttttgttttgctgggattggaaattttaatgtatactgcttggaaagggacgcgtgagcgcattcgttatgatttgttcagtatgtttattacggcggtattggttttttgctgtatcggatttgccttggtcagttcattggggattactccgcaagtcagagaaataatgagttcggttcaggaaacaagggttctcccagactggcatgaaaaactgcctgccgaagtgaccaaggtgattgtacagggagaagatccttatgcggtcaaaattgacgcaaccacctcaccggaggtgcatgtgttcggaagttatgtatacacaggtaaagaggatgaaataaaaggacaagatttataccagaccaagcaaatcggcgatacattgtatgtattactgggtcaaattccgacacgttttatgcagactcagcagcagcttgatgttacgattgctgtacctgagggaactacggttactgtgcgcgatagccgaggaaatataattgaaaaatagggagatcttccggttccaactttacatttcgtatcattcacgcgatactggaagggaagcctgagatgtcatccatgtttctagctaatggtgtatttgcttatcaggcgaaacttgatgatgtgcagtcgaatagcgattgtgatcggaaatgagggagaaaaatgatttcattgaatcctgatacgcttacagggcgtgaaaattataagctgttgaccggaagtatcatcccaaggccggtagcctttgtaacgactttgagcagcgaaggagtgctgaatggtgcgccgttcagttatttttccatcgtagcctctgaaccgccactgctgtctgtatccgtacaacgtgtcgatggagtatccaaagatacagcacgtaatgcgatggagcacaaggcatttgtcgtacatatcacagacgaggacaatgtgggagcagtgaatgtgacggcttcccgtctgttgccgcaggagagtgaggttgcactggcaggacttaccccggtcaaaagtacaaaaatcgaagttcccggtgtggcagaagcgaaaatacgcatggaatgtattctggaacaagttataccgttgggaggcaaggaggactcacctgcctgtgatctgttaatcggacgcgtagtgcagtatcatttgtccgaggaagcataccaaaatacgtatgtgattgctaaggagttgcgtccagtaagtcggttggctgggaacaactatgcgaagctaggagagcaattcacgctggagcgtccccaataggggacgttttttttacagcatgcctaagattacatcagaaggattcttattcatcacatttcctttaagaaggctatgtttaatctgaatattgatattattgtggtgtttcgagagccaagtatttaaaatgaattcttattttgttggagttccctgatgaaaaaacatttgccattgaccatcgtttagtttccaaattgaacttcttaatgacctatttccatcgtcaatcgattcagtacagtatgttgtatgtacaaattctgacgataacaactttattttaaagttggtgatcataaatggtatgtagttcaaaggagctctattatttaaaaaaattaattgcaatgatttgttgtattttttacctgaagaaccatattcaatataatcattagctaatagcttttcaaaatcttcttttcgataatgcattaactgcttttctaaattcaatataatctcttgtaattctttactcactttatcacctcagctaagattttatgtcaccactaggataggaaacttttttgataaaaaaagagaacgttcctgtgctattgcttaggctccgttctcgatattcaatggccacttttacaaataatgataagcatctttgatatttatgagtttatttacttcaaagttttcagtagcagggagcgataggtcgtttcaaacaaaaattcaaacgcctccaaatgctttttagcctcaaatacatcacggccccacgcataaatgccgtggttacgcaataaaattccaggcacctgatcatttagcacaccgggcaccagcttggcaatcgaggcaatatctgcgtaattaggcagcacaggaatatcaatcgcagcattttcgtcccaaatgttaaaagccttgatcagctcaataccttggataggtacagcgccttgctcaccgtaatattcggaaatcagattattaaacacggtatgcacatgaaaaacggctccgcagcctgtcaggcggtaaatttcgcaatggataagcgtctctgcgcttggcttgaggtttgtcgcttctgccgcttttccgtactggtctacgaacagaaaatcttctggagtacgcttggttttatccttaccgctggcggtgactgcaaaataaaattgttcgggatgaaagtcaccgattcggatcgacaaattgccgctcgtgcctgggaaccagttgcgagatgcgaatagttctttgacatcagcgagttcttccagtgcgcggcgtttttcttccaaagaaatgtctgccatgttaaaactcatttacagcaccccttgctcctgtttttgctttaaatcctcgataatgtcatcaaatgtttcaaaggatacatgtggtacgccaagctcttgacactttaaagtcagatgcgaacgggagtacacaagatcggcaattttggctccttcaaaatcggtcaggctgtcgccgatcaaaatccgttcgtattgttcggaaggatattgacgaatcacagtcgttttacacatgccacaatcatttgtacacggttcctcacatggatgcggccacgtaatctggatgcgctccccggaaaaatccgctccgttgcaatagacgtggtcgtgtggaatgtcaaagggttttagcaatggatcaataaaaaaatcaatgccgccactggtgacgaaaaattgaatctgctgctctcgtacatagtccaaaaagcgtgcaaagccctcgcgtataccagcttgtccaagtacatatgagataatttcgtccttttgctccgaaggcatcagggcgaacatcgcacctacgccttcacgaatggatgtatgcccatttacgatttgatgcatgatgggctcacagcctgtaggctgaaaatgcctcatgatggcgacaatattgtcgctgttcgtaattgtcccgtcaaaatcgcaaaaaatgacgggcttttttgctatgctcatcgttcgcctccccatgtgtcgagcgcagattgcagctcggggtgaatacgggcgtattctgccagcggggcattctgctgaaccgcttcaatcgcctgcacaaaggcgcgcccaccagcttctgtacccagcggatgtccgtgaatgccacccccagcgttgaccacgacgtcggtaccaaagtcacgtacaatgagcggcacgaggcccgggtgaatccctgcggaagggacaggcatgctggccttcagcggtagatcagggttgatcagctcatcgcggatcgccatgttttcgtcacgcggcatcgtcactgagccgtagggagaagggaagagcacgaggtcagcgccagccagccgcataagctgaccgagtaggacggaggccgaaataccataatgcggcgatggataagcagcacccgctaacgaaggatgggctgcaatcggcaccgagacggcgggatcgctgctaagttcatgcagcacatcgtaaccgtaggccaacacgttaaacagtaacgcgttggcacccgcatcaatggccgtgagagcttgcgtcttaagctgcgaggtcggccccgttaaattagcggcatacagcagctttttaccggtttcacgctcagccgcttcggcggctttgatgcaggcttcgacacgtttttcaatcggcgtcagcgcgttttcaaataagatctcgtcgtccttgatcagatcaacaccaccgagagcctgccgggtaaactgttcacgaagttcgtccaaattgaggccaattacagatttgaaaatgctcatgagcagggggcgatcataaacgccaagctgctcgcgcaagccgctgataccgaatttcggtcctggaaaagcagagcggaatgcttccgagaaacccagcttcgttagcttaattcggccatccatcgaaattttgccgaagaccgtgaccagcagagcgggaatgtctcggctgaagttgacatccgggtaagcgatggtcaggtccgcgtaccgttcaccgggacctccatcgtgaatatccacagaatgaaccgagccaagatgcttttgcatcgcgtcccgtttggcttgcgggagctcagtccagctgcccaccgtcatgccgatggcaatagattgggccttttggttaaaatcggctttgtcatcgtatacccggtaggtcgccaagcaatagctcattcaattccctccttgagtacagctcccatctcgcgggatcgttcagcgcaccgctgcaccgccgcaatcaccgtttcgtagaagtcacctttgtccagcatttccaatgcagctaccgtagagccattaggagacataattttgtggcgaagggcagaaggctcctctccggtttgctgcaccatacgtgccgctccaagcgcggtttgcaccgttagttcgtgcgcttgctcaggggtcaagccaccacggattcctccggcaatcatggcttccatcaggtagtagacatacgcagggccgcttccagatattccggtcaaaacatccattttctcttcttctataaccgttaccgtacctacagattcgaacattgtaagcacgtttttacgctggatttcgctgatctccttggaaaagctaatacctgtggctcccagcccaattgagctggatgtattgggcatcgtccgtgcgatcggctgcttgcgacccagcaacgtttgcatcgtacgaatagacaatccggcgattaccgaaatgatcagctgctcatcagacagaagtgggccgagctgtccaagtgcttgtgcagcatccttgggcttcatggcaagcacaatgaccggagaacgacgcagaagctcggttttggcggcatcctcggtttggaacaagactccatattgcttttgaagttcctcaaggcgagcctgattactgcggttgataacggtaataccactaggtttgacaacagaacgagccgtcattccgcgaataatagcctctgccattgatcctgccccgaaaaatgtaatttgctcattaattaaaacctttgtctgtgattcacacatagattcataacctccaaggatacagattgatttaagttattattccctgatttgtccagtaccgtacacgcgatatttggttgaagtcaaggcaggcaatcccattggaccgcgggcatgtaatttttgtgtgctaattccgatctctgcaccaaacccaaattcgaagccatccgtgaagcgagtggatgcattgtggtacacggctgccgcgtccacttcttgcagaaaacgctcgacatgggctttatcctcggtgacaatacactctgaatgcatcgtaccgtaacgggcaatatgctccagtacttcgtccagattgtccacgacctttacgttcataatgtaatcattatactcggtgccataatcctcttctgtagcaggaacagcccaaggagccaattctcgtgtgcgtgcacagccgcgtagctcaacccccgcatcacgaaagcgttctgccaattctgttaaatgtgcttttgcataatccgagtgtacgagcaatgtttccatcgagttacacacggacggtctttgcaccttggcattcagtgtaatcgcttcggccattgcggtatccgctgtagcgtccaaaaaggtatggcatacaccagctccggtttcgatgacaggtacggtagcgttctgaacaacattttgaatgagtgaacgtccgccgcgtggaataattacatccagcaagccgttcaaggtaagcatttcgttgaccgaggcacggtctgaatcttcaataagttgaagcgcctcgcgtggcacagctgttgcgtctagtgcctgctggagtacttcgataatcttgcggttggagaagagggcggccgaaccaccgcgtagcacaaccggattgcctgttttcaagcacaggcccgcggcatccacggttacatttggacgcgcttcatatatgatgccgatgacacccagcggtacacgtatcttctcaattcgcagaccgtttggacgttcaatttgctcaagggtgtcgccgaccgggtcaggcagtgccacaatttggcgtaatccttcggcaatagctccgattcggtcctcggtcagcttgaggcggtcgagcagcgattccgatgttccctgttcccgtccacgtttcaggtcattatggtttgctgcaatcagctcttcagtatgatttactagagcttcagccatagcaagcaatgcttcgtttttctgtgctgtagtcaggcggttcatgaccccggcactttttttagcaagattcgctttggttcgtacttcgctaaactgattctcctcagttgcagctgtgttagtcgttaaatcactcatgttacggcctccctacatacataatgtaatccattcatccctgtggatcacctcaagccggtgaatgggaccaattttgcccacaacctcgccgctgggtaatccttgtacatttcggagctgttcatcgtcataattgacgatgccgcgtcctaacactttattttccggtccgagcacctcaacgacatctccggcatgaaagctgccctcgacacgtcgtacgccaaccggaagtagactgtgtcctccgtgaaccaacgcttcctcagccccttcgtctacatgaactgcgcccagaggggtggacataaatccaagccactgttttttcatcggaagtgaagagaggtgggtgtcaaaataagttcccggtccgtgtccttcgacggctgcgtctagatcaccattcgcgcttacgcgtcccacatatacaggtacaccgccgcgtgtagcgactttggcagcttcgatcttggatcgcatgccgccagtacctacagacgatccagaacctccagctaatgcataaatctcctctgtaatttcttcgatacgttcaaaacgtacggcattcggatgtttgcgcggatctgccgtatatacgccatcggtgtccgtaatgataatcagatgctgagctttgaccagattggcaaccagcgcagacagcatatcgttatcgccgaatttcaattcgtcaatcgatacagtatcattttcgttaaagatcgggataacctgctgacgcagcaattcttctacggtcattccggcattattcatccgtttgcggctcaaaaagtcactacgggttagcagaacctgcgcgatcactaggtcaaaatctttaaaagcctgctcataggcctgcatgagaagagcttggccaacagctgctgccgcctgcttttcatgcagtagcttagggcgaaacgggtacccaatctccctgaatccggcggctactgcgcctgatgtaaccagcagcacttcatgaccttttgcacgaagcaagctgatttcccgggcaaaataagcgatggcttcccgattcaaaccaccttccactccagtcagagagctgcttccgattttaatgacgattcgtgttgacaagacgtccacttccttaattttactctttttaatgcaaaaaaacttccatcctttgtatgcaaaggacgaaagtttgtgcttccgcggtaccaccttcattgatgattcatgatcatcctacttgaaacctgttaacggcagggaccgcctgattgcgcagggcgctcggggataggagttgggagagagtccaggtaaattcttgcagcctatcggaatttactctctgaacaggactgagtctctcttaatagtcccttcaacgcgctaaatgatattggatacagaataccacgaaaagaccaggtttggcaaagaagttgtagctggaaaatacggcttaaccaaacaggtttagcttgccaattcgatcagccgcctcggtcagtcgagcttctgagctcagcagccccgctcgcacatatccttcgccgccgctcccgaagccgatccctggagcgacagccaccttggcttcccgcaacagcagatcggcaaaagaagccgaagtatagccctgtggcacaggcagccaactgaaaaaggagccacttgggcgcggcgccttccagcctatttgcccaagtgcatcataaaaagcgttacggcgtgattcatagcgggctaccagctcgcctacgcagttctgcgaggccgtcagggctgtcgccgctgctgcctgaatgccgccaaacaagcttacataaatatgatcctgtagcagattaatcatcgagataatttgggcattaccgagcgcgaaaccaacacgccagcccgccatattgtacgttttggacaaggtatagaactcaatccccacgtctttagcaccctcagcttggaggaagctcaccggacgttcgccatcaaatccaatagcgccataggcgaaatcactggcaaccacaataccgttacgttgtgcgaattcaaccgtatcctcgtaaaaagaaagtggagccgttgccgaggttggattattcggatagttaaggaacattaacttggcgcggcggcggcgttcctcggaaatggcttcataatcgggcagaaaacggttctcttcctttaatgggagaaaagacatttccgctttagccaaggctacgccagaccagtagtccgggtagccgggatcagggacgaggcacgcatcgccgggattgagtaagacttgcggcagctgaaccaaacctgtttttccgccaaacaggatggcgacctcggtttcagggttgagcgtcacaccgtaatcctcctgatagcgctgggcaacggcttccttgagaaagctgtaaccgcgaaatggcgaatatttatgatacagcggattatccgctgattcctgcaaagcttttacaatatgggaaggagtgggagtgtcggggttcccctgtccgagattaatgacatcatgccccgccgcgatttcacggtttacattttgtacaagtgtggcaaaaaattgagtgggtaactgtttcatgacgtcagcggagggaatagaaaaatgagtcatcaattcacacgaccttttggaatagtttaagaaataatctatcacgattttaccgagttgtatagggggaattaagcttgcatagttgcgtaatccagactgatcgggctatgatgggagaaaataccggataatgggtcgcgggaagctccggctcacaaggaggatgaaggattttgacgtatcaggaagctcagccgttcagtgttgcactcatacaagctcatatagagataggaaatcccccggaaaaccgcagtcatatccgagctttaatggaacaagcgatgaaaaccgaactgaagccggatctgattgtcctgccggaaatgtggaatacgggctatgccttggatcgcattcatgagctggcggataaggaagggacggagactcgggcatggatagcagcgttcgcagccacccatcaagtgaacgtagtagctgggtcaatcgcagagaaaaagagcgacggtcatgtgtataatacgatgctcgtttttgaccgcacaggcagagaggttgcttcgtattccaaaattcatctattccgacttatggatgaagaaaaatatttgcagcctggcgaagaaaaggttttattcgcactggatagcgggattcaggcaggtgcgtcaatctgctatgatatccgttttcctgaactagcccgcagtttggccctgtcgggcgcaaatttgctgatcgtacccgcagaatggcctcatccccggcttcatcactggcgtaccttgttgaccgcacgtgctatagaaaatcagatgtatgtcattgcttgtaaccgggtaggtcgcagcggagatactgatttcttcgggcattcgctcataattgatccatggggagaaatcattgccgagggtggagagcaggaggagattctcagaggaacaattgagtctgtcttggtgcaggacgtgcgtggtcgtattccggtgtttgaagatcggcgtccctcactgtatgaccgataatcagtgcagaaaggaatactccatgcttaaggaacgcattgaatttttgtgtaaaaagaaaaacttgtcccgtaaagagctggtagacgggctggtgacacccgcacattttgcgaatatactggctgaccgatacccgttagcagaggatctggccgagcaaattgctgggcgtttaggtgtaaacccatcctacctcttgcgtacagcggcagaggatgaggggatgctgactacagcggataagatattcacagagctgtccaagctggctaatcctgccacggaaagctatgtggatcagctggaggatcgccacgattcgcttgtggtggaaatgacgacttatttgatgaaggccgtatattaccagcaattaaatgacccaacggcctatgaatatttacatcagacaaaattaagcttcagtttaagctgagtgtaacgaaaaacaaggcgatacatttaatgtaaccacacaaaaggatgttttttcttcccaactatccaaactgcagcagggaagtattatagaggtcatttattcacctcaagatccttcaaaattagtctttaaaacacaagtgagtgaagccgaggtacagcaggcatttggttcaactcgatagtaaaaaagtttttcgatatctgtttcagatacagcccataggtgtattataatagtatcccgacaccaggaggttgataacgatggataaccaaagtagatccgaactggcgaatagggatggcctgtcacggccgagaggcttaaatagacaggttgtcggaaacaattatgaaatgggctatgatcaggataaaagtccaccagatttagggagaccctgatcacaaaaaggcgaggacaggcactttgggatcacacagcacattggaactgaggtaggacactcttgggagaccaaggctagagaccttaaggaaagaagtgatgcgggatggataaagtggagtttccgagcaagcgtaaagtaatcaggcgaggctgacaggaaattcaaatgaacatgaaatgtggttcgttgaagacagatggaagcaacatcgcaacagtgtaatcgaacccgtaaagtaaatgaagtattgaaagtataggggtgaagccccgggaccgccttcttctctggctttggctagggaggaagacggtccttttcacattggaagctacttttgagaaagttgctcgaccgtttctcggaaggtatcaataaaggcttcggcagctttagacaaataacgtccgtttcggtaagcaatggccagggtacggctaggggtaggttcggcgagtggcaataatgctggaacaaactcgctgctggcggcccgggcgataaaacgggggacgagtgtcactcccatacctgtcgctacgagcgattggagcgtctccatattagtgctctcaaacaccacattaggttcaaagcccgcttgatgacacaaatccatcgtcagcttgcgaaagccttgcccttttttcagcacgacaaaaggctcatctttcagttcttccatatgcacaggctgcggatggcctccgtttttacgcagggctagggggtgacctggaggaacggctagatcaatccactcttcaccgatgggcacataggaaagtgtaggttcaactaatggaagagatagcaggctgagatctgtatccccactggcagtttttttctccagattcatggatgaatcctcgactaacacgatttcaatgtcgggatgagcctttttgaatacaggcagcacatgcggcagcaaatgagaacctgtgataggcatactgccaaccacaaccttcccttttcgcagttgagaaatgtcgtccatttcctgccggagctgctcgactgcatcgactattttttttgccttttctacaaagctcgctcctgcatgtgttaattccaccgtgctggtgttgcgttgaaataaaagtaccccaagttctttttccagtttggataattgttggctcaaagagggctgagcaatatgcagtttttctgctgctcgtgagaagtttttttccgctgcaatttgcagggtgtactgaagctgtctgaattccatcgaattttgcgccccttgtcttataagctttacctattacatcatagactgattatacaataataaaatgaaattcccaatcttaacgaatcccatgtgtcacaagttttatatagatgaagcgtttttatacaaatagagtcttttaatacagataagcaattcatttaacattctcctgataaaacgtgattaatcttagttctggttgtacaaaaaagtgtctgggaggaaaatgaatgctaaaattttgggggatacatacgaaaaaatcgttggctgcactcgtagcgactatgatgctagccgtaagcggtgggacggcgatggcagtcgaaaaggacacgtcgattaaaaacgtaattattttgattccagacggtatggctaatgacgccactgcactggctagatggtacaaaggatcctccttaacgttagacagcatggcaagcggcatggtgcgtacgcattctgcggatgctccaattgccgattctgctccagcgggtactgcttttgccacgggacataaatcacatactgggtatgtaggtgtccttcctgatgaagcgacaatgcctggacaacaacccattgcagcgggtgacgccaaaaagcctgtagcttccattcttgaggcttccaagctggcagggaaatcgaccggaattattgcgacttccgagattatgcatgcgacaccagctgattttaccgcacattatcctgatcgtaaaaattatgatgcactcagcatgcagcaagcctacaacggggttgacgtagtgttaggtggaggcggcaagtttttggaggcagcagggcgtaaagatggccaagatttgatagcccaaattaaagaccagggttatgactttgtcacgacacctgaagggttgaaaaaatcgacctccagcaagctctggggcagcttttctcccgaagcccttgcgtataacctggatcgcgatgcatccaaggaacctagtctggcggaaatgacatcgaaagccattgatgtgttgtccaaaaacgataaaggcttcttcttaatggtagaaggcagtaaagtggattgggccgcccatgcaaatgatccaaccggaattatcagtgacgtgctttcatttgacgatgcagtgaaagttgctgtggattacgccaaacaaaaccaaaatacagtcgtcgtagcagtgacagaccacggaaatggtggattgacgattggtagcagcgatacaactagcaattatgataaaacacctttagcttcttttatagacccgctgaaaaaagcgaagctgacgggtgaaggcttggaagccaagctgaatgcagatcgcagcaatattaaagaggtgctttccacatattttggcatcaccgatttgacaaacgaagaagtaaaaaccattaaagatgccaaagaaggcagcatgaactatgctgtcggaccgatcattagcaaacgtgcgaatattggctggactacaggcggacatacaggaggcgatgtcgtgttgtacacgtacgcgccgaacggagatcgtccaaccggtgtaatcgacaatacagatgtcaataaatatatgacacgtgtactcggactggatttggatacggtcagcaagcagctgtttgttcctgcaaaagccgcttttgaagctaaaggagccaagtttactgcggacacgaaagtcattacagtgaccaaaggcagtaacaagctggagcttccagtatacaaaaatatagctacgctgaatggtaaaaataccacgctcaacggtgtagttgtatttaacggcgttgattattttataccccagcaggcgattgatttgattcagtagtaggcggaaccatcgacaagggctgtttcttccattagaggaagagacagcttttttgtgtgttgatataaatgtgtattttttggggcagaagttggaggcggtttttataagatgggattttttgtgaaactaatcacgttacaacctctccgatattgctagaataatacatgtacggtacaagccgctgatgatgtgaagtccggatggacgagggaagaagggatgagtcacggacgaattattactgcgtctagctgacggcaaggaatggacgcatacggaaatgatggagctgctgacacgtctggatgatgagccgacgctacgggctcaactgagacacctggcagctcgcaccaaattggagcgctatggaaaaggtgtttttttacggggattaattgaattctccagtatatgtcgtcaggactgcatgtactgtgggctgcgcgcttcgaataaacaggcagatcgttaccgtttgaagccagaagaaattctggcctgttgtgaggaggggtatgaactcggttatcggacctttgtgctgcaaagtggggaagattactggtttacagcagcccggctgacgaaattgattcgggaaattaaaagccgttttgcggatgtggcggttacactgtccatcggtgaacgggatgatgaaacttatgagcaattatacgaggctggcgcggaccgttttttgctgcggcatgagacagcttctccccatttgtacgccaagctgcatccgacgatgacgatggaaagcaggcgcagccgtctgctggctttgcaacgaatcggttttcagatcggggccggatgtatggtggggttaccaggacaaacgaatagtgaattagcagacgatttggtctatctacacagcctgtcaccagatatgatcgggattggtccctttttaccgcatagcaacacgccgcttcgggatgccagtcaggggagcatggaaaaggcactcgatattatttcgttatcccgattggtcgttccagatgcacttattccggcgtctacggcaatgggaacgattcatccccaaggcagggagaaggcgcttcaggcgggagcgaatgtggtgatgcccaatttgtcgccactggcggtgagacctaagtacgcgatttatgagaataaaatatgtttgggcgatgagtctgcccaatgtcgacattgcctggaactgcggattcgcggagcgggatttgaagtcgatatggggcgcggcgatagtttgagggtgcaacgacagcttatgagacaggaaactttgtgaggccataacggaaacattgcagtaaccataaataaggagatgggtatacgtgagtggagtacgagagaaagtgtcggcggattttattaatgaagcagaaattatggcggcagtggagcaggggaaacaagaggcaacagatcgacaccgtattttagaaattttagaaaaggggagagcctgccggggactgagtgcgagtgaagcggcggctcttttgcatgtggatgatcctgaattattggaagagatgttcaaatcttcgagggcagtcaaagaacaaatttatggcaaccggattgtgctgttcgcccctttatatgtaagcaaccactgcgtgaataactgtgaatattgtggttataaacataccaatgacagctttactcgtagccgtctgacaccggaggaattggtggaggaggttagagtgctccaagaactgggacacaagcggctcgtgctggaagcgggggaagacccagtccattgtcccattgactatatcgtcgattgtctgcgtcagatctatgaggtcaaggtagataacggcagcatacggcggatcaatgtgaatattgcatccacaaccgaggaggactatcggaagctggcagaggtaggcattggtacgtatattttatttcaggaaacgtatcatcgggaaagctatcgtaaattccacctacagggaccgaagcgggactttgattggcacaccaccgcaatggacagagccatgcgtgcgggtatagatgatgtggggatcggtgtgttgtacggcttgtatgatttccgctatgagactgtcgcgatgctgaaacatgctgagcacttggaagaagcctttggctgcggtcctcatacggtttcagttccacgattgcgtccggctgaaaatgtagatctggagcgatatccgtacctggtcaacgatgaggattttatgaaaattgtatccgttcttcgactggctgtcccttatgctggtatgatcctgtccactcgcgaggagccggaatatagagaccgcgtcattggtctaggcgtgtcgcagattagtgcaggttcagctacaggcgtaggggcatatgcaaaacaggaaactgatgataagcctcaatttgaggtgggggatcatcgctcaccatcggaaattattaaaagtttgtgccgtggcggatatatgccgagctactgcacagcttgctaccgtgaggggcgaactggggatcgtttcatggagcttgccaaatcaggacaaattcataatgtgtgccagccgaattcgctgctgaccttccaagaatatctgctggattatggggatgaggaggcgcgtgaactgggagctgccgctctgcgagagaatctggagcgtataccacgtgaatcgacgcgccgtttgacgcttgacagactggaacgactggaagcaggcgagcgtgatttgtatttttagcaatttatattattcgtagtatcatttcacgctatgaaaattctcatgatttataatagaacttgaaaatgaaaagcagtcgcgttggaatcagcgcgactgcttttgtgtgtctggaaaaaaatattaatgatgagatgaggtcttttaggaataactgccggcttctacagcttgctcccatgccagcatagcagatgggaagcattcaatagcacggggaaagaccccctgtacataagcgatgaaaataccatagttcacaatcggcaccccggcagcttttgtttccgacattcgatgaagcatcgtacgccgattgagcatgcatgcaccgcaatgaataaccagtgcgtattcgctcagatcatcagggaagctggagccggatgcatgctcgatgatgagacgtttgcctatcgtttggcggagccagcggggaattttcactcgaccaatatcgtcagattggcattggtgagtgcaggcttcggcaatgagtacacggtctccatccttgaggcgatcaatggctcttgcacctcgtaccagttcgtccagatcgcctttatgacgggcaaacaggatggaaaaagaggtaagaggcacatccttgggcgtgtcggccgctactttcataaaaacctgtgaatcggtaatgaccaagcgaggcttgcgtcccaatctctccagcgtcaatcgtagttcatgttctttggtcactacagcgatggcatcactctctagtgtatcgcggattgtttgctgctgtggcaggatcaatcggccttttggtgcagctttgtcgatgggaacgaccagcacaacaacatcgccgggtgacaacaggtcaccgacgatacggaaacgatcctcgttttgagggagcgtattagtaatagcctttttcagttccgtgtctccccaaagcaaagatgcactgaaaggaatcagtgtgagatccagttcagttgccagctttgtagccgttttatctgattcagtaagggtatctattttattcaataccccaataacaggaatctttttggtgcggagcttttcgagtagctcatgctcgaatggtccgacaccaacgatggcgtcgataacgagcagggccaagtctgtactattaagtatttcgagcgttttgttgcggcgcagctctccgatctcaccctcatcgtccagtccggcggtatccaccagaacaatgggacccgctgggagcagctccattggtttgaaaacggggtccgtggtcgttcctcctacaggagataccacagcggcgggctgaccagtcagggtgttcagaatgctggatttgcctgcgttgcggcgaccgagcaggacgatatgtggtcgattgctacgaggggtatcattcattcccatggtgagttccttcttcctgtcccggaattccgggcttggttactgtatagggatggcataattggtcaatccgcgaacgggtcagtaggccgcgatcttctacaatatcctctggcgcgcgactttgcgcaatggctgcagatgcaatagaggcagcttcatcatagccaagctccgcgaccagcgcagaagccatcacggctgagttacgcagatttgtagtacagcgttcctcacgcacgatcaggccgcgcacacatcgctcctcgaatagtcgaaccgcgctgttcagaatatgtagcgattccagcagcgattcggcaatcagcggcaggaatgcgtttagctccaactgaccggaggcagcggccatagtgatagccgcatcttcggctatcacacgcatggctgtgagtcctgccatttcagctattaccggattgaccttgccaggcataatagaggatcccgcctgaactggaggcagcgtgtattcgccaaaaccaccgaaaggaccagaggccagtaggcgaaaatcgccagatattttgtacagattcacggcggctgatttgagtagaccggacacctccacaaagacatccatattttgaatcgggtccattgggtggtcactgcgactcagtccaaagccagtctcatccgccagcttttcgaccatccgatagctgtatgcgcggggcgcgttcatacctgtgccaatcgccgtgcccccaatagggatttcccgcagccgctcttcagctttatagagacgccagcggtcgcgcgctatagcctttgcgtaggcaccaaagccctgcccggccatcatgggaagggcatccattagctgagtgcggcctagcttgagcaagtcggcatattctgtttctttgtgctgtaaagcatcctgtaacgaagacatcgtgtcacataaaggccgaagcagccgtatcgctgcaattcgtagcgctgtcggatagacatcattcgtagactggcagcagttcacatcatccagcggatgtaaaatctcatactgccctggtctgcctcccagctgtacgatggctaaattagcaatgacctcatttacattcatatgggtactggtgcctgcgccgccttgcatggcatccacggtaaacatatgttgatgcctccctgcgagtatttcgtcgcaggcatttacaatggcagaggcccgttgggcaggaagccgtttctgctcaccattcacttgagcggctactttttttaccaacacaagagcgtgaatcaggtttttgttcacaggcctgccactgaccgcaaaattattcatcgcgcgtgcagtgtgaataccgtaaaaggcatctgcgggaatttccatctctcctagcgcatcccgctcggttcgcgtatttgtaggcagagaaagaccttcagtcatagacccgttgctggaatgcgtgtcatatgcagtagctgacgtgcacttgcagcgcgtttttcctcaacacgggcgtgaactaggtctggttcgaccagcttgagggcttgtgttggacatttaccaatacaggccggaccaccgtccacgccttcgcacaaatcacatttgctggcaatcatgcgttctttgggttgcaaacgtcctgacatattggtatacaatccgtcctgcactacaggctgcccgtttcgatactcgggtaccatggtaatcgcgccgtaagggcaggcgatcatgcaggttttacagccaatgcagctttcactattaatgagaatgcagccatctgcattcgtaatggagccgttcggacaagcgttggcgcatggggcatcctcacagtgacgacactgaacgggtgcagtgacaccaaatgatttgataaccttcagacgagggtgaaaatgaaactcatcatctggcgagataaaagggttctccgctgaatgtgcgatgacacatgcaatttcacaggtacgacagccgatacactgatcgggatcagctaaaacaaaacggttcatacaattcgactcctctctaactaacgacaaatataatgtatacaacataaaaataacttaacgtattaatgaatggagtaacccgtatcccctttggtagaaatagtactactgcggctttgcttgccgggcccccgttgttggaaggtcgtgtgcagcagatgatgcgacacatgacccagcggctcacctagaaattcatcataaagtttgatgatgtgagggttctcatgcgattttcgtacctggtgtgcagcatcatgtccatagatggaggatttacgtgcccgataagcttcaattcgttgcttttctaacatgagcttgggttgtccccctccgctgatacatccagcagggcagcccatcacctcaataaaatgataatcacattcgcccgcctggacacgatccaatagctgataggcatgttgtagcccggcgacgaccgctaccttgagctggagcttgcctacctgaacctcagctactcgaatgccttcctcaccacgaacaaaatcgagttggagcttcggcagtttttcatttgtcagcagctcgtaacctgtacggatggcagcttccatgactcctccggtgactccaaaaatggagcctgcacctgaatattgtcctaacggtgaatcgaattcttcatcaggcaggttcgcaaaatcaattccgcgttgcttgatccagtatgcaagttcacgcgtggtcaatacctcatccacatcacggtaaccgtcagattccatttcgggacgatcgcactcaaattgtttacaggtacatggcatgatggcaacgctgtatatattcgcaggttccaccttgtctagttgtgcgccataagatttgattagcgctcctaacatttgcatcggagatttgcagctggatagatggtctagcagatcgggatattctatttctgcaaatcggacccatgctggacagcaggatgtgaacatgggtaagggaccgccttcggtcacgcgacgaatcaattcagtgccttcctccataatggtcacgtcagctccaaagttggtgtcgtatactcgatcgaagccaaggcggcgcaaagcagcagccattttcccaggcgtcaaggtgccgaacggcattccgaattcctccgcgagtgaaacacgaatggcaggagcacattggacgatccgaaactgtccaggtttggtcatcatatcggctaccttattcaagttgtagctataataggcagcgaatagcggctctctgatgtcggcaggcatatcgcgttcttggatacgttccagccgtctagcggcgccttcctgtggagatgaacctgcccagtcagatgcgtatacgctgcatatttgtacacattgaccgcaaataacacatcggtctgcattaacggtttgcggttctccgggcagtccctctatggcatctactggacaaacccctgcacaacgtctgcatcccgtgcagagcgtagggtcaatatgaatgacagggtctgtgcaatcagtcgtcttcatacaaggaggtgaagagatcttgtctattgtggttgacatgtttttctacctttctgcggctgattttgaccttataggcgtgggaaaaagacttcccgccgaggctctggaggtgagtcggatatacctttggccagccgtaggacatgattcgggcaggcctctacacatgcaggctgtccgttctctgtttccgcgcacagatcgcatttgcttgccgcggtgcggggaagggcgactcgatttgcacggtgagtcaggccggactgcgttacaacgtgtccggcccggtagaccggagacacctcaattgccccgaaggggcaggccaaaacacaggaggtacagccgatacatcgttcctcatctatcatgacgacgccgtcctcctgacgaatggcctgtaccggacaggcatgtgcgcagggggcattttcgcaatgccggcattgcaccggcacatacatctcccctgtacgtacaacatacaccttgggtacaacaggtacgctgacggttccgaccgaagctcctataccgttagcctgactgtgaacggcgaagcacgccagttcacaggctttgcagccgatgcactgcccggcgtctgcgactacaaaagaagaagcaacagcgcttgttctactggctgctcccattctactcgtcgaagctgaccggttatctgtcggacggtgcatcatattccctgtgccgctcatctcgtcaccttatcagccaaaacagcttcctggacgttcatctgtctgcgaatccgttggtacgattcatgtacatcacgttcggcctgcacttggtcggcgatccgttccagacggatggcacagtattttaattccggggttttggataccggatcgagaaaatcagcggtcagctcgttacatgctccaacccaccagtgataggtcatgtaggtcgcaccttgttgcacacggtcactgatttgtgcccgtgccatgatgcgtccccgacgggaggatatggcaacaatttcaccatccagaatattcagatctgctccgtcttctgggctaatctgaataaagccaggctcatcagacaactggcgcagcgcgcggcaattgcctgtcatagttcgcacggaatagtgacctacctcacggactgtggacaagacaagcgggtattttgcatccggttgttcttgtggcggacgccattcgcaggcgaataatctgcctttgccactaggtgtcgagaattgatttcccttatacaaatacggtgtacctggatgatcctcggtagggcaaggccattgaactccgccttgctgctccattttttggtagctagcacccgagaataatgggctgaggctgcgcatttcatcccaaatttcctctgtgtttgcataggacatagggtagcccatggcggtagcaacctcgctaataatggcccagtctggcttaacatcaccctgtggctcaacggctttacggatgcgctgaaagccccgatctgccgaagaatatacaccgtcatgctcgccccaggcagtagaagggaggatgacatcggcgtgcagcgctgttttgttcatgaaaatatcctggaccacgacaaattccaattggtctagggcttcacgcaactcggcggcgttcggatcactttgtacagggtcctctccgaaaatgtaataagctttcagcttgttctccttcaggatgaggtgcggtacctctgtaagtggatagccttttttacgcggcagctcaacaccccatgctttttcaaactttttgcggactgtgttgtctgttacatcctgatagccagggtacacattcggcaaagcacccatatcacaggacccctgtacattgttttgtccccgtactggtccgataccgacattcggcttgcccagatttcccgtcaacagtgcaagggaagcgagcccctttactacatcaacggcctgtgaaaattgacatacgcccattccgtacaaaattgtagcggtaggggcctttgcatattccctcatagccgcccggatatcggccgccttgacccccgtaatgccttccgcatattcgggagtatattttttaatgctgtctacgtattcggcaaagccttctgtgtttgcttccacatatcgtttgtcgtacagtccttcatgcacaagtacatgaccaaaagcgttcaccaaagccatgtttgaaccgccctttaggggtagccacatattcgaaatacgagctgtttcggtcatgcgcggatcgcatacaataatcttggcgcctctttgcttggcagctacaatgcgtcttgcgacgatcggatgtgtttcgggtgcattatatccaaacacgaaaatgagatcagagtgttcaatttcaggaatagagttggacatagctccatctccgagcgagtaagtcaaacctgccacagaagggccgtggcatacacgagcgcaatggtcaatattgttcgtgccaatgaccgcccgcatgaacttttgcatgacataattggcttcatttcccggaccgcgtgcggagcccgttcccataatggagtcgggtccgtatttttccttaattgctgacagccgttcggcagtatattgaatggcttccttccactccacttcctccataactccatttttgcgaatcatgggcttgcgcaagcgtgcggtcagaatttgtgggtcattcaaaaaatcccatccatagtgtcctttcagacacaacgttccttcattcgtacgaccaccagccggctctgcgccaattacctgtcctttttccaccagcaaatgaagctgacaaccgctcccgcagtagggacatacggttaataccttgtctgccataagtgcagcacctcttttatatgaaatagatgaaactcgtaacataaaaaaagccaatacaaaaatgccgctttacgctgcatcctgtactggcttatccgcgagcgaggagacaagctccttcccgctaatccaaccggtgtatgtgttgtagttctagagaaatgataatgtgtccgtctccatggacggaggggcagacctcccaagtataagtgaagggactgccgagtgttttttcggcttcgttcataaactccttttccagatagggacgaaggacgttccaatattccctgaccttgtcctcggccccttcatgaacgagaatttcggacaaattagacaatgtacctcgaatttctaccgtaatccggagcggcgaatccagtgaaaccttgacgttgtccggtccttttccacggtagtgcttgacaatacatacggccaacttcctgatgcgctcacggtattccaattcggtattcaacatctggacactccgcttcgaatcaaaataaaggcgtacttgccgcgcatgccagacagcctgtgtagctggttttagaacaaaacgtaaccgtcccgacccaagtggtctgcccagcacggcgtatcactcttctatggtagaacaggttgacccggaaagatgtgaaattcattacactgaaccaaaaatttacatagattagaccgctcttgaagtagctatacctctatggtttgtatgatgcttctcattccgtcgtgttgtttgtacagctccaatacaaaagcagttgaatgacatactatgggctgagattagtaaatggcatactcaagccctctatactgaaatagctcagtgcgaatctcagagatttatagtaagttatttatttatatgatttgcaatatcaatttattattattatattggacggaaatgctagtcgaactccagaaggcatagatatgttatccaagatggtggtaaagtacgggttcaagatgtagaatctatgcgattattcagtttgtagaagggtaacgtcaaggtcgccgaatgaagacttagtaggaattactgcaacgtgtggctgaacatgaagccgcaagtcaagccacgttagaataaagagaagaggtccgtgctaaaatgcatggacctcttcaaacctgtaataattgatttttatgaaactttactgtttaaccagaacggataaatcgccttcaaaaacttgctcctctttcttgttgaaagtcgacagcaacacagtaacgagtcctgttccattcctcatctcttttactccaatcacttcaacaatggtgtacaattcgtcgcctggatatactggtttaataaatttaatattattcatagcagttccagcaataacctcatcaccgtaactgcctgtttcaacccaaagcttaaaagaaacagctaatgtttgaattcctgaagcgataattccattaaacctgccttgtaatgctttctcttcatctaaatgcatatattgcgggtcaaactcccttgcaaatctggtaatatcctctttagttaattttaaagacttggttttaaatacttgtccgatataaaattcatgaaaccgcattattacacctcttgattaaattatttgcttatttatagagtagcataatatcaccaatcaagttaaactgcccgttagaattc

SEQ ID NO: 2596 - DNA, 62400 bp, Unknown
  Kingdom: Bacteria, Phylum: Firmicutes, Class: Bacilli, Order: Bacillales, Family: Paenibacillaceae, Genus: Paenibacillus
ttgttcctgatttagaacctccgtcttatcttaatgacattgggccaacgccgcccctttttcattctatttcatttgtagcatgttataaatcatctcagccgcttccgcccgtgtgacctcttgtttggcacggaagctaccatctggatatccttgtactaaattaatctcggttagtccaagtacatcctttctggcccactctacaatttgagaggaatccgagtatgcattgctttcttgctgtggagtagctttgataatgttattcaccattttagccgcctgctcacggttaatgatccgatctgggccaaattctctattactaaacccacgagcgacctgatctttaatcgccgttttgagcagatcaacgtaccacgccgatggattgatatcctcgaagcctaaagtcacatccgtttcgagcggtaatttcaaggaacggaccagcatagaagtgaactccatacgcgtcacaggtctgttcggctcaaatagcatgtgagttgttccctttactacacccaaatcggcaagcacatttattttttctttattaaatacccgttcaatgtcgctaaaatgatttggcttcttctcaacggttgaatcttgaatatactctgcttctaacgattcctttacaacaggctgaatcggtcttacactctccgcccctcctgctccaccccctgcgtccgcagtattacccgttgtttttccattcgcttgttttgcctctgtgcgttttccttgactattttctgcccatagttgaactttatacaattgcttctctttaagttctctccatgtatagcttcgttccttaccacgatatagttctactccttcactcgcgaggacgaaaatatcattctcatggtctgactcccaatggatgataaactcactattcgttgtttctgtcttcgaaaatgcaaacgctggagacggcagcgtctcgacctgaccttctgtctgcttaccttcaccacttgtgttcaatggcttgacggtaatacggtacaatgtagaactatccaatccatctactttaaattcatgggaggtcgtatgaccgataagccccccgttttggtagacattgtaagcatctgcacccgaagcttctttccacgtaacaaccaagtcggtatctgttacttctttcacagtcaatctattatctggtatttgacctggcaaagcgcgatgcgtaaagggagttatattacctacccccgttgtattcacggcctgtataccaaacgagtaaatcataccaggctggatatttgaaagcttaatatgggcatctctggtgttaaaaacttcccccgtatctttacgggttacagtatattgataagcgctcttgatttcatcccagctcagtaaaatctgtccatcctcaagttctgtaacattaacattttgtgcttgaggaggaagtgtcaacagcttacccaacgctggctggctgaaaccactactgttcccactgctcacttgaaaatcatagtttctcccacctgttaaaccagatacaaccacacgtggttccgtactataataatcttgaccgttgatcgttaccttatattgagttgccccatcaaccggggcccatatcaacgtggcatcgtgctcacgaacatcttcagttgcaagttgcacagctgaatcaggtagtgttaatgcgttgatagatgtatctttacctgtaccacttcgattgtaggctcgtattttaatattggcagatctacccgcaggcaagccctcaaaagtatatgaatggataccacgtgcaacccgcaccttcggttcatcgttaacattcaagatgtatccttcagccccctgcacatcctgccacgcaacaccgatagcatacacatccttcgtcacacttgatattgtagttactcgatcaggtaaagtgatgactcctagatgggcatagtctccgaatcctgttgcattttcagcggaaacgttataaccatactctgttcctgcttgaagatcagtatcggtaaattctgtatacacatcgttataaaccgagacttcgtcacgttctagggcgtagtaggtggcagtgattacagaattccacttcaaatcgattccatcttctcttacagttacattccggaatccgttcgggctgtctggtaggcttagaaaagatacatgctttgctgtaccctctccagtgtcattaatagctgatacagaaacatcgtaatattgaccaggcttcattcctgtaattggattatacacatcctgtgtaacggtattcctaaatatgatttctcccgtacttacgtccgctgctgtaatgttatatttgttagctgagaaaactggcgtaaaatcagccatgatttctgtagaatgacgagagacaggttgtaactggatatgatcaggagcatcaggtaacgttaatacatggactcgattggaatatgcattgcctcctacatggttactggaacgcacttcatattcgtattgccgtcctccttgtagccccctaactgtaaaagaatttgttggatgcgtaacatcccaaacctcattagttgttagatttcggactgtataaacgtaaccatcatcaaggcccgacgggagagtccactgcaaatcagcttccgtatttcgtacggatgtcgcagagagcacaaccggttggggctgattttgaatgcacagagcactgctaactgtttcataaatattacccaccctgtctttgaccttggcatgaacataccattcaccttcatctgtaagatccatctggattgttgtatcggctgcagcatcccagttttcgggtgaatcagggctgttcgtgattttatactgcattgtggataactcaacccccgaatgctgatcggcatatcgtatcctcacatgaataggggtatctttccattcacgcgaatccggcgtcagttggatcgtcggtggttccaaatcaatataagacattgcggacaccgtatcgcttcgatttccagctgcatccacagcttgtgcagtcacttgtatgatccctgaaccctttaatattcctgatgaatcagacacagaagcgccagaatccaattgatattcataatgtactgctgtagtatccgtcgcacccgatagagcaaactgaactggcttattggtatatcgggtaggtgtcgtcaactcagaaaatgtcactttcggaggggttggttgggttcgatcaatcaagaccgattgagtcacgattggactagacacgtcgagattattgatcgtccgtgctgctaattcgtaagccccttctgcgtttaatgtaaaaatgccattgtatgtctgccattcccctaatggacccaagcgatactgtgtcatcttaattccatttgtagaatcacttcctgaatcaatggtaacattaacatcacggttcgttggacctgtttcactagcccggatgacaggagcagtcggtccctttttatcaatcgtgatttctttgcttacttcttggctcacattaccgacgctgtcaatggagcgtgcataaaccgtgcttttgccatctttattcacatgaaacactccaacatagtcctgccaatcttgattcataacgcctgtcaaacgaaattgagtatgggctagtccagaataatcgtctgttcccggctgtaatgaaatggtgtagtcattactatttcccgttgcgcttagggtgggtggagttggaggcatcttatctattcggacattcccagaagaaagaccactatactgattatttacgtccaccgtccgggcataaattgtatttacaccatgttcataaacagtgaaaggcccggtgtattgctgaaatgctcctccattcaggctatattcatagtattttagtccttcaggagccacgtctccatttatccacacggttacaggttctttggtccatcctgtgatcgcttgtccctctgtgcctgcatgaatctgcggtggtttaggcattaagtccgatttgggaataacacggattccaaacttggatacttcattgcttgtctgttggttagttcccatcgctctgaaatatcgaacatcccttaatgtaatagagtcggtgatatctaaccattttccctgataatatctatccgcatagaatttcgttacattagtccatgtatataagtttgttccattaggcctccaactgtcgcctgctgcgctattagatgcatatatatcagtatgataagccccttcaatgtaaatgaaaatcctataatctgaagtcttaatggatcttccaatatcaataaaacgatttgtcggctgcgtagtaccatcacatttataccttgccgaacccatgccagtgtatacttccgttgctcctatcccacttcctgaccaagagccccaactgtcgcctccacccggcaaattgttttggcaaaaagggccccccatgatctcctgagtagcagctgatacccttttcggaaatatgggaatcatcgttaatagtaggactacagccaaaaatccatacccccacttccttacctttcgcttattttttcgatacatacacttctccttactttattttattttcaaagagttttacaaactcgcttcgggtaaaatagaaaaagcacctcaaacgaaggcattaatgcctaggtttgaggtgcttcctctatgtcacgagtatgttttgaagctattatacttcgttcctagcaggatgtaaacagaactgacaaattatttgaggatattaatgaatctgaacgcccaagttccgaaaaaatcctcgcatattctgcatgtaagaatcctgagtagcggaagattccttaagaagattttgcatactgttcataaaagcagaagctgatgtcgtatcagctttgtcaaaccgattgtttaacggtgtgttatttagcaactctgcgttctgtcccgtgcgttccttgtatttctcaatccaatcgggatgttgaggaaccttttgcgcaaaatttaacagttggctcagcccatttcctccacctttaatatcattcatgtacgccgtatatttttgaggatcgacctgcttcatcacttctgatagcttaacataatcctcaggagcacctgacggacgatctattggagtcgtgtagctaatatctccggtctctggatcagtggatcgtgttaaagcaataccagcgatctggttcatggtttcgagaaattctttggccttgtcgccttccatgtaatgatcagcaatatacttggattgagtaactcccatctccagcagcacagctcgctgactctcatccgttactgttccgtcgacgataaaattagattgaatcatactgtacactgcattagacacttcttctggctgaccttccaaaacccggtttaatgaatcattaatctgtgttgtaccgaaatacttggcagcctgtgatacaatagccccttcggccaactgtctaccagcttcactgatctccacggagtcttgaactaccactctggagacctgttcttcatgaagctggggtggtggagcttgcttgcttgtcggattgatccgtaaactacttgcattaagaatcgcttgctgtgctctaagaggtccaaaattcattctatttcctcctgtcatgtttgtaacaggcaatctaaggcgtatgtatagtgtaatgtgaccctgtttctatatatatcggacaaagcatatatggaatgaatatacgctttgtcctaataatgaacaaatattgaaacaaactacttttatttcattcaagcaacaattcaccttaagtgattgctttataaccccatctatcaccctccataaatactgtaagcaaagtgatatacaacatctgtggctatattcgaagtacctctcacctgagcagctacccctgaaagatcaaaatagtgtgtgaaactgatagctccagacagatattctgcaatacttccagttgaaggtggcagggaaagagtaacactaaaaactccattctgatccgtatatgcagtacctgtgcgagtgcgatttccgctgctttcgctccagttttgattcaaccatgttacgtcaacaggagcatttgcaactggataattgtcagttgtagtaaccacacccttcacagtaaaactactacttccattaactcgataatggcgcccataagaataggttgggtagtcattaggcccatttttagaagaaatataaccggtaattacaactttcccagcccgaagcaccggtttaagtgtgagtgcatatgaatggtcagctgaaaactgatttgttgtgtacactcgcacatagtaggttcctgtatttaagctaacattatgattcgtttgcggcaaaagcatcatttggtttccggtaagagctccgtagacttccgctttgtagccatagccgtccgaaacattgtcaagctttacgttcaaagcgtcataattgcggctggcagggatcgtaacttggtaccagtcgttatcaatgcctgaatgaatagagcgtgaattaagcgacgaaccacccgtactaaaggtaaagttataggcatggaaagcactctcatctggttcatatgcatcgtagctggaacttgtatcgaccgttagatagaaaggatcattgatgctggaaccctttttggcatggacagcaatcgcatatgccttttcatatccggcagtgttacgggttcctacgttttcaggaagtgaggcagcaccctgttcataattgttaaaataagtaccataggtggatgcgtcaatggcattagaattaatgtcacctgtcgtcatatcaaactcatataagtataagtcatagtcaagctgggctgaaaatggaccatccaactgggactgcaacaattcaccaggctgcaaataaatcggatataaaaattgtgtgcctccctcctgcgtaatcgtaccggaatacgtagcagaagaagctgtggctaaagcagccattgggcttgctttcagcgaagaaatggattcccttttcaatgaggttgtctctggtgtcttgaagttgagattttcttgcatgacataaaccgaagacgtaacgctgtctggcttgtctgcccgtgttaaacgcttaattacgtctccatttacagttgttagctgaatctcggattctgctttaatcgcttgatccgatgcagcctccgtgttttcactcgcattcgcagtcattccgaaagcaaacaggagcatcatgcttaacatcactgcaatagcctttttgaacctcttcatactgaaatcccctctcaaatggtttaaggaattcccgctatccccggataaaccagggcaatttctaggctgtatggctcaatcataaatcatctttggttctattggaatatattatgcaaaacaatttctatttgtaatctatgaaaacaagaccattttcttattcttggtgaataaacatgaaaagtcgctctttcagaagtggaaagcctcagctaaccattcaaaaaaagcgactctcatgaatcaaaactacattaaagcatatcttaatttctcaagctataagcaaacagataaacaatgtccgtcgcactaatcgaagttccatcgacctgagcggcaactcctgtaagatcatagtagtgtgtagaaccaatttcacttatataaactacattttttcctgtcgattgtggaagagaaaggggcacactgaatttaccgctatcatcggtgtacgtagaagccgttctcgtacggttaccgctgctctcgctccagttcttatccagccatacgaccgtgacaggagcattgggaaccagttgaccatctgttgttttcacaacaccgttcacgatcagactgctgcctccgttaatacgataatgacgaccgtaagaatatgtcggataatcataatagccattggagttatagccagtaatttaaattttgccagctcgaagcactggtttaattgatagtgtatacaaatggtcggctgaatactgacttgtgctgtacactcgtacatagtaggtccctgtgtttagggtaacattatgattggtttgcggtagaagcaccatttgattgcccgtaagagctgcataaacttccgctttgtacccatagctttccgaagtgctatccagcttcacatttaatgcatcataatttacggctggctggtactgtaacttgattccaatcgttgtctatagcggaatggatggtacggaagttaatcgaggagcctttgtcgttaacagtaaaattataagcatggaaggcactgtcatccggctcatagacatcataactggagcttactgctacagttaaatagaaaagatcattaatgctagaccccttcttggcatgaactgcaagcgcgtaagccttctcggctccgattgagttgcgagctcctacgttttctggaagagaagcagttccttgctcataattgttaacataagtcccgtagttggaaacatctataggattggaattagtatcacctgttgccatgtcaaactcatacaggtataagtcatagtcaagctgggctgaaaatggaccatccaactgagcctgcagcaattcacctggctgtaaatagatcggatataaaaattgtgtgcctccctcttctgaaatcgtaccggaatatgtagcagtggaaatggtgtacaccgaatctgtgatactgcaggcttgtccgcgcgtgttaattgttcaataaaactttccttatcagttgttagctgcacattggaaactgcccgagcagcttggtccgtcctctcccgctcgcgtttgccgtcatcccgaatgaaagcaggagcattgagcttagtgtaactgaaaccacctttttaaaccttttcatactgaaatctcctctcaaatgtattaaagatattcagctattccctaaatatatacagggaaattataggatatctatctttatcataaagtaattctggtttcgatggaagatatttctttaaggtttttcatttggaatcccttttatccagtcggtgctttgacctgcgggttctctcaaacaatcatggacataggcagcgtgtcgtccgcttgtaagtatattcaaataatctcctgccagcaaaagcatctgtccatcaggaattttttcaaccgacccgcgcttgacagaaacaatgagacagtgagcaggccactgaaaatccttgatttgtgtaccgtccaaacgcgatccctgaagaataggtacttcaagtataactttgcttgatgattgctccgtttcaccacttgcctttctttgatgcaaaaagcgctccagcagaacttcatacacgggatgagaacgaaacagctcggccgtcatgtaggcaacgaggcagacaacacctgtagatagcagattagtgaaattccctgtcatttcggtaatcaatatgattccagtaataggagccttcaagctcgctgtaagatagcctgccattgccaaaatcaagaaactactttcgctaagcacaggcattccccataatccatttatgaacttgctatacatcacaccaattaaggccccgatcacgagcataggtaaaaatattccaccaggagcagaagaaccgtaactgaacatcgtgaataaaaacttaagtattaaaataacaagaagaaatttcaacgaaaaagaatccgttatcaaatcgttcaccaggccatttccgcccccaagcagtaatggcatgcttagtccaagcactccagaaattacaaaagggagaatgggtctatatggagcaggcagccaggtcattttttgatagaaatcttgaaaggcatatatagacttattgaaaataacgcccataatacccacaataatgcctaaaataagtaaatgaacgtactgattcagcggaacaggccccacattcataaaatgaaaaacgggactcattccaaaaaactctttggatacaaaatcagccaccagtgatgaagcgagtgacgcaatcaggataagaggcgagaaattcaaatgaatttcttccaacgcaaaaatgacccctgcaatgggtgcattaaatgccgctgccagtccagcgcttgctccacaggtgatcaggatattctcttctgttttcgatttactcatcaaacgactaaatccctgggcagttagagccccgatttgaatagaaggaccttctcttcccaaggacaaaccggaaccaatactaatggcaccccctagaaatttagctgtaagagccttccaccaattcatatgtagcttattctgtaggactgccttgacttggggaataccactaccggaaatcgcaggctgttttttgacggtcattcccgttgcccagccgactattactaatatcacgaaccataatgggacaatccacatatggcgcaattgatagtggtaaaattcaagaacacgctccaaagcttcttccaacacaaatcggaacaacacaaccacgctaccagataacaagccaactactatgccgcctatcaagagtcggaatttaaaattaaaccaggtcgccagtgttttttgtgtatcatttctttccattcacataacctacttcacttcaattttacagatggctaatataataattcattgtcacgtatctctgcaataaattacatcacaggctgagcaattgccagctctccctataacgttaacagaccaagcttagcctcggtcatacgccccctgcaactctcctagctaaccgcactttatatcacatcacgacaaaaaagctcactcactctaaggagcttttctgaattgcgtgtctgcagacacgctcctgcttaaggagcaacgtctgaatgaaactgcggataccacgcatctgacatttcaacccacgctcctacataaggagcgaccgtcgggccattcataggatataaatggatgactgatttcaatccacgctcctacataaggagcgacatccacttggatatccgcatgaatatcatgaatatgatttcaatccacgctcctacataaggagcgacgataactttaacgatctgcaatatgcccaagatatttcaatccacgctcctacataaggagcgacgcgcaagaattgccaccacttccgttcctgtgaaatttcaatccacgctcctacataaggagcgacttccggctgctgacttaccttttttaacgagccaatttcaatccacgctcctacataaggagcgacagcacctgctgagatgccttgctgtgtaaggcttcccagcatgttaagtgcgaatgtcctttttcgactcgtatatatggaaacaaatgggcgtgaatctctgaaatcccgcgtcccgcttgaggtgcgaaggaaccgggatttttatgtgagcttggggttcgcaccagctttatttattatattttgctacctatattcaacgcaacccataccgtacttctctatatccttttcagcttttggtttcaattgggcgtaaaggagacacattccgtggaagtccattttgcgggcaaaaatataatgctatagcaatttatgcttccaactcagctctctcaatagcctggaccaacgtcataaaaggggcctcccgtttatattgaatagccttttggcttgtaccgccagcatcacaccattcccaatgggtatgaatatccacagactccagaaaataaacagacaaggcctccacaggattcactccatacatatgtataaatgcctcgtctgaaagctgattattttggagatattcatttttcatggtgcaaagaagcttgcagatatcctccctgtttacattaacgagacgactcacgaatgcattgcgtctttccaccgagttcagtatgatttgcatagcattgcgtatatgccacgcatcggggccgatatggagcctgttaattaaatcgttagcggtcaggtcaggattaaatggggctggctccaaaatgtatgtccatgcatcgttgtgtcctttttcaaacacctcaatagcgtcagagacgtttataccaatggtttgccacttgcgattgagggcatccataatatgatagtagtgtagctcagtttctccatgttcaacttcttgcgtccaaaccggtctcatgcgtacaatatccttgattgcttgctcattcgctttgaatttcgtagtcactgtatcttcctccttttgaaatctggtaaaatggcaatagcaaagctaagggtatgttgtaacatccctttgggcgataaatcatattcgctttagcgaatatttatatgtactatattattcgcataaaagaataatgtcaatggatttttaggaggtctattttctttgctaaaattaaacataagacttaaagaagtattaaaagagcgaaacatgacccaaatgcaactttctgaaaaatcaggtgttaaccaagcaagaatttcacagctttgtaaaaatgggcgacaagaagtgaacctgctcatgcttgaaaaaatcgcccatgccctagatatcaaagacatatccatactgttgcaatttgaggaagaaaataactgattattgtacactcgctacaccctaaaattcaacactccacgaagcctacataattattgggcttctctttttcatttcacccaattccaatcgtacatcacccctatgctttgttccccacatctacacttctatctttccatgacaaagaaggctcacatcacttttatagagagtcgagcctttcaagtttcaatccacgctcccacatggggagcgacagcaagcatgtggtgagaagccttactgcataaggcttctcaccgcataaagtgcgaatctcattttttaactcaaaaatggaagcaaataggcgtgaatttctaaaatcccgcgccccgcttaaggtgcgaatgatccgtttttttatgtgcgcctggggttcgcttaactttcctgttgcacttatgttaaaagcatatcaatcaacttaattttgacactattttaccacaaaattcctaccattctcttatttatactatataatcaaataatatggatagttctttataactatttaatgaatcgaattactcataacatacacaaaaaaggggaatacagatgaaaaagctcagcgtatttatgttggtattgtgttgcttttcgattttggcagcctgctctaccgatccggttaaaaaagatttaattacgtatgtcaatgatggaatgcttcctttggcacaagatgaaaaagcagttactgataagtatgaagctgtgaccggagataactttacagatgatgttacactatataatgctttaaaagacgatatcatcccggaatacaccaaatttgttgataagttagaagctgtaaagacggaaacgcctgaggtaagagccgtccacgaaacctacatcaaggccgctagtactcaaaaggaagccttcattaagatgctcgatgcattggataaacaggatctgaacttaatcaatgaaagtagcactaagctcagcgaaggtagaaaactattcagagattttggtgaacaggtcaacacacttgccaaagagcatgatgtggagatgaataagaaataaatattaaaactcccttgatgggagtttttttatatacttcaggattttgcaaaatcctcacttatgaatattcgaagcaaattaccgctttgcttaattcttggtcgtaaaataaatagacggcatccgccccgcacgcttgaaaataatatccggtaatggaaccgatataggtaaaagtctcaccattgggacgcttaggcacatgaagcagattggtttgctcgaactggagcatctcttccagagattcgtcatattccttgataaaactttgagccttgtcagactgaaatgcgatatcctctaaaataccgttaacttcagggaaactcagcccccaaccgctggattgcttttcctcaaaatcacggatgagttcttccacagactttttggcctctccaaaggaggaatatggataaattttattgttttctaggaaaaatgctttgcgagcttggtagtcttgttcattagccatgtacacctgttccagtccgtccaacgccatgacttctctcttcatacgtaggtacgctttatccccggtagatttcagcgcttcataggtagcttccaattgctctttctgatggagactaaaataattccagtctgcttcgaatttgtatttgccgtcaatgacatcgaaacccagcatatcttccttggtatatgaggtatgaaattgctgagtattttcacccacacagccttcgtagatttcttttacggaaacaaaatgcagccactcatcctgctccgggaataaaaactgaagattaatcgagcaaatcggcagaaagtgcttgcgatgatgttcaagatcgctggcaaatacgtcctcgtatgctggaaaacgtttgatgaatctctcaggtatgttcatggtagtcccccctatattgtatggttttccggcagtcttctgatctgaaacgttccttcaatggaaatcacgctatagagttcatcaaatccttcttcgtagcttggaacctctagtttactcattacacttttaataccgatttcaggaatatactctttgcctgtacgctgcccattacgcttaatagattctgcaaaatcgggctcaaaatagtagccaataattttaaaccccttatttttacaagcatctatatatttcttccgttctataacggtagcatttgtattgtctacaacaaagcgctgcatggtttcgatggaggcttgtagataaatattttccctattccgtgttttaagcatatcaaggtttattcgcatatgtgttttgaagaaatgttctttataaaatgtcgacttgcccgaagcctgaattcctataaaaatgacacactccaaatctacacatccttgtccaagtatacatattggttaatgtaatctctattctgtgaaaaaatcggtgtttcatgatcaacatcccacttgcttctgacggcttcgcctttgttgtactgttgtttggtaatacaaattccccgcttttgccagaccggaagatcgttccagtttagctctttttccacaaaaagcttgtcttggagctgttttccgttcaatccttctagttctgaatgcctgaaatgagcttgagctaccatagaaatgctatttttagtagcatcttgttgtctccataggaagtagtttgtaacctcatcctggggcaaaacccatgctctcgcatcaaaagtggctaaaggctgacctgggtaaacggcgtggtaggcttaatctataggcattttcatattccttcatcctatttccaaaatcattttttttcataaactatgtaggtccctttcctgatccgtgatttgcgcatagagtacaacaatgtctatcttccccaataggcgtatataagaattgtaactaattggattatgcattgctaggaattaagcaagacaaaaaaccttagcagatgggcttgcagagtctttggttttttggtatctattccccaaatgttaggctataatatttccatctttgaatttattccgatatgaaaaggatgatatatttgagccaaaatccatccattccgcgcccgttagtcagggctaatcaatgggtaattgttttatctgtagtttttacttggattacaggggaatatggggtgctagttattcctcttatcgcggggttgctcggcgtcctttttaacttcaatccagtaatgcggatagccaagcttttcttgaagaaaagcccctcctcatatgtgcaggaagaccgagaacagcaaaggtttaatcagcttcttgccgtcttttttctgctggtcgcttgggttggatttatgctccagtggagtattgtcgcttatgtattttcggtcatggtcctggtggcggccttggtggctatccttggtttttgcataggatgttttgttctgtaccaatggtcccaatatcaatatcgaagaagaaaaaacgtgtaaacagaaaaaactctctattcattccatttcaattaggacatcgttaattaaatcgagggtgtagccgaactctccaacaatatggatgctatatcggttccgccttctttttattttgcggtaatgttatcttcaaatacaaaaacggagatggctatatcttcctccactttaatatctgaaaagaggtgcagcagccgcgaacccatgtaatcctccagttctttattgaagtgtgtgggatatattttttgaaccattttggttcgagctgcatgcaccatctctttcccggattcttcttgtgccagaaacttttcggatggggttaaatttccatacagcatcgtgatggccatattatctacaaaggttgtatgtatgcgctccgggcctttcccaaacagctctttacgtacttttcgaataatttcgttaaaacccgtttcccttctcatatcgcaccgctctcctaaaatctactaaaaaccctattactatatccatcataaccgattcctctcatataaaacagagactagcgaaagtgatttttggaacatgattttatctaaaattataagcgttcattaattttgagtaacatttcctctaaaattttcttctcctcttcagtcagggcttgaacaatttcgtcctccaccttttgaaaagagtcactaaaagctttaatcaattcaatggcttttggtaaaacataaatatttttttgccgctcattattggccgggattttgcgctcgatgaatcctttttgctcaagaccttgaagtatgcttgtaatgctggctccgcgcagatgaaaccgatcggccagatccttctgaattaaattattttcttgattctcgtagatatatctaatcatttttccttgttgagcatttaatcccaactcttttatgctctcgtccgctcttttctttaacttaagaccaataatctgaaacaaatccagataaaccgtatccttttgggttttcataatcgtacctcctcaaattattagaagtctaattgtcaataaataaactatataaatctctaaactgtttgtcaaatgaaaatcagtttattgacagttataaaactaatagttagaattctaactgtttgaaactgaacactaaggaggaacgacatgaagaatgtaactcaaagctctacggtagaaaaagttacagcgattacgaatgtacgtattttcgatggagaaaaagttattgagcccagaaatgttgtcatccagggggaaaccattatttcggtaggcggagaccttccgacgcatgcaacgatcatcgatggggaaaatgcgacattattgcctggcctgattgacgcgcatgtccacacttcaatcggtgggttacgagatgctttaaaattcggcgtcacgacagaactcgaaatgaacggcagttttacagaaagagggcgcaagatccagttgaaaaacgtgaatgacgtcgccgaagtccgttccgccggcacagcgatcactgctccaggtggtcatccggacgaattagtgcaggatgaggatgaaattcctgagttcgtattaaaggaattggagaagttacccaaggaagaccgggaagctatgctagccgcctacgctcacgatcacgaaaaagtgccccaagtgacgacagtggaagaagcgatcaaacatgtgcatacccaagtggagagtggcgccgactttattaaaatcatgattgaagaagggacggtcttgggtgcccctggactgcctattttaagcgacgagattttaaaagcagccgtggcagaagcccataagctcgataaaatagtcatagctcacgtcttgacggctcattcttcgcaaaccgccatcgatatgggagtcgacggattgggtcacttatttctcgacaggcccgaatacacatctgagttggtgaaatccatagcggattcacgcgcttttgttataccgtgcttggtattgaactcatccattcttgggaatccggcatcagaattggcgaatgattcacgtgtttattccaaattaagtccggaatggatcgatattttgaactcaagcttccatactttcccgcaaggcaatttggagaatagctttaaaaatgtgatggatcttcaccgtgccggtgtggatattctggtcgggacggatgtcgcccccgttcctgttcccaatcttggcggcctcgctcatggagccagcgttcatcatgaaatgcaattgctggttgaggccggatttactcccatagaagcgcttcagtcggctaccgcgaaaccggcccgttgctttgggcttaacgatcgcggctgtattgccgaaggttcgctcgctgaccttatactagtaaacggtgatccgacaaccaacatctcggatactttgtcgatcaaatccgtatggttaaaaggtgtgcaacaactatgttaatcggagcctatcgaacaggaacaactttctaatctcatttgtatgacttccatttttactttccgaggatagcttaatcttgttgccaacgcaaaaacaccttcaaggttatctccatattttacgacatggagtttcactttgaaggtgttttaattgcaaggaacattgtaaaaacgtacaaacagtggcccaaatactttcgccatgcactgtttgtcataaaatatagaacttactcgtaggcaccgatgttcacagcggctccctgtactcttggcttcccgtcgatatccagtgttccaatgatggcacggtccgtgttcccggcatcgatcgcaggtgacgaagactgcaaatggaagttcgcggcattcacgaatttaggatcggcaaatagagaatgcgtatcgttgccggttcctgatttatattcggagaatcccgtatactctttatttttccaagtccaattggcctctgagctgccgcctggagcaaaatataaattataatccacaacattgccggaatttttcgtgtatccattggagatcagcatatccgtggagctggccacgaaaatattgtttttgatcacgttgtttcgcgtatcatattgaaccaaaagctgaccgcttccgtcgtcaaacgtatcgttcttgtatagtgtattgttcacgatcttgcagtttaccgtggagccacgctcctcattgtaaccgcccatggcaatgccggtcagtcggttgttatatatcacgttgctgcgaaccgtaatattactggttgctttaccggcgtgctcagaggcaatttcgacgccgatatcgttgttgtagctgtagttctgctcaataatgctgtccttgcctccatctacataaatgccgccggccgagttatcatcggccttgtaagatgggttattttgaactgaattattatacacccgattgcccttcaccaacccgttccgcgcctgatcgtaagtcgtattcggcgcggtgccctcaaagccgatcaaatcaatcccgatgttgtcattatcgtgaataaggttgtcggtcaccgcaaagccatccacgttgccgtttaaaacgagcgattcgctggagcccagcacgagattgtacagctcattgccgctgatcgtaaggtcgtgaatcgaagccggagctttcgtgccgtaaacagcgataccgtgagtgtcccgacccaaccgatctttgccggtcggagtgaccgtgtttttgatgtcatggattttgttgttggacagattaatgaagccgcccgaaccgtggacataaatacctacaggcaccacgttcttggaagcagtggtaaaattgcggatttcaaacccctgaacagtaacgtaattgacatcggccagttcgatcagcccttcgttcccgctaaccgaaagtccgctgccatcaataatggcggtctctgtcccatagttggtgaacacaatgggaccctgcgaagcggagccagagcgggtaatctttaatttctgcttgtacacgccgcctcggacgtaaaccgtgctgcccgcaggagccacgtcggccgcgtgctgcaacgtcttccacggcgcatcgttcgttccggcgttagagtcgctgccgctcgtggccacataatattctgtaccggccgcggaagcggcgggaggttgcacatttccggccaccagaccaagcccgaaaaccatggctaaacctaccagaaacatttgcccgaatttcatcatgttcctcatccccctttgtttttttgtaaattgtaccataattccactaaatctgttctatggcatcggccattagtgcaacctggtgctcgataccaaggaccgggaggtcaccgtaatcgctgtcgaaagaaccaagaaaccctgcgttttagtaatcgcagggtttcttggtgatctaagctgctctataacgttgccgcagccgccctatcggcagactgcgcatgttcttactccaaacggactaatcctttaccagtcgattagaaagcatcaacatgataaaagagaataaaatgatgacagctacccagctccaagagagtgtcatatttccgacctcggacgcggtgtaaatcgcggtaggcagggtttgggtctgttcaggaatattacctgcaagcatcaacgtagcgccaaattcccctaaccctcgggcaaatccgagaatgtatcctgaaatgagcggtcgataggcaaggggcatcgtaatgtggcgaaacacttgccattcgttggcaccttgcgcacgtgcagcctgctctagctccgggtctacagcttcaaaccctgctttaatcgtacggtaagccagtggaaaagcaacaactacggccgccaccactgcagctccccacgtaaatacaatcgtctgctcgaataggctttcgaaggcagtgccaatccagcttttccttcccagcaagatgagcaaaataaagccgacaacagtgggaggcaaaacgagcggaagaagtaggacggtctcgatcacgctggttcccctccgcggcgtgcagttcgccatcatccgcgctaccacagtagctaataaaaagacgatgatgctggcgacgacagcgactttaacagatacgataaccggaggaagaaaagctgaccaatccaacgggaccccctcctttatctgtaaattctattttcccgtcatttctgtaggggctgaaaatccatctttactgaacacactcattgcttcatctgttcgtagaaaatcaagaaactcgcctgcttcctggctatgtttggttgcttttacaatgccttcaggatacaggatgggtgcatgcaattcctcgggcacttccagtgctatgaccgttttatcggatgatttggcatccgttaaatagacgagtcctgcatcggcgttgcctgtttcaacataatttaatacctgtcttacgtccttggcgaataccatcttaggttccagcttgccccatagtccagccttcgttaacgattctttggaatactgtccagcgggaacggtagtaggctccccaacagccactttcaggaaagaaggacccatcaagtcattgagcgtaatgcttttgttatctgtgcttttcgccttatcttgcggaacaaccacaaccagtttattttgaagtagaacgttatccttttccactaatgaagcatccgttaatgccttcatttgcttcatgcctgccgaaataaatacgtcagcgggtgcgccttgctcaatctgtttttgtaatgtaccagatgaagcgtagttaaaggtaagtttgatatctgggtgctgtttctcatactggcctttaagcgtattcagactatcttgaagacttgcagcggcagatacgactagttctgtcttgggtgcggactgtgccgattgtacagcagccggagacgagcagcccgccagaacccatgccaacaatccaacgaacgtaaatatgtacccaaatttctttttcaacttgtttttcccctatcctataaattccaaaatgagatgacgaaatgtgatagcgaaaataaggaaacattgtacatctcataaccggtcgaatctattgggtcaacccaaatatttgtgataaatcgatctcgcctcggcgatgtccttcgtgccatgaattaagacgcgtccatcctgaaaaagaacgattcgatgcgttccgataacaacggataccaggtatggattatgctccaccttgcccccctgacgggataacaaacgtgccgcttcattcagatcacgtacagtacccggggcagggcggatttgaaccgtatctcgtccgcacaagacagccgttttagcctgatgctccgattgtaaaaaaggatacactgggtgctcaccacacgttgggcaatcggctttcttcatggcgctgatttgaatcgcctgatgctgattgttccacagatcgaaagaaatcagcttattttgcaaagccgaatcgtccccggtgagcagcttcaatgcttcggcgctttgataagcggccaccatctgtacagccgggctaatcacaccgaccgtatcacaggtcgcaccgccaagcggtacggtcccgagtaggcaatgcaagcacggtgtctgtcctggcacgatggtaaaggttgtcccgtagctgcctacacacgctccataaatccagggaattcggtgcttgaccgcataatcgttcataagcagacgtgtatcgaaattatcggtggcatctacgataagatccactcctgctgcgatatcgtcgatttcctccagcgagacgtcacggactagcgcacgaatgtccacgtcggaattgatttgctgcaatcgcttctgcgcggccactgccttggggatctgatcacgggcatccgtttcgtcatagagctgttggcgctgcaaattgctccaatctacataatcacggtctaccaacgtcagccgtccgatgcccgctcgcaccagcatgtcagcattggcagtgcccagtgcgccggcccccaccatcagcacgtgcttactacggatattttgctggcctgtcggtccaattttcgagaataattcctgtctagaataacgggcatgagacgcatgcgcatgtgcttgtgcatcaacttctattttctgatttttgtccatttctgacatcgttgatttacgcctccatacttatccattgatagctacaagttgatcagacaagctaaaagttcaaatgtcctcgcccttatttgaaagctttggggtactttgagggttccagccacccagctgatgccccttccattctgagccgtcctcccacacttcctttttccaaatcggtacgatttgctttaaccgttcaatggcatggcggctggcttcgtagcaagtatcgcggtgtgcagcagagacagcaatcaccacactcgtctctccaattcttaccgtaccaagccgatgtgtaatcgcagtacgtgtagaaggccaacgctctgcaatttcgtcaccaatctgcttcatcgtgttcatggccatcgggacatacgcctcatattcaagcagcaccgttcgctgaccttgcgtaaattcccgagtcgtaccattgaaggtcagcgaggcgccatgagaagggtcgagcacctttgaggttacttcatcggcatcaatcaggtcgtacgtaatggcaaataagccacattttgaaacgaccgtctccatcccgggtgctgactgatgaagagcaattgtatctgatggaagcacaagttcatctggagaagccaactttttatgatgggtaaaaaaagaacctggcagttgtgaagttacttccgggtacagctcattcagcctttttcgaatgtctgcaatggtcaccgcttcctgtgaaagttctaccgtgatcacatcaccaagttgctccgccatacctgcgaatagctgaatacggtattgcatatgatctgcccccttgcacctattctatcgaattcatttattctattaatagaatttaccctcctgaaaccggaggaataatcgcaatctcatcatggatacttacgaggtcctcaggagcggcgtaggcttgatttctggcaacaaaagaaccctgcaactgggctgctgcttcagggaaacactcggatagcaagtcttttaacgcggcaacgctcatcgtttcttgatcagtaggcaccgtgattataggccctcccatctgttccgcaagtccggcaaatacttgaatatgatagttcatttaacatcccctccttttcagtacagtgactgtccaccacatatgtaccaagaaaaaccaacatgaatgaataccccgaaaggttttttccatgctggttaactatgacggtgtacaatgaggatttgtatattatattttagattcaaccagttcatcaatccgctcggtatgcgtatatacattcagagaatgactgcgtataaagccgacggttgtaattcccagatcctcagccaactcaagtgcaagctctgtgggagctgacttggacaacacaacttcacagccaatctttgcaaccttcaacaaaatttcagacgaaatgcgcccgctgaaaactatgattttgtcttgtaatacaatatcatgttttaggcaatgcccatagattttatccagcgcattgtgtcggccgatatctattctggacaggatcatcccgtttttatcgcacaacgctgcattatgaacaccaccggtctcttggaacgtaagtgccgagctttgcattaaattcatcaagcggaaacaatcgtcaaaagacagcgtaacatgggtgtcattcattctttttgccactttggcatcattcataaaataaaagccctgtctgctttttccgcagcaggaggtaatgtaccgtttggaatgaaagttttgataaaactcattcattcgacgggttttaatatgaacaaaaccttctttttcctgaacccaaatatcttcaatatcatcgtaccgttgaatgacgccttcagaggccaaaaaacctactgccatatcctccacatactctggtgtacaaaccatggtagcaaattcctgctgattgattttgatggtcaccggatgctccgtcaccacagtgtcttcaaaacgcttgatctgaccgtcacgataacgtagaatctcacgttttacctcagctggcttttccatgtgctccactcccttgtttctgacaggcgggctcttcggctcacccgccgatgtgtgacatttcaattttagacgttgcttgctgtgtatgattcagccgttcctctgaatagcggtcggtacgttctctccaaacacgctcaatgtaagctctaatctcgtcatcagactgttcggaacgcagcatcgcgcgaagcttgtacccttgagaggcaaacaggcacgtgtacaaggagccttcagcagaaattctcgctcgtgtacatgtggagcagaaggcgtccgtaacagacgaaataataccgatttccccgtctctgtcctgatacctgtagcgcgtcgccacctcacctttgtactggggcggaacaggctctaacggcatatgctcatgaatggcttcgatgatctgctgcttggaaacgacctgatccaatttccagccattggtgttgcctacatccataaactcaacaaaacgtaaaatatgctttttcttttggaaatagtcagccatgggaacaatatcctgatcgttaaagcccttttgcacgaccatatttattttcacctgcatccctgcttgagcggcagcctcaataccatccagcaccgcctttacactgcttctgcccccgttcatttggcggaaccgatcatcatcgagcgaatccagactaaccgtcactcttttcagtcccgcctctcgcagtgctacagcatatttaggcaaaaatacgccgtttgtcgtcattgcaatatcttcaacgccatcgagttgagttaacgaatgaataagcaaggacaaatttttcctcagcaacggctcaccaccagtaatacgcaacttcgtaacgcccagcgagacaaaaatacgggaaaggcgcgtaatttcctcaaaggtcaatattttttcttttggcaaaaacggatagtcatggccaaatatttcttccggcatacaatatcggcaccgaaaattacatcggtctatgacggatattcttaagtcccgtaacggacgattccattgatcgtcgctccggttcgccatcctgttcacctcaatccgtcttcattaataaaactctaataaaactctttacactctaaattggaacggtatttccattcattatatactgaaccaaaaaaccggcatcacaacaacttcttcgcttatgaatatcgaagaatctgctaaatgccggttaatttatctacatcaggattttacgaatcccacttcatgtgatatagaaaaatcaaactaacaagcgctgcgacaaataaaatatacgcggttcccacgcacactccatttacgattgctctgaaatagattacattcctattgttagcaatcctggaacgtttgtcaatgatttttcgatttctcaaacgataatcattatcaattaaaaaattaataatgtaccgttgaactatcttaaattttacgttatagttacacgagatgacatgcagaaaatgacatatctaagttattcagaagttattgatatacagacggtgcgtactgtttgttattaatacatattcaaatggcggattggcctccaggacctagagcttggtcactactccaccataaacacaagtgctggaacacgagcacttgtgtttatggtggagtttttttattcctaatttttaaatttaaaatctgaaaggagcctgaaccgtgactgatagtacgatcaaaattacattaaacggacaggaactgaaaacgaagaacagcgcaacgattcttgaagtgattaacgaaaacaacatcgcccatccccagctgtgttacgttcccgaagtcgatccgatccgcacctgtgacacatgtatcgtggaagtggacggaaaacttatgcgttcctgctcaacactggcttcggatggaatgaatattcatttacactcggatcgcgcgaaagcagctcaaaccgaggctatggaccgattgctagaaaatcatctcctctactgcacagtgtgcgataacaacaacggtaattgtactttgcataatacagcagagcttatggagattgaacatcaaaaatatccgtatcaaccgaaagttgacccgacagaagtagatatgtctcatcccttctatcgatatgaccccaatcaatgtattgcatgcggccaatgcgtagaggtatgccaaaaccttcaggtcaatgaaacgctgtccctcgactgggaagctgaacgccctcgcgtcatatgggatgacagggttgcgattaacgattcctcctgcgtcagctgcggtcagtgtgtaaccgtctgcccatgcaatgccttgatggagaaatccatgctgggagaagcaggcttcatgagtggcatgaacaaggatttattaaatccgatggtggatttaataaaggaagtggagccgggctatagtgggatttttgctatttccgaagtcgaagcagcaatgcgcgaaacccgtacgaaaaaaacgaaaaccgtctgtacgttttgcggtgtaggttgcagctttgaggtttggaccaatggccgcaaaattttgaagatacaacctacctctgagggacctgttaacggtatctcaacatgcgtaaaagggaaatttggctgggattttgtgaacagcgatcagcgtttgacctcccctttaattcgtcaaggtgacgaatttgtggaagctacctgggaagaagccttgagcctgatggccagcaaaatgggagctattcaagaaacttacggcggtgaggcactcggctttatttcttcgtccaaatttaccaatgaagaaaactatttgatgcaaaagttggctcgtcaggtcttccaaacgaataacgtcgataattgctcacggtattgccaatctcctgcgtcatgggggctgcaatacaccggaggcatcggtggggacagcggtacgattaaagatattgccaaagcaggtttggtcatgctggtcggttgcgcgccaggagaaggacatccagtgctggctactcgtatcaaacgtgcgcataagctgcacggtcaaaagttgatctcggtcgacctgcgcaagcatgaaatggcagaacgcgcagatctgttcattcgtccgaagcaaggtacggattatgtatggttatccgctgtagccaaatacatcattgagcaaaactggcatgatgcaaaattcattgaagagcatgtaaacttctatcctgaatatttgaagttgctagatcgtttcaccctggaatttgccgaacaggaaactggtatttccaaagagacactgattcaggtagcgactatgattcacgaagccgacggcactgccatttgctggggcatgggtgtgacgcaaaacatcgcaggctcttacacttcgattgcaattgccaacctactgctggtgactggaaactttatgcgtccgggtgcaggcgcatatccgcttcgcggacataacaatgttcagggtgctgccgatatgggtacaatgccggatattttcccgggctatcagcccgtgacgaacgatgtcgttcgtgccaagttcgaagcggcctacggcgtacaaattccaggtcaacgcggactagacaacattcagatgctggaagccattgaaacaggtaagctcaaagcgatgtatatcgctggagaagagatggcatgggtggatgccgactccaaccatacccaagaaatgctggcgaatttggatttccttgtcgttcaggatgtatttctgagcaaaacagctgaattcgccgatgtcattttgccagccgtaccttcactcgaaaaagacggaacctttacgaacaccgaacgtcgtgtccagcgtttatatgaagcactccgccctatgggagacagtaaaccggattggtggattttcagccaatttgccaagcacatgggatttgattgggattacagccatccaagtgaaatttttgaggaaatggcgtcgctcactccatttttctcccaatgtaattatgacgtattggaaggctggaacagcttccactggggatcgccggatggtagcaatacaccgctactgcacaccaacggctttaactttccggataaaaaagcgcgtttgggacttttcgaatatgtaccaccgaaagagtaccccgttgaattcgatctgaccttaaataatggtcgactgctcgaacagtttcatgaaggaaatatgacgaccaaatcggcaggcattcagctgaaacttccaaaagtatttgtagaagtgtcccctgaattggctgaagagcgcggaatccataatggatcgctggttcgattggaatccccttatggtgcggtcaagctacgcgttctggttacagaccgggtgcagggaactgaaatttatgtgccgatgcactctaccagccatgatggtgcggtcaatctgttaactggtggagcgttcgatgtggtcacccgtacaccggcctataaacaagccaaagtacggatgcaaattttggaggtagacggtcaaaatccactaccacgtatcaatccgcgttacaaaaagcgtcatccgcaaaatggggttgaagtggaccgtaagtggaatcgtcccggttacgtcgatttagtggatcaaaaataaggaggtcaagccgtggctaagcctatttcaattgtgagaaaacgcattttgacagaagaagaacggcaaaaacaatcgctggatcagcttactgctgatctggcggacaatgaggcggcattgcagaagacacttgaaatcgtacgcgagctgcacgatagtggtcttctcgaagcagctcagtctatgctaaaggctaaagaaagcatcgccaaaatcgctgtaggacaagcgacgcgtaagcctgtgacgaacatcatcaataatctcatgggagcagcagggatgctgtctgaggtagaccccgagctgatgaaaaagctggcaaacagtgttactaatggcctgaacgaagccgataaacatctaaagcagaataaaaagactcgtctgcgcgatcttatgaaggcgatgaatgatccagatgtaaaccgggcaatgggatttggcattcattttctcaaaggagtgggaaaaagtttgtctgataaataactcatagagcgtgaaggtggaagactagtaacaacagacaataaaaagagctggctccgaaaacgggggcagctctttttatttattttttatccacctgtaatagcgtcaccgttttaagagaaacggcatcttttatttgctcctctgcgatgaccttgagcttaagcaaactggcaatcttcgatgtatccggcttggaaaacaagcgccatagctgcggatcaggcagtgaatcatacagctttgtatgatcgtattccttgcggtgctgctttataatcttgactcggtagttgccaatttcccaatctgatacttcctgctgtgcacaatgtgcggtaatgtcattacgcaaatcagtcagttcaccttcaatttctttttgcttttgctttaactggtagtagcgacgcaccttgttttccaatcccatcacgctcctctgcttacatatgtatgtttgcagaagcattttaggacaagttttgtgatgttaggattgaaggtataaatacaaaagcatttcccgggtaatggaaaggtccttaagtcgagccatcatcatccaaactttatttaggcacattcgcccctggatttacaggccctgctccttgggatttccccttacgtttcatataattggcccagtatgccgtcagaataggtactaaaatcgaggtcacaatgaccgaagcagcaactaaggccgttgcagattgcgctacaggcagaaactcaggcttgatgttggccacaatgactggattggctactgctgcacctgctgtactggaggctgcaatccctgctgtaccgttgccaccaccgatatatttgtccgccaaaatcagtggaatacctgtaacgataatgacaaaaatacctaataaaataccaagcatacctgtctggacaatgacactcaggtcaatggaacaaccaagtgcaaaaccgaaaaatggaatcaaagcttgcgttgcgttcccaaaatattttcggaaatcatgatccagattgcccaacataaatccgaccaaaaatggtaataccgcccccacaaaggtctgcggttcaaaaacggccagcccggtgctacccaaaataatcatggtcaccaacggacccgattccagtgacatcagtacaaatgctcctgcctcttccttggagccatactgctgcataatagaggcgtataacccgccgttcgtcatatccatagccgagatcagcgccagcaccgacaaacctgcaaatagcccactttctataccactaacaggcagcaatctggatgcaatgatcgccactacccacgcgaccgcgattttagtcaacacgagcgttcctgatttacgcaatacagtacccgtcgctcgcacatctatagaagcacccatacaaaaaaaccacactgccaagatgggtaccgtacctgtcatcagccccttggtaaaagatccaaaatagtcgcctgcccatggagtaaatgtatgaaaaagcgcgccaataaacagcggcaccagcataatgccccctggaattttatcaatgttttgtttgattttcataacttcgttcaaccctttcgtttttgccaatgcaaaaacaaggccgtgttacttacggctcaagccgagctcgggaatcagtctcgcgaaggtatcgtgactctccttcagttgccgcgcgaatgcctctgcatcctggacacgcaatcccaacccatgcttacgcatttcctccctgaattcctcgtctttcgtccccttgatcagtgcatccgtcagcgtttgagcaacttcctccggtgtatccttgggtacagccagccctctccaagtgccgataaaatgtacacgtagcccagtggcttgctgtagtgtcggcacttttggaaacgcttccgaaatagtgtctgcctggatcgccagtatgcgaagtttcccttcgtccacgtatttcttcacttctgcgggactgacgggtacagcatccacaaatccgctcattaaagcggagacggctgggcctgctccctcataagggatatgggtaaagcgaactccgtttttctgctccagcatcgcggcagcaaggtgccatatgctccctgtgcctgcattccccattttgagcttgccgggatgggccccagcatcctccagaaatgcctccgctgtcttccatggtgcatccgcccggaccgtaatggcggaagggtccatattggtttgaagaagcggtttaaatcgctcataggtgagcggtagcagtcccaaatgaggcaacgtagtcagctcagcgaccagatacgttacggtataaccgtccgcctgcgcctcagccccttccatcagcccgacagaaccgcctcctcccgttcgattaacgacgatgatcggctgaccgagatgcttttcggcggctttcgccaacgctctcgcggtaatatccgtaccgcctccggctgcgtaaggaacgacgagtgttattggcttcgtaggaaatatacggctgtgatcctgcaaggtgtggtgatccacatattcactgatactcaaggcagaaagcatagctactcccgccgcaaccagcacatatttttgccatggctttttcttcattacgtttcctcttctccaaaaatgaactgggcccgtcatgcgcccgttgtcacctccaacgttttcggtcttgttgtttgcgtttacatgaagtcaatgtaccgcaacgtggagggctacagctatcgcttaatcttcgtatttatcttctatttcgccaaagtatcgaccttttgaccgatctgcatattcattggaagatttgctgatttgtctgaatttccctggggttacttgtttggtgcttgcggaatacccggataaagctgttctcatttcggtatccgacctgttctgcaatttcaccgattttcaaatgggtttcacttagtaatgtgcatgccttttttacgcgtaatccagtcaaataatcgtaaacggtggtccccgtttcttccttgaacatgctgctcaccgaggacacgctcatgtgaacatgatccgcaatttcctgaagcccgatgttcaaatgtaaatgattttccatatactcgatcatctcttgtacacgcacaaaatctttggactggatgcgtccattccatttttcttcaatatcagtcaacataatgaccagcaatacctccatgtcatgaaggtctagcgtcagaatctgattccagtggtaatcagcaagctgctccggcggcgtcacactctgagtggcacaccattttagcaaatcttccagcaattcatgaacaaacaagtagacctgagctggggatgttctgtggagtcgaagttcttctacccagtggctgattagctttacacttgcaccaggttcctgtgactccagggcacgaatcatttccacacgccgattgtccagcaatgttgaatcctgaatctgctcctttgactgttcatccaccgtattatcctttttcacacttatactgctgtctatattcgtatatgaacgtccatacccctcatacaaacgcaaattaagggcctcttttcctttcataaaagacgcccgtgcctctcgaatatccgtgaccatatgaccaatccctatagaaatagtcaaaggaagatactcaccgacaacctgaatcagcctatccacgtttttgtgaagcaaaatgctctcttggaggtcagtctctgtaccaacttcattcgaactctcgctgaactgtaacagcacaataaaaccactttcctcctccggcgagcatactgctttccagtgaggttcgagcatctctagcaaaatattgttcagcgcatacttgagcagcattttatcttcttctggaaagcttgcggcccacgcagaataccggtcaatggacacgatcatgacaaacaaagaatggccgtcccaatcggaaaaatactgttcccatttcatacgcatttcctgtatgcccattctacgctggatgacatcttccatatatttggaacgcagctccggcaggcttcgctctaccaccaatgatttgcggtgaaactctccaaccagtttgctaatcacaggttccaggtcatacaatcctccttggcgcgttcctttattgcccgaattcaataggctattaatttttttcatgggacgaaaagctgcataattataatagtaaactgctgagcacccagccagtatggagataaaggccagccacagcatcatattgcgcgccagctttacatttttcagcagcttgtccatcggaacgagcgatactagacgccagcccgttacatcagaaaaggtttggttcgccatatattccatgtcctctatctccacataagcatagggactcacatccagttcttttaaaatcctgcccatatcatttaagggtaaggacgatctcagcttgggatagatcaactcgccctccagatcatacacgtattgcgagttggataaatgaatatagagtttggagaaaaaacggtcataatccagattgattagcaccgcacccatgacctgaccattctctactatgggcctggccagcgaaagcagctctaccgccccctgctcacgatcggtgccgtaccaacgccgcttaatcaacaacggctttttttcaatatcctgaatccagggaacccatgtggtatccggtgcctgcttccaatcaggcctgtaaccataattgctggatacgagagcatgattgtccaaagaaataacttcaaccgagtaaatttcttcgtgcgaagaaagggttttcaagtatttgtgaagccgatctatgacggaggccttgtcttccagcgattccccatctgtttggacacgtacaaaggcctctacgtctggatgatatgctgcgtccagcgccttgttatcagactcacgaaaagcccgattggtcacatccagattgatttgcaacaattctatattgggtgtgttcagctcggtatccaaaccttcacggtatcgtgaatacgatagcaagccgatcacgctaattacaagcgacacgcacagagtgagcagtagaatcaatcttgtctgtttatttttcagtatcaatcgaagcttaagtcgcaacattcccgtaacttcatccttccggacttcgttgtccatcttcctcttgccaatatacgtggtgacatattctccctaaatctatttgacgtaagagttggaattccctgcctatgtatatcaaacttaatataaggattcatataaaaaagaagaagcctccctgtactgtacaaggtagaactccttctttggcactgcttgtatcattattcagcaaaaacagatactcgctgcacaggttttagctagtctattccacctggaaacgatctagctcccgctgcatctcttcgcgaatctgacgaagctcttttaccttctcagccgattcctcaaatgaacgcttctgctccaccgtggaagccgtaatctcttcactgcctgcggcggactgctgagtgattgcgctgatattttcaatagcttgctgcacctgtacgctcagttctcgcgatacattcatgtccgttgataacttgctgacttggctggcaatttgctgcactttgccactaatctctgtaaacgattctccagtcgaggaggttgccttctcctgctcacggaacagctcctgactttgcgccacagaagtcttcaccttatccatagcctgcgtgatactgtcaacagcagtataaattttctttacagcagactctgattgattcgccagctttttcacttcattggcaacaacagcaaaaccttttcctgcttcacctgcacgtgcagcctcaatagaggcattcaaggacaacagcgatgtttggctggcaatttcggatacgtatccagtcatggttgtaatctcggctgcattcgtctccagctccttgaccgtctgctccacttcggacatggctgaacgattttcagcaacgatacgcagttgatcgctcatgacccgcgtaccctgctcaatgacacgcaaagcatcctcactatacgcggtcgattgtgtggtctccagtagattcgattcaaacttctgctgcatttcgtccacaacgccaactgtcgacgacagatcctcagcaattttctgactgcctattgccagttcctctgttgacgtgctgacttgtgtcacaatttccttcatggcctcattatgctgatcaatatcccgagccatcagatcgacacgattacccgcctgatcaatggagagtacaatgctgcgcaagttcccgatcatcacccggaaagattcattaagctcgtccagctcatcgcgtcccttggtttgggcaagctgcactgtcagatttccctcagcaatttgctttgcggcatccgttaatttgcgtgttctaagggcaagctgtctggaggtatatgtattatatagcccaaccgccaccagaagtataactgcacctgccaaggccaattgccatgtaaaacgaatgctcttggtcaaatcttctgtgtattggtcataacgtgccttgctcagcagatccagcataaatacatcgttctgaatcccttgggcacgcatggcctcccgcttggactccgggctgttttgggtactcatggctttctccgttgctactttcaattggctgaattttgttttaatcgtattcagtcgcttttgctgcgcctcggtttgcatcatgccctgtgaaagcaaagcaatcgtcttttcagactgagtcagttgattttgcacatcggctttgttgctctccgtcatggaagctgaataattttgcattgcctgtcctgactgaatcaaataggcattgagctgctgtacattcaacatagccggaaccagattactactttgcgagttaatacgaattaattcaaaaatgatataagccactaaagccaggcaagcgatcaaggaaatcatcgcgttcagcaccagtttaccttgcagtttcatcagctttcatcctccgtttgcgaaaatttattgggtgggaacagtcagtgtgccggatttgattttttcctttaaatcatccaacaacttttgctgatccggactcagtgtcacgacacgaataggcgccaaacctacaccatcttccgcaagaccaaacaccatatccttctccgtaaattttctttgatgatctgcaaatcctttgactgctgtataaattgcaatgtctacatttttaaccatcgaggtcactaccgctttttccgcaataaaaaactggtcgctatcgaccccgatggcgaatttatgctgcttttgcgcttcttgcagcgcacccacacccgtaagacctgcggctgcaaagatgacatcaatctgatcctgattaatcatgtcatctgcaatttccgtacccagttccggctttccaaaatctcccgcatacgttgcagtaactttggcattaggcttgactgattgcactcctgcgcgatacccaatttcaaattttttcaacagaggagattccgcacctccgagaaaacccacctgttcggtgcgactcgtcaaacccgcaacgactccagccataaaactgccctcttctgctttgaagctaatagaggccacattcggtaaatctgatttctcatccacgattaaaaatttacggtctggatattttttagcaatggattccaaactgtccttcaccatgtaacccagcccaatgattaaatcagccttttcttgagcaagctgttcaaaagccgcatcatacgtcttggtctccgttatttctcggtattcaaaaacaattttcccctcatcccgtgctttgaccaaaccccggaaagcagcgtcgctgtaagattggtcacccagaccaatatctgacagtacgattcccaccttaatgggctgagccttagtttgggctaccgattgcccacatgcacttagcaataatgcaaagattgtgacaatgggaatccacctacaaattaataatactgctcgcttcttcatgacatatcacctcggcataatttggaaatccccaacatctttatatcggttataaaagcatattttttcataagagtttctgtaaaatcattgtaaatagaatatgataaataagattattttttccctatatgtaaaaaatgtatattttcgtactccttttattatacgaactgtccaaattcacttattttcgtttatgtcgtaagaataaagtgtaatttggaaaacataggtactctaaaaccatcactctatttcaatccgaaaggagcaacattaaaaatgacttcgaccaatttaattccacagcccaaaacttatggtcccttaggtaatctgcccttgatcgatacacatgcccctgtccagtctctggttaagctttcttatgagtacggtccaatttttcgcatggatctgcctgaaggaacgaacatttatatttctggtcataagctggtcgcagatgcttgtgatgaatcccgtttcgacaaacaagtgtgggctccattacaaaaagtacgagcttttgcaggagacggactattcacaagctggactgaggaaccgaactggcgcaaggcccaccaaattttactgccaagcttcagtcagagggctatgaagggttaccacaatatgatgcttgatcttgctgttcagctgatacagaaatggtctcgactcaatcccgatgaaagtgtagaggtaccggaagatatgacccggctgactttggataccatcggattatgcggctttaattatcgttttaacagcttctaccgcgatcagtcccatccgttcgtgaccagtatgacacgcgcattagatgaagcgatgggtcagctgcaacgcctcaatctgcaaaacaagctgatgttatcgaaaagaaagcagtttaaacatgacatcgaaacgatgttttctctggtggacagcattattgaagagcgtaaaacccttggcaaccaaggagaagaagatttactagcgcatatgctggaaggcaaggacccggaaactggtgagacgctggatgatgaaaatatccgctatcagatcatcaccttcctcatcgccggtcatgaaacgaccagtgggcttttatcctttgccatttactatttgcttaagaatccgcgaacgctaaccaaggcctatgaagaagtggatcgcgtgctcactgattcgctgccttcttatactcaggttcgcgaactcaagtacataaggatgatactgaatgaggctctgcgactatggccgacagcgcccgccttctctctctttgccaaagaagatacgttgctcgacggaacctacccacttaaaaaaggtgacagcgttaatgtactcatcccaaaactgcaccgtgataccgaggcttggggcgaagatgttgaggaatttcgaccggagcgcttcgaggacccatccgccattccgcaagatgcctacaaaccatttggcaacggtcaacgcgcctgtattggacagcagtttgccttacaggaggccactcttgtgctgggtatggtactgaaacattttgagctgattgatcatactcattatgagttgaaagtcaaagagacgctcacactcaagccggagggcttcaccattcaagtacgcccgcgcagcacacagactgctgtcatgctcccaggtgccgttcaagaacttcatgaacaagaggaacaaaaggtcgcacccccacatgccgaaaagcatgatacttctttgctgtctttgtacggctcgaatctgggtacagctgagggacttgcaggtgaactagccgatttaggtcgaaattggggtttcaacagtagcctagcaactctgaatgatcatgtggacaatttgcctaaagaaggcgtggtacttattaccactgcatcttataacgggcatccgccggataatgctgatgcctttgtacaatggttggagcaggcaggcgaagggcaactggcaggcgtaaggtatgctgtattcggctgcggcgaccgcaattgggccagcacgtatcagcgtattccaaggctgatcgacgagctgatgtctgccaaaggggcaatgcgactgtatgaccggggtgagggcgatgccagcggtgacttcgagaaggattgggaagcctggaaccacggcttatggccggatttgttgaatgctttcggggtggagcacaatgatacagaaccgcaggacagcaacagcctgagcatagagttcgtcagcgccatactcagtacacctcttgcagacaactacagagcagtgaccgccgtcgttacagcaaatcgtgagctgcttgctgctgaaagtgaacgcagtacacgacatctggagctcaaattaccgaccggattgtcctatcgcgaaggtgaccaccttggtgtattgccgcgtaatcctgcttcgctggtcaaaagggtgatgcaacgctttaaattacaggaacaggattacatcgtattgagaggcagcgaccgggatgcggcgcatctccccttagatcggcctgtcagcataggagatttgctcactctcagtgtggaactgcaagaaccggcaacaagagcccagctacggcaactggcatcctttaccgtgtgtccaccgcacaagaaagaaattgaagctttgctggaggatactacctttgatcgagagatacgacagaagcgcgtcacgatgctggatattctggagaagtatccagcctgcgagctgccatttgaaaactttatctcgctgttaccaccactcaagcctaggtactactccatttcaagctctccgcttgaatctgataattcggcgagtataacagtgggcgtcgtgcgtggaccagcccgtagcggacaaggtgaatacctaggaatcgcctccaattatttagcacagctccaaccagatgattcaattgtcatttttgtgcgtaagcctcagtcgggcttccgattgccagaagacccgaccgtgcctgtcatcatggtcggtccgggcactggagtggcaccattccgcggattcctccagacacgccatctacttaaggagagaggagaacagctcggcgaggctcatctatactatggctgccgtaatcctaagctcgactatctgtacaagcaagagctgcaagcctgggagcaggagggaatcattacgcttcatacagccttttcacgtctgcccgatcaacccaaaagatacgtgcagcatgtcatgaaggaagatgcggacgctctgattcacttgcttgatgaaggagcgcatctgtatgtatgtggtgatggtagccggatggctcccgatgtagaagacaccctttgtgctgcttacgcgaaagcacaccataccagtaaagaagaagcacagcaatggttggatcgtctccaacaggaaaaacgctatgctaaggatgtctggacaggcatctaatgataacaatataagagcaagcatcatgttaaaaaataaaagggactgatttctggacttcgttctcgtcgccagtaattcagtcccttttatgattatctttcactccatttggaagcaatcacttcggttttactctctataagatccatgacttcctcgcggcgtttcgtcttgaataaatcaatcatgtcgatcaagtcattgcggtctaataatttaaccccgttgacagcagcaagtgttttacaggattccgtataacggccggaggtgatgacgacagacttgtcggccgcataataacgcatggaggtataaatttcctgcaccgcgcccaaacctaccggatgttgtaccccataacgtttggcctgtatgacaactctgacgccttcacggtctgtaaaaaccagatccgctccaaaatcccggctactggttgttttatagatgtccttatagccaagcgcggataataaccgctgcaaataaagctcaaattccgaaccatcctccatacgatctatatcctgaattccaattttgcgtgggtccagatcacgtaaaatccgatttctacgaccacgtatcaatcctctgatgatgagcgcaaacaacactaaaagtacaatgagtcctattcctaattccttgtatgccaataatttttctagcaacatccaactctctctccctcttctatcgtaagcatagccgtatcatctttaacagggaactcccctatgcaggctggctcccgtattacatctctctttatcacataacaatagccccgccagattcgacggggctatcttcgtcttgcctcaaagctgtctaaactccatactccgcatcattattcgcgattcagcaacgattctccggcaataccaggctgagtcatttggtacgggtccaatataatgtccagctcctcctcggtcagtacattgtacagcaagcacagctcgcgcaccgatttcccagtcgtaattgcttcgcgagcaatgcgtgataccacctcatatccaaggtgcggattaagcgctgtaataatgcctacactgttctccacatattcacgacaccgctccacatttgcttcaattccttccacacaatgaatgcggaacacgtgaaagccctgcttcataatttccagcgattgcagtaggttgtacaccagtacgggctccattacattcagctcgagctgaccagcctctgaagccaagcagattgtatgatcattaccaatgacctgaaaagcaatttggttaatgacctcacacatcactggatttaccttgcccggcataatggatgaccctggctggcgggcaggcagactcagttccccgagacccgcacgtggtccggaagccatcaaacggatgtcatttgccaccttagacatattcatcatacaaattttcaaggcggcagacacttcagtataagcatccgtattttgtgtagcatctacaagattttcgtcagcttccacagggaagccactgacgtctgccagtacctctgcgacacgctgaatataacgacggtctgcgttcaggccagtacccaccgcagttgcgcccatattaatcgttagcaggtgctgcttggtcgcacggacgcgtccgatatcacgacccagcacgcgcgcataagcctgaaactcctgtcctaatcggattggcactgcatcctgcaagtgagtccggcccattttaatcacactatcaaactcatttgccttgcgggaaaatgcttcctgaagctcactcatggtagctaacagcttatcaatcatacttaatacagccaagtgtacggctgtaggaaaagcatcgttcgtcgattgcgccatattaacatgattattaggactgatctcctgataatctccgcgctgcttgccaatcagctccaacgcgcggttcgcaatcacttcatttgtattcatattaatggacgtgcctgcgccgccctgaatcggatcgacgatgaaatgatcatgcaactgtccttgtataatctcatcagcagcctgaataatggcctctgctttggggcggtgtaaacgggttagttccatattcaccgtcgctgctccctttttcacgatcgccatggctttaattaactcagggtgcagtctttggcctgtaattggaaaattttcttttgccctcagcgtttgtacaccataataggcatctaatggcacttccttggtacctaaaaaatcatgttccaacctcatattctctgattcctccgctgtgtttgctacgtttcttcagttcagtacaccaaattgacataaaaagaccttctctgatccccctcttcattatacgtttctattcccgtgcttttccagttgaataaacgcggaaaaagctatgtaatcctatgacaagttatgattacccgtatataccacacttgttcggtaaatgctcagctatgacttgaatacggatttaatgacttataataatatcgagtggcatgaagctgaccatcggctgattgagcataacccggaataacaccagcttctacaaacccgatgaactcgtatagtccattggagggatcacccacccgcgtatctagcaccagtaacgttctatcctgacttagtgcctcttcttccgctgccttcattaactgtcgtgcgatccccagtctgcgaccggacggatgtaccataagctttgcaatttccgcacgatgaatagcgttagctttttgagccaaatgaagctggaccgtccctacaggtactccgtccttctcggcaatccacagaactacgccgtcctcaagtacattgttccaataagttgctgcttcctgataacctaatgggggtaagaaacctatagatgcaccgtctgcaaccacgtcgattagcagtcgacttagcgaatctaccagggcttcatccaaagcctgaacagggtagactctcatttcgttagacattgtgattcctcccgatgagttcgataatatacaataaagaaagcaaactatctttttaggatagtttactttccataatacttcgcttacttcatcattctcatttccattactgctctgccatataaaagaactcccacagatgaccatccaaatcctgaaagctccatccatacataaaaccatgatcttgaggttcgtttgagggcttgccgcccgcttccaaagccttgtggacgatctcgtctaccttttctcgactttccaccgataaggcaacaattgcttctgtgctttttgtggcatctgaaatttcctttgtcgtgaacgctttaaaacgttcttcaaccaataacatgacaaaaatatgctcactaacaaccatacaggttgcatgttcatcagtgaactgagcactgaattcaaatccgatggtagtgaaaaaatcaatggactgttgcagatttttaactggcaaattcacaaaaatttgtttagcttttactcccacgacatttcacctcttcatttgtcattcattctaatttatcatactacctctccacaaaagataacttaactatcgtataaagtcaatcaatctaacatttgtatagggaaatctcctattcccaatgaagcttagccagtgtacgagataatacagccgcagcttctgccctcgtcacggatgtagccggaccaaaacggcctttctcgtctcccctcagaatacctagtccagacaaagtcttcacagccggagctgcccatgtagaaatctcctgcgcatccgacaatgatacagatatactttcactcacttctcttgtattttcttctgtgttcccaacgaagcgcaaggctctctctatgatcacagccagttcctccctcgataccggggtatcaggacggaagcttccgtcagtatagccgttgatcagcccagctgctgctgcggtacgtacggaatccgcataccacgattcgggttgaacgtcgtcaaagctcgtcagcgtgcgatcagtacgctccagtccaagcacacgaaccagcatcgctgccagttcagagcgtcgtacctggccttcaggctcaaaatgtacgttcgctaagtccctttcacgagtagcactagctgtagacgctgttggatcggtccccgtcacaagcagacgagttgccagccgtgtaatgtcctgctgcgcccaatgaccggatatatccatgaacgatctgacttcaccagaagccccgccatcaagcacagcgtaagtccctcccgaacgtccatacacggttatttcctcactcgaagtgtgaaaaggaacgggggtatatgatagctgtccggcttggttggtcgataccttcactacagcaagctgctctgcatcgaccgttgcaggaacacgtaacagataacgttcatacccactaccagagtctccgttacctgccaaaagctgtttcggtccatcctcgcttctcagctcagcggcgatattcaaagcctgtaacagtttgcgccctgttacatccaagcgtttagccagttcttcgttcgaagcgatggaaaaattcaaggaaatttgttttacaggcacctgccaggtatcagccagcttttgaagagacaaacgacttgttgctacttcatatccaccttgtggcgtttccactcgaagggtacgaatacggtcgttcaaaacggcttccaaagcttccccgcttaaatgaacctcgtacgtccccgcttctacttgctcccctgcacggatcacaagcgtacccttcgcaccattttgaatggccttttgtatttcagcagctgttacttgagcaattgcctttttcagtccgttttgctccactccggtcactacagacttgacttgcaccacatttgtaccagacaggctgcttccattgggttcaccactggcggtctgaccctgcccatttaccgttccattcgcgttaccgctactgccatttccagcgttggcgtttccctcgttatcctgctgatcctcatcatcatcgtcatttcggccactcccaccctctgtcggtggttcttccgttttgcgcgacaaatctatttgcgcaaccaacggatcatgatcactgacccgcccgtccgccgcactaaagtctgcattcatatgaacgatatccagcacggatgttttgctcagtgacgggctgaccagcatatgatccaatgtttgcgagttaccttcataaatataagagtaccgttccttttcatccaaatggtcaatcagattagtcaattcctgcccccgtagcaaagccagcgtttccgaaaattgaaaatcattcaggtcaccgagcaccaccatattggccttagggtttacttgcagtaccgactttacaaagccattcacaatcgttgcaatcttcacacgctgtatttcgctgcttcgcacaggtggctggattcctccaaatggcgcttgatcgccccctttggaattaaaatggttagcgaccacaatcacctgctggccttcaaactcaaattcagccgccaacggcttgcgcgagtcttcaaatgacgcattcaggggatcaatccgacccgggttgagggaaagtccctgcactccataagtgacagacgtaactgaatcccccttgggcttgtcggtcagcgtaacacgttgcggattgtacaagaagccaacacggatgttgccaccgggggcaccgccatccttattattttcagggccaatatctgtaaaattgtattccgggcctccatgagcacgaatcgcctctatgagcacacggaagctttcggaagcgtctgtggtgccatcatctttctcaccgttattatcctgtacttccagcaatcctatgatatccggatgattcaaatttacagcgatagcctgccccagctgatctatccgttttccatcaccgggatcgaagttttccacattaaaagaagctactgtcagcttacgatcatcccctatcaaacgcgtattggctggctggaggccgccaggtacaacatccggcatacgctctggcagcagcttataattgctaaagctatagctcaccacacctgtgatagaacccgcaaaacgatcgcctgttttcaacagtgtcgaaggcttcgcatcaatcagaatccgttgcgggttcagacttctttctgtcagcatgagtccgcctgcctccgttacaacctcacctgtgtttggaccgttaacaattcggactggaatttcatagccatagggaccaatcacagtggtatccttcaactctacacgcatgccttccaggctttcgaaaaagtccaagccatcctcctgtggatcaaacaccgtcattccgtcatgatccacaacagatgtcggcatcacacgtccctgttcacctagcaaaattggagctggcaatggacggtcattggcaattaccttaaccgaagaagccacaatttctgtggtcgtcaagtcgattggcttgcttgcatatgttctttccgtgtattcctttaccgaaccgctaacccttacctcatcccctacctgtgcaccgtgactaggcttgtacactaaaatggcctcggatgttttttcatcctgatccacttgagcatccaactcttggatatagaaactgctccccttcaccatcgtgacaacgccttcaatatccgctactttttgtccttcatatggagaacggtgtgctgccccctgtacatcgtggatgcgaagctttttaggaaaatagacatctgcatatacacttgcccctacagttacgggtgaaggttgcacctcttttcctgcaaaagatgcaggctctgccgaagcttttccactggacaaccctgccggccctccagctgaaagcagcagtatagcactgagccatgtgatcccgaacctttttaatttcgtaggtaatattttttctatgtattcttgtttcatcaaaagatactcccctccccatttttactatgattacgcttacaaatatattcatcttttaagataccataaattagtcaatttagtacctgaattatgtaaaatgaattcttcttgccgtagcatattcagatcaaattattgtaaacttgttctaatacagaaaaaggtggcacatacgctatggagcatttgcttaacgatcaggttaaaaacattcaaatcagcggcatccgcaaaatcgccaacaaagttgccgcattacccggaaccctgtcattaacgatcggacaaccggatttccctacccctgcgcatattatggaagctgcccatcgggcgattaacgaaggacgcacctcctatacacctaatccgggactgccggaattacgagaagccgcagcggcgtttgtagctcgtaaatacggcctgaattaccgtggacaggatgaggtgatcgtaacgaacggagccagtgaagcgctggatattaccttacgcacgattttgtcacccggcgatgaagtcattctgccagtgccgatctacccagggtacgagccattgatccgcttgtcaggcggcattccagtgtttgctgacacccgcaacagcggcttcaagctcacggccaaggtgctggagccttatctgaccgaacggacaaaagcagtcattctcggatatccttcgaatccaaccggacgagtaatgagtcgcgaagaactggaagcggtcgcggatttactgaaggagcgcgatctgtttatcatttcggatgaaatatacagtgaacttatttacgaaacaccccacgtgtccattgcagctttaccaggtatgcgggagcgcaccatcgtcattaacggtctgtccaaatcacattccatgacgggatggcgcattggttttacacttgcacccgctgaaattacacagcacatggtcaaagtccatcagtacaatgtaacctgtgctagctcgattagccaatatgctgccctggaagccttgactgttggtgtcgatgatgcactcccgatgcgtgaggaataccgcaagcgtcgtgattatgtacatggtaggctgacagacatgggtatcccgctggagaaacccgaaggagccttttaccttttcccttctatcgcccattttggattaagctcgatggattttaccgtgaagctgctggaagagcatggagtggctgtcgtacctggagatgccttttcttcttatggcgaaggatacattcgcttgtcctatgcttacggacaggatgtgctggagcaagggttggataaaatagagaggtttgttaggggaattgtgaggagttaaggtgggagaggcgctacgcagtccatttgatcttccgatcgctgttgcttctccagattcaaatggcccacttcgctcactgcccgccttaaagtcccacgattctctaacgtgtgtgaagtatggggaaaagaagtacaatactcactgctttacacggtgaataaacaaaacaagcccttgaaccacctacacgggtggttcaagggcttgttctttcttcctctactccctcacctgggtgtggattcatgggtgcgtacctttaagcacggtgcagcggagggggcggaatggtgctggacaagcgaagcggtcgcctttaaattccgattttaacctttaaatattcaatcataaaaatcggaatttaacagcgatggtaagcaccatccgccaccgcagcgacctttaaagcaccaactcctaatcccaacgccactcccctactttaaatgcattttgaattgcaggaacaattcattgtaatgagccagcatgcgcttgcctagattgttgtatacttccagcttgtctgtaatttcggacggagggtaaaaacgctcgtcaccagagatatcttcaggcaacaacttctttccatcctcgttgggtgtggagtatcctacaaattcggcattttgagcggctacatcgggctgcatcatgaaattgatgaacttatgggccgcatccacatgggtggcggtttttggaataaccatattatcaaaccacaagttggagccttcatctggcacgatgtaatcgagcttctcgttctcatccatgatttcagacgcatcaccggaccatactaccccggcagcggcttcctcgtttgccagcagcattttaatctcgtcaccgacaaccgctttgacattgggcgctaatttttccaacttcgtcaaagcctgctgcaaatgtgcctcattcgtatcgttcaaggaatagtgaaggctgttcagtgacatccctacgatttccctcgcaccatcaaccaacagtagattattacccagctttggattccacagaccgttccagctatgaaaatcaatgcctttcgtcagctctgggttaaacacaatcccaactgtaccccaaaaatacggtaccgagtattcattattcgggtcgaacgaaaggtttagaaaatgagaatccacatgcttcaaattcggcagcttgctgtggtccaacgggagcaacaagtgctcctgcttcattttagccaaagcatattccgagggaaccgctacatcaaacgaagttcctccctgctcgattttcgtcagcatcgcctcattggaatcaaatgtctgataaatgacagtaatccccgtctccttctgaaaccgttccagcagctcagggtcaatgtagtctccccagttgtacaccgtcagtgtgttaccaccggagtagccttgactggaattcaaccatgcggccacccccatcagcccaaacgagatgatgaaaatcgacagaaacacgcgcacaagtgacttcatctaggcacccccatttctgccgcaggctcttttttaccattacgattcgccttgcgcataataaagtagtaacccaccaccagcagcacagtaaataggaaaatgagcgtggatagcgcattgatggacaaggaaaccccttgacgggcacgtgagtatatttccaccgataaggtcgaatagccactgcctgtcacaaaaaaggtcaccgcaaaatcatccagcgagtacgttaacgccataaagaagcccgcataaatccctggcttgataaagggtagaattaccttggtcagcacatccattcggctggcacccaaatcacgcgcggcatcgaccagagatggactcatttcctgcaaccgcggcaaaatcataatgaccgcaatcggcacactaaatgcaatatgggataataaaacggagtagaaacccagcttaatcccgaccatcgtgaacaaaatgaggaaggaagcgccaataatgacgtccgggttcacgatcaatacattattgagcgatagcaacgtatttttgactcgacggttttgcatctgatgaatagccagcgcacccatgatgccaataatcgtagccaacgcagacgacagcaaagcaatcaccaaggtgttaatgacaataatgatcaagcgagtgtctgcaaacacctctttgtaatattggagtgtaaaaccttcaaactcatgcatcgtcccgccactgttgaaggaatagtacatcaaatacaaaataggtgcgtataacacgagaaaaacaatcaccaaataaatattcccgaaccggtttttatttaccatgccgcaccctccgtttcgttcccgaggtgagcagcataatgatccccatcgccaaaatcaggaacacggcaaccgtagagcccatcccccaatcctgagtaaccagaaaatgctgctctatcgccgtccccagtgtaatcacacggttacctgcaatcaggcgggtaatcataaacagcgacaacgctggaataaacacagccatgcaaccggatcgcacacccgcaagcgttaacgggaaaataaccctacgaaacgcggtccacttggaggctcccaaatcacgggcagcgtccagcagtgaagggtttaacccttccaacgcgttatagatgggcaaaatcataaaaggcacaaaaatataaaccgacacaaacacaaagctggagctggtaaacaataattgctgaccacccaacccaaccatacctaacaccgcattcaccgggccataggtaccaaatatcccgataaaagcatacgttttgagtaacaggttaatccaggtcggcaaaataatgagcaacagccacagctgcttatgctttgtgcgtgtgagcaaatacgccgccggataagcaactaacagtgaaaatacggtaatcagaaatgcataccaaaacgagctgagcgtcatgctcaaataaacgggtgtcagaaactgagcatagttgttgaatgtgagatgaccatccacatcaaatagtgaatagtaaaacacaagtacaaccggagctgccacgaacagcacaatccataaatagtaaggcagcagatacgctgctcttgtattaccggacatgctgatccacctcttcataggcttccagacgccgatcaaattcttcttctgtttccccaaaccgcatcacatggatcgcttccgggtcaaatcgcagaccgatttcactgcccagctccgcctttttggtagaatgcacaagccactcctgacccgaatcatcatagcagcttatttcatagtgaacaccacggaacaattgggtatctaccttcacacgcagcttgccttcagcaacattcgtaatctccaagtcctctggccggatcacaatttcaatgggttcgttcggacgtaatcctccgtcgacacattcaaactgtcgaccgttaaattccacttgataatctgcaatcatccgtcctgggacaatgttggattcgccgatgaagtcagcaacaaaccgattgatcggctcatcataaatatcattaggcgtaccactctgctcaatcttacctttgttcataacaaaaatttcgtccgacatggccagcgcttcctcctgatcatgcgtaacgaaaataaaagtaattccaagacgctgctgcatttcgcgcaaaatgtactgcatttcagtacgtagctttaaatccagtgcagacaatggctcatccaacaagagaacatcaggttcattgacgatagcccgtgcgatggctacacgctgacgctgtccaccggacatctcagaaatttcccgctcgccgtagccttccagattgacaaaggacaacgcctgtgtcaccttctcctgaatgtcctttttgttcatctttttgattcgcaggccgaaagctacattttcaaacacattcagatgcggaaatagcgcataatcctgaaaaaccgtattgacctgccgctcattggctggaacacgattaatgagttttccatttaaataaatagagccttctgtcggctccgcaaaacctgcaatcatacgcagaatcgtcgttttaccacagccggaaggccccagcagtgtgtaaaatttaccacgctcaatctcaaagctgacgtccgccagcactgggggatcgttgtcatattgcttggtcacccgttcaaatcggatgatggtttgctctcccataacaccctccttcaaaaaattcgacttcattccatttcattcttttcattaaacctatttattcagggcgtatcatttacccttgagacttccatgtaaaatagtctgtcagcacacgaatggctacaccaatcgcttcctccgcaggctccagcttggcatgatgcaaaccataaggcgtatcaacaccaagccagaacatcagaccgggaattcgctccagaaaatacccgaagtcttctccggtcatcgcttctccgcattcaataagctgcacatcttgccgattacggacccagttcatgaattcctgggttacctgagcttcattgtacacttgcaaataattggagccataatgaatctcggcatgacattcaaatccagtctccacaccgcgcactagtgcttcaatccgtgatttaaccagcttcatcgtatcggctgacaacgttcggatcgtaccctccaaacgggcggtttccgcgataatattttgcttcgtgcctccgctaaccttacccacggtaatgaccgctgcatcgagtggattcacattacgggctacaaccgtctgtaattgtcccaccagctgacaagcagccactaccatatcattcgccttgtgtggatacgcagcatgcccacccatacccttcaggtcgatgaaaagctccgacgtattggcaaataggatgcccgggcgagtcgcaattgtgccaacaggatattcgggcgcaacatgcagtgcgacaatttcatcgggtatccagtctgccagctccgtgctgtcccgcataggcaaggctccgcccggcccttcctcagccggttgaaacagcacaaccaggtcatccttaatcggatggcttgcaaagtgagtaacaattcccaatccaatcgtcatatgtaaatcgtgtccacaagcatgcatatagccgggatgggtcgaacggaaatcgtaccctgtctcttcttcaatcggcaaaccgtccatatcacaacgatatccatagcggcgttcaggagctgttccatgaatgaacactaacacgcccgtacgccatgtacgaatgtccaaccgctcctgagggagcgtttccaaataatccagcaaatattgttgtgttttgtattcctcaaaacccggttcgggaatttggtgtaaatcccttcgtatttggacaaaagaacgatagtcgaccgtactcattgctgctacgcctcctctttatagctcatcagctcttatctggcaaaagaacaaaaggacaaaagcccggcgcagccgccgagccttgtccgttgtgcttcgtccctaagttatgctgtcagtgcatcatgcttctgacaaggaatcgttcacctttggtacattaaaaaacttttgccttcttacagaacgcgcagttctttcaaaatctcagttttagatttggtcttatcgtcgacctgtttgatcacacgtgcaggtgtacccgccactacggagtattcaggcacatcttcagttacgacagctccggctgcaacaactgcacctttaccaattcgcacgccttccaatacaaccgagtttgcaccgatcaatacatcgtcttctactacaactggctgtgcagatggtggttcaatgacacccgccaggacaacgcctgcaccgatgtgacacatgttacctactttaacacgaccgcccagcacagcattcatatcaatcattgtgccttcaccaatcgtaacgccgatgttaatcactgcacccatcatgatgactgcgttgttaccgatgccaaccatatcacgaatatatgcgcctggctcaatgcgggcattgatgcctttcagatcgagcataggaacagcagagttacggcggtcattttccaccacatagtcttcttctttcgcgtttgcgctatccagtacaggcttgatatcagcccaatccccaaatacaacaccactgtctccagaaataaaagcttgaacattctcgccaaaagatgcggaagccaaagctccttttacatatactttaacaggcgtctttttcttgctgtttttaatcacgttgatgacttcttgtgtattcatttcgatggacatagtaaatctaacaactccttcatcgcttcatacgacttcgcaagccggaatgatcttattctctcatcctttatagcacaaaagtgcaggtctcgcaattatagattagacccttatagctctaacctaacccttaaaataacaatttccagcggcataactgccttaaattcatgattgtaagccgccgaccatcccacatcaaagtagggttatttattagcttgcaggctctccagcgatgtataaatgaaggattcgaatccttcagcaggttcaccttgtggaatgttcactttcacgatgaaaccgcctgttttattttctacaacaatatattgctgtgtcatcttcgaaccgctcgcttgtaagaacagacggctactggacaacgcttcaggtatggctgctttgtccagcttttgaaccttgccgatggaagctaggtccttttcgccttctttttgaagctcatccagattaaaatcggaaggcagcttcgtaatttcagcataatagttatcatctacagccaaggcaacacggttttgatcgggaaacagggacatcggatcaaacacatacagtgaatatccctctccttttgccaatgttgctgtctgcttttccttttttccttcaagggtaagctcaaaagtttgagtcttcgagcgttctccgcctactgcttgaccagaacttccgttttgattgccatctgttgcagcctctgttttttgtattttcgttaaagtcagttgcttcgccgtcgcgtcgccctctactgctttttcgttgtattcaaacgctactgtatcgccttccttaagccctgctattaccgtgtccagtccgtctcccagttggaaggattgggcttcaccattggtttcaatctctaccgtatgcgggtcagcagctccattgtatacacctgtgccttttttaacttccggctcagcgattggctccggtttaacttgcggctgctgttgcgtttgcggttggtctgacccttgaggtgcggtgttattggtttgcggtttcgttccacaggctgacagagccagcactgccactacagtcagtagtatgattgaaaatgtgttttgttttttcataaaatccacctccactatgatagacgagcttgtgcagcaaaagttctacgcagcatctcacttaaaaccctacctcctgctcccgtttattatattctcaggattttgcaaaatcctaataccacgggaatgtcaggtacggtataatgggctgtattaaacccaattttcgagataccgcttggaaggaacataaacgtatttattttcctccatacggatggagctgccacatgaatcaagcacacaaaccgtcgttttcctttgaattattgtacatcataggtattatcgccatttcgttctcctcgatcttcgtaagatggtctgaagccgaggtgtccgtcatcgctatgtaccgtttgtacctaaccaatctgatcatgctgcctttggtctggaaataccgcaccgagctgtttagcctgacccgcaagcagtggatgctgatcctctggtccggtatagcgctggggctgcatttcttgctctggatgggctcactgcgactgaccaccgttgcaagctctaccgttattatgacattggagccgatccttgtcatgctcggttcttttttgtttttccggacgggcacgaatcgcgctatgctcatcggaatgggtatggcttttatcggctcactggccatcggagctggagactttcatgtctcgggacaagccctgctcggggacgcactgtccttcttgggtatggtagccgtgtccatccatatgctgatgggtaagcatctacgcgagcatttgagcgcgtttgtgtataatttttgggttttcgccatcgcagccacctcacttgcgctgtataatatggtcaatgccattccttttaccggatacgctccacgggaatggggactgttcctgctgcttgccattgtgcctacgctgttcggacattacctgtttaactggctgctcaaatacattaacgccactgcggtgtcgatggcggtactcggcgaacctgttatttcttccctgctagcttgggtgctgctcggtgaaaggctgtctgccttacaatttggtgcaggcttttttatcctattcggggtatggatttttatccgatacggagcggattttaaaaagaaagtcatccatcaaagtgagttgcccgacactgagcatcccctgaaagccagctcttaacttatttaccccattttcataaaccatactcaatgaattaaatttactgttaaataaaggaaggcggaatcctctatgaaatccatcgtatccaaacgctggctgctggcccgattgtatgagccggacatgatcattgccgactgccgttccctgctcggacaagccggggctggacggactcaatttaatgaagaccatattccaggggcgatccacttcgatttggaagaagaccttaccgctcctcttggtgagcatggtggtcgccatcccttacctgatgtgaatacacttgccgcacgtctaagtcgtgccgggatcaacgcatcttcacgcatcgtcgcttatgatgatcaaggcggtatgatggcttcccgcttctggtggctcctgcgctatctcgggcatgagcaggtatatgtgctggaagagggctacagcgcttggaaagaagcgaagttccccgttacgtcagaccagccgattcgcattccaagtacattcacaccgaatgtacagccgcaaatgctcacaaatatgcaagaagtgcaacgtgtatccaaagattcgcttcctgatggctcttacatattgattgattcgagagagcggcctcgctacctggggctggaggagcccattgatcaagcagcggggcatatcccaggtgcggtgaatttcttttggaaagaagtattggacgaacaaggcagctttaaaaatgcggaacaattgcagcagcactttgctgaccttgatccaaacgcagaaattatcgtgtattgcggttccggcgtatccgcctgtcccaatgtactggccctgaatgaagctggatttagtaaggtccgtttatatccgggaagctggagcgactggatcagttatgaggagaatccggtggcgaccggagaggaataaaaagttttcaacggatatacaggttctaaagacaaatacactgtcctagcgattaggcttacggcagtgtatttgtctttgtttaaaaaaacaacttgagctgagtgaagcaataaaacgatgtagttgaagtttacttgcttttttgaatagctatcccatcttttgaacaaatatatatcttaattcatattttttctgttgtttttctgcatatatcagagtttctcttatggaacccgtttctaatatattcaaatcattaaaatgtccttttaaatcttcttcagtaaagaagtgagcatatttcccttccttgtattcatatgttccttcttcaatttccctacccacaccattattaaaatcacaattagaaaaacatgtgaaatacattactcctaattccttcaaatgcttcacgcaattctgtatcagtctttttcggtcttctaacaaaaataaatgtaataaatcataacaatatattccatcatacctttggcttgtagtaaactctaataccgattcttgaataaaattcgtttttaaatcccattcttttgctagatttatagctgaactagatatctcaattccatcaacctgaaaataagaagagaacgccttcgtatttcttccatatccagcaccaggaaccaaaatatcatgtacatgattctgtttaaacaaatctatagcttgggttacagtttgacttggttcacagccccaaatcatcccttcttcagtaaatcttttgttccaataatcccccatatgattcacccgcctatatactcacatagctcttcttttaagttcattaatctgtctgatatgatgttgatcatgccagataaaatctcttaaatatgatattacagtaaacttcccgtcagcatattctttagtaaacttgtcgtcttcaaaactctctatactctccaatatcatgttacggtactgaatagtcattttaattaattcttctttcgtttttgtttttccatattcaatagcattctgattaaattgttcaaaatcaatacgtgttaatgtcaaaggtgtattgtttaatatgggacttattgctgcatcaaaaaagtatttatcccacagcagtatatgacttacgacatcctgaactgaccatttaccttcagcaatcgttatttgccaatccatttcacgaatctcagaaacaaaacgaatccattccttgaactcctctagtaaccgcgacttctcattcatggtttcacgctccttttttcaaattattcattgttcctttgccattcatctgctaaaattgcatgttgatatgcattatgccaaatggttgtccttcttttcgcatcaacaagcgctccaacaatctccacgatgaagcgatttctggattacacatcgcaataatccgatgagcctttaactcttcaaatccatattgcaatactcttctacctgcctcagtagcatatccatttccatagtatcttgggttgaatatgtatcctatttcccatgttaaaaactcaaacggtacggtttgattaaaataaatgtgtcctatcattttataagtaatcatgtagatcattccaatcatcagatcgaaaatttcttataagtaatctttctgactctaaatctatcataattatcgcctctgatacgtttatttagcctttgcttgaattacttttaacgatcatttaatccctctccattgagaattttctgcatacatttttcaacccttgactcccgagttttagattgtttgggtgcactcagactccgtaaggagccactgcttggatatgatgttatgcgatacccttgatctcctttgagttccttaaaataatccctatactactgtattttaacttctcaaatcgacaaccatcgtgattgatgaatcaactttcccaacttctttaaatccgaatctctcgtagagtttcattgccgctgcattgctcggatcaacactgagggataattttattatattcctcttcctagcttctttaaataattcatccattaaggccattccgatttttcttcccctgtattcttttaacaaagccattcctagttcaggttcattatcaataaatccaaatcccttattatcctcgttaaaatatcgaactgttatcgatccgacgggttcaccctcatggttcattgctataaatccaaaatccccatctcttccccaaccttcaatgaagtgcaccccttagaat

SEQ ID NO: 2597 - DNA, 1532 bp, Unknown
  Kingdom: Bacteria, Phylum: Firmicutes, Class: Bacilli, Order: Bacillales, Family: Paenibacillaceae, Genus: Paenibacillus
cggcgcagaccttccttcgtttctttgatgtgctgtgccagtgtcattcccttgcccatttccagcagcaccggatacaagctcgtaaaccagcctactgtacgtgtaatatccacctctggcaggattgcttcccggccatgtccctccagattcaccagcacctgtccggcgcctgtccagttgtgcatcgccaatcctaacgcggtcaatagcaaatcattgacctcggtgttgtaggcgcgatgggcctgctttaacagctgctgggtttcagcttcggtccactctaccgtcaacacttcgctgtctgcattcaaggagccctcataggcaaaatccttaggcagcggtgccgctttcgctttggcctgttccagctgctgccagtaggcttcatccgatgcagcctctggacggttggcgtaagacgacaactcctgtgcccatgtttggaaggaatccgttttaaagggcaatcgtacaggctcacctttgatcgcctgttcgtaacctgtcgagaaatcttcaaacagaatccgccacgataccccatctatcaccaaatggtgaatggctatgagcaaatgatcgccctcggctgtgcggaacaatcccagcttgaccagaggtccttcggacaggtgaatgctgctttgaatttcatttgccttcgcttccagcgcttccgcataggtttcctgtttacggtaatccaacgtttccagcgtatacaacgcgccttcatctacactacgtgtccaagccatataaccagaggaattctgatggaaaaccgtacgaagcgcatcatgatgcttcacgatgtgatccatcacctgacgaaccgctatctcattaaagccctcggcacgatagagcataactgcctgattaaagtgctgcggacgctcgcgctcctgcgcaaagaaccaatgctggatcggaagcaaagcggtttccccgctcacttctccttgatctgccatacgactgacctcatgcatatgcggtgccagtgctgcaaccgttggatactggaacaaatccttcatgtccagcttatagccagcctgaaacgcacgcgatgcgatttggatcgccttgatcgaatcgccgcccagatcaaagaaattgtccaagatacccacagtctgcagtcccagtaccgactgccagaccgctactagagcgcgttctggcgcggtacgcggctctgcataatccgttccagtttgcaggctgccttccggtgtcggcagggctttgcggtcaattttaccgttcgcactcagcggcatctgctccagctgtacaaagtacgatggcaccatgtagcttggcagctcctggcccagctcacttctcagctcactggcacccagctctttcccggcgacatagtaggccaccatttgtttttggcccgtttcgtctgcacgagccacgacgaccgcttctcgtaccgattccacttggagcagctgcgattcgacctcgcccagctcaatccggtacccccggattttcac

SEQ ID NO: 2598 - DNA, 6455 bp, Unknown
  Kingdom: Bacteria, Phylum: Firmicutes, Class: Bacilli, Order: Bacillales, Family: Paenibacillaceae, Genus: Paenibacillus
  misc_feature (2375)..(2376): n is a, c, g, or t
tggttcagacggtaatcccggcggtaggccgcagccgtattcaccaagctgcgatgctcaatcatgacgcccttcggacgtcccgttgtaccggaggtgtagatcacatacgctagatcctgctgttcattgatgtgattgacgtctgtggtatccccggtgtacaacgactcatcgtccaacgccagtacggtatgcagacgcaaacccgctgcggattcggatgtagttttgctttcatccagccatacctgtgcacgctcctgtaagccgatttgggtcaacagtaccgtcgcaccgctatcctccagcatgaaacgaatgcgttcggacggatagtctgcatccagcggcacatacgcgcctccagctttccacaccgccaatacgccgaccagcatgtctaccgaacgttcactcaaaatgccgaccatcgactcgcgtccaatgccttcatttcgcagtctacgggccaattggttcgcacgctcgttcagtgtgcggtacgtaagctgctgctcttcgtacaccaccgccacgtgatccggtataagctgcgcctgttcttccacataggtatggaacaaagctcctgcttcaacagcagcaacatccgatactcccacatctccaaaaccgtagatgatttgtgccttctcctcgacggtcaccatatccaaagctgccagtggctgctgtggatgcagggtaattgcacgtacgagttcggtaaaatgctgtgccaatcgcgcgatggtctcaggcttgtacagcgccgtgctgtattccagactgcacagaatgccttccggctgctccactgcatccaaggtcagatcaaatttggccgtatgattgtcggtcggatacattttaaaggtcagaccctccagctcgaactcctgctgttcaaatgttttcagctcaaacatcgtgtcaaacagcgcattccggctcgtatcccgcgttaaattcagcttttcaaccagttcttcaaaaggatattcctgatgctcataagcactgagcgcatgctctttgacctcttgcaagtaatccaggaacgttttgtcgccagccggataattgcggatcgccagcgtgttgaggaatacgcctaccaagccttccagttccgcatgcggtcttccggcaatcggcgtgccgacgataatatcctcctgccccgaatatttatgcaagagcgtgctatacgcggccagcaacaccatgtacaaggtggagccggtttgcgcggccagctgtttcaactgctcgctgtcctccaggctgatcgcaaattccaatcgagctccttccagacgctgtacggctggtcttataaaatccgttggcatatccagtgctggaatgtcaccagccatcgtgttcagccagtagctttcctgctcacgaagacgttcactttgcatatcggcatgctgccaaaccgcatagtccttgtactggatgcgcagaggcggcagttccttgccttcatacaattgagagaactcctgcacgataattccttcagtcacgccatccgaaataatatggtgcatgtcatagagcatgacgtgacgctccggtccgatttccaccagctgaacccgcagcaacggtgcttgtgcgagatcaaatgcacgtacaaagtcctgtgcgtactgctgggtctcttcttcacttgcctgcacatgctccacattgaatgcgacgcccgattcaatccgttgaatcacctcgccatccaccatgtcgaatcgggttcgcagggcttcatgacggacaatcagctggtggaaggcttgctccagtcgcgttttatccaaggaaccttcaatgatcaaagcgcctggcatattgtagctaacctctccgccttccaggtgactcagcacgtacatccgtttttgcgccgaggaaaccggataatatgcacgttcctccgcaacagggatggatacatacgtttgctgtgtctgaacttctcccatcacctgtaccagttgctcaatcgtcggatattggaaaatatctcgcagcgccagcttgtaattcagctcctgatggattttcgccatcagagttgtcgcgcgcagagaatgtcctcccacttcaaagaaatggtccttaataccgatctgcggatgattcagaacactttgccaaatacgtaccaactgctcttctagcagtgtccgcggtgccacgtatgctgtgcctccttcgaggcgcgcttccggcgcaggcaacgctttgcggtcaattttcccgtttggtgtcagcgggaattgatccagttgtacgacatatgtcgggatcatataacccggcagcttgggctgcagcatgttgcgcagctctggcaaatnnacgaatttctcggccgtcaggtctgcacgattcaggtagcctcgtgccaccccggctccgccaatgcacagctcacccagtacgccgatcggcaccggattcagctggctgtccacgatgtagaagcgggcgttcagccacgcctgaccaatcggcacattgccgctgcttggcagcttcgatagatcttcatcgtagaagctggagtcaatcgccgcttccgtgacgccgtaactgttcataatgcggatatccgcgccaaatcgttcttgcagcacccggtaatccgtcacactgcagctatccgagctggtaatcagcagttccagactgctcatgtccagcccctgttcatacacatactgcataaacggtacgatcagggccggggtcgattcgaatacggtaatctggtaatcgcgaatccagccatacaaacggctaaaatcaatccggtcatctttcggacaaatgaccatcgtgccgccgttatagagcgtccgcgcgatatccccgacgaacacgtcgaaggagaagctcgccagctgcagcagtcgtaccgggaactcgctcagacggtaatctcggcgatacgccgcagccgtattcaccaagctgtgatgttcgatcatgacgcccttcggacgtccggttgtcccggacgtgtaaatgacatacgccagatcctgcggttcgttaataggctcgatatcggtggtgtctccgatgtacagcgactcatcgtccagcaccagcacggtatgcagacgcaagttcgctgcggattcggatgctgcttcgctgtcagacttcgaatctgatttcaagcttacgccttcactaaggcggtctctttccatcgtttcagcgctaaccgccgtatccagctcactctcattctttccttcgctcagagcccattggctttcattcagccaacccagtgcacgctcctgcaagcccgtttgggtcaacagtaccgtcgcaccactgtcctccagcatgaaacgaatacgttcggacggataatccgcatctaacggcacgtacgcgcctcctgccttccacaccgccagtacgccgaccaacatatccaccgagcgttcactcaagatgccaaccatcgactcgcgtccaacgccttcgttccgcaatctccgcgccaattggttcgcacgctcgttcagtttccggtacgtaagctgctgctcctcgtacaccaccgccacatgatccggtacaagctgcgcgtgttcttccactaagatatggaataaggctcctgcttcagcagcaacatccgatacccccacatctccaaatccatggatgatttgtgctttttcctcggcaggtaccatatccaaagctgccagtggctgttgtggatgaagtgaaattgcacgtacaagctcggtaaaatgctgtgccaatcgcgcaatcgtctcaggcttatacagcgccgtgctgtattccagacggcacagaatgctttctggctgctctattgcatccaagctcagatcaaatttggccgtatgattttccagcggatacgaatgtaaggtcagaccttccagctgcaactcctgctgctccaatgttttcaactcaaacatcgtgtcaaacagcgcatttcggctcgtatcccgcgtcaaattcagcttttcaaccaactcttcaaaaggatagtcctgatgctcataagcattgagcgcatgctccttcacctcttgcagataatccaggaacgattggtcgccagacggataattgcggattgccagcgtattgatgaagacacctaccagactctccagttccgcatgcggtcttccagcaatcggcgtgccgactacgatatcttcttggcctgtgtatttatgcaagagcgtggtgtacgccgccagcagcaccatatacaaggttgaacctgtttgcgaagccagttctttcaggcgttcgctaacttcacgctccagtccgaattcgatcgtatcccctgccgtactctgcaccgctggacgggcaaagtcggttgccagatccagcacaggcacgccgccccggaaggtacccagccagtacgctttctgacgctgcatccactcctgatgggcttcgctttgctgccataccgcatagtctttgtactgaatacgcaatggtgatagctcttcaccgccatacaagcggacaaattcatcggtcagtacctccatcgacacaccatccgaaacgatatggtgcatgtcgagcatgagtaaatgctgggattcctgctttgctccttgtgcgcccagatccaccaagcctacccgcagcagcggtgcagctttcagatcgaacggacggacaaactgccgtacccgttcttgtgcttcctggctgaccgtcgtgtccgtagctgtagctgtgtcctgatctgtatccgtagttgcacgctctgcttgtaccttcgtatattccactttgaacggcacggtgtcctcaacccattgcatcggctcattgtccaccagttcaaagcgggtacgcaaggttgcatggcgatcgatcagttgacggaacacatcttctactcgtttcacatccagcggaccgctcacttgcagcaccgacggcatgttgtagttcacatcacttggatcaaactgatgcagtacatacagccgtttttgcgccgaagataacgggtagaaattgtgttcttccgttaccggaatggacgcgtacgttacttgatccagctgttccagtacgactgtcagttgttcaatcgttggtgcttcaaaaatactgcgtagtggaagcggcttgttcagctccttgtgaatcttcgaggccagtgtcgtcgcccgcagcgaatgtccgccaatctcgaagaagttttccttcacaccaacctgcgtgagacccagtacatcctgccaaatgtgcgccagtttcacttccacccacgtccgcggtgcgacataatcggctccggtttgcaggctgccttccggtgctggtagggccttacggtcaattttgccatttggactcagcggcatctgctttagctgtacaaagtacgatggtaccatgtagcttggcagctcccggcccagttcacttctcagctcgctggcgccgagctcttgtccggcgacatagtaggccaccatttgtttttggcccgtttcgtctgcacgagccacgacgaccgcttctcgtaccgattccacttggagcagctgcgattcgacctcgcccagctcaatccggtacccccggattttcacctgatggtcgatccggcccagatattcaatgttgccgtccggcatccatctcgccaaatcgcctgtgcggtacatccgttcatagcctgcttccccgcctgcaaacgggtctttcacaaatttctcggccgtcagctctggacggttcagataaccgcgggctaccccgacaccgccgatgcacagttctcctgcaaccccgatcggctgcaattgctccgtaccttccttcacgatgtacagacgaatattttggatcggttttccgattggaatgaccgaataggtttcattaggctcgcaatcgaagtacgatacgtccaccgtcgcttcggttggtccatacaggttgatcagtttcgctccgaccaggttcgacacgagccgctggaaccgggccacatgctgtggtggcaacgcttcgccgctggcaaagacatggcgcagcgtgatcagcttcgcttgcatcacttcctgtggctgctgctccacatattccaggaacgcatgcagcatggcgggtacaaagtgcattgtgctcacgccatcgcgggcaatcgtatcgacgatgtcttccgggttcttttccccgcccacgggcagcaagctcaccttcgagccgaccagcgaccaccagaacagctcccacaccgacacgtcgaacgtgaaggccgtcttttgcaggatcgtatcttccgcactcaagccgtaccgatcatgcagccacaaaatcctgttcatcacgaaatggtgctcctccatcacgcccttcggttttcccgttgagccgga

SEQ ID NO: 2599 - DNA, 135502 bp, Unknown
  Kingdom: Bacteria, Phylum: Firmicutes, Class: Bacilli, Order: Bacillales, Family: Paenibacillaceae, Genus: Paenibacillus
tctcccatgcaggaaaaggatgtatcgggtattagctaccgtttccggtagttatccctgtcttgtgggcaggttgcctacgtgttactcacccgtccgccgctaggttatatagaagcaagcttctacataaccccgctcgacttgcatgtattaggcacgccgccagcgttcgtcctgagccaggatcaaactctccattaaagaccaaccgaagctggttatcgaaagagcgatgagctcatgttgaaactgacgagataaaaatatctcttgttcgcttccatttcatacaacctaatggcatgtaccaaaatttctgcgttggattttgtaaacaaaatccgtactcactcgttgttcagttttcaaagatcaaatcaacagccgtttaactggctggatatataatttatcacgtgtatacccatcaggcaagttgtaatatttaccagtttgctaatttgtatttctacacggtgtagtttttattaaaacactccaacacacgatgatttacctgtaataaccgaaactctcttttctcctacttgaagtgcaaagttgatcaggtataaacgtcataaatcagaaaagcagaagctctttatgtattggatgagctgccgctttagcttttatgataaaaatcctgaaatgttcgtttagcttaaagctgtagctaaatcctgtatcaaaagttcagcgggctcatgccctacagccaagcggataagcgattcaggcatgtgttgtttttttagactctgcttattgaagccgtagtttggtgagatcacctgactctccatggacccccaagatacaccgatccggatcagtcgcagtttattgatcactctacatatatcctcataagtcgaatcctttagttcaaaactgaataatccggcatagcctttgagctgtctacatgcgagctcatgttgtggatgagaagggagtccgggatgattcactttggaaatggccggatgatctgatagaaaatgagcaaccaacaaagcgtttctctgatgggcttccattcggagcgggagtgttcttagcccccgaatgagtagccaggcttcaaaagggcctaacgagccgccaatcaactcatactcttcagcatacatacggtttattatctctttagaagcgatcactgcccctgcaattaaatcattatgaccacccaagtacttggatgcggagtgaacaacgatatctacgccccattccaatggtttttggaaaaggggtgtagcccatgaattatctacgattgtgcgtatacccttcgctttggaaagcgaagttacctcctgaatatttaccatatcgaatgtgaatgaggtaggagactccataagaatagctcgggtctgcggtttgatggcaccagcgactgcttctgttgaagtcgaatgtacgattgtatagtctatatggaacctctttaaatattgggctaggctgacggaggtttcatatatgtgtccgaccagaatcagatggtcccctgcggacaagctacacattagcgcggcgctgatagcagccattccggaagcaaagcacttgcagtccgccccaccttccagcgcagcaatcatttgctctgcaatctgaacggtaggattggttcccctcgaatagacataatgctccttttcattattagctgcttcagcataatcttcgtaagtatcaaagaaaaatggagcagtctcataaataggaggagcagcagccttagcaaaataccctagttcgccctcaaatttgagacagataagctgatcatccgagaaactcaaacctgatcaccactttctaaaaaatttcaaacccgtatgaggtagtctcctcaatccggaactcaaatattctataatgtaaactcctctagaccctgtggtggttgatttgcgaaattcggaaaattatgagccaaatgtttttcaataagtatccaattcataaaaataacgtatattttaggttgcagggcaaagataggctttatcaaaaaagaggggctcacatgtgttaacacgttggattagaaatgttctgaaacctggaaaaaggtacacacaggatatcgaaaaatccaaacagcaagcctcttcagaacctataaatccatcattagcacatactctatctttgctcaaatttaaacttgggcaaagttctgactttattattcgtgattttcccgaaagtcctactcatgccggccaatttgccgtttgttatattgaaggactgattgaccaaaacttgcttcaaatcatcaattcgcaaaatcagatatatcaagctatcttgtccggaagtgctgtcattgtgattgacggtaatctatgtgctttggccatttccatagcaggcggggtcagaagagctgttgaggagcccagttcccaaaccgtcattagggggcctaaataaggatttacagaggatatctcgttggttgctcaacgggaaggtactccttttcctgcattattggaagcattcatgatggaattaatgtttgaagtgattcgtgaagccggtgtacggatgccccgggtcatcggaccagccgtttcaatcgtaggggctctggttattgggcaagcagcagtacaagccggactggtctcaggtgcaatggttatcgttgttgccttcacagctatatctaactttgaaattacgtattttagtatgcgctcagcagtccggttattgcgttttgctctcagtgctgctagcaggagcactggggctattcggtattctgatggggatcatcccccttttggttcaccttgtagcactcaaatcgttcggcattaattattttatgccctacagcccctcctataagtccaattttaaggacttggtcattagagcaccgtggtgggctatgaaaacaagacctaatgaaaaatcgggccctaacaagacgagacaagcagcccatcaatatcctgacagttcagatgatactggtggtgatcatgagtctgatatccaaaagtagttgcaaattcgggaaggatgggaaacagctcagaaacggaatatcgatcttgttggaatcgggaataaaatccaccaaaaatattctcaagattggaaaaaaattaaggaaacgtggcctaaagagttggcaagcatggacatggaactagatgtaaaagtaaacattaaacgcccagggttatttcaaaaatcttttaaagaactgctggaatctgaaaatgataattaaatgcatgaaataaatatgggaggggtgaatgtaagccatgagtaaaaatacactccgggtatcagagttgatcgtctgtatttcattgtttgagttgggaagtacaaccctgtatttaataggtgatgaagctaagcaagatgcttggttagctatgctaataggagctttagtaggactatttgtccttctgcttcatctagccattcaccatcaggccctaatttagatttgtacatgttgtttcggcgatacatggggaaatattggggtacactcttcaacctgttgtttgttggatattttgcatatgaaacttcccggaatttacgcgatttaggcgaggtgacagtgatgactttgctgaaccaaacaccaatatgggtcattaccttgattacagtcatggttatatccaatacggttcgttacggatacaaagtattgttttcatttagcttaattcttttacctgtttttgcgattgcatttactgtaattactgtattaatcccggccaccggcctttttcactttgagtttatacttcctattttggaatacgatggttatttttgttctgggttccaagatcgccgcaagcagcacgctgcctcttttggaaactgtacaattgattgaattggcagaagtgttcgaacgcatggatgcacttttcaccttgctcctctttcttggcttaattatcaaaatggtcgcattttttaatggtgccgtgatagggcttgaaaaaataactaaaattggatttaaaaaatgggttttgcctctcggagctctcatttatgggctttcatttctatcccctaactacactcatcacattatgacgggtcggaagactgtggttactttttggtttcctatttttcagtttatcctcccatcattgcttcttatagtaatagttattagaaaaagaaagaagctaaaaaaacagcccgattcgtaattcagcctcttttattgtgctttttctatttcatcggcacgatgtgaagtgttccatcctcgctaaactctgcataggcaatctcatcgagactatcatatccctgctctcgcacttttgctttaatctcttcaatatcgattgacttcccacgcatagattcgttcagaagctttcctttatcaatgactgtaacagaaaatagatcaggctgtgcatctattcccatatcctgagcagcaggtggctcgtattcgggtttgcgcatgactgacaatgaaccgttcgtctctaacgtggcataccagacctcacgtagagaaaaaatattttgctggcgcagcatggagagcaactgtgtgaattctatatcatatttttcaagcatctcttgattgacctggcccttatccacgagcagcactgttcgaccttctgccatatagccaaatttcacaaaacgggtcgtcgccttttcaaaaaagtaggccagcgcgcaccatagtgccaaagcaaacaatagctgcccaatgcttaccttatcgtcatataacgtatttcccacaatttcgcttaacaccaatgatgttaggaaatcgagtggtgttaactgactgagtgttttccgacctgtaataaaagtaatgatccacaagccaaaaaagctgatgatcaatttgacaccaatcgtaacaaatacctccataagtatgcctcccggaagaagttgttttccttatgtgttatttacacctgtctacctcagcataaacagaggcttattcctaaaattgtccgattaaaaaagcccgctaccaactagaggcagcgaactttttaattacggctattatataatcttaatctttcagatgtttatcaaaaaactcttaaccacgtccaatatatgtggctagttaaaggcaatatgccagctcccgtaattttgtgcatagtgacatcattgcccgctagcttggactctggagtcatgattatctacttttcacaagaagctgaatcgcttctttaaccagcttatccgtgtctcctccagcctcttgctcttccaatatacatcgttgcagattctctgctacaatttgggcaattgctttatctgatgcgttacgtacggcagataactggctaacgacgtctttgcacgattttccttcatccattaaacgaagtaccccacgcacctgtccctcaatcctcctcaggcgcgttttcagttcatcactgtaattgtaatccataagtaatgcactccttttttgacttaccatatacacgtataggtatattataaaccaaaaaaataaataggataccctaaataaatagattcaccttgccctgcgaagcatcccccaagtaggcggctacaccagcatattccaaaccgtcgattagctcttcttgctgcagccctaacaaatccatggtcatggtacaggcgacgagcttgatcccctgctctcgtgccaactctataagctgcggcaaggaaagcgcattgtgctttttcatgacatgcttgatcatctgtggaccaagtccggcaaaattcattttggatagtgcaagctttttgggtccacgaggcatgatccagccaaaggctttttcgagcattcccttattggtgctcacgatttcatccttgcgtagcgtatttagcccccaaaaagtaaagaaaatagttacttcatgatcatatgctgccgctccattcgcaataatgaatgcagcaatcgccttatccagctccccgctgaataatacaatcgttgttttgggctgagcatattcttgattatttgtataaattcctgctgtcgtactcatagggattcgcttcccttagtctctccagcccattcggatatgcctgaaagtacagatttgactttattagcgcctttggaaactaataactgacaagccatttcactgcgtgctccagcttgacaaatcactgctatctcttcttccaagttcagttcagagagtctgttctccagttcgccaagagggatgtgcttagatccagggatatgtttaagcgcaaattcagcgggttcacgaacatcgagcaaaatgaagttctcttttccagaacattttacttgtagctcttcatggcttatcgtagaagaaaatatttgctccttcttcacttcagccggatttgctttgcgtaaataatgtcgcattacatctccttcttggagagtacccaaatattgatgtccggtgtttttggcccagctctgaaaatcggctaatgaacctttgtcagtcgcctggacctccataatctttccgggaacgagctcattcatagccttttttgttcttactataggcataggacaagctagccctttgcaatcaagaatatgatctgcttggatattgttagttgatgacattctataacctccacctgttttttgagggggcttagcttagttaaatccctttatacatatacccctatgggtattaggataacgagactcgcttctcttgtcaacttatttggccgttttttctcagaagcaaacgaaatcatgtcttgaacaaaataaaattaaaagcaaaaaagccgcgcaaaaacgcgactctaatgcataaacccaaattaatcgtcttttttcatcagttctggcagatccagcgacatcgaaatattgcacagcatacctctggcaagaaaaagcatcgttctttccattgcttgttcaatacctgcccgtcggaaagcatcataaaccgtcgtatgaatttcacggaatccttgctgcatcacgcttacgacctcatcctcgcggatcgtctgcgcctgcatttgcaaaagtgtttcattgcggtattccatcatcatttgcgaataggctgcaattagctcttgctcgagctgttcagatgaggccgaatgaatgacgctgtgaaaagagtctatgatacgtgcaaatgaaaccttcagggcttcaacaagcaacgcttccttggtagcaaaaaaacgaaagacatagggctgagaaatattggcccgttctgcaactttggctgttgtagcccggtagtagcccatctctgcaaacacttcaatggcagcagatatgatttccttttggcgatttatagaggttgacgtagctttagccatgtttttttcatccttttgtttatcccagttttctgattagtgattaatcaattacaaatcagtataaacgacatactctaaaaatgcaataaagttgaaaaaagtcgcctccgcaattctgacggaaacgactctgttaaatacatccaattatggtgttttagagttgaaatataatcggatataattgatcttttgcgttttggtttgataggaaaacactaaataataactaagtcctgatgtgttattgatcgtataattagcttctgctgtatcaggtatgtctctagaggtgtcaacggtttccgtaggttcgcccaattcgtcaacaacttgtttgataagcaacttcttatagtctggatcgaaagatgtaatttctgtaactttatcgcttccatccagcatgatgtctgtatgatacttagcatagcttctcataggacctgtagaacctgactcggatttcccccacagctcaaataacaaatcgctactagttcccaagccaagacctttaggcaaattcggtaaggtcccctgcttggctgcgctgagtatagcagctgcggagctgtgtttaccgtgagatgaagctgtactactggcaggttcttgatgggtagaggtagaggttgagccttgcccattagtattgagatccgtgttttgatctgtagaactaacaggtggtgtgactgtttctgctttagtaggagcagttgatttttcctccccgctattgctgcatcctgtcatcacagcaaaacctatagccaataaggcactagtggtgattagcttgtaagccaactttttacgatcataagattgatgtgtatgcttcattataagatcactctttccttgttcttgggtacaaaccaagtgtaaccgaacctcgtttccagaatacctctacttgtatccaacttgtaaacaaggacatggatgatattttctaacataccctatttacgaccataagctcccagctgttgtttagaaaaggagtaaggagagtcactcttcttcaaccatatattccctttaatgatgaagattacagcaaaaacaaagtagatcgtacccgcaatccagtctattgccgttgggatgtctcgatgtactatttcatgaatataccagattccgactggaacatgcaggagaagtgccgtaaacaagccaggattatataaggtttttgctttaatattgacaacgatgccgtgccaaacgacctgaaagaatcccataaaaactggtgcgagtccaagccagattacttgcggaaaccatacgggaagcagataaaacacataggcaattgccacattgataatcatcgctgattgagtgtttaaagggtaatgatccggtgtgtcacttttaaacataacattgttaaataaaccagcaaaatatccaggccagcggtactcctcaaattgatgaaacaatatagccacaaaactcaaccataacatgcctgttatatccgaaaggatagctggattcataagtaaaacaatacatacaaccacaccgattatagcccctgcatcttgccaatattttctcaaaaaattcatattagtcactcctatgatttatttttgatcaaaatatctttcgaacagcagatttaattgttcctctattgaaggtatttccacaactgcccctgattcaagaattggactcatcagtgcaggcagaaaaatagctccaaatatttgcagcatcattgctaacaagcgctccggctgttgctcacctgtcagctccttgatcgtgctctgaacctttggaaatcccattatgtttaaaaaccttccgtattcctgttgagatgtatagggcgtgctgcccatggcaataattcgcgaaagaagctctggatattgacgaatgacctgcagatagttaagtaaaaattgtttcagtctatcttgggggggcatcgttgtattgtccaaaatagaaaaggtatgctgaaagccatttaatatcacttcaatagcttcactgagcagattttccttagagccaaaataataattaactaaagaaatattagtagcagacagctcggcaattttccggattgtaaccgcctcaaaaccttccttttgaataaattccagcgtagcgtctaagattttttctttggtttgttgttttttgtctgggtgattcatgtttttcctcctcctatttcgtccaatcataacggatgaatgaaatgggacgattttatgtaaatgacttttcaaacaataattaaaacgttgtttaaattactgtttgaactcagtttagcactttatatttcacaaaacaaggagcaatttgagatttagggaatagaaaaacccgcataacgaatgagatcgtttgcgggtcgattgaatggagattgaaaaaaggcctaaatagcccaatttcctttgcggaacacggcttctttgcttccgtcttgcaattcgccgtcaatatccagctcagctgagccgatcatgaagtccacatgagtcaggctgacattggcaccgttctggagcagctcctcccggttcatttgtgtcccattttccatattaaatggatacgcactgcctagagccaagtggcaggaggcattttcgtcgatacctgtattgtaaaaaatgcgattgagattggaaatcggtgaatcgtgcggcaccagtgcaacttctcccaaatagctggccccttcatccgtagcgagcaaatgagtcagatgctgctcgccggattctgctgtatattcagtgactttaccgtccttaaaggtaaacgttatgcgatccaccagttgtccatttaaattgagtggcattgtacttgtgacatgaccattgacacctttacgcttaggcatcgtgaacacttcttctgtcggcatattcgcgacaaaataatctccgtgctcgttctcaccaccaccgctgcgccaaatatgcccgtcagccagttcaattctcaaatctgttcctggtgcacgataatggaggcttttatactttttatgattcagcttgtcttgtacctgttcaaggtttttcaaatgtttctgccaattctgaataggatcagagccatctacacgattcatttggaagattgtatcccacatgacacgtatacgatcctcttctgctacatctgcaaatactttatcggcccaagccttcgtcggcgctttaatcaaacaccagctaattttatgatttcgggtatatttagaaaaaccttctctcgccgtagctgccgccttagtcgcacgagataccttttgtggatcaatgccttgatataaatccgggttcggtactttaatcgttagtgtggctccaccctcttcggcaaatttctccatcatttctgccttccaagcaggatagtaatcaaagctggcttcgtcaccatgttcaaaacgactacgtatgatggaatcatcctcgaactctacctgtacatatttagcgcctgcttcataggctttgctgacaatcaggcgtgtaaactcaacagtttccagtggtgcagttaccaaaaacacctgtccgggctgaatgttaacccctactcttacgaccagttctgcgtattgctccaacaatgattcaaatgtactcatttttccacgctcctgttcccttttgattatattgaatgatttcatcactacagtacggattgcttctccagttcacgtagctccactcttcgtattttgccagagctagttttaggaagctcttgaataaactctatttttcgtggatatttataaggcgccgtccatgttttcacatgatgttgcagttccttcactaacgccggtgatccttctaccccagctttgagtacgacaaaagcttttacaacatgtccacggatttcgtcagggctggctacagcagcacattcctgcacggagtcatgcttcataagcgcttcctctacttcaaaaggaccaatggtatagccagaactgataatgatatcatccccacgtccttcgaaccagaaatatccatcctcatctttgcgagctcggtctcccgtaacaaaataatctccgtggacactagctaatttgcgttctggatcatggtaatacgtatggaataatgccggcagatcagcgcgtaccgcaatatcgcccacttgccccggagccagtggaatgccatcctcgtctacgacctcaacgagtcccgttgcaatagatttgcccatcgagcctgtgcgcagaggtgcatcctttaaattaccaataattaatgtgctctctgtttgaccgtagccgtcacgaatcgtaatgttgaactgctcctgaaacttattaataacctcctgattgagaggctctcccgcagaaactgcgctgcgcaattgggatagatcatattgatccaaaccatccgttttcgccataatccggtattctgtcggcgtacagcacaacacttggattccgtactgctgcatgaactgcaaatagcgacccggacgaaacggaccattatatacgaatccggtcgctccattccccagtacagataaaaacggactccaaatccacttttgccatcctggtgcagctgtagcccatactacgtctgaagctcgaatatccaaccatggtgatgttatccgcagatgggcatatccccagccatggctatgtacaacacctttaggatttcctgtggtgcccgaagtataggccagaatggccatgtcgtcacggtgcgtcttcacagcttcaaaagtatcttcctgtccatccattagctcattcagcacgagccagccagatacatctgccgtgtcgtccccggagaccacgatacgataatccagagcaggcaaatcatcatttattttgtccacttcgcttgttactcccgtccaggcaatgactgcgcgcgcttccgaatggcgaagacgatatgcaatatccttggcacgtagcatttctgaagatggaatgacagcaagccccagcttcaagcaggccagataaattatatacgcaataatacgccgtggtactacgaccagaaccctgtcacctttgttaaatcccagatttgcgagtcctccagccagccggttagcctttttcaacagctctccgtaggtgatttcttcgtattctcctgtctcactcagccacttgagtgcagttttaccagcatcatggtgttccatttccgaagtcatattgtaatattcaggcgcaagccattgttgttgatctgtcaaattataccttcccctttatacataagatgagatccactttcttactgtagtataacacgtcttagtaccaggttctaataccagaatcatttttttggaaaaaaataaatttggtaaagcgaacgataaaaataaagagcctgatttcaggctctttttcttcaccgctatcgtgatctacaactggagttctaccattgtaaaagctgcttcctgcccgtttacgagcagcgcaatccggtgcgctcccgcataatggcgacgagttgtcaggtctgcaaaacggtgtgtccgtgtacctatgagacgcgttcctccagggaccgttttgtcagatagcaaaaacagtttacgtgagacttgtcctctcgccttcacaaaatcgatgccgtactcgatacggactcgtactgggtcaccttctcgaagctgaagcgcgtagctcaactcacagttatcaccgagccttaacaaggctgggtctgtgctgaaagaggcttcagtgactaacggcgccccgtctgtttcatccgcatagccgaacattgccatcacttcggggatggatttgcgaatcaaggtccgacagccatgacgcacaatccagtcggtgtcaggatgtgtccctttccaccgttgagccgtagcaatgaccacatcaggatgatccttggcgatatcgttcaggttgttggctacacttttacgtacatatagtgaaagatccgccttcagtaattccaatacggccaatactggtgcaggatcacgcttaaacacaggcaatgcctgtccccagggtagccgtggacggcagccttcgctggcaagacggcgaacgtgttcactttggtgtcccgcccaggtcgtcatctgctgcatcatccgttccggttcacgcaggaggaagggtctcacagcgaactccgcagaggatttagatgtgaagcgctccagtgccttcatggacaggtcccaatgctcttctccctgcccatacacctccacaaaatcggggaaaaacaagtacggaaaaccactgcaatgctcgtctatagcaaaaagaatatccagagcttcttcataattgctgggcaaaaatacccctaatgtaaacgaaatacgccgtattcgttcttttagctccagctcatcccatttttcatccatcacttgatggatgaatccgttggtatcgaacggcatgtacgctgactgtactttttcaccgaatagttgaagaaaattctccgtgtacatattttttaagggctcggccattatatatctccttttgaatgaggttgagagaattgtagcaaggcatactaaaaatgccaagtcctatgattaggacctgacatttttacattaatacaagaaatcgatttacttataattcgtgttggacaaaccaattggtaatacgttgcagtcgttccacgcgaagctgtgggtgcccttttcgtgaaagctcgtgacttgaagctggaaaacggacaaattgcgtagttttccccaagcgacgcaatgctgtaaacagctgttctccctgctctatagggcatcgcaaatcctgctccccgtgcaatatgagcagcggtgtgttgatttgctgcacataagccagcggagattgcctccacaagagctcgcaatcgtcccacggattcccgccgacttcatcttcagtaaacgagtatcctatgtcactcactccatacatggacagccagttagatatggatcgctgggtcactgctgcacggaaacgatcggtatggccgacaatccagtttgtcataaagccaccatagcttcctcctgttacacccaacctttctggatgaatgaatggaaattgacgtatagcctcgtccactgcgctcagcagatcggtgtaatcgcgtccgccgtaatctccaaggacgacattggtaaaagactgtccgtatcctcggcttcctcccggattcgtgtaaatgactgcatacccctgagcggccagcaactgaaattcatgaaaaaaagaattggaatacatggcatgaggaccaccgtgaatctccaaaatagcaggataagataccccctccttaaacccagcaggcttcatcacccatccctgcacccgtcgtccatcctcaacctcagtccagaagctctcaggcacactgatctcaatctcatcaagcagagaatcattcactcgtgtcagctgttcctcagttcctgaatgaatcgcaatccggaacaaatcacctggtaaagctacatcggtggaagcggcaatgatatgctgctcatccgaagtaagctcgaattggtaaatttcccgttctccctgggttaaaattttaaaagttccatcaagcgcaaactgatatacgtgtacattgccttcaagggttaccagcgtatacagggattgaccgtccgcactaaagcgtggtggtcctacatgaagatgtgaacgcatgtcgctcatacccgcgttaccgaggtgagcgtcaagcgtctcactaacgcatactgccgtccccccactggaaggaaccgtgtacagtcgggtctgtgtagcgtctttggcatgtcgatcatgaccgtaaaaggcaatcgttgaaccgtcgggagaataagcagcactctcgatgtgcagttcagaatgagtcagcttaagcggtgctgctgcatcaccatttgaagtcccaagagctatcgtaaacaaatcattttgcttacgtaaatccgtatcctcgttcgaatgctctgctattctggcgacgaataaaatacgttgaccatccggtgaccacacaggctccgccgcatcataagcgccggaagttagttgaactgtgtaccccgaagtcacatctgttacatacaagtgatcacgagtatcatcccacagtccatatccgtcggatttagctttcgttcgattaacgactcgtcccttaagttgtgcctcctgagttcctccatcggatgtagggcttgacgggttctcggccgttttagctacaaacgatatgcaggtcccatcaggagaccaggctaatgaatgaacattgttctctacgtgtgtaagctggcgtgcctcccccccgcgtttcggaataatccatacctggcgcttgccgtctgttgtacggagaaaagctagttgtgttccatctggtgaccagacaggcgtttcatctttgggtccatatgtaaagggtactgcgctagcgccttcagacgataatagccaaattcctgagttataatctgtccgctctttattaatatgctgctctacgtaagcgatttcactgctgagaggatgaatagctggatcgctaacccagtgaagtcgatataaatcctcggctgttatacagcgcttggtcgtactagattgtgagtcgctcaaaaaaattcctcctttatatcattagattccacatctttaaattttaattaatccgatgaattttatgcgatttaaataaatatacaattacgttactctttttatgtatctctgtcaatttgtttaaaactaaaaagcccctctctcagtcgctatcgacccgaaaacaccgctacttcggttgctttcatgagagagggtaacgttattcatcaatcacaactgaaaaataggagaaatggagggagcacctttaggaatagcagccagtgatccattttctttgtgtaggttcggcacctgctgccaaatagtgctgggaatctctcgccgcagcacagggatgatatcctcggcaaaccgatgcagctgttcaagctgctcctgctcttcaagcccatccacgcttatgctaagtacctgatggccgaacgcagtataatagtttcgtattttttcaagaacgctgtccgcagaaccaatcagaactggaccgttgcggatattgtcctccaaacttgtaaacggggattgattatgctgagccgccgtcgtcgagtggtatgcatcataatacgggcgatagcgtctgatcgcttcctcgtctgtatccgccagatacaaactcccggctccggcaccaattacggcccgagcaggatcatgaccgtaataagcgagccgttcacggtaatgatcaattagcgttttatacttggcctgaggatggaaagaatttgaggaaaataacggctctccatattgtgcagccagctccgtcgataatgtactggaggcacttccatgccatatcggaatttgcttttgatacgggcgtggctgtgtcgtgacctgatacagcggggaccgatagctgccctcccacgtaacctcttcctcgctccatagccgtttgagcagacgatagcgttctgctagcgactcccactgctcttcctccgtaattccaaacaacggataatggcgtggatcattgccttttccgataatcagttctaatcttccacccgataaatgatccagtgtcgcgtaatcctcagctacgcgtaccgggtcaagaatactaagcaccgttaccatcgtcagcagacgaatccgttcagttctcgctgctatagcggtcagaacgagtggaggtgaagacgacaaaaaaggcgcaccatgccactcccccacaccatacgcatcaaaaccaagctcctctgcgagctcagcctgctttattacattttggaatttttgctgcgaactccaggcttctccggtaatcgcattaggcagattagccattaggctgaacaatacaaacttcataagtcctgccccccttctgcgaacgaatcggcttcgtccgttccctatgatcgcgtctaatttcgattagctgtctcggcttcatttttttcacgaatgtaggtggagaataattcaggattcaccactttacgtagtaaatgcatcgtcccgtcccctgttccatggtcaaaagcatggatacgttcatatccccaacgctcgtacatggatagcaaatagggatgcttttccgcagtcgccagtgtcacagcaggagcaccgaccttgtcacgaataatcgtttgctctacccaattcagcagttttttcccatatcctttgccctgggcagccgggtctacagcaaaccacatcacaaacggtagatcggttataaaattaagggctctatttttgagatgactaacggtagcctgaatgacaccgtctacctccagcacgtagcaatcattatttttaatgttttcttgaatgagagcaacgtctgcctgagcggcaggccatcgaagctccaactgccgaattgtttcatacgcctcatacgtcacatactgcaatctttctgcgtcctcttggagtgccaaacgatagatttcactcatactaacccgcctccttataatgtttttataaaacgagtgaaccactatataactattcccatctatttaataagatataaaagttaacataactgtagcatgctcaccattcagcgacaaattaattttttctataactccatttaaaataacaatagcccctcgaaagattggaattcgttcattaaagtcaacgcaaaaaagcccgaaaatcgggctcctctactttctagacgaataaaatgctggtcttatccccagcattcaaacacaacatatatgctgtattactccgcaggggcagtaaagctgcgtttggcaaactcgctgtccagcatataaaaggcgttgctgtctctttcaatgcgcttaagcttctggataacactgtcgaacagagcttcctcttcgacttgctcatcaataaaccatttcaggaaatggatcgttgcatgctcgcgtccatcgagggccaagtcagccaaatgataaaatttttgtgtgttttgctgctcatgcttgtagccatgctcaaatacgtccagcatggaatcgtagctatttttcggctctggcaatgcagccaatgtggcgcgtcctctacggtcattaatgtatttatacagtttcatggcatgaaaccgttcctcctcagcttgtaccaggaagaagtttgcaaacccatccagactttcactggagcaataagcagccatcgccaaatatacgtgagcagagtaaaattcaaagttcatttgctcattcagagcctgtgccaaattgtcgttcatgtctcaggtcacctcggtcatgtatgtaatgatgtaacgatcatagtgtaccacgaatccgatcacaaaaaaatggacggaagtgaattcaatgatctcacattccgcccgcaatttccactatcagttcacaatcaaggctccagaccccagacacgtttgtcgtttatatacaaaggtgctttgtcccaatccgtataagatgtcttggttgaatcataggaaaaatcatcactttcgttatagttgctccagtccgccttgttcatgcgaatctgaatatcccctgtattttcccctgctgccagacttccagcaccagctccaaaggagatttccagataataatctgcacctgtaacggccttatccagtttcaccaaacgtccctgaacgttactactacccaactgtgcatagtcacaatggaattcctgtgacttgtcgccatctacagtatagtagtatcgcagcttgacatttttcaggtcaacagcatctttacccttgtttacaatacggaaaagtggccgaatctggttatctcccgggttggtgtcgcccacgcggtattgggcaatcacatctcccgttgccggaatgggtgctgccgtaggcttggcactgacctcagcagaatccgggctggttcctaaagaatttgttgcatttgccacataataataagtggtttcattcaccactcctgtatccttgtaagtgctgtctgttaccgttgctactgtggtataagggccaccactggttgtcgagcgcttgactgtatagctatcggcacccgtcgctttgctccaggttagtgtaacctgagcatcccctgcgtttgccttcacatttgccggagctttgggagctgtcggctcggttggtccactaccgttaatgagacggtcatactcggcataagccgttgccatatccacttgggaccagaaacgatgatacgtaaattctggagcgcctttatcccattttttggtctgattgttccaagaagtcgtgtatttatctttgagataagaccattgcggatctttagtgatattaggccggatgtcactatagctggaatacgtaccattgccgcctttggacggatcagaagccgtagcgtcggtgccagggatcgtgttgccttgtccagtcttaccgctccagccgctcggaatatacacttctttagtgaaatagcgataataatcctctcgcgcttccttcgttgtaatgcctataccatcgttataaccccatgcagcatcaagcaaagctttagacagatccttagcttccttgcctaactcggaatagtctcctttttcagctttcgttccagcagcaaaaaaagtaagtgctttaacatagctgcccagcactccggcatcctgccccggattctttgttaccacatggagattggtattccctttatgattggtaaatccgctccaggtttcaggctttccgctccattccagattgctcggcagccagaactcacctttagccgctgtagtagccaccttcggattcttgccacccagaatacgcttaccttgagcgtccaaatagtatccctgtgcatcagtcacaggccgttcgttggcaaatacatagctcttggaccatgctatccagttttccgtcacttgtttagccattttaaactgctcggacgaagtatcccctttcttagctaagatgtagtacagctcggcaacccgctcgacaggccaagcctgcatcccaaaccagttgttggatggtggatcgttatatacaggagcccctgtataagccataccataaaaggtacttgtgccagatggataagctttgtaggcaccatcccagctattcgtcgctccgcctgcaatggccccctcatcggattgcaaccaagtataaaactccagttggcgcttcagcgaggtcgcccagtcctgtcccgccgttggtgaattcggtattaatccaccatcttgatcggacaacgcatacgctgcaacgacattttggtagccctgatgcgcatggctggcaccaattcgccaagcccagttgccgctttggccaagtccgccgccccaagccgtataccatgccattaggtaaagactggcatccttgcccgtaccagcaataggacttccattggaagcgcttccggttttctggaagtatttatcgtacatgccgtaccgcaaaaagtctcccatctttttggctttatccaaatatacggagttgtcatatcccaattccttagcccagtacatcgcttgaactgcccgtgcatccgcatcggtggcattcgtgtagcgccattgctgtgccggggcattattttccttagtgaacaggctcataaacccttcattaggcttgccaaacttatgattatcttgtgatggatgtggtacagcctcccagactgattcctgttccccacgctggaaggtgtttacataggcagctgtatgcgacggattcagaagattgccgaagccgtaccaattatccacatccaacaaccagtgcatcagataagtctggttgttgccataggttgccttcagctcagagtccagtggatccttgccagcaccatactgaccactcagacggcttgggtactgatccggctgcgaatattctgcggcataagtggcggggctgttcggattatagttactcattgtcggttgctcttccttaccgtccccttcattaacaggaatgatatatttctccatgttgtcccatgcggattccaaatgcccccaatccccggtataatgaccatacagcacttccagccacatccagtagctgtacgcttccgaagtcgttaagtgtccgtaatccggagcctcgctcatgagcgtttcaacagaatgataagggatgccttcttttgaaaagtatccgctatccggatcctttagctgtttatatagttgtagaaaacgtgtcgattccggtgttgcggctgatgcacggtcgggtcctgcctgaaataaccccaaggttaacggaagtaccaaaatggctgacatgaccatagagacagatttcctgaacacggattttctgctgatcacttttgcattcatcctctccattatcaattttggctttacacaagaatttattccgaaaaacgacagcacaaaaagacagcatcatcacctcacttttccgtaaaaaaggtggaggacacgctgtctattgctccaaatgcttcgcattggccctggaaaaaatatatcatactaggcgccaaatgagagtcgaaaaattctataagtttagagattcacaaggaaaattgacgaaatcgattggaatcggtactatttcacagggaggcgttaaaacatgaaaattttgctattgcttggttgtatcgtgatgtttttagccgtagctctgggagcgttcggcgcgcatgcattgaaaaaaagactttccgcagacatgctcagtatattccagacaggaattcaatatcaaatcgctcatggactgggtttgctactgcttggagttcttgctgacagccttgtccattcttctctcatcgtaaccgcaggttgggttatgctggtgggtattctcctgttttccggcagcctgtacgcccttagtatatccggtgtgagaaagcttggagcaatcactccccttggcggggtggcttttttggcaagctgggtcattgtgatcgtggcggttgtgcaaggttaaagaaggataaaggaacggagacttggaaaaggaggcgcttccaagtctctcaattattaacgtagcattcctgattatatgaaagaatgcactatctcgtctgcacttgttgcgctttctgagcggctatccgatgaccttcgatataacgtctggattcagccatctcatgctcctgagcagcttccataataatatgaacccccggcttgtactgctccagtagttccatgtagaggccatagttcatgtctccaaaacccggcggcaccgtctcaatttcacctgacgatgacaaccgccggtctttggcatgcgctgcgataatccgggggcccagcagttggaaagcttcgcggatgatctcatcctgttgcgccagattttccgttttcagcagattacccggatcaatcacaacaccgatgtgtgaagaaggtacttcctccagaaaggtagccaactctacggcggttccgaccaagtgatcgtttgcagcttccaatcctacgaatacgccccacttctccgcttcatctgctaattcacgcactacttcccttacaactctccagtcacgatccgtataggcggtaccgtcctcattacgtccgacttcagctgcaaccattggtgctcctaacagacctgcatatcggatcagctctttgaagcgctctacattttcacgcagcaattcctcatcctgtataaaaaaatgtaaatagcacccgagcactgatatggatacaccatgcttacgaaattcttctgcgatagacagtgccaatcccggattgaacttacccggtttattaaaatctacatcactgatcgctctccacggagccagctgagcatgagtaaagcccgctgcgcctacctttgcagccaattcacgataaggcaacttgccaaacaaatgtgccaatacacctactgtcactaaaaatcacctcttatttttattgttgtatggtacttgttaccgtactctgctccaaggtctcattgatgatgtgcgtaatccgttccacttcatcatgaataaaaaagtgtcctccctcaaaggtaaacatacgaaattgctgatccgtatggtgtgcccatgcctccgcatcttgtaaggtcaccgtgttatcggtcattcccgtcaaagcggtgataggacaatgtaaaggtgcggctttagccatgtacttatacaactcgacagctttgaaatccgctcttaacaccggcataaaatagtcgtataattcccgattgtcaaaaatcgcttccgaaagctgaccgtaccgctgcaaatgcgtcctgaactgatctgcgggcagatcgtgtaaccacggggaatttcttgggacatgcggtgcccgtccacctgaaacgaacagatgagcaggcttgccatatccactcgccaccagcttgtagtacagctcgaatgagatcatcgtccccatactgtgtccgtatatggcataaggatcgcccggggctatctcttcgctgatcttgtgcaacagatcctcgctcatctcctcaatgctttcctttagcggttccccagaacgaatacctctgcccgctaattccagtggaacaagcttgatctgcggaagcagcaactttttccatttgaagctgaccgacgccgatccgcctgcatacgggatgaaaaataatgtgataggtgccattcttgcaacctcctgccttgctaagttctaacttttttattttagcataaaaaggtatatttacccatttcaaatattttgcaaattccagaagaatggtttagaaaatcaagcacatttgtataaggcaggaaatgtctttctaaagaaagaacggctttatgtttgaatataatcatgtgttgggtcttttgacgggtacagcggcatggaactttatagctattactcaatccattctcggtattcagcccgaatgggatggtctgcgtattgatccgtgcattcctacagcctgggacgaattcacagtcacccgtgtcttccgcggtgatacctacgtgattcatatcacgaatccacaacatgtctccaagggtgtagttacagttaccttagatggcaccgtcctacgaataatatcctgccggttgaaggggacggggctatccaccaagtaaaagtgttgctaggctaacaagttcatggccttcaaaaaaattagcttcaacttcatcacatagtatcttataatacgagaatggctaaagatacattaagtgtggtgacatcatgaacaagacaaaacggcttactcaaaccatggattacaaaacaaagcaagcccgctgggtacgcaaaatgttattactgtattggatgattatagctgtacattttatcgtccagctgggcagctacttatttcttgattaccacgcttcgccttatgaattttacgtcggaacccttattgttcccacgctaatcatgagtggttccaacttactggcagagttggctcattttaaatttaacaggtattcttttgcgatcctgtttatggcaagcaccgtcatttgctggatgattattcgcctaaattatgatattcggattattcctgcgctatgtttgttgcctattttctcttctattctgttcttcaatcgtcgcttaatatggctttcctttgtattgcaagtggtcgtcttttttctgttgctggcagcagatggatcattccgcagctatttgtcagactttgatatcgtggcgattccaacctttttaattatgtccacctttattgctctcattattcaggccagcggccgcgatttgttagtggatttgtataaaacaaagcgcgcccaacaggaattaatgatcagtaacgcgattatcagcaaaatgtcaatgactgatggtttgacaaagctgtacaatcatttgtcctttcaaaacttttatgaaaaagcactcgaatatgccgaacaaggcgcgatcatccatctggcgttagtggatattgataatttcaagaagatcaatgacacttacggacaccagttcggagataaaattttggaaggcatctcgcaaatcattacagaacagattaccgcaaatgacattgcagctcgctatggcggtgaggaatttgctattttgatgttcgagcatactttcgaagaagcttatcagatcgtcgaaaacatccggcgtgaagtggagaaaatgacctttcaggagaaattgcaaatcgtttctgtaaccgtaagcattggactgaaaagctatacagaggaaatgaacaaagataaagatgtattttttcagcaagcagatgactatctgtatcaagctaagcgctccgggaaaaacaaaattgttgctcttaatcatatcgcttaatgtaaaaacacttcatttgttgagactccggcatgagcttgccggagtcttttgaatatagagcttaaaatgtaatagagttgacaattccataagttgaaactaaaattgttacatatgtattggttatttacttacattaaataagttcgaaggagatggttttttaaatgtcaaccctcgttattgtcgttcaccctgatcttgcggaatctcgcattaacaaaagatgggtgcaagaactcaagaaacaatctgacgtaaccattcacaacctgtatgaggtatatccagatgagcaaatcaatgtcgcccaggagcaggaactgctagagcagcatgaccgtatcgttctgcaattccctttttactggtacagcactccttccctgctgaaaaaatggctggataaggttctaacctacggctgggcttatggaagcgaaggtggcaagctacagggcaaagagttgttgatcgccttgtctgctgccagcgttgaggaaaattatcaacatgacggacggaacaggtatacgatcgaagagttgttgagacctctggaagctacaggccatatgattggtgtcaaattgctcccttatttcgtacaatatggtgctgcagtattgaccgatgaacaactagaaaaatccgcacaaaaatacgcgcaaacggttatttcttaattttttactagaaagccccttggacggcgcccgccatacctgctttacagcagacggcagctccagccaaggggctttactgatcgatttacatcgtaaccaaggtactggttacctgtgccatactttctttaataatttcgcagcccttacgcaagttttccaagcttatcgttaacgctggcataattttaattaccgtatcgttacgcccagcacgttcaataatgagtcccctactaaagcagagagacgctacctccttggcgaacgcttctcccagatgagacacatcaatcccccagatcaatcccatgccacgaatttcaataagaggatctatcgattggatatgttcacgcaagaactgctgaacaaaagcctctttttccttcacttgtgcttccagctctaccgtatctctgaactccagcgcagcctttgccccgacgaaagcaagctgatttccacggaaagtgccgttatgctcacccggactccatatatccaattctggcttgagtagcaacagagacattggcaatccgtatccactgatcgatttggacaaaacaaccatatcaggaacgattcccgcccgctcgaatgagaagaacgatccaacccggccgcaaccgacttgaatatcgtcaacaatgagcaaaatatcatgatcatcgcacagctgtcgcaaatcacgcagccattcggtctctgcaatatgaataccgccttcagcctgtaccgtttccaaaatgatcgcggcaggcttttccacacccgaatgggtgtctgttaaaagctgctccatatacaaaatggtatccattccgttaaatgtgctgttataaggtatgaaggtaacattgttcagggggacccctgcgctctctcgcatggagttgttgctggtaatagataaactacccagcgacatcccgtggaacgcacccataaaagcaaagataccatttctgtttttcaccttgcgtgcaagtttcagtgctgcttccactgcattggttccggtcggtccgcaaaattgcagcttataattcaagcccttgggctggagaatacgctctgaaaaagactccataaactcttgcttggccgtcgtgtacatatccagaccatgcataatccgatcggaagttaaataatccaatatccggtttttcataaaatcattattgtgcccatagttcaaagcccctgcaccggcaaaaaagtcaatgtaacccttgcctgcctccgtgtacagtacatcgtttttagctttgttgaaaacaactggaaaacttctgcaataggatcttacattggactccagcacttcgaatgtgttcatgatctctcgtcctcccgctgacctgattttaaaaaatacaagcatggaaagcaaaaaaatgtaaatatgtaatctaaaagagtagacagtctgaattcacaatgggatatccacaccaaagaatcataagtatgatcgcaagaacaattaaagtacgaaaattaaatacagagatagcacattgagagtaagttagtagaagattaaatagtgggtttttctaagaggcctatcagaggatgtcaactcctatgtaataaaataccataatattcatttaagtcaatgcatgtttctgaggtgttttgttaaatttatgtaatttatcatcaacgacttgtagtatattgttataagaaaacgaaaattgtcgtattatagaaataaatctcaaaaatagtacatttccatatcaaatagatatacatctggactatttgtcaggattgccacaacaagcctgatcttttgacagactgtccaaaggagtttactctatcaacaggacctgccaaaaacttgttgtaaacattgcagttatcctaactatttggctcgaatttgatagaaagataaggaaatatgatcatgtctaatgttttaattattgaagatgacaatatgctgggagataccctttccttgtatttaacaggagaagactacaacgttactcgagtggaacaagcgtctgagggtattgctaggcttgagatcgtacagcccgatattattttgttggatctgttgcttccagatttggatggaataaatccctgcccactgatacgcaagcatacggacgtgcccatcatcgtgatttctacagaaaacaacatatcagagcgcattcgtacacttacgttgggagcagatgattatatttgcaagccttttagtatgcaagagctaaaagcacggatggaggctcttttccgtcgtattgaaatcacacgcttgcaaggaagaggcagagcacctgaacctgaaacgggcattactttggatctagcgaaaagaatgattaccgttaacggacagaatgtggagacaacatattcagaatttgagctcatgaagcttttttatttgaaccggggaattgtattcagtaggtatgctttgattcaggctctccgtggcacagactcctttattaatgagagggctgtggacgtacatattaaccatttacgcagaaaaattgaaaaagaccctaagaaaccgcaattgatcaagaccatctggggaatcggctacaaatttatgcaataatacggtcagctccagggaagtgatgacttgatctgattaatctccttctgaaccgtactgagttgctctttccagtccggatacagttcacctgttgaggtttcattgctgcgcttcaatgccttttccaggtctatcacctttgccagcagctctggcgcgcatagattccccgttcctcccttaagcgagtggattaatcgaagagcagaagataactgcccattgcccatttttttcagtactctcttatcaagatgctggtattcttgaatccatttataaagggcaaattgaaaaatgtacaccttgccatccatagcggctatcgcctgatctgcgtaaataccatgtaaatcttgcagccatgctaagttaatccaactagttaacactctagcagcggtcagttcatggataggcttgagaagcacggcattaataccggcacgaagacaaacttcctgttcatgctgcacagcatcagcggtaaaagcgataatgggaagcctgttaaaagctttgtttctccgaatatgtctcgccgtctcaaaaccatccatctctggcatatgcagatcaagcaacaccatatcccagtaacgcagttccagtaacgctattagttctcttccgttcgtgaccatcgttacctcaaagttacgctctgctaaaaactcggtaatcaccacctggttaatttcgttatcctctgctatgagaatttgataattctgtgttgtatcccccacctcattgcgggaactcatggtcacatgagtctccagagtattaccatctgcaggcactgactgttccttcttccagcagagaacctccagcagagcgttccgggtaacgggcttggacaaaaaggcatctatcctatgatccatgtccccatcagctatggtttccatctgaaacacggttgtaagtccaatgatctgagttatctgcctatccagcatttgaagccattgcctccgggagtccagttctctaaaaccttccatccccatatcaatgataacaaaatcaaaatgctcacccttttgaaaagcgtccatactttcttggaaggatgaaatagtgaatggttttagccccaaatcttgcagtaattcgttcaaactgtacctcaccagttcatgctgcgcaacaattaaggctttgcctttgatttgtttttctatttgtgtgcttcccgcattcaattccccggtatccaactcgacattaaagtaaaattgactgtactctcctaatcggcttttcacttctactttcccgcccatagcttcagccaaatgcttgctgatggccaaacccagcccagagcccccatatctgcggctggttgaggtactcgcctggataaaagggacgaatagcttgtccatacacttctcggaaattcctattcccgtatcttctaccataaaagaaacgcctactcgtccgccctgctgactgagcattttcacctgtaacaatacatgtccctgatccgtaaacttgatagcgttggtcaaaagatttgaaagcacctgctccattcgaagcggatctcccttaaaccttttcggtaacgccaggtccgttataaatacgatctctatttccttaccttccagcaaagttccaacggtatctgcgagatgccgaagcattttttccggctcaaattctaccttttccagttccagactgccggcttccattttggaaaaatccaatacgttactgagcatggatgaaagggtacgcgaggaggcaagaagcttgtggaggtaatctctttgaacggcagtcagttcagtcttattcaatagctttgacagaccgatgattccattcagcggggtgcggatttcgtgactcatatgagccaaaaaaatgcttttcgcatggttagcttcgtccatctcctttctcttctgctctgaagctttgtactccgtaatatccaacacgtgaccgataacatacctagtaatcccgtcctccttaaccggatgtaaggtaatgagagccgaatattcccaaaactccaattcaaatacggcttgatcaccaaaccaggcttgcttgtagtattgactaagctgctccatcgtttcagaggaaagctccaatatgtccccgagacgcttcacatgctcccttttgttgtagttgacttgcagattcagacctacgcgcttcagcaattccccttcaagcagcctataataaaattcatcaccacttttctccagcctgaaggtaaaacccggttggacccgaagtaaattcagcagatcacggtctttgtttaacaaacgttgtccatatgtatacttagcggtggttaaagtgtgcacaaacagagtcatgaacattagaccaatccctagctccagcaagcaggtcagcagtgttttatcacttataccaatacataagagcagaattcctgccactccataaaatacacctgtgatcgtctgacgaacaagctgacgctgaaaaattaaaactaacaataatatcacgatagcacatagcattaaatctcgaaccaagtgttcgccccccttataatcttccatgttttgtacaataaatcgaaaatataaaaaaactcaggacagattccttatgccataaggcttaaagaactgtcccgagcattcattgtactatagattccatagggttcaagctcgttttaatatttgaaacgactgatcatcaccttcaaatcagtagccatggttgaaagcaactgtgcagaagctgatatttcctccatggaagccagctgctcttgtgaggaggcggcaacttcctcagatgtggcggcattaccggttgcaatcgtcgccagttcgttggctgtcgctgcaatctcttgtacactggctgatatttgctgtgcaatcgcagcgacctcctctacctgaggtgttgtctctcgaataccttccatcgcatgacccaacttgacaatggttgctttggaaatctgcagtccatcctgcacctcagtcgtaaccctgtccatcgtcttcactgttgtttcggtttcatgctgaatttcggcaatcaaggtggcaatctgtgtggcggatgtctgagactgctctgccagcttgcgcacctcatcagcaacgacggcaaagccttttccatgatcacccgctctggctgcctcaatagctgcattcaatgccagcaggtttgtctgattggagatatcgccgataaccttcgtaatttcaccgatttcatgagagcgggcttgcaaggtttgaatcatctggttggaacgctctactgattgatgaatggaattcatttgctcacctgtctgctcaacagactttcgtccttcctcggcttgcaaggcagatcgtttggccaaatcggctaccgaaatcgagcgttcagcgatttgggtgattccttgtgcaatttcatcgagggccaccgaattattttccagccctgtagtctgcttctctgcaccactggctatttcttgcacagcctgggacacctgctcacttgcagcactggtttgttccgcgcttattgtcagttcattcgaagaaattgccacatgatctgcactgttccctacgttctgaatgacagatcgcaagttattctgcatattttgaaaagccactcctaattctccgatctcgtcctcgctctttacttgaatgtcctgtgtcagatctccggcgctcacatttaccgcttgttcttttaactttaaaatcggtttgatgatggaacggatcaggaaataaacgatgataataccaatcacaagacaaccgatgatggttagtaaagtgctgatcaaaatcggtcctgctgcctcatcgacttcagacaaatatagcgttccgcctatcttccagccagttagcttgttagtcgcatagttcatatatttgggctgtccttcatactcatactcgtattcaccagtatcgctctgaaacatgcgtgattcaatatctgtaattttggtgcctgcttccttcgtcggatgtacaatgtaagtatggttgctgtctagcaatatagcataaccctcatgacctactttaatattgttcaacgtctctttaataccacttattttcaggtcaatgccaataacacccgatccatctaacgttgccttggacaccgtaaccgtcatttgcttcgagcttgccgaaagatagggagaactaatcgctgtctttgcttgctcctttatcgctttatcgtaccaaggtctgactcgtggatcataattatccggtaattgcttctgtggataggttgtaaatttaccgtccttcgtaccataagagatggattctgcttcaggatgaagtgcagcatattgcttgaaaaactcttccagtttggcctcttgttcctccgtctctacccgattgccttttagtctttctgcaaaatattctgcgtcatgtaccttgggttcaatagtactatcaataataaaattagtgcggatgatagcctgctcggcactttcttcaatctgttttcgaatctgctgactcgcgcttataaacgacaaagcccccacgatcatggacggtaaaatcagaaatgcaataaaggcgaccattagcttcgttttaaaatttttgctgagcatccttgcgactagccacttttttcccgataacttcttcattaataaacatctccatttcatttcctggatttcctaacctatggcgaatctcttcgtcttgccgatgacgacaatcacccgacagactctctttcacatttttcacatctgctgctaaaacgcttggacataaaagatataaacacgctagttaaataggtatatgtacttattttcgaaaacagcaaggctggtcggaaccggttctttgatataatatacctaaaaaatattaaaaaaaatgcgtagcatatgttaagaaaatattagtttcatctcactatacctacctcttaatatgaaaataatccccttgaaggtagcaaacatagggttattttcgaaaatcaccttatgcttactacccccgaggggattaggtttgatcgctttattcagttcaatccaacaacaccttcagatcttcaagcctggtaacaggtgcctgacaggtaaaatgctcacacacgtatacagctggtttgccttccacaagattgtaatcacggatataggaaactgtctctgcaatctccgactgtccttcatccttcagaataacgaccgtattcggcctgaaccccgctcgaatcgcctgaatgaactgtacggtctgtggatcgtccctatgacctacaatcacaatctcttttgtcgttcctgttgcatacaacaacgcgctgagcaaggctgagcagcctgacgggtaatgagcaaccatgccgccaaaagccttaaactgcttggctgcataattctccaatcgggattcacccgttagccgtgcaagccgcacaaaattatgagccgcaatgctgttacccgacggaatcgcaccgtcatagatttctttaggcttggcaattagctgctcactatctgacccataaaagaataatccgtcccgttcctcatcccagaataagtcgatcatattttgattgagcgtcaacgcccgttgcagatactctatatcgaaggtcgcctggtacagctcgatcaagccccacacataaaaagcataatcatctacataaccgggataagctgcttctccgtcccgataacgtgccaacagccgtccattctcctgtctcaaatggttccacaaaaacgtctcagccttccgagcttgctctgtatatcttgtgtctccaaaagcttgtcccgccttcgcaagagcagcaatcatcaacccgttccacgaggtcaaaatcttgtcatccttatgaggatgaacccgctgctttctggcagcaaacagcttggcgcgtagctcactaacccgctgctccagttcctgctcagtcaagtcatgcttgatccgataggcttccagattgatatcaatcaggtttggaatgttgtggccttcaaaatttccgtaaggtgtaatcccatacaaatcgttgaaaaaggcggcatcctcatcgcctagtatagcccttacctcagagtggtcccagacatagaatctcccctcttctccttcggaatccgcatcctccgccgaataaaaggcaccccctgcatccgtcatgtctcttgcgatatatgtaaagatttgttctgtaatccgtcggtacagttccttgcctgtcacctgccaagcttctgtatacgcgatggccaacagagcattgtcatacagcattttttcaaaatgcggcaccaaccatttctcgtccacggagtatcgtgagaaccccatgcctacgtggtcgtagattcctccacgggacatcgcatctagcgttttctctgccatttccagtgcctgttgattccccgtatgctgtgcatatcgcagcagaaaagacaggttatgcggagaaggaaacttaggagcttccccgaagccgccatattccttatcgaaggtgtggctgtattcatggaaagctttattcaagctctgttcatccagttcaccgcgataacctgcaagcaagtcctgccgctcatgctcggtaagcacctgctcactcagctccaccagctcttcgggctgttctttccaccgggcgcccaccttgttcagcagctccaacagtccgacacggccatacttttgctccttgggcaaatacgtccccgcaaaaaaaggcttctgatccggcgtcatcaatattgtcagtggccagcctccatgccctgtcatcgtctggcagatggacatatagatatgatccacatctggacgttcttcacgatccaccttaatggatacgtaatccctgtttaatacctcagccacttcttcatcctcgaaagattctctccccattacatggcaccaatggcaagtggaatagccaacagataggaaaataggcttgttatcacgtttagcaatttcaaaagcctcatctgaccaagggaaccaatttaccggattgtgagcatgctgtagcaaatacggtgatttttccttggatagtctattcggtttgctgctcgttgtcatgggacatcaccacttccgttgttggattttatgcttggtactattttaccctaaatgggtggtaaaagtcggaagagatgaaaaaaagatgatatcagattagaattactacattgttaagaagtatcaatgactctcaaccgaatctatccataaattgtttattcagatcataagtaggtatgaaaaagcactgatggatattcttcatcagtgctttatatactgcagtcgtaccttattagcgtttagcattatactcattagaatttatatcaaagatctccagcgctttcagtaaggcgtattcacttgttctggccccttcttttgaaaaatgtgcatccggaaacgcaggagacatatgatggtacccgggatagacatgtaattccactaagactccatcaaaagccagttgtttggcaaaaaccaatgcttcatcaatgaataaatcaatggtacctatatttatataagtcggtggtaacccggccaatgacttagcacgggccggcgcataatactcatttacctcctcttgacccggttcttcccccaatacagatttccagccaaaataattactttgttttgtccaaataaactctcctgcgtatggatgctctggtgcggtacttgtccgatcgtctagcattggcctcatcaatcttagatgatggatttcgaattccttctgatcacgaatgtacaaggctaggccagccgccagaccgccgccagcgctgctgccccctacggcaactttctgagtatctatccctaactcttccgcatgttcaatacaccattttaggcccgaataacaatcctgtaactgacttggctgcacatgctctggtgctaggcgatagtacacggatacacaacagaaaccatgttgtgcagcaagagatgcattagcaggacgatccacgactggacttcctaagaccatcccgcctccgtgtatcgaataatatagaggcatcttatgatgctttgaatgtttgggcttaatgatttctatttgaatatctggaccactaaagtaacttggcacaacctttttttctaatgtaatagggaacatctgcgttacatctatttgttgcatcatttgagattgatttttacgtgcttccattagtgtagattcggtaagatcggttgttggtattaaatcaactgcactgataatttccggatcaatcagatgtctacttctacttttttgctctcccatagtaatcgtttcctcactttcttgttttaagacaatgaatcaatacatttttccctttaattgttgctgttgtttatattcatattttaaagattaaaataagcttaataaatgaaaacaacgatttagaatcatttttggcataaaaacaataatgaaaaatggagtacagcctttgaaatagaatgggtctgttggatcatcggggagggtgaacggaattttgggatcaagaacggtatgtaaaaaagctcaagagagaaaatgaaatgcgaacacatatcaaaccttttgccaaacaaaaagacgtgaccggattgatttttcaccacgatcatccggtcacgccctaagctcaccatgttatgaggccaaaaataaattcattgacgcgagtatagcaccacgccactttgcaaactaggtatttttatgtgaatacacaattttcttaatggtttcggtagagaggaaaaactccgtagctaattgctcgatactgctgctattttgaaaagcatttctgattgcagcatttcgctgttcaagcaaccttctcccgccactcaaacttccccaatccatatattccgtttttggcttaggaatatacagcgtctctccttgaacatatttttggatttccataattagtttttgaggtaaaacttttgtagcattcgtatatctcaattttgctcgccccttatttggattctttaaaataaggtgcaaagccaaaaatattaaaaaagcttgtagcgttaaaaattgtttcgccccatacaaagtaacgctttcccaataattggctttgcatgagtgtaagaagtcacagacaatcccaatagattctccatcagtaggcacccccttttacttcgcaagtatagcataacttctgctcacctgggaccagctaaatgatatcagtacaatcaaaccattaaaattgagctgatatataactgatcttcattcgtttatgaggtgttgccgggacttttgtttgcccgactcttgttattcgcaagccgatgttttatattgacataagagtaggtcaaaaataaaagaggtgaacggacgagatgtctccacgtacgaaggaacaaaacgaagagatccggctgcggcgtctggcgcaaatccgaaaagccgctgccgatgtgtttttaaataaagggcctttactggaaatccgcgatgtggccgtgcaggcgggactcggctatggcacggtataccattattacagcaacaagggtaatttgctccacgatctgctgtgggacgcgttggagcgggccgggggatggctggaggccccacgcgcttcggcttcgggggaggcgccggcaggcgggcatttcggcttggttgctgcggcggacaccggtaactcggctgccgcggattcccaaagcagcagccgcgaaacggctgcttccacagagcttgactccgtcgccgtcgccggcattcggctgctgcagctttgggcggaggaccacgccttgtacctgctgcataagctggccggtgagggctttgcctcgctgcctgaagcgcgctctgccccactctcggctgcctttcgccgggaggtgctcgcgccgcttgccgcgctgctggaaaccggtcgtgcggcggacggggctgccgcttccggcggaaacgcggctgagccaccgtatcggctacagcgcgcggaaatgctgctggccgccttggtcggctgcgcgtcgctttcgcttcgccgcggaaagctgcacgaagaggccgaagatatcgtccggtttttaaaattatagaattgataaggagcgaatagacaaaaatgatcattttaaaatcacctagggaaatcgaagagatgaagccggcgagccaaatcgttgcggactgctaccgcgaggtggccaaactgatcgagcctgggatcaccacccgggaaatcaatgactttgttgccagacacatcaccaagctgggtggcaagcagtttacgaaagggtacaacggtttccccgccgaaacctgcatttcggtcaacgatgtggtggcccacggcattccttcgaaccaggcgcttatggacggcgacttgctgaagctcgacatcgtcgtggaatacggtggatggtttggcgattcgtgctggtgctatgcagtgggcaatatccggccggaagcgcaaaaattaatgaaggtgacaaaggaatgcttggatatggggatcgcccgggcactcccggggggccggctcggcgacataacgtcggcgattcaacaacatgcggaagccaacgggtattcagtcgtacgcgatctgctggcgcatgggatcgggcggagcctgcacgaggagccgagctacgagcatatcggcgtagccggcaaaggcattcggttaaaggaaggcatggtgtttacgattgaaccgatgctcaacgaaggtacgttccgtatcacgatcgacgacgatcagtggacggcgagaacggccgacggcaagttgtcggcgcaatatgagcatacgatcgcagttactacggacggaccactgattttaacggcccagtaagaatagaggagaacggacagcaatgcgtcattttaggaaataagtcgccaacccgccctccttggcctgacgaaagttcgtaatccgaaacgcgaaaaagcgccggttccagcttgggaccagcgcttgttttatatggtttgtaacttaccgatttacgaaaaaccacgttgttatacgtttttttattatgcctttggtatcgtgttacggatttacactctctgctttgctagcctgtcttacgtgtatttttttcattgcaaatcttgctattggctgagcgaccaatagctcaatccaaaatgctacaccaaaatttctaaaaaaaactgtgaaagaagttctgaaaaggttctaggcttatttgtttcgtaccaacccaagttcctataatggttagaagcatagataagactgtaacattcaataatgtattcaataaaactctagcattaaatccatctgtttgtcctacgaatttgggtatcactttacccactaacggtcctgcaaccaatcttactaacaaaacaacgataatccacataaacggaataatctttagcgtttctaaatagttttctttactaaagcctcgttccaatcccataataatgggggcgatcgtgtttactgaaataattgaaataatcaataaaaataatataccttcttttgcgttttgaggcagtctttcttccttatacatattgtttccctccgaaataaaaatatttcagatggtagacgtatcatgcgacatatatttttggtcattaaaactagtaccaatatctctacacactgatctaacaattataacaacttttttaaaacaaataaaagggttttctaagcaagtataaaactgataaaggagtatatgaaccagatgaacaattttctaaatgaatttgaggaaagatttagggcaggatttttggatgatcttaaaagcatactggaagaagtgaagaatgagcaggtttacacttgtgcttttggcacagacagcgattttatcaccttgtttcttgctgttaatacggaggaatcacttgttagacatatcacaaacatgaaagcccaagacctgtgcaacagcaaggaagatgaaaattattatagatggggattaagcgaatatcaatatggcgatacaacacatctcaatcatattagcaaatttctgtatgcaaccgaaaatgtgtttaactataaagatgaaatgataaaaattatggccaaggtagttaaggaaacagacgatgtactttttaatcaatgtggccaatccaaagaagatattatttttttcgtgtccatgacggatgatgatatggccgaggaactggaaaatcagtccgtaattcagatgacaaacgccaaattagttgatggcttcttgcatcgttattaataaaagtacgtttggaatattacactcatttcgtttaggtaggtggctttgctagacaaattcgcaatgtgcttgtcctatgcgctagtaccctcttgatctacacggggtagtactagcgaagctgacactacccccgggtcagaaacaaccactatgatcagccccgcatttctcttcgcaaactacgccgctatcatactcatggtatgggaatccgtttgttttactaacgcgagactccggtgcagcttatgattgacgattccgatcaccacgtccggctccatttcatcctgatgtgagagcataaccattgctgcaatatctcccatctgatatgccgccgtcaacgcccttagaaaagtcttcgagttttcactttccggtaaggataactctcctttgaggagatcctccttgactgcttcaagcgattttcgtgcccggtggagtgcaacttttaccgctccctccgttgtttcgagcatgtcggatgtctcgctaatcgaatatccaaacacatctcgcagcaaaaaaacagttctctgaagcggagataaatgtttcattaaggactgcaacgctatctctatttcaaaagatccatgatccggtacagttactttcgcttgttccctattcaatattcgagtgtagactgcttttctccgtatatcatcaatccaggtgttcttagcaattcgtagcaaaagtgctttggggtttgtatgctcgaagctatttaacttacctaatgcttttatccaagtttcctgagccagttcttccgcatcccaatttgatttcgtaagcgacagacagtaacgtttcaggaccgcctgtaattcctccaagttctcgatgtttattgtattatctgtcatttgtatagaatcatctatgcgcataggtcctctcctccacagtcttattctgccctttcctagagcaaagccatttgtacctcgaatgtaaacgaacaagtggttgtaaaagttacaccgtttacgcaaatcgttttcccattgaaacctccgtatctttttacgacctcggttcgtttacaaggagaaatcaactgaaaacagggaaattgggggtatcagaatgagtgtttatgttccttatgttgtcgagcaaaccgctcaaggtgaaagatcgtacgatatctattccagactcttaaaggatcgtattgtgtttgtcggggcaaccatcgatgatcatttgactaacagtattattgctcaattattgttcctggcggcagaagatccggaaaaagaaatttacatgtatatcaacagcccgggtggctctacttccgcaggatttgccatttatgatacgatgcagtacatcaaacccaatgtacacacgatatgtacgggattcgctgcttcgtttggcgcgatcctgttgctagcgggcgccaaagggaaacgttcggcgttgccgaacagtgaaataatgatccatcagccgcacgggggcgcacaaggtcaggccagcgatattgcaatcagcgcaaaacgaattttatggactcgtgaaaaggcaacccgtatcacagctgaacggaccgggcaatcttttgaaaaagtcgaaaaagatatggaccgggacttttacatgtccgctcaggaggcactggaatatggtgttattgatcaagtgataacttctttgtagagtatgctcaaaacctaatgatctgcaagaaacttcaagaaataatacgaggtgatatcatgttagcaagcttacaaggcgaggaagtaactattcattttatagatgggacccatgtatgcgacggggtactggatcagattgacgacaagttcgttaaataccttacgcaatatcagacgcttgttattcctattacatccattcgcaccgtatccattgacattaaggaacggcaacgccacagagttggattcgccccttgaacctattttagcatggggtggcaatttcattttacggaggcccgatattttgaaaatttcacagggagtagaaatgcttcagctagattttcatgggaatatgattcaccccattcttttgtgggatcaagaaaccgctgttttaatagacacaggattccctgggcaaatggaagatttacgcgaggctatggaaaaggtaggtgtgtcgtttgacaaactaaaagttgtgattttgacgcatcaagatgtggatcatataggttgtcttcctgagattttgcaggagtgtggccatcatatcaaagtctatgcacacgaactagataagccgtatattcagggggatatcccccttttaaaagatagtcaccttgagaatcccccgaagggcaaagtggacgataccttaatagatggtcaggaactgccgttttgcggcagaattcgagtcatccatacgcctgggcatacccctggtcatatcagcctttatttaatgcaaagtaagactcttattgccggggattcgatgtacagtgttaacgggattctcgggggaattcatgtcccgaccacaccggatatggatgcagctcatctctcattgaaaaagtatttagatctcgacattgcatccgtagtttgttatcacgggggattaagtaatgtacatgtgaatgatcagatattaggacttacccaaggattattaagttaaagttccagcaagctgccttttggtgaaacgatgttgtgaacgagaagattatttaaaataacactttgttaattcgcgattgaactttaacaaagtgttattttgcatttcacaaaatagatcttcattgtttattcctgcaacccatatgtatatagatcagactttaactgattaaaaatgtatgcttgcatttgatctaaaagaagaatgatgttagtatctttaccatttttcaaaacccactgaatagacgtcattgagttagcagcatatagttcagctaaatactccaatgcgatcgaagttgaagaattctgttgctttaaataatctaaacaagtccgaaacaaaatttgttcaaattctttacgtaaatcagcggatacttcatgaacggttaacaatgttgaaatttcgagcttatttttaatcatattatcggttacaagttctatggcgtttgccaccttgccatcttccgtggaattaaaacgctgcccaatttcaactttaaaatcagaagcatactgtttaactactttttctagtaagtcgtacttatccaaataatgactataaaaggtagaacgtccgataagagattgatcacagatttttttgatcgtaatatctttaaaattatgttgttggagtaattcaatgaaagctcgctcaatagctatttttgttttataaattctgatatcttcattcatttaaccacttgctccttatgtgtaagttttcgaacactttatatataccgtgtaagatatcttacagattatgcgatactaattattttttatgtagtaactatactctatagtaagcacatacccaaattgaaggaggacagtatatgtttaaatcctatgtcaataacgaacagttcaatcttcaaattaatcgttttatcaatgattattatcaagaagatgatcgagcacaagctgacttggaaaaaatgattccgaaattaaacgacacccatagctggtatgaagcttggctcaattttgcaaagaaacgcgaagacagcaaggactatgatttagcctcagtctactatcaagctgcagaattttatcttgcaaccacagaccccaataaagaaaaaatttatcaaaaatatagagaaacattctataaaggctttcatgattttgattataaatcctacaagattccttatgaagattcctatcttcctgctgtaaaattgttggtgcctggagctacgaagacattacttgtctttggtgggtatgattcttacatggaagagatgcttaaaatgatgagatttatgaagggaattgattacaatattattgtattcgatggccctggccaaggaactgctttaaaaaacggcctaaaattcattcattactgggaaaagcccatatcaacggtgattgattatttcaaattagatcgtgttagtcgtaggtgcttcttggggaggatatttagctatgcgtgcagcagccttcgaaaagagaatcgataaagtagttgcttttaacattttctattgtggcttagatgccttaaaaatggggatgccagaagaaacgtatcagagtatgatacagctagtcgatcataatgaagtagatcaagtgaatacattattcgaacagatgatgactcacaatattgatttgcattggaagattaccaaagggatggaaaacaccggtgaagtaacgccttttgatctcattaaaaatttcgaaaagcacacaatgcaaggcattggagcattcattaatcaagatgttcttttactagctggagaagatgatcaatacgtacctattagccgactcgctcaaatccaacaagaattaatcaatgttgcgttcattacaagaaacaggtggtgagcaacattgccaagcaggtcacagggagttagcatttaatgaaatgaagaatttcctataacaaagatggatgaatactaaaagtatttcacataaaaaattcagagcatggttaatgcggatatttcataaatatttaaaagaattatgcataacgaatggtttccccaaaaggggaaaccgccttttttacgtaaaattgctcaaaacatgcctagtgttaatttcttaatcttccaaactgtaaatacttgcccccacttgaacaagatcaggagatgctaacttaccaacgcatattccaatatttttcctttcagccattgaagttgaaatttgaacagagctaacgcttaataccatttcattttgatttgcatatctaataagaattttattacctatcatttttttatttctgggtaggttaaatgatctaatcctttgtttgttcctactataattgtaccttcatcttttgactcaaaagttaaactaacatccattatttttcccattttaaacgttgccccctttatcgttcctcaatataaagttctcccttaatatcacgtatatgcaaatcagcattttttaaacgggttatggtatctcttagtagtgtaattccttcaagtgatgttaaattaggtttaaagacacgctctcgtccagtaaaaagatattgcctcatcagatccgctaaattagcggctttttttgtttaaaagtgctggcgcgtcagtcctttttttataaaacatcaacatagtttccatatatagcaaaaccgagaatggatggtataatgaaggatgatttaaagaaatctgtagtgtagtgaaggggtgattcatattgataaatcacgataatcttgaagagtatcgagacccgattaattatgatcttgaatttggcggtgagactaataaatacaatttctatcttgatatggctagattgaacccaggcgaggttttggaacttgcctgtggtacaggattgacaaccattcatttatcaaaatcggggatacatataacaggtgttgatatttcttcatcgatgcttgaatatgcgcgggttaaagctcaaggtttgcctgtggattttattgaagctgatgctcgtacattcgattccgaaaagcgtttttccatgatttatttgacaggaaatgcattccaggcatttttgagcgatgaggatcaacgagccttactcgaaaccgtctacaggcacctagaatcaaatgggatatttgtttttgaaacacgaaaccccttgggaaccgatttatccaaccaagaggaaagcatctggggaaattttatcgataaagatggaattaaagtcaagatatctgggacacagtcgtatgattcaagtaaccagatcatgcactgggtcacgttccgtgattggggattggagaaaacaatttctcgaattgcatgtcgctttactgataatgacacgcttcagcgtttattatcgagccgcggcttttgtattgaaaatcaatattcggactgggataaaacaccgttcactcctttatcttcttccatcattagtgtttgtcgaaaaaaacatggagcctaaaacgaataatcccggaatgttcatcccaagtgtttgacgaccgcgcgtaagatatccatgtcattcgcatgtttttgaaggaacaactggctatttcagtgattcccggaaagaaaaatcgccgagtcaccctaaaatatgatcaggacgtttacaaaaaaacggtatttggtggaatgcttctttaataaagtaaagaatttatcgtcgtctggcgactcactatgataaattggcgtgtactttcaagtctttttttgccttggccaccattatggtttggcttgcctagagtttgaagacacgccctaattcataaaaaattctattgttttctgccaagaatctgattgaccaaaagaatttccttttaaagtaccaccacaagtaaaaacgcctccacccatttttaagttcaatgtttcgcttaaaggtataataaacggtattggtaatgagtgacctaaatccttatagtctaaaagattgtatttgtatttataattgttttttttcaaaatactcattatttctacacatgcctcgtgagtattccaaatattatcttgatgacctgagattagcaataaattcgcatttgcattctctatttttattcgagcctcctctttatttcttgccctttccacactttttttatatgtagtagtaaaaccaaaaggtatattcttttctaagcaatgacgctgatggtcgtaaaaaatatcattatcaacgggtataaatggtaatgatctcccttcatatgaccatgatgaaacatttttaccactcatcaaaccatccaacgcttgaaaacaatatgcatggggtgcagaagccacaactttagaaatgaaattatatcgcgctgccaaaagtaacgccaattctccgcctttagatgtaccatgtacatatatttcattagcacgtgttaatggattttttttaagccaagagaacaccttttcaaaatattcaaggggaatttcctctagttttttaggcaatcccttttcattgaaatatccaacggttaaaacattaaaacctctagatgccaatggtcctgacaaaagcgaaagaccacttcgttcaccatcagatccacccaatactacaatcgttttattatttgagttttcagaataaaataactctcccataaattcatcagtgatctgttgtcttttcacttccggtaacttgaacatacgctctagtcttatacattctcgatcttgtccattttcacatactatatcaataaatacactatcatctattgaaatattaagagcgatattccctccctcactattaatcttttgtaaagaagtaataagccccatactatctatataatcataagttccagaatcaggtttgtgttttgataaatcaacactgccatttgaatccgcagtaaaccaagcaaatgattgatacttttcacttactgcccatggaaaatgcatggttgcagttattttcgttttgccctctggtggtaaccctgtgacacaaaaatcgattttttcatcaataagtgcaactcttggttgtacttgtaatttcatctcgtagcctccaaaaaaaatatagaacttgaatggaaatattgcctattttcaattccatcatttaaaatgttttctccgcaaaataaaactatctaaagctcgaatttgtgctccttgaaacccttccaggtcttcaaatttataatttacgtcttcctcaaaaccaacgtactcttcgttgtgagtaccatatattcttttcaataaactccataacacttctaattcttcagttgtgaattcattaaaaatatctgccattaggcatattgctttctcaccacattccagcatgactcttttccctaattccgtgatttccacgttaatggcacgtttgtcccgtttgcttggtgtcgtaatcaagtatcctttattctctaaattgactacaagcttttgtgcactttgtttgcttgtttctaactttcttgcaatattaacaagtgtcgtttcatcctctggcaaatgagctattgccagcatgatcatgtactgtcgtgatgttaatttctcaaaatagttgtcgccttgtatttgcaacttattagtgacggaaaaaaaagtagcgtaagtttgttgcattatatataactctctaagcgctttagaatattccataaatatatccttttatttttattgtcagcatactgactataattacaataacagcattttgtattatcgtcaacatggtgacaataatcatttggaaatttaatacatcaaataaacaattgttattttgtatctggaatccctagtcgttatgaacgatcagcctggtcacatcttttgccctgcaaaagctttggcaagtccttatcgcagaaagataccaccagcgttcgcccactcaatattgcgtaatatccgttacccatttttggttaggcttttactctacacactcagcagctaagtagtttctcctagagcgacgttttcggcgaattttggacttgactaaactttcaaaatgaattgaatacaaacgctctacagcttgaataagtattctattcatttggttcacctccattagatatgaaaaaaacttatttctcctcatggttcgaggtgaaataagttttgaattaagtgcattcattcaaacgaacaggaggcattaccattcgatttcttcaaataaacggaaaaccatctttttttcaaattcatctaatatcttaaacccagttatctcatcttctttttctccaagttttatcatagtagctattgctaagtctcctactttataatgacctatcatcttatcttgaggttccctttttgaagacaattcactcaacttttttataattccctctgtacggaggccttcttttccgatatgggtcaatgcatgatataaaactatggggttcttttcatccagcaaattttctaactcctgtattgaacattttccttcttctattttttttactatattcattttattcttcctttaaacagatattaattaatgttccaaactgtaaatacttgcccccacttgaacaagatcaggagatgctaacttaccaatgcgtattccaatattcttcttttcagccattgaagttgaaatttgaacagagctaacgcttaataccatttcattttgatttgcatatttaataagaattttattacctatcatttttttatttctgggtaggttaaatgatctaatcctttgtttgttcctactataattgtaccttcatcttttgactcaaaagttaaactaacatccattattttccccattttaacgttgcccctttatcgttcttcaatataaagttctccaagaaaaattcatcaatctcttcaaaagaattttgagtactaaagtataattctttaatttggaaattagatagagaaagttcggttagtagcactaacattttatttataatcgaatcattatagtttataactttatttggtataatcacgaaaatacctcgcaattttgtatgaaaaaagagactataatttcacatgcttctagagaactattctctgtctttttacttaaccattcagccatatgattataaatctcttcttgtgtatgtttatttttcttcaattttaggtaaaatgtatttacttgagaagcaattgtatcaaaggaatattgacattctttgtccagcattataaattgttccttcacaaagaaatagtagtccgctacatcacttttaattcgtctctttgtaagtctattcagagttatattcgccttttcatcaactttcaatgcatctaaatttagaatctgaggagataattcattttcgttttccacaagtttatttagtattatttaatttctgcctcaatttgataactatgatagtctgctctcctctcatttcttctaataatctccttttttatgatgagtaattttttatattcttctatagtttgtggggaatcaaattttttatgacaatcacgacataaggaaatcaaattattcaaatcgtttacattttgagataatttctctacgttttttaacaataaagattcttcttttgttggatttaatgggtaaataggagcagcttcaaatatcttcctcctaattccatctttcacatatagtaagcttttagaacagaaagggcacataccttctacctcaaaaaaaggatcatattatcattttcattcatactttttctattagcttgcatgagttcacctcaaactaatcaaatgtaataagatacaattaaagaatttgcttccttatttcgactttatgtacttatagtatcatacaaatgaactattggtcgatgttacctgatctttttgcctaatacttaagagccattttcgaaaaaaaatattacattagtcttcgtaattggctaactaagctaaaagctcactccagtaaattaaggagaaagctctggttataatcattgtattatagtttagttatgatccaattgtcattttatcaggaaatactccccttctttaatgaagcatcgagccatttgttgtgctgctctgtcaaaataaaaatgtgtttgaatgatttgaatcttgtataggctcaatctcagaaaataacttagtatctttattcaattggattttctctcatgaattcttttttggaccttatctatacacaaccacagtctcatcatactgttctttataaagtaaaataaatgcttccattctcaaaatcctctttacgtactccccttaatattattgattgttaacataatctgaattagatgtaattcccttaactagaattcatttacaatatcttcgatttcactagcaaactttctcatctataaagaaagccttctgtctacacgtatttcccaagcctcgtactgcacctcttgtaataaaaaaagtaactcctaatgtgagagctactttaaaaaactaaaatggcatcgccatttgtttctacgattcttgtaaagatagtttatatatttcacttacgattcaatagtagttttttctacgaagtttccattctctttaataatcatccttgccaaccttcgtcccgctctcttaaagaaaaattcgtcagcataattctctgaaactatcggtgaaatttgatttataacctcattttttttgtcatattctattttccccattacatcttcactcggtccataactatatacaactctttcctcatcttcgtaatcttttaacatgattatatatacggccattattctcactcctcataaatcttttcccaattccatggtcttccagattctatagttttatcatgtgctgttctgtaattcgtatggaatatgccttcaaatctcgattcaaaaagctcatgatgtagtaattgtacatcagaatccacatacttcccatccattaatctctcccacgcttgtgataactcaaagtctgggtcaaatctcccgattccatgatctttaatgtgggtatcgttaaaaacatggtctttgattctttgaattctattttctgaaaaaccagtatttttagaaatggcttccacgtctagatttcctaaattcctaaatttttcatacaactcttctgcaatagcttcttctctaaaaaattgctctggagaaatattacgagcaccagtttcagcataattaaaatcgtctgattttatattagaagagcgctgttcgctttcttttaaaatattggctttactctgagtcgattcaaactttacagacccttccaaaatatttttgggcttaatcagcgctttggttgtcgtagaacctatcatcaaaccagctgtaccaatcaaatttgccatatgttcttttgaccatgcatttgtgggattaaatgctccctgaatcatgcccgatactccaaatgtaccgaaattgagcatgtcattccatgaatcgttttgtttagctgcccgttccatgtacccttgatacattccctttggaatgccgtacgacatataatctaggaagctccagactgaatcaaattttttctcatatcgttctgaattagctgctacaaaatcctgcccaagctccgttaagctatccgccgatttctggagcgcatttcgtgtatctgcaacaggaactgtgcaagtattcggtggaggtggcaagcaacctgggtctagattcccattctccatcatatctgttaatctaaacttatttgcatgctgccgtagttctctagcaatcgaatctgttagtgtaacaaagtcagccatattcttctgagatgtttggaatctataatagaattgctcctttgttatcccctcccaaaatcgttccataaacgaaatttgctgcgataactgactattcatttgcatcgccgtttgctgtgcaagctcaaatttcttagagacagttataagttgttcaggtgtcactttaattgttgtcataatttacctcggttgagttcattaagacataataacattattcaaatttatggaaaaccatctttattactaattgttatatgaattagaagacttaatccctacgacctctgacttatatttataaatacagctcccccttcattataaataagtacctttttaatgcctcgtcatcagcaaatattcgtaaaaatatatctttttttagtcaattcacaatcaatgtaatctccctaaggagcagcacgctatgactaagggttatcgaaaattattgttggaatatggttacccggaggacttagtcgacggatggactttggaagactgcaagctgaatggcaggagtttttacaattaacgttcaatattctgccagtcgacgaaaaatcaaccagccttgcggtggaggaatatttggaaatagttcggcagaatcgtcagattggctttgtacgtcgggaagctgcaattactcaggcatattcatatagagagcatcaatcgacaaatgaaatatccaagcagacggagaacatcgccacatacaacgtggacagggaggcaaagcttcaaggctaaagttcggctgctggagcttgcaatgagcaaattgtcccgtatacaacgagaggttatccagcgcagttatttggatgatcagggagattgattacattagttgcggggaaatggggattagcgagagcacgtttaggaggatcaagatcgaggtattgagtattttagctactgcattgagactggaaatgagtaaagaacaaacaaactatggaagtgaagttgtttgctaagccaggagaagcagcggttatatcaacacgtacgacgaataactaaaaagggtggaattgataaactatatcaattccaccctttttctgtgtgacgagttcagtctcttttcttggtaccgctttttactgtgaaaaacaacaatgataagaagaatagagcctgtgaagttttaaccatcaaccggattccttcacctgaatcttttatatcaaacagaatatcagctatggataccaaacctgtagtaataagtataatcaatgcgagtatgtacacgttagtcccccttttgttcggttttacagcaggaagaagacaatagctctggatgcgggttcggccaaccatgcaggtaatccaacatattttaaagcgtaagcaagaccgtcctctgctgtgcctgtgaaatctaccatgatatccaaagcttgcattattacttgataaccaagataatatttcaaagtttcttttgcaccgtcggtcaaaagtggtatcttatctacataaatttttatctgttcattccaagcacatgatccaatattttttagtttagaaattaattctaacgctacttcttttgcgaactttgatctccagccttgtgtacttacttccccagatggacgttgagtatcgaccattccaagattagtgcctacagttttgaaaaggtcatcataatcaacttgtcttaattcttgttctactctttcatcaacaattccattttccaagtctatcttagtctctgaagttatagaagattctacgttgtttgcagcttgagcattagcgaaagcaggaagtgtaaacgatgataacataagagctgataatgacgtgatacccaattgcttaaacttttgcataaaatcaatgctatcttcatatatttggtatttctatcaatatactaacatgaattatatatacttgtaaaatagagggatatagtagatgatttttcctgtaataatatctattcataggatttggataataaatggttattataacctgtgaaaagagactgtttattgaataatttttgaccgaatgatggccttcgttagattttcagcgtgatatatttgtatcatggaaaatcaaataaggaacacaccacagctttcgagcctcggtgaaccaggtcggccaatgtgccggccttttgatttttcaacaaaccatattagggaacataaatcatgtctacagaagcaagcgcagtaagaaacggtggtaaatatattgagtctcaaaatcatatacttcaaacaataaatggatgcgcatacgtctgttcccttcttgctctaaacctaaatgaaatcctccgactaagtagcgaaataatcgctaataattaatagcgattatttcgctgagatattcttggtatggaggtgagtaagatgtaccaaagaatccgagatttgcgtgaagatagagatttgactcaaacccaaatggctgaatatttgaattgcagtcagcgaatatatagcaattacgaacgcggtgacgttgacattcccacgaggattctaattaaactagctgatttccataacacaagtacagactacttgttaaacagaacgaaacaaaaaacaccttatccggcaggctagctacttttagaaaataaaaaaggtaactcttcatgaagaaggagctacctttcaaatttttttataatcgccctcttcaatcttctgaactacctattttaacccttctttcccgtcaaatacttcaatcattattagtgcccccattttataaccctcaatataagccgaagcggacaataaggaaattaaaacatcttgtaaatccgaaagttcttcaattaatttgtaatcctgctctggcaattttattttgagggctccctcaacatcggctattctctgagagaccagttcaaactcagtgtctttcgatttgattcgttcacttgggttacattttccgtaataaaagttctccaagatactcatgatctactccttcttgatatgtattattaaccctctgactaattttagcgaattattcgctaaaaatcaatagcgattatttcgctaagatattcttagttcgaggtgaatatgatgtatcaacggattcgagatttacgtgaagataaagatttgactcaaactcaaatggcggattatctgaattgtagccagcggatatacagcaattatgaacgtggggaaatagacattccaacggagattttaattagactagctaatttccaccatacaagcacagactatttactaaatagaacgaaacaaataaagccctacccggcgggataacatttctaagaaataaatattaggcttaatctaattgtgcattatttcaataaatgtttttcaaccaacgtaaaattctctcttattgtagatttcccatcctccgtaatcagttttacaccaagagtatgggtcattttattggctttacgaagaacttcccttaggcgacaagccgttcgcagacacagagcatcatttgctcctagttctggaggatggtaaagtcgaacttacaggctgccagtctggtgcggaatgcacttaatttttatagtaaaatcgaattcaaacacaaggagcattgccctgtcgacaacatcggcttggacaatgctctttattttatagcaactgcccaggggacagcatcttctactcattaacgttagaagtcataacaagctaatttttttcaaaaagcctcactaattaccagattactgtggagggaacgaatattttttgccaccccaagccacgagaagcgcaaggaataagagtatgaataatgcccatgaaaatgatcccgaaccaaaagtttcaagtaaaatccccccagccatcccgccgccggcgatagccagattccatacggtcgtgttaatcggcataaccatatccactttgctctcccctgcagcctgagcaagcgccgtttgcaacagcgttgctgcgccgccaaaggttaaaccccataccgtaacaatgatatagattataaggacattggagttgctaaagctcatggcaatagaaattaagacgaaggaaataagactaataaggacaagcttacgcagccaacggtcgatgaatacgccagttatccatatacctacgagagcagcaatgccaaagaaagccagcgccagccccactctctcccccatcccattggccgcaagaaatggagcaatataagtgtaaagaatattatgtgctgtcatccaggtcagtacaaccaatagtatgggccgaatccccggtgtaaggaagactgcatagatcgaagcttgcttatcggaggactgtcccggatagtccggcaccttccaaagcacccacgcgatcagtataacagtcagtagcgacatgattccaaaaacagaacgccaacccataaggttccccagaaacgttcccgccgggacaccaatagccaaggcgatgggcgttccaaccatggcaaccgccatacccctccccttcaatgtagcagagaccatgcggagagcgtaaccaccgatcatcccccatagaactccagccgaaactcctgccagcagacgggcagccagcgtcagtatgtagctggaggaaattgcggtgacactgttaaaaaccaggaacccgcagatagccagaagtaacagcggacgcctccgccattggcgggtaactatagctacagggatggcagccactaaagaaccgatggcatagacagtgaccagttgaccagccattgcctctgaaatataaagtcccttgcttatttgcggaagcaaaccagccggaatcgtttccgtcataatacagatgaatcctgtcatagccaaagcgagcaggccaagccagggaaaggacctagaggaagcggaagacgcgatttttgcagtattagaagaattattgctggacattagcgcagctccttaaaatcgatttcaaaacaagttcaagcgaaaaatcaagcacatatgccagtgatttgccctccttttaattttattgtggatcaatcattccatattttaaagatgcctctcggtcttgtcaattacttttggatcgattagtatataagtacaagataaaaggaggcgactccatggttagaaccggaagaccacgtaaattcagtcgcgacgaagcgatctcccaagctatgatgttgttttgggagcatggatttgaatcaacctctttggctcagctcaaaaaggcgatgggcggcatctcctcagccagcttttatgcagcttttgaatcaaaagacgcattattcaaagaagcgctggaccagtatttggctacatacggacaagtatcgacaagccttacaaactattcactttcatcgcgcacagctattgaattagccttaagaagttcagcaatcatgcagactgagcagacccatcccttgggttgtttagtcatattctctgcaaatacttgttcgccggaaaacactcatattcgagaactattgaccaggcaaagagcagtgactaggaacaagttccatgctcgtattgagcgagctaccaagaacggagaacttcaagaatccataaatgttagcatgttaaccacactattcgttaccttcctggaaggtatatctacagaagccagagatggtgtgcccctagacaacattgatgcagccataaccaaattgatggagctttgggatacttgtgcctgagactggctcagttttcatgaaataagggcatataaatagaaaaggcaatcctcctaaaaaaggagattgcctttttattcaggaagattgcttctctcaaaaacggctttattcagcctatcctacacattagtttgacttaattgggtatcgaagtgtgatttgaaatagaatcgattattaaatcccaatcgtcatagtgaagctcatgcccagcaccttccaatgtcagtaaaactgcacctggaatttcgttagcaagatttattccgtgttcataagggataatcggatcttcagtaccgtgaatcaccagagcagggacggttatttcccctgtcctagccagataggattctccacctgacagcattgcgtgattgttcatgctggctatattgttgcttcttttccattcttcttttgctaatttataaacttttttctcatcgaaagcgtgttttgaacctactagaattcttgatctacctatcacaaaatcgaccaccgattgttcgttcgtccaatctattgctcccatattcgagaaatagtccataaccttttcctccatcggtggaagatcgggagcaaaattggacgttgatacgagggtaacggttagaactctgcctggatgtcgcagagctatcatttgagtcagcatgccgcccatggacatgcccacaatatgcgcttgctcaatcttatacccatccaatactcgaatagcatcatctgccatgtcttcgaaagtatagtccggttgcccaggttcataggttgtagaacgtccaacatctcggttatcatagcgaacgacaaagcgacctgtctctgctaaacgctggcagaattcttcctcccaccagaccagtgatgattgagcccccataatcagtaatattgccgggttaacttgctttccgaaactgtcagtacaaattactattccatcgctttttatgagttgttcgttcatgtagaattcctcccctcaatgatatataaaacaaaaaaacacagaatattagtctatgtttacagtaatcgaaaaataatttagaaatgaacccaatataaacggattctatgccctctcctcaattaaaataacagatgtaatactcatgagaaaaactcccttaacgtattctcatgaaataatacatcttaagataatggcatatagtatattattgcaggtattgtcccctcgtagtcacccttctactagtcttgactagacctagcaattacttagcccgaatcctccaccgttgaagatgtcatggaccttacgacaacaaacacaattatggatgattgtggtattattttggattattgttaatactacgtatctgaggagggtgaaaatgaagttacagaccaaattttcaagacaattatgccggaatatcgatctcatttgtgacttcatgggaaacagttcggattttattgttcgtgaaatcacagctggccataaacacgccgcacttttttatttggacggaatgactgacatgcaaaaggtacaggacaatgtgatccgtccgttgcatgatcgtgtctcctctgacgagatcactttaccgttattgaaaaacgcaattttggacattggtgaagcaagctttgctcaaaactttgatgatgctttggaacagatcctctcaggtggtcttctcctactccaggacgatatggatgaaggattgatcatttctttgcctggatgggaagaacgcagcattacagattcgaagacacagcctgtggtcagaggtccgcaagagtcgtttacagaaactttacgtacgaatacgactatggttcgtcgaagggtgaaggatacaagagtacgtctaactaccataaaagttggcgaaaaaaccaagaccgatatatcggtcatgtatttgcatggggtcgctgacccaaaaaaggtgcaggacatgatatccaagttaaagaacatgcatgtagaaggtgtgcttgaaagcgaatatttggaagaatgtctccaagaaaataaacaactcacgatatttccgatcttttataattctgatcgcccagactctattgcagcaggaattatggaggggaaaattgcgatatttgtggatggatctcccttcgccatccttgcacctgcggtgtttgtagactttcttcaatccgcagaagattattatcaatcctttatttacagtagtatcattcgaatattaaggtacatatgcctggcaatctgtatgttggctccggccatttatgtcgcattaacgacatttcatcaggatatgattccaacagttttgttattaagcttatccgcgcaacgtgaaggagttccgtttccagcatttattgaggcgatgatcatggaagtggtttttgaaattctgagggaggcaggtcttcgtatgccacggacggtcggtcaagccgtttctattgtcgggtcaatagtgatcggccaggctgctgtagaagcaaacatcgtttcggctgttatggtcattgttgttgcaataactgccatttcgagctttgtcattccctcgtacacctttgccattccaatccggatattacgtttcgctttcataggcatagccgctatgtttggtgtgtacggattgactgttggtattctcatgctctttgtgcatctcaatgggcttcattcattcggtgtaccgtatttaagtccctttgccaattacaaatcgtctgagcagagggacgccatattgcgttttccatatagaattaacaaaaaacatcgcaaaaactaaaggagtagaccatcatgaactcgtatcgatccaccattttattactgattatgtccatctggctaatggtgtttcttacgggttgctggaacagtaaggaattgagcgcaatttccgtcgtgatggctctgggcattgatgcagttgatgaccaatatgaagtcagtttacaagtggttgacccatcgaaaatgtctcagaattcccccatggaacggacgccaacgatcgttttttccaaacgcgccgataccatatttgaagctattcgaaaattaacaacggaatcgtcccgaaaaatgtatatgtctcacttaaagtttgtcatttttgatgaaaaaacggcaaaaaaaggaatcaaggagccgctggactttttgttccgtgatcatgaagttcggcctgatttctatttggccgttgtcagaggaagctcggcaaaggaggccgttacttttgtaactccaaccgaggtcttgcctgcaatggatatgtataaggcattaaggctttctgaaaaagcatgggctccaacttccgcggtcaatgtgaaagatattttacagagtttcacagatgatggcattgaaccggttctcaccggtattcgactgacaaacctagaaaaaggtctaactattgataatgtgacaaagtcgccccaacatgttaaatacttttttactggaattggtgttttcaagggcgaccgacttatcaattggatggatgattcacaaagtaaagcctttacctatatatccaatcgtgtttccagcaccgtagcttccatcgattgtccgaattccaaaggaaaatttgttgttgaagtaatccgttccaaagtaaagatgcgtccaaaaataatagatcatgagccgcacatttctcttattgtggatacagaatccaatatcggaacggtctcgtgcaatgccaaccttaagaatgaagagacatttagagatcttcaagaatcagctaaagagcatctggaacaatctttgaaggagggcatttcgtacgcacaacaaatcggttccgatatattcgggtttggagaagcttttcaccgcaagttcccacgtgaatggcataaatggaaagaggattggccacaaaaatttcaaacgcttaaagtggatattcagctcaattatcgtttagtccggttcggagacattaccagtccaatcgatatgggaatacacaatcaggagtgaatgcaatgctttatgtgattctcgtaacttccattttaacatctttgtatgagtttaaaaaatttaaggagaaacaatatgtgcgtgaaattgtattcagctcgatattgttgattataggcgttatattgattatcctacggatcgccaacattaaactgccgactccactgaagggcattcaaatcctatttcaaccaataagtcggttacttacagaaatgttatcttaaggggggggattggaatgaactccaatttgacggttcgacaagctattttgtggtttgcattgtatcaaataggaagcgcatatctggtgctcccagcggtaattaccgctgtcgcaaaacaagatgcctggctctccatcccagtctccttaggtttccatctgttattgatacctttatatgcctccatcgctaggcaaatgcaggggaaatctttcgtagagcatctccgttgcctcttcggtcccttgggcgggacgatcagcatcgttttcatttttttctttccctttcttgtgttcattatgacacttcgaaatctgggcgactttatcacgatagctattatgccggaaactccctccgacgcgatatatttcatcatgcttatagtcatttattttgccgttcgatcaggccctgctgtaattggtcgttgtgcggaaatcctattttttttccttctggttctgtatctgttggtcaggtttacccttctttctgataccaccatagataatgtgctccctatttttgagtatggtttgaaccctatcgttctcgcttcgttcaatttgtttgcctttccctaccttgaggcaattctgtatcttttttttgcacagcacatccccgatccaaaaaagtggagaaagacagtgataacttgtgctttgattagcggcggcatgtattttttcatggttctacaaataatcgccgtgatgagtgaaggtgttgtatctaatttgacatttcctactttttttattaaccgaacaatcagtaacggagagtttcttcaacggtttgaaattttcgttgcagtgttctggtttgtcaccatttttttccgactcgcactgcttttatatgtttcagcgcaagggcttgcagatgcttttcgtcttcgaagcgctaactctctcttagttcctctgatcctaatcgcattggcaatggttcattctatttggccaaatatgcaatttttaatcaagtttttttcagtatggcctttttatgccatgattttcggtatcgtgtttcctattgtgctatggctggtgggtaaggtatcgttgaaattacgtaaaaagtatcactaaagttgcgttggctgtatgaacatactgttctcaaataaacttttgttgtactcattattgcaatttagcaagaagtagctccaattccgccttctcaagatgtctccattgtccacgctccagatgatccaaggtaatattcataattcgaacacgttccaattttagcaccctgtaccccaaggccttgcacattctgcgaatttgcaagttcagaccctgcgtcaaaataatgcggaactcgtattcgctcgtacgatcaaccttgcacggtttggtaatgacgttcaatatttcaacgccacaagacatggcctgcgtaaactcgtttgtaacaggttggtctacagtcactacatactccttctcatgaccatgttcggaacgcatcatttgattgacaatgcttccgtcgttcgttaatagaatgagtccctctgacgctttatccagcctgccgatggcaaaaatccgcgaaggataattgacataactaataatattgccagccacttgctccgctgcggtacaaacaatgcctatgggcttattcagagccaaatatacaggttcactggaattaagcggaatagcttccccatcaatcagcacgatatcctgtggctctacttctgcgcccgcttcacaaacatttccattaatcgtaattcgtcctgctgcaatcagcctgttggtttcccgacgtgagcaaaatcctgtctcactgatgtacttgttaattctcacgattcacctgcttctgattataatatgcgagtttaagtaaaataattaaaaaaacacctgattgttcttgcttaatcagatgttcgacgtttacgacaacttatactttccctgcttatttgctactgttgccgccgcttttattccttgttggtttggcagtgccgccttttgtgccacctgcggctttgcttcccggtgcgcttgtagaagcgctttttgtccttactggcttcgcagttttgttccagcgtgtccagcccttactacctgtacctctgccggtcccgccgcccttgctttttccacccatatgatcactccattactagtcgttcagatttaactaagctatcataccattactttgatcataatgcccatttcttttaaaaattgaacatgttaagccgcaaatactttcgcaaaacggatcttgttgtatttttgtttgtttgcaagtaaataatgattcttgaaggagtgaaacacatgtctgttgatgtttatcttaactttaatggaaattgtcgtgaagcagcggagttttacgcagaggcatttgggactgagaaaccacaaatcatgacgttcggtgaagcaccacccaatcccgattatcctctccctgaagaagccaaaaatttggtcatacatacgcgccttcaaattgatggtagtaatgtcatgttctcagacgtttttcctggtatgcctttcgtagccggaaacaacatcagcctcgccatcgtcaataaggacgaagagaaaattcgatcgtactttcataagttaaaagaaggaggaaccgtaagcatggaacttcaagaaacattttggagtaaatgttacggtagccttaataataagttcggaattgaatggcagttaagctatgataacggaatgaccgacagttagtctgttatattaacctacgacagttaagccctcacaagctattctgactgaatgctttgtgagggcttaatattagcttgaagttactctatacagcagccttagaattcttccaagaccttgaatttgtctccatgaatcttatccaagtgatcctctccccagtagcataaatggtctagcgcgggttttaatccccagccgtagtccgttaactcatactccactttaggggggacttcattataaacctttcgtgtaacgatctcatccttttctaggcctctgagctgagtagtcagcattttttgtgtaatgccgggtattaaccgacgaaactcagatgttcgtttccgtcctgtcatcagatggtagataatcaaaggcttccatttccctcccatcacctctaaagccgcttccactccaacttgatacttcttttgaaccctattttttatctgttcagtcatttcttaatcctcctttagaaggcttcgtttgctcagaacaaccatcacttcaatttattactcagatcagttactagggaatctacctagggcacttccatgttcctatggcacctgtatcatcctatagaacttaaaagtgcgtacttccagattattctcctactgtatataatagcatcaagcattgagcattcctagaagtaaactattgagaaaggtagtgaagaagcatgaaagtattaaccgttgtttcacacccgagaaaagattccttgacctttaaggttgctgatcgtttcgtacagggtcttgccgatgcaggccacgattatgagatattggatttgcatgagattggttttgatcctattttaaaaggagtagatgaaccggatttgacagttgcggaacagtccttttcccctgaagtagaaatggaaatgaggcggatgaaggagcatgatgcattggcatttatttttcctctttggtggtggaatttgccagctatgctgaaaggttatattgaccgtgtatggaacaatgggtttgcgtacggttcgaattacctgcatcatcagcatgtcttgtggattggcttggccggagtttcgaaggaacagatgaaaaagcgtaattatgatgaaatgattactcatttgctgaatgtgggaattgcagattattgcggggtttccaattccaaggttgaattcttatatgagaccctgagttcaaattccggtcattttgaaatgctgctggaccaagcttatcacttgggttttaattatgccaaggattaggctttatttacaatcctcacccttcaacacgaaggccggaaatcctaacagaatgtgagaaagaattgtttttccacaaggagacctaagtagtaacaaaaaaaagatactaacctagccattttttctatggacatgggttagcgtcttttcatttatctacatttaactggctttcgacagtaagtaaaggaaataaggggtgactagtatggtgataataattccggttggaatagctgccccaaaactaatcgtccgagtaagtgtgtcagcaatcaaaatgacgagtgcaccaactaatgccgtcgtaggtagcaatagcttatgattgggccctactagcttgcgcgctagatgggggctgaccatgcctacaaaaaagaaatttccgccaagtgccacgctaccagaagcaagcgcaacggcagcaatcgtcaagccgataaactcccttttaattgctacgccgaggcccgatgctgtctgattccccaaattcaacgtattgagtgtgttagacctgtaaaaaacgtaaaaacagatgataagcacccacgggagcagcaccataatatagctccagtcgtccccccacaggtctccagcctgccatctcaaagcaaagtcatactgttgcttgtttagccggagtgtcaacatcagagataatgcgctgtagccactgcccatagcgacaccagttaaaattaagcctgtaggcgagatgtctcttccccgcctgaaagcaaacataaaaatcaaaaatgctgccgtaaggccgcctgcaaaagccagcccaggaagaagaataggcgatagcaatccttcactagcgaacaacgtaatatacataagtacaaataaccctgagcctgagctgatgccgagtgttcccggactggccatgtcgtttttgagcaagctttgcataatacagcctgatatccccatgccaatacctaccaatatagaaagcacaatacgtggcagtcgaaagtcaaacacgattaggttctgtttgctcgttccttcgccaatgatgaccttgaaaacttcgagtggagaaaggttcattttcccaacattcatactgagtacagccactagcagcgtcaacactactaacagtaaaataatgctaatccccttggtattacgggacagtttcaactaaactccctcctctgcttgcgcacaaggtagagaaaatagggtacgcccaccaaggcaaaaataatgccaaggggtgtttcgtgaggacgattgatcagacgtccgagtaaatccgccgccaacagaaagactgctccatacaaagctgaggccgggataatataccgataatccgttccgaccagatggcgcataatgtgtggcacgatcaaaccaacgaagccaacagggccgaccacaataaccgataaccccgttagaattaatacaattaaggttgaaaacagcttaatcctgtttgaacgaatacccaagcctgatgccacatcctccccgaagctcaaaatcgtaatcgagggagaaagcacgatggcacagatcaaacccactacaaacagtggcgcaatgaaagctaattcaccccacttggcactggctgtaccaccagcagaccagtaatcaagggcttggccaatctcatacctaatagcgataaacgtactaaacgcaccaaacagcatggagatggacatccctgccagcaccagtcgctgaggcgtcattcctcgcttgcctatagatgcgatgtaatacgtaatgcctgtagtgattgctgcacctagacaagaatacagcatggtttctccgtaggtgcgaccaggcaaaaagaccatacataacgcaatagcaaatgtcgagccagaacttatgccaatgagtcccgaatccgctagtggattacgagtggttccctgcataattgccccacacacagccaagctgcaccctacaatgatatctgccacggttcgtggaaaacgcaaggtgtgaataatctgatgttctgtaatgttgggatcaaactgaaatatagcaccccatgccagcttcaggctcatttccgcagcaccaaaggtaatagatgctgcggtaaccagcaggagtaggaacacgcccacgatcatgtagcttacaaaatgaaatattccttttttatttggttctttgtgagtagacatcgattacacccttagttgatcaattatgcatcgttaattagtctgttccagcaatttgctaatcatataatctagctgtcccgtcatactagcaacgtccgaataatagaacagtcctgcatatttcgctggaatttcgatgatatgtccgtttttaacggctggaatactgctccagatttttgtcttcgcatattcagattccttgccttcctgcttaaaccaaaggacataatctccaaagtattcagcagctacctcgtaggataaagaaccccgactctctccggaatttttaaccaatgtgttgagcttttccggtttgtgaagtcccagataattgtaaagcaacgttcctccacgtgagcctgtttcataatatattccgtaagagccactgccccaatcctcgaaaatgctaaacgttttgtccttgaatatgtcggaatttagtttttctttggcctgactcagcttgctttcaaacagtgaaatcactttgtctgcttctgcttcatgtcctgtggcctgaccaaggaatttcaaacgttctatagaggtcattttatcctcaggtattacaagaacaggcgcaattttagacagcttatcataatcctttgtatcatatgtaatgatgagatcaggatcatacttcataatttcctcagtttcccacttttcaatattgggaatgtcgttaaacttatcgtaaaaaggcatcgtttcttgtttccaccccatgactgcggctggcttaatccctagtgtaaatacatcgccaacataccagttcacgactacccgttgaggattagcgggcaccttcacgtctccttttaccgtagagactgtacgcgtatcagaatcaccgcttgcctcttccttcacggacgacgcgggtttagcagatgaatcagaggaactgccagcattcccgcaacctgaaataacgaaaatcactacgaatagtgcacataaaatcatgtgaaacttcttattcatcatacgatgcatgttgtaaatctcctttgaaatatagtaagtgcaaaacatacttaaaataagtgatattgataatcattatcactgatatcaaattgtaaattttacctcactgattgtcaactgtttctttaagttttatgttttactttaatgggttctccagctcccctcttctatttgcttcatgccattcctgatagattcctccaatttcataaaaagctttgttcattacagttgtcagctccttcatgatctccttggtatattttaaatgagtatttatgttatccactttatatttgcgaagcagatttagatgagcaatgatgtgaatcgtatcttcgataatccaataaatcacatcctctacatctttcgtaagcttgtttagcatctgtatgcctctttcatacatctggagcgtatacccccgcttgcctacttgcacatacggactaagatcatcataaaaatccgtacggaaaggtcgtcttacatattgctcatactgctcttcatatattgaagtttgttcaagcagcttaatagtcatatctataatttcttgttcactgtatatttttttcatcagattttcccttgcctttctctactaaataaattcaagtcatagttaaattagatcacaagtgatgcaataagaagtcaaactctttttttaccaaccattaacaattttgtttgatgcaaacgataattagaatagagggatttccctcaatatatccaactgaaggagacaggcgaatgaatagagtatggacgaaagcatcggctattttattggtagtaatatccctgatgttcaatggaacgtacgcgctcgcagcttcagcaacatcaacgtatatcgttacgtttcaacaagcaaccttggtatccaacgatcacgtaggcaacgaatgggccattgctgcccaggtggcgggccaatccattagtgaagacaacagcgtaaaggtaaaggtcaaatcagggggcagcattaagctctatgcgtatgccgaggaacaagacaaaattcctgatgaaggtgaagccaccaagaatgtaaaggtctcctctgtttctgccaaaggttctaccgttaagctaagagtgacggttactgaaaaccgtggacgttactcaggtcatcaagccgtttgggaatttacgtataagattaagaaacaataatagaaaaaatagaccgtcactcccaggaggggcggtcttcgcttttacaagtcgcggtaactgggcacataccatttcggtatataggtttgaaagtaatcatacgcttccaaaacctcttcagctcgttgcaccatatcgtccacctcttttttgccaaatggaatggcccagtgaaccgatgaaagctgattgcttgcaatatacagagccattaatcgaaaaaataaatcaggtacatggttattaaaataaccgtggatacggcccgaagcgaataaaggacttaatgctgcacaccaggtaattctattgaattcctcccaaggatcaccaaaatccattctattaaaatcaatgatacccagttcaccggatggtgtaaccaccatattgcccacatgataatccccatgctgaaaagtctggggacgattttctaatagctgacgattttgctcaataaagcttatggcttgatctgctccctttaggggaataccgcatgacttatagtttgtaatatatctgtttattttgccattataatgttcaccccatgggactcgatcttgctccgcatgaatctcatgcatttttttcaatgcatctcctgcttgaaccccgagttgatactgttgtgctgcggtcaacgtagggataatctcttcagcatctttcccttcgatccaggtgaacagggaatatacagattgaccatgatgacaaatcccaaattcaagcggccgggacatgaacagattctccacgtggttcagctttgttacagcttcaaactcgcgcttctttttatcataatgaaccatatccgctattcttagcagcaagtccctaccgtcagtggtttgaatataatatttcttgtcactggaccagcctctatgaatttcttccacgtggctccacctgctggcacccggtatttcactaaagagttgattcacgctcatcccccccacgttaagatagccttacttactatatatgctttccatagtttaccttcgtaatgacagaggaatcaatcctcttcctggaaaaactcaaataaaaaaggctgaaaagacaagccgtctcttcaacctcaatattcactgagttgccatcgtgaacacccatcacttgtattttcaaatcagtaagaataagaaaactcatgtttaaattcgtctacccgttgaatggttttcagaatatttcgaccttcacgtgtgccatcaataatacgacgagcttgtttactatccccgatattaataacttctaattgatgttctttaccatattcgagcaagctgtccatcagcggactgtgtgaacgcatacccaagcatacgaatccaagatcaaaaggaatctcaaactcctgttctccatgctttactttgaagcggtcgctacacacttctgtcaaagctgtttccgtatggacgttcacttcccgctcctctaccattttcatcatggaaatccgagtaatcatatccaggtctttacccagtaacggcatcatctcaataatagaaacctcttgtgctccacgctctgcataatattcgacgacatccagtcccacggctccgccgccaactacagcaatgcgtttaccttcaaattcctggaatttctccatgttgtgcaaaagatcaaagatggagaacacttttgtacctggtttacccagttgctcatgtaaacctgcaatgggcggaagaagtggtgtggcccccgtcgcattgacaataatatcaggattcagggcactaatcatcgccaaatcggctcgggtccctgttacaatgttcagattggttaactgtttggtgcgctgaatcagataatcagggaaatcattgatgcgtgttttgtctggcaagcgggcaatatcacgagccaagccgcccaactctggtttttcctcaaagagggttactttgcagcctacttcggctgccgtacatgcagcttccataccagcggtcccaccaccgatcacaacaacctgaacgttgttttttacacgttgtttccggtattcagcttccttgaacagatccggatttaccgtacagcaaattggtttacttttggagatacgatgatctgcacaaccaatgttgcaagagatacattttctaagcaaatgttcgtagccgttttgcactttaagcacccagttcggttctgcaatcaagcctctacccattgccagaagatcagcgtcacctctctccaaaatatcctgcgcagcctgtgggctccgaatattacctgaggtcatcgtgatcttcccgaatttttcttttaccgctttggccatatatgagcgccaaccatccggcaagttcatcccgtcaatctggaactggatggaatcattcagagcagcagaaacgttcagaatatctacctcatcattaagatactccaataactcgagtgtatcttccagtgtgttcccaccttctgtgaactcttccgcgctaaaacgtaagcaaatagggaaaaatgggcccaccactgaacgaatttcatcaatgactaatctggcaaaacgggtacggttttctgcgcttccgccaaattcatccgtgcgtttattatacatcggcgaaagaaactgactcagcaagtaggagtgtcccgcatgaatttcaacacagtcaaatcctgctcgttgcgctcttcccgctgcttctccgtatttgcgcacaatggcgtaaatttcttctttttgcagaggtcttggaatggctccgccctttttagaaggaatattcgaagaagatacaggctgaactccgttcagtcgtcccgcataagccgaagcacccgcatggttaatttgtacagaaacacaagctccataagagtgcagggcttctgttaatctaaatagtccgggaataaactgatcgttatccatacgcagctgggttgttccgttcgtacccattgggaaatccagacaaacattttctactgttatcaagccggtaccacctttggcccgttgcacgtaatagtcaatatgatcctgaacaaagcttccatccatggcagcaaagttagttcccatcgggggcataacaatccgatttttcaaggtcatgcgtcgtatggttagaggttcaaagatagcaggatagtggttcattgttcttcctccttgcgagtttacaaattttatgttcaagcttccattaaagtattttcatatgtgatttttttcacttttgggaatatcgagatgttattgagtacgatcattccttatggtttgattttatatcatctaattcataaattctaatgctattttatgtagtgaatcatagtttcagtctatagattaactggattaagacataaaaaaggaacaaacctgtgaggaatgtcccttttgtgtgaaaaaaatcatgctaatattccgaaccgcctaccgatctgttcttttgaaaccgttgggtacacgctccaaaatcccctgcccgaaaagctgggtgagtctaatgaaaggaaacacctcagcttgacgtcaagggagacttgtctatccgtatacagattatacttttaaatcaccatcataggtggcaatcatattgtacagttcaggacgacggtcacggaaaatgccccattcaatccgtcctacttccagctcatccagatcaaattcagcagtaagcacttcctcatcggtacgacccgcttctgcgatcttgttaccttgatgtccggcaataaaggaagaaccgtagaatgtaatactggagtcctcgtctgtttcagttccgatccgattggaagcaataactggaatcagattggaagccgcatgacccagcatacaggtctgccagtgatctttggaatcaatggcagaatcctgtggttctgagccaattgctgtcggatagaacaaaagttctgcgcccatgagcgccatacagcgggccgcctcagggtaccattgatcccagcacacgcctaccccaattttggcataacgtgtattccatactttaaaaccggtatcgcccggattaaaataaaatttttcctcatacccaggaccgtcaggaatatggcttttgcggtatttacccaacacttcaccgtctgcgtcaatgacagcaagactgttgtagcgcgcgtagtttttcttttcataaaaactgatgggcagcacaacctgtaattccttggcgatcttcttaaaatggttaaccgccttgttgtgctccagctcagttgcatatgaataataatcagacttttccttctgacagaaatatggagtttcgaacaactcctgcagcaaaataatttgtgcgccctgcgctgccgcttcacgtactaacttctctgctttactaatattttcttcgatattggtagagcagctcatttgagttgctgccacttttacttttctcacgttagtcctccttttagatgttgtatcattcaacgatttacagcaggcatctgctgggtcgtacagtgtacgttaccgccttcacggatgaccgccataccgtctacagtacgaatggtgcgatctggaaatacatttgccagcacttgctcagctgcaagatcgctcttagcggcagtaccgccaaacaccggcaaaataatgccgccattcacaaagtagaagttaatatagctcagtgtcaatcggctatcttcataatccacgcgcggtggctggccgatccgaatcacttccagcttacggccttgggcatccgttgcttgctccaaaatacgcagattttcctgcgtgatttcgtaattttcatcctcaggatcatcacatacttgcataatgaccttgccaggagctgcaaagcaagcaatattgtccacatggccatctgtttcgtcgccactaagaccacgttttagccaaattattttctctacacctgtatactcacatacataccgttcaatttcttctctgcttaattccggatttcggttggaattgagcaaacactcttcggttgtaatcagtgtgccttcgccgtctacgtgcaatgagccgccttccatcacaagcggtgcatcaaaccgtggaactccaagttggtccaaaatttgcggcgcaacctggtcatctagatcccatggagcgtatttgccgccccaggcgttaaacttccagtttacacctgccaattgactatgctcgtctgtgagaaaagtagggccgttgtcacgcagccacgcatcgctgtgctcaatcggcagcagttctacccgttccccaagttcaagcgccttaacgctctccagatcatccggatttacgaccacagtaactggttcaaattccgccatggcgcgtacaattccggcataccccttgcatacatcagcatgcatatctgggtaaaccattgaagattttacaggccaagaaatatacgtgcgttcatgtggcgcccattcaggcggcatcttataatgtgaatccttaatttgcatgtattgaagctctctttctttttcataatgtagactccgctcctatcatacaataatatgatctttgtctcaatcgaagcggaaaagttttaataatttacatttacattggaataaattactttgaaaacgtgattgctttcatcgtattcccatcaaaatccttcacagtgaattgtgctccctccagcacaccgtaagaggatgaatagttttcttttggcagcgagatcgaaccggggttcagtataaagaccccattctccacatctgctaccggaatatgagtatgtccctggatgaacacatctcccgcttccagtggtggtaaatttccgatactaaagccatgtccgtgcgtgacatagattcgccgtccttcatggtgcaataaagcataatcacccatcataggaaactccagtagcatctgatccacctctgcatcgcaattcccgcgcacagaaaccgcaatatgggacttgtacttattcagcagagctgccacttctgccggattatacccttctggtaacggattacgtggtccgtggtacatataatctccgagcagaacaagacgatcggctttctcctccctgtacttttccagtgccaattgcaaccagtgtaatgagccgtgaatatctgatataaacatcaatttcatgattgttttttcctttctgaataggctaaaaatattccacttaagcacattattgcattattccctgaacaaatctgtgcaaaattgttcttttgtttggtaacactctatcagttgtcttcccaagtaaaattttgatgagtgtttctcgttcttcgatatttctaggatgaagctgattatattcgtggcagagacttttggcgtataaacgttcttcaatcaactcttcagaactggaaagctactcacattgaaatttccaccaaattaccttctggatctttaattacgctttcataatagccgtcacctgtcaatcttggctgacccacaacttcatatcctgcatgcatgagctgctctgtcttttcattcacccgtgctttacttccaacggaaaatgccacatgagcccagcccgtaatatttatctgtggtgaatgatctactcccgttttacgcataacctctaaccttgctccatcctcaaaggtgataaaataggactcaaatccttttgtagcgttataatatttatcgttagattttccatcaaaatattgttcgtaaaagcttttcatcttttctaagtccctcacccagatcgctacatgctcaatcttcattattttcctccttctgctgccctcatcattaaaaaatcattaatttatactggactcaatttttagcatagttattattaacgttttaataagtctcaatatatctcagtaattcatttttgtccaatctatttatcatcaattatcaataaataacgcttacgaatcattcatgaaagctctttcgtcttcagcttgtaactcggttgctaataccctaaaaaattagcgaccgcttcgtaaaagagaagaaacggtcgctatctataagccttcattgtatatttaatacttaatcactggtttatttataaattaacgtttcaagctttcaccgttcgtagcaataacttctttgtaccaatgaaacgatttcttcggatatctttcaagtgtaccgctgccatcatcatgacggtctacgtaaatgtagccataacgttttttaagctgagcggtcgaagcgctgacaaggtcaatacatccccaagacgtatagcccaaaacctctactccgtcctcaatagcttctccaacttgaaccaaatgatcattcaggtagttgattcggtagtcatcctcaaccgttttttcgcctttttcattcgtgatcagttcatcaacggcgcccaggccattttcaacgatgaacaatggtttttggaagcgatcatagaacgtattcaggacataacgcagaccttgcggatcaatttgccagccccactcacttgcctcgagatgcggattgatgacaccaccaaggatgttaccttcacctttgacttttttagcttcgtcagctgtctcacaagtactcatataatagctgaacgagataaaatcaacggtatgcttcaaatcttcggcatcacctggttcaaagtgaatagaaattccgttttctttaaagaaacgtttcatgtaacctgggtattgacctcttgcgtgaatatcggcaaatgccatgtttctgtgatcaaattccatcgcagcaatcacatcgtctggattaggtgttagcggataagtaggcatacttagcaccatacagccaattttgaaatcagggttgatctgatgaccgatttttaccgctcttgcactcgctacaagctcatggtgaatagcttgataaagatcttgctcactaagttgatcttttggtgtgctaattcctccactcatgaatggtgcttcaagaatggagttgatttcattgaaagtcaaccagtatttaactttatctttgtagcgattaaatacagttgtagcatagcgctcataaaaatcaacaagcttacggtttacccaaccatcgtattctctggacaaatgtaaaggtgtttcatagtgagataatgtaacgagtggctcaattccatatttgtgaagttcatcaaacaaatcatcataaaattgcaagcctttttcgttaggctccagttcgtcacctttagggaagatacgtgaccatgcaatagaagtacggaatactttgaagcccatttccgcaaaaagtttgatatcttctttataatgatgataaaaatcaataccgatcaacttcatgttatcttctgttggtacatccgtaacgggcccccagccaccacgaggagttacatcctgaatggaccagccttttccatcttcttgataagcgccttcgagctgattagcagcaactgctccgccccacaggaaatcttttggaaactgtgtactcatattttctccgcctttgctgatgtttttcattaactagatagaaatacgttacctctatgctaatgtgttataagtacttctaaatgaatcttaaggtttgtaacgcgtttcatgtcaagtattattttaaaaacttctagagcttataactgtattatctccaataagtactcccctatttataactcttctattgttgagtaaaatggctattcttcaaatggcggatctacatgaatatctctatctggttcagtgcttacccagcgtgtaaagataacctgaaagccggctcgagtcggcgcacaggcaaaaggacccgcctgttgtcccgtttcataaggaaaacgtgctacacgtacggtgcgccagctttgattttcggttcgtgctctaatgataactgcatcctgtagctgtgaagcacgaatcgtgacatttttccctacccattcaggtacaggagctaatgaccaatcggaatagccatctgtaactacgacagctaattgaggaattccgtcatttaattcaatcccagctttaatccacttttgctgtccttgatacagcattataccggcctgatcatagagctccgtaaatgagcctaattgaaacgtgacttcgatggctgagccttcttcccagtctgtaagcagggaatgtccgctactgcgttcaaatccatacaaagttttttcccagtagtcgcttccttctctggtttcaactttaagaaactggtcttcttctatggatgatacagggtgattagtccatgtccctgtagtccatgcaatcgatttttgagtcattaatctcatcctctcatgctttattgaacgatgtcctatttccttttctccaccaattgcaaattgtacgtcagactttcaagggtcactgaaatcaacccatacatatattcatcatgcgtatcgtttttcacaaaaatctcgggcatatgttctttgggtacatcttttagacagccgttataaatatcgtccaacagagtcggcttggataactctccagtcaaagcgatagatacagggtctataattgcaataatagaagtaatcgttttgatcgccagaggaacaaatccctctgtgctatttaactgtttaagctgttcctctcttgttaaatcaaagggtaagaaggacacctcccccgcaaacttggtatttccttttaacaaatgtccgtcgacaataaaacccgctccggggaaattgtctttgggaaacgtaacaatagcaaaggttttatcctcatcataattctgcatgttataaaatccgtagactgtcaaatgcatatcattttcaatggtaacttctaatccgtatttatcttgaagacgtggacctacagggactcctatgagcaggtcgagatcacaaacatcgataatcccttgatgaacaaccccagggatgccaatcccaatggctttgacgtttccatagttattaatcagctctccaatttgggtttctatgacctcataatcaatatggggcactatggaagtattctcgatgatgatatcgccaagcaaattggcaacagcataagtaagagaatgtataccgccttccgttttcacatttaaacagataatatatgaataatcagcgttatatttgtaccgtctagccggacgtccgccgttcgattcttccaattccgtctctaatacttccccggtttgaagaagctcattcagaatatttccgcaggttgccacactaagacctgtgatactggctatggatgacttggttgcatattccttggatttcagtgtgtttttaactaactctacattaatttgtttaacccgaatggtattattggagactggttgtatttgaatacactccttttccagtatttattaaaaggtttataataagttgtaatataccgctctgcctgcaaaaagtcaatttgtacgcgtcttcctcttctcctctatcatcatgctatactataaataagaaacaaatttttagtgcggcatctttgcgatgaaacgaagtgaattaggagggattctgttgtcagctattgagtatatagcaataatcgcgttgctcctctccgtcatacttttaattaaggtctatagccttcaatcgcgtcttaatgacctgaaatccgacgtggatcgtcttgaaaatcgttcaggaatacaaggaacatcgctgtcaggtactattgctgccactccttcacatgttctagatgcaggagcttcagaagatatcaatgaaaagttgctcctgctaattagggaaggaaaaaagattcaagccataaaagagctgagaaccgctaaggatctttcccttaaggatgcaaaggattatgtcgatcaattggaaaaactctaaagaaaggaagaaataagatgagttccaacaaaacaaacgccatgcgcatattggatgggcaacacatacaatacaatattttgagttatgatcatcaagacggaaaaatagacgggatgaatgtggctgagaaaatagagagagccccagaaatggttttcaaaactttgattgcacacagcaaacaaaatctgtttgtttttgtaatccctgtacataaagagcttgatctcaaaaaagcagccaaatccgcgggagagaaaaaaattgaaatgcttccagttaaggatttgcaaaagtatacgggatatattcgcggtggctgttcccccataggaatgaaaaagctctaccccacttttatcgaccagcctgcattggaactggaagccatcgttgtgagcggtgggaaaattgggacccaactggagttgagtccacacgatttagctcaaatcattcaagcacagtttgcagatctgacgcatacagcataaaactcaccacatgatcataaaatctttatgcagattttctctaatcccttgcttcatcaagcttcaacttggagaggaagatctaatgatgcataatgattgcccgaaaaatgtaagaatcccccaacccatcagaagcgatggtgctgggggcatcgacaagggcccacgtgatgtgatgagggatctacaaaatcccgatatgctggttccccccgtaacggacaatggtctcattccgaatatgagattttctttttctgacgcccatatgcagcttaatcatggtgggtggtcaagagaagtaacggtaagagaattacctattgccacaacccttgccggggtgaatatgagtttgacgccgggaggtgtacgtgagcttcactggcatcagcaggcggaatggtcatatatgctgttgggaagtgctcgcattacggcagtagaccaaaatggacgtaattttattactgatgtgggtcccggggatctctggtattttcctcctggcattccgcactctatacaggggcttgaggatgggtgcgaatttttgctggtttttgatgatggcagtttctccgatctaaacaccctatccatctccgattggttcgcacatactcccaaagacgtactttctgcaaattttggtgtaccagaagctgattttgcagcgattcctcaagaccaagtatatatctatcaggattccgttcccggttcaatccaaagccaagcggttccctctccttacgggacgttgccccaatccttcaagcatgaattactagcccagcccccaatcaaaacaccgggcggaagcgtacgaatcgtcgactcctctaattttccgatttccaaaaccatcgcagccgcccttgttgagattgagcccggagccatgcgagaaatgcactggcatcccaataatgacgaatggcaatactatcttacagggcaaggacggatgactgtctttggtggtaatggcgctgcccgcacatttgattttagagccggagatgtcggatatgtgccctttgcttatggtcattacattcaaaatactggctctagctcattatggtttcttgaaatgtttaagagtgaccgttttgcggatgtttcactaaatcaatggatggctcttacccccacagaacagattcagagtaatttacatgtaggtgttgatgtaatctctaatttacgaaaggtaaaatggcccgtcgtcaaatatcctggttattcttatgaccctaataagaagtaaccgggaacggtatcacgctcgccactagatcaatgaatcctcttcttgaatatgatgggttattcatttgcccctttcatgattatttccagatgtctacgtgtgtttgcacaaactgctcgaatgatatcggacggcgcccagtgacacgctctacggtatgagtaacttgatcttcacttccattttcacgtatccttctatccaatcccgccagcatatctgcatattcttcaggcattccagctcgaaccatgcccgcttttagctcttcatcaggcaacgagatatgctggatcgcttggcctgttaacttcccaataatcttaccgacttcgccataggttagtgactgaggtccagtgatgacatgagctgtgttatgcggtttatcgtcaatcagagctcgtactcccacttctgcaatgtcatctgcactgacaaaacctactctcccatctcctgtcgcactataaatcgtgctggtgtttttgatggtacttacatgctgaccttctgtaaaattctccataaagtaggatggctgcaatacagcccactctggagctaatctacgtagtgcttgatgcacaggtccaaatactggtccgtcctcaggcacagatgcgctccctaacagcacaaacctttgcactccttctctcaaggccctctcaataaaaggaatcatcactttggcgggattgacatccagcacaggtactaccaaataaattttatctacattcatcagcgcctgtgcatgtgttgattcatcataccaatcaaaatatacataatctttcccttcccattcggcaggatgagcacgtcctgccaaacgtaccggatgctgaagttgcgtaagtctggcggctacacggctacctgttttgccgtttgctcctgtaatcaacgctatatttctgtctttcatgaaattcaactcctatttaatttttttgttttcgcctagatatccttatccccatgaggcttgaactctttcattcatgattccagggcttcaagagctactaaagggttccagtaatctttgtagtgaataatttttccgttcttcagcttaataacagaaatgtaggtttgattatacggtttacctgtgctcacagcctgcgcctcacaggcgaactcggccacgaataaatccgggtccgttgtcgtatggataattggtgaagagaaatgctgaatccgaagtatattaggaaactccttaatgtactcgtaaattgctgctttgccctgaagcatttgtgcaaaatgcttaggtgcataagggaactcgaaaacagcgttatcatcaaataatgaaatccattgctccatattttcttctaacaggttgctcgtaaatttatgcatgactgcttgcgcttgctgttttacttcgtcaatattcggattgattgtcatggtagacacctcgcaaatatatttttagttcctgcttaaaaaacgaattcaagacgctaaaataaacataagcattctagattgaacagtctataatactcaaaaaaatttgaccaatcagtctggaatgttcaaaaaataaacgctattaagcgttcataaagatcaatctaaaatcgacagcgttgtacgcacaatatctctaagcacctcagtgctcgcgcctgtcttggcggtaaatgtcaacgatagtcgggcatgatttagaaatctagcgattgacaatagctcagattccgtagcatgaatctccccttctttttgggcgcggactagggcgtcgtaaaaagcaagttcaagcttttctgtgttttcagaaataaaagctttgatctcatgatgatgcggagcctgttcaatagcactgttcataataaagcattccttggacatcctcttatccgtcaacactctaacagattcattaaaaatcatcgctattgcatccttaatgctcccaggttgactgagcagatgtactacggcttcggtcttgtcacgtatataaagctgaatagccgaaaaaaacaaatcatatttcgttccgtaggtatcataaagactctgccgcgctatacccaactgatcgagtaaaattgtcagagaagttccctcatagccatgctctccaaatacagccatagcttttcgtagaacactttcagtatcaaattctttagctcttcccaaaccttatgttcacctccttgcctatgattataatttttgcagactgatcagtcaagaaaataaaattgattttttataagtttatttacaaaaaaaccatcgtaccgaaatacgatggtttaggaatgtttattttatacaaacgctcagatgtaaatgatgcaatccgactactcgtcagagtctacattgtggtaaacctgctgaacatcctccaaatcttctaatgcatcaatcaatttatcgaattgaacttgtgcatcttctggaagagaaatatcattttgagcaagcatggtgagctccgcaacggtaaactcagtcactcctgcttgtttgaaagcttcctgcacagcatggaattgatcaggctctgcatatacgatgacggcttcatcttcttcaatgatgtcacgcacctctacatctgcctccatcagcagctccagcacttcatctgcggttttacccaccagaccaataactgctgttgaatcaaacatgtaggctacagatccgctcacacccaggctaccgccatttttagtaaaagcagaacgcacatccgatgctgtacgattaacgttattggtcagtgcatctacaatgaccatggaaccgttcggtccgaaaccttcataacgaagctctacgtagttttcatcgccagcaccttttgctttttcaatagcacggtcaatgattgctttgggtacattgtacgtttttgcacgttctaaaacgactcttaatacccgattggattcaggatcaggttcgccctgtttggctgccacataaatttccacgccaaatttagcatatatacgactcgtattagcatccttggatgccttcttttctttaatgttattccacttacgtcccataatatcccgctctcttcctgtatgaatatacacaacgaacttcattatatccttgtatattatatctcctaaaggacatacgaacaagttcaaacaactccgttatggaaaaataaacaattctacctaattagggatgcttggaaatatgaactttcaattctgctcatctatggacaatccccctatccatgtctaagatgaggaggaagtctgacttgaaggagatcatttaattggatgtcttgtacaaaaagttgagccataatcatgaaatcacagtatacgaaaccacagagctgtatggtgaaaaaggcttatttcgagtgatgcagttttcaaatacagccgttcaaggcgcggtggacttgaatcatccgcaacgcattctgttcgaatatccgagagcaatcatccatctcatggaactgaacgatccgacatttgaagacgtatttgttattgggcacggtataggtacaatagcgggtcattttacagataaacgctttaagattgccgagctggatgcacaagtcgtagagttcagccgaacattctttggatacgatcaggataatgtaactgttggcgatggacgacgcattctggagaaggaagcgcctgatgcttatgactatattattctggacgccttcacagagcagggtacacccttgcatttagtatcctgggaatttttcaagatggccaaagaaaggctggattccgaaggctccctgatcatgaatttaatgggcaaaagtgaacacgaccatctgattaatgccattcacacaacgttgcgtgaagaattcgcctatgtcacaactttctcgctcccctcggatggcgctgccgatattcaaaatatcattatggtaggtcgggacaagccaatccggtttcaggcacgtcagatggcggactttcatgagattacacttggagaaggccatattctacgggatacagatgcttagcgtagttccaatatccgtctctctacatcttcgatatgaatcgtctctttgttgcagctttttcgttccactaactctactttcccgtgttcggcatctttaccaacgacgatgcgcacgggaatacctactaaatcagagtctttgaatttaaccccgggccgttcctcccgatcgtccagcagcacctccacaccgtgatcctgcagttggttgtataatttctcggctaattgcatctgaagcctgtctttcacagaaatcggaatgatatgaacttgaaacggggccagcgcatgaggccatatcattccgttctgatcatgattttgctctacaatggcagaaaggattcgggaaaccccaataccgtagcagcccataatcatcgtttgctccgttccagatgtatccagaaaagtcgcacccagcttctcactatatttggtgcctagtttaaatacgtgtccgatctcaatcccacgataaagtttcaattccccttcgtcacatcgaggacatctatccccttctattacattccgcaagtcagccacatgccgaagatctatatcgcgccttggattcacatgtcgataatgataatccagctcgttcgcgcctgcgataccgctggacatttggacaacggcgtaatctacccatacagggatcgtcaatccgcatgggcctatgaaccccgagggggttccagtcgcctttgacacggtgtctgcacttgctatttcgaatttttcactacctaaaatatgtttaactttcacttcgttaacctcatgatcacccctgacaactacagcaacaggttgatcgtcagccatataaatcagtgttttgatgatttcttcaggttctatgtgaagcgattcaaccagttgatctattgtacgtaggcctggagtatggaatttttccattttagctgtatcaaaagaaggatggctgacatgttcattttcatctgagactggagctatttctattttctccgtcgaccgcgcgacggctttttcaagattagctgcatattcacagcaggtgcatgctacaatggtgtcctctccaatatcagctagagccataaattcatgggtttcaccttcgccaccaatggcacccgcatctgcttctactgcacgaaaattcagaccacagcgggtaaaaatgcgatgatatgcctggaacatagtccaataggtatgatctagtccttcccaatgtgcatcaaacgaataggcatccttcatcaagaattctctgctgcgaagcaggccaaatcgaggacgtcgttcatcccgaaatttggtttgaatttgatacagggttacaggcaatttgcgataagaattcacttcatttcgtattaaagacgtaatgacctcttcatgtgtaggccccaatgcaaactctcgatcatgtcgatcttgcagacgcatcagctcaggaccgtaaacatcgtatctccctgattcttgccatagctccattggctgcaatacaggcatcagcagctccccagctccggcgcgatccatttcatctcgtatgatttgctctacttttctgagcacccgtctgcccaatggcatgtaggtgtacattccagccgccagttggcggataaatcctccccgcagcataagctgatgactgatcacttcggcatctgcgggtgcttcacgcaaggttgtcagtaataattggctttggcgcatgtgtagctacctccttgtatggacgataaaatgtacgcaaaaagacacatccgtcagggacgaatgtgtcgtggtaccacccttaatttgaccgtagccatacacggaacggtccttcatcagataacggcgtctagccggtaacggtttatcttacaaaccgctacagctcgcaaggcagggaaacgttcattcgcggcgagaaacctttcagcccatgagtttcttctctgtacagcgggtattgaacctttgatccttggtctacactattcctatatattacaattttcaccactttacacgaaatgtaacttctagtcaaggagataatcgtctatctgagatcagccagggacatgaacgatatttaattttcaagataattaaattccgttggttaccctattgcataatgagtggccagactttagaacggatacacctgcgaaaacccagaacaaagcagacactaccaagccattacgtatgtgaagctcccaatacgcgctgttgtagggtagagttctcttaattacttatgtatcttcctttttaaaatacacgcccttgaaaaacacaaaattttgcgaatgtgtgccatacagctcctgaaacctagaatggagtttattcatagaaagggtctctgaaaccgtccgatccgtttgcagggtcaagtcgacacagctaattccaaattggcacacttgctccataggataaccttgggtgattccataaatcatcccggcaataaaagcatcatctgcgcctgtgacatcaatgacctcttgaacgggatgcataggaatttgtccatgagttccatcctgagaggcgtacaaaactcgatcagcaccacagataaaaatgacattttgaaccccaagtttgtgaaaaatccgggtggcatccaacatatgctgatcatctgtaagttctagccccaaataagcttcagcctccaccggtttacataccagccattccaccccatgcaaattccggggaagctttctcatcttggaggccgataccgaagaaacgacaatcggaacccgatgttcatggcagacatgtatggtggctgcaattacgttcatagagaaattagtgtccagcagaacgagtcgggacgaggcgattaaaggagtattttcataaattactgaaggacgaatctgatcataaatctccatttctgctgtcgctacaatcaattcaccacgctcattcagcaaggcagtataaaccccagttgacggctcacctttgacttgcagaggaaccacgtgcatgtaacggccggactgttcaataataaattcaccttccgcatcgtccccaaccgcagttagcaggctgacccgttggctcaacctccctaaattttcggctacatttcgtgctaccccaccgcaagattgcagccttgtactgctcggattggaggtatgaagctgaaatgtacctttaatcatgattttacgatccagattggcccccccgatacatagtattggtttgctagagggccaaggctcgtcctgttcatttttgtggattttttttaatttcatgatttgactcctttctcgagtctattcgctagaatgatttaaatttgtacagaaataggcaccctataaaattaacacgttccaaatgtcaaattcccaagaataatgtcgagtccgttaaaatatccaaaagttacccatgcaaaaaaatcaccctatcgtaaagtttaccttccacttttacgatagggtgattgggttggaattgcagcatagttcttccttacattatgttattcaggatttttgcaaaatcctctatttcaaaataaatagagctgctccgtgaggaggtaaatctgcggacagttcttgtgttaaaacacctaaatctacatgattccacaaatctctggcatttgcctgtccttcaataccaaggtcttttaaggatacacgcacctttgaagcctgatctccagcattaaacaaagctgcgtatacatgaccttccccgttatgtgaagtccaaacgatatgttcatcctttctgtacacctgccgcgcattcaaaccgttgcgatgggcatttaacacttcttcattcgttaccaaggaaagggtccatgcatcattatcccgcagctctcccccgaacatcagtggagaccggaaaatgctccacaaggtcatcatcgttagctgctcatccttcgtaaagcgtgtccatcggtcatggctgccggaatccaccgaatctaccgaacgaatacccagatgacctagtggcagcatgtcgcaatccggccagtgacccggacctacatgttccgcccacttcacgcagcgctcaaacataccatacagtaaaggccatacatcccagaagtcatcagtcatacgccacatattcgcgtttgcaattaaatcagatgcatgctccagcggtgcaggaccaggtgatagactcagcaccaacggacgtccgcattgggcgatagcccgcctaatcaattcaatttccgccaaatgaataccatagaggcgtgatgcagcaatgtcatctactttgacaaaatccacaccccattccgcatacaggtcaaacaacgaattatagtactcctgtgcgccttccttggatgcatctaccccatacatatctgtgttccagggacaaatagagttgggatgcgcaatttgtctcgccgtggctgtggttcccaaaatcggggtatcctggtgcaccgcctgacgggagatgcctctcatcatatgtataccaaatttcaatcccagactgtgtacatattccgcaagagcttggaagcctcgtccatctgctgccgaaggaaaacgattcaccgctggaataagacgtgaaaatgaatccatttccaatgggacgaacggacgatactgtgaagaaactgctcctgactcataccactgaatatccaccacgacatattcccaaccatattccttcaggtgctccgccatatattgagcatttccccgtacttcctcttcccgtactgctgcaccgtagcaatcccagctgttccaccccataggtggtgtatgcgctgtcaaaagatgtttcatttcattcatcctttcatctagtaaaactcaccctgctaccagaaatcccctcattactacgttactattataatgtaaacccttacttttgtcgctcgtcatcttttccatttccactttttatacatttaagttgactaacttaaagaatgtggtacatttaaaattgcttgttaaaaaactttgacttgaatcagagggtgattttacgtgtgtgaacatgcttatcgaattttgttgttttacaaatatgtcaacatagaagatcctgccacctttacggcagagcatctggcttactgcaaggagcttggcgtcaagggaagaatcttgattgctgcagaaggaatcaacggaacactgtctggtacagtagagcaaacggagcaatatatgcgtgatttgcgcgccaatccgaaattccacgatattgttattaaaatagatgagtctgacggtcatgcgttcaagaaaatatttgtacgccatcgtcaggagctagttacgctgcgtcatgaggatgaactggaccctaatgtaattagcggtaagcggctgtcaccaaaggagttttatgaacagcttcaagatgaagatgtagttgttctggacggacgtaatgattatgaatatgacatcggtcatttccgcggggctattcgccctgaagtcgaatcgttccgtgaatttccacaatggattcgcgacaatatgactcagttcaaagacaaaaaaatcctgacgtactgcaccggaggtatccgttgcgaaaagttgtccggtcttctgatcaaagaagggtttaacgatgtaggccagttggatggcggcattgtgacttacagcaaggacccggaagtacaaggacgtttgtttgacggtaaatgctacgtatttgacgaacgaatctccattccgatcaatcatacggatgaagacgtcattgtcggcaagtgcttccattgtgaaacgccaagcgatcattatatcaactgcccggtgtgcaatctccagcatatcgtatgtccggattgcgaagaacagcatcagcactattgctctgatgattgccgaaccaaagcggaaaccgtcgctactgcataaatcggcagtatcattggttcattataataaaagggatgcccacagccatgataaacggctaatagggcatcccttttattgttttcacaataagtgtcgaaggcttcatagtatatacctatgaccttgattgtgttttcatcttggacgggctcgaaagtagcgccttataatggaaaatgtcattacagaaaggatgggtggaattcatgatacaaatcgtactttcaactctattatccgttatcgttccgctgtccattccagtgatcgccggatttttactcggaaaattcatgaagctggaaacgaaaccgctctcgactttgtatttatattttttaagccccgccatgattctggacacgctactcaaagcacagctttcttggcatgatgtagcgcagactgccgccttttcaatactgaacctgctgctgttgtggggaattgcacaattagcggggagaatctttagactgagcactccggaaacggctggacttaccttaatctccacgctgaccaatagtgcaaattatggcctgcctcttattttacttgcctttgggcagctcggtctggataaagcctccgtgtatgtcgtcatccagataatcatggtcaataccattggcgtttactttgcagcccgctctgaattttctgttcaaagtgctgttaagtcggtgttttcacttcctgcgatctatgcagctctactcgccatgggactgcggttgctggactggcatcttccctcagggattcagtcaggcgtctcgatgattgctgccgcttattctccggtcgtgctggcgattcttggtacccagatggcttatgtaaaaatattcaagctggagtcgtctattaaaaaagccagctacgccggactaacaattcggctactgatctccccgcttgcggcttgtcttgctatgctgatactgggaatttcaggccttttgttctccgttctcttcattctggcctcgatgccggttgctgtgaatgctgtcattttagcagaaaaatttaatgcatcgccaaaactggtttccacctgcatcctgtggagcacgcttgcctcattcctgatattgcctattttgattatgttggtagcaggttagcgagaaaaaaagactctctacaccatagagagccaagcacgattctgtctccattctacttgcacaggcgtttcaaaaaaagcactaagcgtttcactgcttagaatatcagtcgttttacctttggcaaataccgtgccccggcggattaaaatcgtatgcgtgtacatcggtagaatttcttcgatatgatgtgtaacatacagtaaattcggcgaagcctgcgactccgataactggcgaatgctatctagcaatgcttcccgggagaaaaagtccaaaccattacacgcctcgtccaaaatcagtagcttgggcgaggccattaatgcgcgggcgataagtactttttgcttttctccctgtgagcatccctgatacaaccgatccacgagatgagcacaccctagttgcgtcataagctgaacggcctgttcatactctgtatccgtcgtctggtcataaagtccaatggaggcaaatttgccgctaatgacaacatcctgcgtacgctgactcccattaattctttcctgtaaagaggaactgacccaaccaatagatttgcgcaactccctcagatccacatctccaaaggtatgccccaatacaccgacactacctgtggttggccatatgtaaccgttaatcatattgagcatcgttgttttacctgatccattcaagccgagtacagcccagtgctccccctcagctacctgccaattgatttggtccagtatggtacggttatctctcttccagcttacattattaagttcaatgacagaattcatggctgtacaccctttctattcgtcgtatcatcagatgtttatacgcatagtaaagatcatcgttagtacggctagctcctcttttatgtaagcatagcacagggtcacaggttgttcaattttaaataacccactccattgttcctataggagtgggctcaacatgtactgctcatgtaaattctcttgctccatctactttttcttacgctcgcgaaaacggcgtaccttcatcaaattaccacacatcttatcgtcgcaaaatcgctttgaccgatttcgggtatcatcgtaaaatacccatcggcaatcggtattatcgcaaatacgaattctggagccgccgctattgacaagtgcctgggcaaaatcggctacaacctctgccagcacttttttccaaccatttgtcacgggttccagcacaatgctgaaatgctcatcctgttgctttaataagcgagtgaccggccccccttccatcatctttcggttaatcatatccaccagatcagttgtcatttgtccgccagaagtcaggtgctcagcgaagctacgtaattcccgccggagaatttgcatttcttcgatatcttctgcactggctgggaccgaagcggtaaattgccaccgcataagaaattcattttgccattcgggcttcaacaaacgatcttctgaacgtccgctccctctccaatcgtgccattcgctgtttacaaaatcagtccaaagtgtattcaaaagagttcctccaccgtccgtaaccactaaaatcattttaactggttgcaaatcttaatttgtcatgctacattgttaattgtaacgatttatcctatgtttagctagttacatacctacaaaaggagttgggttaggtgagccgagatcgagtaaatatgctggtattgcaaagagaaaattcatgggataaggaagaatggattgttcctcttgccgcagcacttcagggtgtgaatacacaggaggccacttggacaccaccaggtggaggaaacacgatttggcaaacggttcgtcacattaattattacaatgagcgtattttgagacgtttaactgaccgccctataagttcaactggaataagcaatgatgagacattcggtccgctaggggatgctgaagaccatgaaggatggcaggagacgctaaaagaagcggaagctcttgtaaaccaactgcttgtcgccattactgctctgaatgatgctgatctggataagcctctcggctccgacactctcggtgctgaattatcacgatggacgctgcacgatgcatatcatagcggacaaatcgtacttatacgcaaacaattggggacttggcgagtttaaaatgtaatcctttagtcaagatattttttgttttttagaatctttaattacattcttatctttatttttaactttattcttgtctttatttttatctttatttgtatctttgcttgggacggtaaccttccttttttcattagctagtcgccaatagcttaacactttacggtacatggacttatctgttaattggttaaagatatatgggtccggcttcgtattcacctcaataatccacgggataaagcgatgatccagtccaatgtccacaccaatttgccggaatttcggatatgttttttgcagttgtttggcgatagtaagacccagttcatttagtttcttgaccagctccgcctgcttgctttgcgataaatgggattttagtaactgctccaaggccatcggcttaccaccactatgatagttggtcacgattttacggggatgaccaagacgtccaataattccggtagactcccatagccctttttcattacgctgcaccatgacccgaatatcaaaataacgcatttgatggcgtagtaaatggattcccttttgaatgagataacttttcttccccgtatgtttcgataggctgatatatagtgcatccaaatgtttgaattcttggcgcgtttcctcatattgataggcgaaacgctggctggtctcctgctctactctcattacacctttaccaaaggtacctcgctcgggttttacatagaccataccgtacttctccagcattgatttcaaatttgctttattatatttgcgagtttcaggtacatacggcttaatgctgccatgctggagcaacaattgggttttatgccatttgctgcgcaacgcctgcgcttgtgaagaattcacttgcccctctcctctctactctcaggtagaacgctcctgttaaaaaagatcaatctatcgtatgcgctaactccccattcgaagcttcatcagccctgtcctgcatagaaatggacgtttgaccttgcccggtcgaaagcgcctgtccaagcatacgatattgggagacgctgggagcgtatatttgcacatatagggagtgaatgacatgtcagcgcaatcggatgggccacggaagggttcccttacaatcgatgttctgattccagcaattgataaagatcttgccacactaccgctggtgattgacagtctgcgccgtcacgtgcagcaccgaattggaactatttatatcgtctcaccgcaaagcaccgggattcgccgtctgtgcgcaaacaagaaatgtacatttattgacgaaaaaacggtgctgcctatcaccaaaaaacatattcattacgggacaacgcgctgggaccgctcaggctggctgtatcaacaattactcaaaatgaatggcgacaaaatcagtaaagcctctttttttctcgtcattgacgcggacacgattttgattcgtccacatacgttccgtaaagacggaaaaacgattttttactaccgcagctggagccagcctgagtattttcgcacctaccacaagctgattggcgttaaagcaccctcaccaaaatcctttgtcactcactatatgctttttgaaaaagcgcggctcatccagctcaagcaagttatcgaggcccgacatggaaaaccttggtacaatgcgattatccaaagtataaaccggacaaaacagtttgggttttccgaatatgaaacgtatgccaactatttatacagcaataagccttctcagatgattttgcgcaagtcattgaataaagcgcttcatagtcgggcttcttccctgtcgcaaaaacaattgggtgtcttggccaagagctatcgttccttatcttttcatcaacgcaaggtgtaccagcttgctccaaaaacaaagattgaatcatcgctaaaatagttcttaaaatcctgcaaaatgatgcaatccaaatggatctgcattgaaggaggaaacgtccgtgcgcatcgtattgttatgcggtggtgctggaaaacggctatggccactatccaacgaaatccggtcgaagctgtttctccagttgttgcccgcccctgacgggcgaaaggaatctatgctcggccgggtgtaccgtcagcttatcttagccgggctggattcctctgccctgcttctggctcatcgaagccaggtaaatctagcctttcgccatacagaaggtcgtctgcccgttttgggcgagcctgccaaacggggaaccttcaccgcggctgcactggcggctgcttattttcacaccagaggcatggggctggatgaagttctctgcattgctccagcggacatgtttgcaggggaggatttcttccatagcatagcagcgctctccggcttattgcttgagagcggagccgatttggctatgcttgggacaaggcccactcatccctccgaccaatacggctatgtcgttccgggtctgcaaatgatacgggaagggaaaccttcttatgcgcaagttgctcgcttcacagaaaagccggatcattccggggcacagcagcttattcatcagggtgcgctgtggaactgtggtatttacgcttttacattacggtatatgctctcctgtatggagcgaagttatttgccgctgaacgataaagcattatgcgcaatgtatgatggcctcccggttcgcagtttcgacgaggagattgcagagcgagccgaacatgccatcgtcctgccctacgatggcgaatggcacgacatcggcaactggcaggctctaacagagcagctaaatagccaagtgatcgggcgtggacagatcagtggccaaactcatggcacgtacatcgtcaatgagttgccctatccacttcatgtcattggtgtagaagatattattgcagctgcgagccccgacggcattctcatcgcttccaagagccatgctcacgcgatcaaggaccagctaggcaaacttcaactacatcccaagcatggcgaaacctcttggggcagttaccgattgctggacgaatttgatcatcggagtctgaacgatatactggccatacggctgacggtactgccagatcaccgcttgaatggccgtattcacggcagtggacttaaagtatggacgatcgtgtccggccggggagaggtcatgctgaacggagaacgttttgctgcagcaagcggttctgtatttagcattccggtcgatacgtatcacacgatccgtgccgatctggatacaccactggagctaattgaggtacgtctggggaacagcttagtgaacgccttctataaatcagaagcctgacaacacatagatataatatcagcacaccacggattctgaacgaaggtcgcacataaaaaatcgcttctgagcaaggtgaaaaaatccttgctccagaagcgattttattttgtggtgccatattttcttgaggtaaccgttctaaccttggcagataaatatacctcgttgtctttgactattccggcttcttttaaaaaatgctggacgatctccaactgatagtgtatgcgtactttcttgggcaggctccaacccgtctccacggtaaccgcgcgtgcacctaaaatacgggctgcagcagtgcgggaggaacctggaagctcatgcaaccgaatgttgaaatgtcggttgctcacctggatggagcgattcattcgcttaataatccgacgaaccgtaggaaccacgggattggccttattggagattagcgtttgaccaagcaccttggcatccttttgtgacaatccgttggcctcatgcaagtcgagataccattcaggttgatgcttttgtgttaatttgaatagagcagcggaaagtggttgtgttgccagctgcttttttttgcgcggaaaggttcgattaagatcaggtattcctctaatccgtttgcggtaagcctcttgatttacaatcggtacaattataagcttaccatggctaaatcgcagtttttgctgattcaaaagctttaccaatttctcagcagctcgtatgcttgctatttctttaccatgtattcccgccaccaccatcacacacggacctttctgtccccctgtaactatataataaggagttgcccaagagccctttccgagcatatatcgtttgacctgcatctccttcacctccgtataggctgccgttgtcctctcttctgttctcgccgacggatgatttcacggtataatcttaagtagttactggtcatctgtttgttggtaaatctttgagtcacatacaaacgcagcttcgctggtgacgggtagttcttttgctgtgcttttcgtgccatttggctaaccgatttgcaaatcaactgcggaaagcccgataatacctcggggacggagccattttttaatgccagcaccggtgttccacaagccatggcttcaaccatgacaagtccgaatggctcttcccacagtgtcggaaacaacagacattctgcatgtttcagcaacttctgtttctgatcgcctccaactgcccccacatagcgtatattcggattgcgctgaattcgtttctgaatctctttacggaaaaattctggtgctttgataggacctgcaataagcagtttttttcctgttcgttctgcaacctgaatggcctccaatacacctttatctcgaatgattctgcccatgaacagcaagtagccacgcttctcactgctgaactcgtattcatgtgtgttgataccgttatagatataaaaacctttgcccctgcccatcagctggcgcgctcgtttacttacatatactgggtttttaccgtgtctcttcactggaagatgaacggtgcaaactgatggacaaggcagcttcctacgccctacagaagaacgaaaggtatgatcatgaatgatatgtgtgtcggaaggcatatgccggagtacatattgggggatctgactatgtttcaaccccttgggatagggaatcaatcgcgcactgctcctgctcccacgtgcggcaaaaagagatacatgatgtcctcgtctcaccaattcctccgttaattcatacacgaccttttccgttccgcccttgttggagggtaccggctgtgcatcgggatagttggaaatgacctgaacaatggttagacgtggttttttgagtgctttattctgctttgaagccatacgaattccccttcctgaccggaaatacggtgtgatccttacaatgtcaacgggaatcagaacatactcccgtacaggtaaattgtagtatataggtatgtatattttgcgtgattgcttgtgccaatcgactgcaagtcgatttttgtcatacgagcctatctataagtggaatctatacattttgtcaagccaaaattaaggaggaaattctcatcgttttctaataaatgaggacaaagcgttggggtaacaggtttgtaaccatgagtggtaaattccggacattttatttgtgttattgtcatttcaggacatcaacacaatacgaataacggaggaatttatatatgaaacgtacttctaaaaaattgtggatgggtatttgctttactatgactttagcattgagcgcagggagcttcgtcattggaccagccaccactcacgccgcttcggcaagtaaagctgatcggattatttctaaaggctcccagtatatgggcgtacgttatcaacatggagccccagctggcagtacaagctcttttgactgctcttcattcactcaatatgtatttgcacaaaatggcatcaagcttccgcgatcttccagacagcaatcaactgttggcgctttcgtaccgcgtagccagctaaaaaaaggcgatttggtctttttctatgcgccaattcatcatgtagccatttacatggggaacggcaaaattctgcatacgtatggtaaaggcggcgtaacggttacagatctaaattcgggatggtggagtcgcaattatacaacagcacgtcgtgtcctttagcataaattttagataacttccatccaccgaatgcttaacttacaagtaacaataaaaaggctgttccgcgagtagatattctactggagggacagcctttcctgttgtctttggggcagcgtgacgatgactaccgttccttctccttctaagctctccatacgtatcgtaccctgatgggcgtctgtaattgccttggcaattggcaaccccagcccggttcctccggttttacgatgtctggagctatctacccgataaaatcgttcaaagacccgcttgatctcgccctcaggtattccgatcccataatccttaacctggatatagacatccttttcatctgtagataaccctatttcgatctcatccgagctgtattttaatgcattatccagcaggatcactagcaactgcttcattttcgtcaggttggcatccagccaaatttcgttctcttctgttaaaatagaaatttgacgatcatgtacaggcttgagatgcgctactacctgttgacaacaaccgatcatttcgatccgctcatgcggctcagggtctttctgctgtgaggaggcaagagtcagcaactgctgtgtcatcgtacgcattcgctgagtttcttcatagatcgattcaatggattccttacgaatctcctcgtcacgcgtgccccaccgccgcagcatgttggcatagccctcaataatcataagtgtcgtattcagctcatgtgaggcatctgaaacaaactgctgctgactctgaaagctttcttctaatctctccatcattcggttaaaagtagtggtcatttgggacaattcatcttgattgtgaccaccaacggggatttttttgaatttcaagcttctttctatttcctgcatcgtttgaatactacttgaaatcggtagcaatatcgcattcgccaaaatcgtgctccctaccaaacttagcaacatagcccctatagtggatgtgatgaggatcgtatttaaaatatcgagattggtttcgagtgcatcccatttttctacaatctccagggtccccttatgattaccctctggagaaagcacagggagatggatcaccaaaattttatgaccctgtacatctgtcagttgagaactttgtgaagtgttaaaacgtatatcgcccagcttaaatcgggactggcgacttacttcatacagaagtcgggattgccgatcaaacactctcagagtggtatctccagaaagctcatctttcagtttggggccccatgcattctttagaatcatcgtgggtcctgtttcggcaatgatttcagtccatttattttgcagcacttctctttcatttcgcgtagcgattttgacgaacaataggtgaactgtaacatccacaaacaggagtatcgacatcactaaaatagaactgagtagggttattttggtccgaagcttcactagtcttcctcccggatgcagtacccaacgccgcgcacggtttttatcaatttctttttgtatccatgatcaatttttttgcgaacataccggatatacacatctacgacattcgtatcaccgacaaaatcaaatccccacacgtcctgaatcatttgatcccgctgtaatacctgatttttgtgctccatcagataaagaagcagatcatattcttttggcgtcagttcgatttgattgccctcccgcaccactaaccgtgtcttgcgttccaacaccaagctatccacttgcagcctagacggcggcttatcctcttcctgtaaagcggtagctgttggctccatttgatgcctcatactggcccgcatccgcgctaataactcctcgatctcaaaaggcttcgtaatgtaatcattggcaccttcatccagacctgaaaccttatcaggagtcgtgttacgtgcagtgaccataattactggtgtatgattgtccacttttcgaatctgctttagcacctcgaccccgttcatctccggcagcattacatccagaatgatgatatcccatttaccagctagagctttttccaatccttctctgcccgtctgtgcgatttcaactgcatatccttcatgggataactccaactgaagcaatctggatatcttctcttcatcatcaataaccagcaccgacttttccattgcaaaaccacctattttctatagaaaaaacatatgagtaatggaaatgacattcattttttatttgattttaagcttttatccgtgtagtcgctctataatataactttgttattcaattttttgatgttaaggagtaatttattcatgttaattaatgtagactatgctttatttcactggatcaatgaactggctaattccctcgcctttttgaatggaatcatgcttttcttggcgcaatatgcaccgtatttattcggagtggctttgctgatttactggttcacttttaaaatgccgcatcggatgatggttttagaagccgtcataacggtttgtatcggctttgtaattagttggggccttggacatttgttttacagagatcggccttttgtcggacattcagtcattcagcttattcatcatgatcctaatgcttcattcccgagtaaccatgcccttggatcgtttgctctggctacaattttatggcttcatcatcaaaaatttcgtgtcctctgggttatcttggctgtactcatcgcagtatcccgcgtgtggaccggagtgcattatccctcggatattttggcaggtgcgcttattggtgcaggttgtgccgtcggcgttcatcatttcattcgaagccggaagcttcctggcatcttcatgcaggcggctattatattttatgaaaaatgggagcagaagctggggctcaagcctggtgaacaggccagaactaagatgaaatgagcacacttcctctgtccaaattaaaagcagacgctaaagcgtctgctgctttattatttatgctacccgttatgctgtcgatttggagcgaagtggcagcattcgtcgttcttcgtaccgctgataaaaccaaatacaagccgccatccagcagccactcataaaatatccacccacaacgtcgctcggataatgtacgcccaaataaatgcggctcgtcccgattgctacaatcagcaggctgctgagtacaataagaaggatacgccccagcctagaaggaacatgcttccacactaaaaatgtcagcgccgcatacatgctgaaagctgtcatggaatgtccgcttggaaagctgtatccattctcttcaataatacggttaatctccggtctcgcacgctgaaaaagcaattttagtatcgtattcagcattaccgatcccaatacaccagccgccaaaaaaagcagttctctgcgatgtcccaatactctatagagcacgaacatggcaattaaaatgatgatcgcaactggaatcccactgccgatcatggtaaaaaatttcattagacgggtcatgacgggcgactctagttgtccaatagccgaaataatttcctggtcaaaatgccgaacttgatggtcactcacccataatgcgaccaagccaaaaccgaatgcacatactatacatgtgagcagagccaaggaaatgggcagctttgttgatgtttgcttcattttctatagttcctccataatattcattgcgtgataaaacaaagttcagcattagcttacatataggtcttactttgcccacttttctcttatcatttcattaaaagaattagatgcctccctgttggtaaccactgccactccctttttaccaacgtaacagcgtcttcgatgcaacgttgaatgagttgagagcctaatcttctcatactagcctctcccaactttagtatcactttataatataaggatttcatattgactacaaaatcgcaagcggaatgtagcgaaaaaagcagcatcaaaaaagaacgccattcaagccttataaacggctcgaatgacatcctatgattacacttgacaactacaagcgcaattcccaagttaaataaacatcatcttctaattaggttggtgtgacttctccaagtttaaccttactctctgcttcctctatcggatagcgtctgcggaaccacagcgactgaagcagcaaaaaggtgccgcttaccgtccaatataatggcatggcagcaggggcattaaaggaaaagacagccatcataatcggtgaaagataacccatgatcgcaaattgcttgcgctgttcaggcgtcatctgaaactgagaaagcttggcctgtgccaagtatacaactgcgacgacgattgccaaaatccagtccggctgtccgagccggaaccataggaaggagtgagacgccaactccggggttaagcggattgcagtgtacataccgctcaagatcgggagctgaatgagaataggcagacaaccgatattaagcggattgaattgatgctctttgtaaagcgacatcatttcctgctgcatactctgctggctggcggcatcttttttgttttcatacttcttcttaattcggtccaaatcgggctgcatggcgctcatcttgcgcttcatcccctgctgggcacgtgtttgacgcatcataagcgggagtaaggccagccgaacaatgaatgtcaaagtcataatcgccagcccaaagcttccaccaaaccattgcgccaattgctgaataagccaagaaagcgggaacaccacgtaatgattaaaaaatccgggtgtctgtgcatttatctccgcagcattcgcaccacaaccagacagcagcatgaccaccgccaacgctaccattaatccaaatatccgttcttttttaccccaaaaggtgaatcccttgaatcgtttcatatgttcctcctcgttgattggctgtgccatcgttcaacgagggagaacaatcggatgcatcttcatccggtgcttccttacgccggatatgtcgggccagccggacaggcatgtcctgtccacgggcagacatcggcatctgtggagaagcatgagaccttacgggcccgccttcgacccagcattcgggtacattgccgtgcaaatgagcgagatacgtataagtcactgtgcacagtaagccgattgtaaataaataagggagtaggtcctgaagctcaaacaagggatttcacctccttcggtatgttgctacaattatagcacgaaaccggacaagcgactaatctttaattagagatacaggttggatcacaagcaactgaatttaaggatttatgctcaaaacaaccaaaatgcaaatgcaacatgaaacttttggttttttttacagtctaatcaaaggtgactttctgaaatccttactcccctattaaccattaaaggagccagcgcgtatgagaaaaacgatacataacactttgtttacaggattggcggtagccagcattgggttgcccttgatcagcggtggattcgctgaaaaggcaagtgcagagccgtctgcggtctccatgagtaacggcgcttatagcacctcaatccaagcacctgtgatcaaaccttcctggtcttttcccgttatcccaatcgatagaaaccgatatccagatcaggcggtaacaatagcggaaaacggtaaagtattcgcggttgactcgaaccatagactggttgcccttgaggccagttcgggtcggaaattgtggcaatatggtgatcagcttacccctgttttaacgtacaacaaaggtatcatctacggaatgacacgaagcggttctatctatgccgttacagaagctggcaagaaagtgtggtctactccgctgggatttactgaagcatatcgtattcagcgcattggtccaactatatatattatgcaatcggtgcaaacggcagccattgatgctgtcagtggcaaggtgaagtggaaaatcagtgaggataagaactcatacagtggtttgggcgaaataatggaaactgacggtgtgcttatccgcaactataatgtacaaggcagcctgacctttgaacagattaatgcctatgacgctaaaaccggcaaaaagctttgggacagctttagaacttcctttccactggtggttaaagacggaatcgtatactctgttgccaacacgtttatgattgatgatgacccggtaaaccataaagttacgatcgcacagtacgacctcaagacaggtaaatccaaaggagatcgtcagtatcgctggaccgagcctgaaaataaagacggtgtttatcgatctggaggtgtatatggttctgcttttttgtacggcaaagatctttatgtctttcagggagagacactagcttcctatgatttttggaactacaagccagacagcaaacctgctcgcaagtgggcgcaaaatggctatgatcaacttgttcctttattgtctattcatgaaggtcgcatgttctaccaagattttagtacatccagactgactgctatgaagctgtcctcaggtcaattcattcattacgacggcgataatccgaccgttcaagctgacgtattcggtaaaggagtctatgtcgggcaatcagatggcgtatttcatggctatgatttgatgagcttaaagcccgtgtttgctgtcaacacaggctcacgctccttcggtccaacgctcaaatccggtggaatgatatttattcaaagcggaaaccgtctgcttggcgtcaagctccctgcttctttaaaataaggccaaagatttcaagcagcattctcgctggaacagcaaaaggttaacggatagcaagcatacgattcaatgctagtacagcatcctgtctgatctgagcatccacacgaatcacacccacaggctcaccccgatcaaactgctccattgcccacagcaaatggggaagatcgatccggttcatggtcagacagggacacatatcgggattgagcgattcaatctgctgttcagggtactgctgcttgattcgttgcacgagattcatttctgtaccaacagcccattgagttcccggctctgccgcgcgaatggtatcgatgatgaattttgtggagcccgcgcaatctgcgagctgtacgacctcataagagcattcggggtgaacgatgacccggatgttcttatcacgctcgcggacattgcgaatgtgatctactgtaaacttttcatgaacagagcaatgtcctttccataaaataatttttacagttgccgggtcctgttcagtctcaagctgatcggtcattggattccacacggccatttcatttagcggaattccaagatcgtaagctgtattgcgacctaaatgctgatccggcagaaacaaaatacgttccttttgcttcaacgcccactccagcacttgcttagcattcgaagaagtcacggtagccccgccatgccgtcctacaaaggctttgatctctgctgtggaatttacatacgttaacggaatgatcgtatctcctaccaactcctgtaaatgcttccatgctcgttctgtctgctccacattcgccatatctgccatcgagcagcctgcacgcatatccggcaggacaacagtctgtcgatcagtagtcagcatatccgctgtctccgccataaaatgtaccccacaaaatacaataaactccgcttcctgattttgtgcagccaattgagcaagctgtagagaatctcctgttatatcagcaaactgaataacctcgtccttctgatagtgatggcccggtatgagcagcttgggtccccatttttgtttcagctcggccactcgctgctccatgtcagcaaccgtcagtgtcttataatactctggcataagccctcgatttccttgtaaaacgtcaagcatagacattagaatccctccatatcgatgcggctgatcgttcacgctctcacgaacagataaccgctttgtgtacatacatgtttacaagtgtcttgacacttatatttacacatgcctacaataatctcaagagtttttgaatggaattattttaagcagggaggatttggtgtgatttatctggactatgccgcttccacacctatgtgtggcgaagctttaaatatgtataacgtattaaataaggaaatgttcggaaatgccagcagtctccatgatgcgggcggtcaagcagcctatacgctagattacagcaggcaacgaatagcaaatatgattagcgggcaaaaggaaggcatctattttacaacagggggaacagaatccaatatgttggttgtgcaatcgatcctgaacgggttgccgcagcataaaaagcattggatcatgagcgctttggaacaccactcgatgtacaaccttgctactttgctggaacgtcagggctatgaactgaccattgtgcaaccggatcgggaaggacgaatgacccgcgaaactcttttacctcacctgagagaagacaccggacttgtctccgtacaacacgctaattcggaaacgggactggttcaggaccttgctgccttatctcccctgctacgcgaacgggggattttgttgcatagtgatgcggtacagacatttgggaatattcgcgtagatgtagaatccatggaagtagatgcactctctgtatcaagccataaagtgtatggccccaaaggtgtcggtgctgcatatctcaaacccggaaccccgtggcgtcccgtgtaccctgatacactacatgaaaacggatttcgtcctggaacggttaatgttcccgggattgcagcctttgtcgcggcggcagaaatgatgaccgaacagatggagtcgcatcaggagcgatatactaccctgagaagacactttattacgaaaatccaggaaagatccattccgttacgttgggccgtacaggaaagcgagaataaagcagtgcttcatcatatcgtaggatgtttttttcacggttacgagggacaatatgttatgctggaatgtaatcgcaaaggtgtctgtatatcaactggaagcgcatgtgctgccggacaccacgatccttcgcctgccttacaggcgcttggagcatccggccgtgaagcgttacaatttatccgtgtttctttcggaagaacgaccaccatcgaggaattgaatgtattggtagatattttgacagacctgacgcatcgaaaagaaaggagcttatcccgttgactgaatctttaaaacggtcaggtacggatcgtcgcgaacagctactgttgtggctcaagagcgaatcaccactgaccgggagcgaactggcgcgcagatcctccgtctcccgacaagtaattgtccaggatatttccctgttaaaagcaagccaagagcctatccttgcaacaagtcaaggatacatttatatggagcctgcgagtcaggcaactcccttagcctcacgtattattgtgtgtaaacatcgacctgaacagacagaagaggaactaaagctgattgtggactacggtgtaagtgtgcaggatgttattgttgagcatccagtatatggggatctgactgctccgatacgggttggcactcgcaaggaagtggacgattttatccgtaaaatcagctccacccaggccacttatttgtcccagctgacgggaggcatccacctgcataccttgaatgcctcggacgaagataaaattaatgatgcctgcgctgcattggagcaagcgggcttcctaatgacggactaacttagtgcgcttagcggagcaaagaaaatcctgtccagtatgtggagtgcaactgtgctccacatggacggtattgtaggcagcgagaaataaaaaatcccggccccctcatataagggaatcgggaatgaactatgtgagcttaatttcaagcagctcatatttaattacagccatgggtgcatccacatgaatgatactgcccacttcttttcccaaaagtgccttgcctaaaggactttcataggaaattttgttatcaagaacatccgcctcagcaggacttacaattttgtattccatcttctctgaaaattcgatgtcattcagaatgacagtcgatccgatactaacggttctaagatctaaattactctcatccacgacccgggctttggtcagcatcttctccaatatgagaatgcgggtttccataaacgcttggtcgtccttggctgagtgatactcactattttctttcaaatcgccgtagctgatagccaacttaaggcgttcggctagctccttgcgttttacggtcttcagttccttaagctcatcctccagcttggccaatccctctttagttaacaatacttcttcattcgacatattttatctacaactcctatttcagcattttgcttaattccaattcaacgctcaaaaatacaataaacgaactaaaccgtttcagtctaaacattgctgattgaaaacgctcctgggatttatgcaaatgctcatttggcttgctttattgtagtttactctaaatcggaccaacatgcgaaataaattactggataacagtagccaactgccttcagccaggatgattcttatagtaaccaatgctctcttattcgcatatcgtatgatcataacgtatattgatgagcacatggagtgccgctgtccttgtctcgaattttgtgaaaaccaggcaggagcagtatatggcgggaggaagattcaatggcttccttaggaaagaatggtaatgggaacgggaatcgtaaatccaaatcccccctcaacggtcaaaagaaaaatggattaaacagtaattcggctatcttttctgcgcttcaaggaaaaaatgtggaggtcctcgtggcagccctcctactaacaggaaaactaaacgtcgattccgtgactttatacagacaagcaacattgtttttaggactcacaggaaaatacaaaacactagcatccactccatccaatgtcgataatatggtgaaatttttaaatgataacgggaatatgacactggaccaggtgatacaagccttttcacagaaaataaataattaacaagtggcgaaaggagacttatgcggtgagtgagtttgatggagaatattttgcagaggttgtcattattgtgattctagttgccatgttcttctatggctcctcagatatagagggactttccgcttcgccaacccaatcctaaaataataattcccgcttcgtaaaaaataaaaaagcatctatagactctcacgaggtcaatagatgctcttactttttaacggcccatcatttctacttaatgcccctttacttctacacttatcgtttgactagaaacttctcctgaagcattgactaactcggcccgatactcatatgtacccggcttttgattttggatgttggtgactgcactttgggcctgcgggctttcgcttggcagatgctgagcgtcgatcagttctccattttcatataagttgtattttgtcgcattcgtgccccaccacatgttcattgtaagggtgtaggtgccgtcaccgtcccaattgtcatgagacagcactggaatgccaggggaagcatcggtcacttcgacagttaacgggtcgctggtcgttttaccagaagcgttgatcagttctgcagtatacgtgtagataccattggtcttgcctgtaacaggaatgactgcatgctgtgctccaggggaagcggcttgcaacgattgggtgccaatcagcttgtcgttttcgtacaacttgagttcatcaccattcgtaccccaccacagattcatggtgatgttgtagttgccatccttcagcccggtgtcctgcccgttatcatgcgacagcacaggtttacccggcacttcacctacagcagtcttttcgactctaacggttacaggattggatacgaccgttttaccgtccaagatgacgctggctgtaatctccgcgctcccctcttttagggccttaagttctccatacgtatccagcgaaacggattcatgactgctgatatactgaacagaagcgcggcttaaatcagcttcgctgccatctgtcagcgtacccttgagatgtgtcgctgccgtatccccaatgttgagggtcgtttgatccattgaaagctctacttcctgcaaagctgcgcctgcctgagctgaaaaatcatccagtccacgcggttttaactgataatcccctttgaaaatcgccgaaattcccttcagcttcacttgctgtccttcttgatatggaaaagatgtccgagttaagcctgtacgtgcatcgacgcgcacatggtgacttacttcaccagatactgcatcaaattcaaacgaacctacgggagtggcgtctatcacattacgaatcattgccgtaggaagctcaaccaactgtccttggttcgcatcactgagttcggtgacttgtacagcttccggaagttgtccttctcccgttttttcaattgccactggagcggttaactccagctcactattatacagtgccaagcttgctgtaagctttactcgatccccttggtgaaagccgctttggttctgatatacataaataccaccactttcatcctgcatgtaaaaggcttgaccaccgaatgcacctggttctgttgtcacaacaccctctaaggtcacgactttgccagccgggagattccgtgcttctgcgacactgattcgagctggaaccgtattgccttcctcaggcaacggctgggccgggacatcagccagcacgacggaatgggtcagcagattgctgccgttttgcctcagtctaagattagctgaaccactggttcccggcttgatccgcaccgtcaagtccttataggcatggcctttgccgttggactccaggctaaatgttccgctatagccgtaagaggttggccagcttccatccggattttgaatttgggctacttgattgccgcctgcaacataaatacctgtgctgaatccgctaatcgtgctgttaggagccagttggtcggcagtaacccgaatttgaaaaggctgtgcattgggcagctgctcttgacgaacgatgctgtacactggttgcgcactggctgtagatccgccataggaccctgctttgaatgttcgctgatcccaccatttgtagccggctgcgggagcggaccaaggctcggcttgtggttccgtggaagtctgcggctcttcaaaaggcagtaatgccgtcggctggtccagctgtaagcttttcacttccgtcaggctggtatactcctccttcttggacaaccagtctacgatattaaccagtaacacagcgtcatcctgctccttaaagccgtcatacgttgtcttcttggttcctgtctcttcgcgcaaatattttggcgttgcatcttcgacaggagacgagtccccaatgaaagcagctttgccttgccctaatttcgatacagctgcataaggtccttccggaatgccgcctccgttataaacgccctgatctaccgcgttgccccaagcctgattggttttaggaagatatacgattcccttggctttcgctgggtcgataatcgcgagtgttgatcctgcatgcattgcgacattactcactccagctgtaatgccgaacgcctgcgctggctcgacaatctgattggccgtgatatcgcctaatgcattgtagcgaaagcgcacaccaaactggctgcccagccaatctgagctgactacaccttgcattgctgccgagcttttttcttccgcactcattcccttcgcagggtcttcccatgcaccacgacgatagccattaatgctctccgatccgtcccagcgattcttgttgcggtccgcgttataatgatctccaatgaaaaaaatactattgcctgcttttacatactgctccattgcagcctgttcgctctgtttaaaaggaatattcggctctgccgtaacaaatacatcataattttttagatcattgtaagtaataggcgtagattggcgaagctcgtgtacatcatagccattactcgcgagggcttggccgaagtctgaaaatccaccatccatcacccaatctgctgcgccagctgtctgtccatgtgtattatcaaacagcacttttttaccagcgttctcattgaccactttcgctgcaatgaagggggctgggtccgccggaccttctgcccgtgccggttgcatgctgcccgcaacaccagcgtacaacgataaagtgaaaaccatagcagttgcgtatttgaagctacgggatgtaaaacgacgaaagatttccattatttccctcctgtttgttggtttaaaacccctctggggggcatcagatacaaattttagcattcatttatatttgaatatgcattgttttgtaaatctttaggaataatgaataggaaggaaattccaataaaaaagatacaccgtatgcagcaatgtgagtaccgcaaataggattttcccggcagcccgggttcttctttcccctgtaatcagctttgcgccattcacgattaatacccacacggcaatgagtgctgaaatgagtggcaacgtgcaaattccccagatataccacgcggaatagccatacacgatctgattgttaccatagatgacctgcaccccgagaaaaatcgtatttagtgacgcaatgaatgcaaggttggacgaaatgtgactattcgttttacggatatctctgatcacatatcttacgatccaaatcagcaaggtcgtgatgaaaaataaggaggcggcagcgtagctgacaagcagagtccaggtacggtgccaaagtgtcgtctgcttcatggtcttactatccggggcaaccatcatccacgtaccgttttcctgatacagcaaaattttaagctggccccccttttccacaaacaatccatcgcctgctgcttgaaaaactttgtctgttgcttcattctcatttgggtattttcctttaacaattaacgtatgatcatcttgaattcgcacggtgtatgtaatgtttcccagtatccgaatccattttccccacccatgaacaggattagaatccacctgatatacaccctcaatctctggcgaaagcttcacttgggtggaagaacgagctagtgactgcgaaacgcccttcggctctgagggcagcatttgggctatcgcatggatggcttttccatgaagcagggtgtccgtgtcagctgaattaatgatcacaaaaataccgatcttttgcgacggaatcagtaccatttcggaaataaaatcatcaatttccccggtagcccacagcataggtactcccgtctccaaatgaccacggaaaaatccgtagcctacgccatccaggcgtgcatcgactgcaaattgctgcgcatgcatcacttttaccgtatgtggctggagcaccactttgccctcatacttgccccggtttaaatgagtgatcagataatgggaaaactcgttgggtgtgacgttcaacgctcctgctcccggcagattgatatatgacaaaggctgtttcaaatacgctccatccttccactgatacgattgggccaatgccggatgatttaacggcaattccagcgtcgcgctgggcatattcatcggctggaacagatgtgtacggaggtaatcgttcagtccctgaccgcttacttgctccacgatattaccgatcagaccgtaggcgacattgctgtaatcatactgaattccaggtttgcggatgggaggctgattttgaaaatacgtgctgaggtactgctctgtgggcaaaacgcctgcccgagtcgagctgttaatgtcgtacagcgcttcatccaatcctgaggtatgtgtcaaaagctgatgcaaattgaaaggctgattttggtattgcgtagttttatagctgtggagatagctgttcacgtcttcattcaaatcaagcttgttttgctcaaccagctgcatcgtggcgcttgcactaaatgatttggttagagagccgacacgaacaatggtcttcgctggatcgaatgccactttccgctccagatctgcatatccatagcctttactaaaaaggatttggttttcttgggtcacgacgaccgcagcccccggaatatgcaattttcccaattctgtattcatgatatcgtctactgttttttccaatgaatcaggtgttatgctgtctgttgcccatgccgaagcaatgagcaggttccagagaaacaacgctgctaaaaatgcggataggtagcaaatgcctttattcttcatattgaagtaccatccttacgtatgaagttgattttacgtatgaagttgatttaatgatttgaaccgtgcggtgattgcatagcgagcagatatttatactccgtatggaagccatcagcatggcgctatggaatcatcgcacttcccatcgcgggagtgcacatgataaagcgaatcctgatcgaatcgtgtaagcagaaggcttcttacctgtcgatcaggattcatgtgttacagattaaaaattagtgataccgttcgttacatcatcgaccatagatgttcaagatttatgatgtgccaaatcttgtgtcatgtctttgtccgtgttccgagttatcttttgtattgtggcacggatactttttacattttcttcgataaatccgggttccagtagttcataatgattaccaatcaagctatgctcttcatagctaccttgtgtagcgtctttccataaaagtcgattatctcctgtacccctcaccgtttccgatccaacggcgacaaagccgtgaatattcgcctgaacgctctctgtattcacaagctggttgccatacaccgcgtaagcgatcattttacgttggtacgtttcattcaacagctcacggtaggagtcgggaacctgttccagcatgtcatgaatttcatgctctgtttcttcagctgtgaagggcagggcttccgcccttttgaccgaatcgagcataaaaatatcggatacagcatggccttgacgttccagtatgtcagcaaccttatgcgccagattaccacctatggaataaccaagcagcacatacggaccttgcgcttgcgtgctgacgatcaaatcaacgtaacgtgccagcatggcctgctcatccgcagcatcatccacgaactccaatccatacacgactgcgtcctgatccagttgtttcgccagctccgcgaacgacagcccgtatccaagcataggaggaaagcagaagatggagatcggaccgtgttcattcaatcgaatgattggactatcggccttgtattccagatcggctttcaataatgtgagcgcctgctcttctatagtcgggaagtccattacactacggatgggaagctcaatgtctgtggcaaggtgaactttgcgtataagctccagtactttcaaggaatgtccacccaacgtgaaaaagtcatcatggatacccacttgtggaatttcaagcacttcctgccaaatggatgccagcaactgctccacatcggttcgcggtgcgacatattctatacccgtgtgcagccctttgtccggcacaggtaaagctttgcggtcgattttgccgtttgtcgtcagcggaaaccgatccagctgtacaaatgcggatggaatcatatagctcggcagactggccgacatcgcagctcgaatctcacggatggtcagctgttcatcagcagtaaagtaagcacataattgctgctgacctgctccatcccgcaaagcaataaccacgctatcccgcacggacggtacacttgccagccgcgcctccacctcacccagctcaatccggtaaccgcgaattttaacctgttgatcaatccgtccagcgtattccagtatgccgtcttcacgccagcgaacaaggtctcccgtgcagtacaggcgatctccgtccctccacgggttagcaagaaatctctcagccgtcagctcaggacgatttagataaccacgtgcaactccgtctccgccgacgaccagctcaccccaagctccgaccggttgcaggttaaatgacgaatctacaacatacgccgtcgaattgcagatgggccgtccgatcggcacagaatccagctgttcttccgtaatgtgatacgtcgtcgaaaaggttgtgttttccgttggcccatagccgttaatgatgttcatgtccggattatcgcgcaggacccggttaatatggggtgcagacaaaacatcaccaccaaccagcaaatacttcacatcgccgaaaaatttactatcctgctgtgaaagctgattaaataacggtgtagtcagccacatcatggtgacgcgatgatcccgtatcgtctctttaagcttggccgcgtccaatagatcatccttatgcacaagaacaagctgaccaccattcagtagcgcaccccaaatttcaaacgtagatacatcaaatacaaacgcgcaagtctgcagcattcgggtcgattcatcaaatggcacataatccgtattgcggacaaggcgcacgacactttgatgctcaactacgacacccttaggcttacctgttgaacctgaggtataaatgacataagcagcatgattacccgctccatctatacccagattggaagcatctgcactgtaggacgtatcctcattcagattgacaatctgtccgtcgaaatagcaacgatccagtaaatcctgctgagccagcagcagcttagctcccgagtcctccagcatataacggatacggtcctccggatattgagggtctaccggcacatacgcgcctccagccttcaaaatagcgagtgttcccgtaatcatgtccagtgagcgctccgtcaaaatgccaacaggttcatcggatttcacccctgcatcacgcagcgtatgcgctaaacggttggctgtctcattgagttcccgataggtcaatgattgatgacccaaagctacagcaatatgatccggcgtgcgctctgcctgctcctcaaacagtttttggatcgtgtgattgcttggatatgcagaggcagtgtcattaaactctcctgtaatttgttgtttttccgccgctgtaaccagttccagctcttctacgcaaacattcgggttaagcaaaacttgctccaacagattcacaaaatgcccatgcagacgcttaatgcctgtttgatcataacttaacgcattatacataaaacgaatcttgatgcattctcccggcataacgactaagctcagatcatagttagtctgctctgcagccaccacgttggaaatcgggaatgtatcctgcccgtcacttcccagttcttcgacttgctcatctaccggataattttcaaacaccataatatggttaattaaatcctgtttctggtcggtcaatgcctgaatctcaaacagtggatacgtatcatacgcatgagaagccagcgcctgctcctgtgttttcttcataacttctgcaaaagattcccctgcctcactaagaatgcgaactggaatggtattaatgaacaagccgataatatcctctacaccgataatatccgatggacggcctgagacgacactaccaaatacgacatcactgtggttgttatatttttgcagcacaatcccccagacggtttgtaataacgtattcatggtcacctgatatcgcttagccgtctcctccacccggagggtcaactcacgttccaaaaccgtcacccaatcactagccgtgttgcctccacttttgcgaccggattttacagctggtaatgctgtttgctgctcatatccagataaatagctgctccagtagtcggttgccgccttggcatcctgtgcttccagccattcaataaagcggctgtacggcactgccggtgccagctctggtactctgccctcctgaagtgctgcatagctttcaaacacttctttatttataagggacaggcaccagccgtccatgacgatatgatggaagctccatacaaaatgatagctgtcttctccggtacgtaaaatcgctacacgcagcaggacatcccgacgcagatcaaagccccgtgctttatcttgtagcttgaaatttttcacccaggtatctatttcatcctcatccagatggtgtaaatcttcatattgaaagccgcaatcccgatttcgatacaccacctgcaacggttccgtatctctgccaaaataaaaatgtgtacgcagcgcctcatgtcgccgaaccagaatattcaggctttctgcaaaagcccgaatgtccatctgacctcgcatatcataagaaacctgctcaaaatatgcgtcattcgcagctgcttgactatctagctggctgtgaaacagcatccctttctgcatgggggtcagtgcatatacattgtcgatctcacccgcagcacccatttcagataagaggctgtccaacccctccacactcattcctttataagaaatatcacttggggtaagctccgggtgttctttatggatgcaatgcgccaaaatttcacgcaggctcgattccaggaatttcgccaatcgctcgatggtctccgctctatagctcgtacgactatagctaatcgtcagacccagttggcctcccgaaataatgccgccaaaatccagcgtatacgttcgagccatggtcgggctcagcggcatcccaccctcgtatgaggatgattgcaagtcgttccctttcatatcctgatcgaactgtcccaaatagttaaagctgatttcgggatctgtcgtaaatatggctggagatgcctccggtgcctgtgtctgacggtcggataaatatttcagtacaccgtagccaatccctttttgcggaatgccgcgcagtccttccttcacacgcttaatccgttgcgaaagtgccagttcttccggcatatcgagcaaaacaggatattggcttgtaaaccaccctatcgttcgagtaatgtccacctctggtaaaatggcttcacgtccatgtccctctagatttatcaggaaacgatcatttccactccatgcttgcaatgccattcctaccgccgtcaacaacaggtcattaatttctgtacggtaggcacgattggcctgcttgagcagctgctctgtctctgcatgtgtccacaaagcagtaaccgactcactatcgccaatcaatggcttttcgtgctcgttatatccataatcctgcggcaaagaagccagttccgcttgtgcaagtttcccccaatacgctcgctcatgttccatagctggactgttggcataagcgtgcagctgctcggcccatgtttggaacgaatctgttttatgaggcagctgaatcacctgtttacccttggaggcttgatcataagcagtcgccaaatcctcgaataaaatgcgccaggataccccgtccaccgccaaatgatgaatcacgaccagcagatgatctccatccgggcaacggaacagccccagtctcatcagcggaccttcgcttagggaaataccagattgaatttcattgcatttcgcttcaattatcttcgccaaatcttgcttgtttacatcgctgtcattatagtcaaagcattccagatggtacggttcgccttcctctacactgcggttccatgctgtacatccgttctccgacaaactaaaaaccatacgcaatgcatcatggtgcgaagtaatctgatggagcgcccgccgtagtgcctgttcgtcatagccttcctgacgatagagcatgacagattggttaaaatagtgtggttcttccgttggctgttcaaaaaaccagcgctgaatcggtgtaagcactacatttcctgtaacctcgccctgctcggctattcggttaacaggctgaatatatgtgcttagtcccgcaattgtcgggtatttgaacaaatccttcatttccagcttgtatccagcctgaaacaagcgggacgatacttggatggccttgatggagtcaccacccaaatggaaaaagttatcctgtattccgactttcgggataccaagaatggctccccaagccgtagccagtgcctgttggacatccgtctcgggtgccacataatccatacctgtatcgagattgtgctcaggtgcgggcagtgccctacggtctactttgccattcagcgtcaaaggcagtctggagagctgcacaaagtaggacggcaccatatagccaggcagatcctgcgacaaaatgttacgtaagtcgctggcgctcaattcactgtctgttgcaaaataggcacacagctgtttttgtccgtgatcatcctgccgcacggtaacaaccgattccttcacacctggaattgtggacaatcgggtttcaatttcacccagttcaatgcggtagccgcgaattttgacctgttcatccattcttcccttgtactccagtacaccatcagcacgccaacgcactaagtctcctgtacgatagcaatattctccagaccggaatggacttttaataaatttttccgccgtaagctcgggccgattcagatatcctcgcccaacaccgtcgccaccgacgatcagctccccccaggctccgataggttgcagcttcaacgaacgattgaccacataagcggtcgagtgatcaattggacgtccaatgggaatagcctgggtttgcggttctgtaatgtcatagatggtggaaaaggtggtgttctccgtcggaccataaatattggccaggcgaagctgcgggtactccttcaacacacgattgacgtgtggtacagacaacacatcaccacccacgagcaactccttcaaggacgcaaacactccgatttcttgctgcgaatactgattgaataaagccgtagtcatgaacatcgtgttaacacgatacttgtcaattgcctgtttgagcttggaggcatccagaatagtgtcatggcttaccacatacagttgtcccccgttcagcagcgttccccagatttcaaatgtggaggcatcgaacacaactgcgcccaattgcagcatacgtgtattttcatcaagcatggcatagcttttgtttttcactagccgcacgacattacggtgctcaatcatcacacccttcggcttgcctgtcgtaccagaggtgtagatcacatacgcaagatcggaggaagatccccctgttgtaatcgcaattgttccatccgtctgagcgtcacattcagatttgctattgcatcgctgttcatcactcaaatcgatgaccggaatgccgggttcaaaaggaatctgttcacgtcgctgtaacagtaacagccccgcactggaatcctccagtaaataacggatacgctcttcaggataatcgggatcaatgggaacgtaagcccctccgaccttcaaaatcgccagcataccgacgaccatttcaatggagcgttcagccataatccctactcgctgtgtctctggctcggacccgcgctgtatcccatgggaagcgagtatgcgtgccagacggtcggcacgttcattcagctcgcggtaggtaagctgcatgtccgcaaaggtgatggccagccgatctggtgattgcgctacctgttcctcgaacagtacatgcagtgcttgatctcgtggatacggatagtctgctaccgtatcattgaatctctgcacaagcagctctttttcttggaccgaaaccatttctatagccgaaagagcgatatccggctgatttataaccgcattgataagctgctgcaaatgttcagtcagtcgttcaatggtttcccgtttgtacagccgagttccgtattgaagagcacaggaaatttgttctccatcctccactgcgaacagactcaaatcaaatttggccgtcgtttgttcacttggataagatgccaattgcagccccaccagctgctgctctttttgctctatgttttgcagtgcaaacatggtatcaaataacggattacggcttaaatctcgatctacgcccagcttctccaccagctcttcaaacggataatcctgatgttcaaaagcctttaacgcgttttccttgacctccaacacataatcgcggaacgttttcccgccttctggataattacggattgccagtgtattcacgaacatcccgatcagactgccaagatccgcatggggccgccctgcaattggcgaaccgacaataatatcttcctgcccgctatagtggctaagcaaagccgaataggcagccaacagcaccatatataatgtcgattccgtctgcaccgcaatgctttttaagccttcgctttgtcgttggtcaagcgtaaattccagcacatctccttcaaagcttctcaccgctgggcgtggataatcagtcggtagatcaagcacaggtagctctcctgcgaaggtattgagccagtagttttcctgttcccggtagcgttcactttgctgctgcttctgttgccaaacggcgtagtctttatactgaatgcgtagcgatggcagcgtgtcgcctgcatataaatgaataaagtcctgaattagtacatttatagaggtgccgtccgaaatgatatgatgcatgtccatgagcaaaatatgatgctctgggtctgtttcaatcaaaccaactcggaataacggggcctgccccagatcgaatggtttgacaaagttacgtaccagctcatccgtttcctttggggcagctccgtgagcataggtcaattccatgcaaaaaggaacctcgtcatgtactcgctggacaggttcaccgttcatggtctcaaaacttgtgcgcaatgtttcatggcggtcaataagctgacggaacgcgttatccattgccttgtgatcaagtgaaccggtcagagtcagggcaccaggtatgttatagctaattcccgctccatcaagctgattgaggatatacatccgtttctgagctgaagaaaccgcataaaatggcttattctccgtaacagggatggattcataggtggtttgctccagtgcttcaataacctgcgccagctgttcaattgtcggatgctggaacagatcctttagctgcacatttttatgcaattccttatagatgagtgatatgacatgtgtcgcccgcagggaatgtcctcctgcctcaaaaaagttatccttaatcccaacgcgctcaagctccagcacatctttccagatgctagccagttgtgcttgtaattgattttgaggaggtacatattctgcgcctgagcttacacctccctctggttgtggcaacgctcggcgatccaccttgccattgggcgtcagtggcaattgctccagctgcacaaaatacgacggtaccatgtagcccggtagctcctggctcaaagcactacgcagctcacttgtcgctacttccgcatgggtgaccacatatgcgcagagcagtttttgcccctgctcatcttcatgtgcaattacaacagcttctcggactgcctccagcttcaacagctgtgcttctacctcgcccagctcaatccggtagcctcgaattttcacctgcgcgtcgattcgtcccttatattccagcgtcccgtccgcattccaacgcaccaggtcccctgttcgatagcagcgttcgccgccacggaacggactgtcaatgaacttttcggtcgtcagttctgggcggttgcggtatccgcgagccaccccgtcaccgccgacgatcagttctccccacgctccaacaggctggagctgcatcgaaccgtccacgacatatgccgtcgagttgtggatcgggctaccaatgggcacagatgccgattgaacgccggtaatggcatgtgtggtggaaaaggtcgtattttccgtcggaccgtagccgttaatgatatgtagattcggatgggcctccaatacccggttaatatgcggtacggacagcacatcaccaccaaccaatagctcccgcatcccctcaaatagttccaagtcctgctgggatagctgattaaagagtggtgcggtcagccacatcgtggtaatgccgtgattgcggacaacttccttgagcttgggcgcgtccaaaataacatcctgactcaccagcaccagctgtccaccgttcaataacgcaccccaaatttcgaaggtggacgcgtcaaagacaacagacccggtctgcaaaatgcgcgtgtcggcattcaagcgtgcataatttgtgtttgtcaccaaacgcacgacattacggtgctccaccataacccctttgggctggcctgtagtccctgaggtgtacataatataggccaagcgaccagctgcgctcgctttcggttgttcttcagctgcataagcgtgctgtatttgttttgcttgttctgattgcgtagctttggattgcatgttttctggttgtatggttgtcgtagaagcaagttcgggactggcggaaatggagtagaacggatctaggcagtccacgtatcccggatcagtattcgttccgtgatcattcggcaaaatggaatcataacgatcagcatcatccgttccataaattgcagcatcgctaaggtcaagcaccattcccttaaaatcagtgggccgatgttccattcgctgcacgagcagtatgtctgcaccggaatccttcagcaaatagcgtacacgctcatccgggtaatcagaatcaatgggtacatatgctccacctgctttgagaattccgagcataccgacaatcatctcaatcgagcgttcagctacaatgccgaccgtctgctcggtgcggattccctgcttacgtaaagaatgagccagtcggttggccttttgattcaattctgcataggttaggctatcttgcccacacactaccgccacctgctctggtgcctgcttcgcctgtttctcgaacaattcatgaatagacgcatgacgtggataatccacatttgtatcgttgaaggtatgaaccagctgctctacttcttgctctgacagcacttgtgttgtggaaatcgccaactctggctgctgcaaaacaatagtgtacagccgcagaagctgctcaacaaagtgctcaatcgtcgtctcgctataacggtcgctattatactttacgttcagggagaccgcttcattttcccattgaaactggaaatctagttcagattgtacgtgattcaaaaaatcagaaatatgaatattttgcaaggatactgtggtgtgaataagaggctttccatcctcattacgttgaatgtcaagtaattcagaatagttccaaaaaggaatgttttgatgttcaatagcttcgccgacagaggttttgatttgagacagcaacgctttgaaggttgtgctggaatccagcgtatttttcaataaaagcagatggttgatcggctttgtagcaccattgctagacttggctaccggaatgcccagcagcacacgttcctcacatgtgtatttatgcaataagctctctactccagcaagcaggaccataaacacggcccatggagcgccacctgttatagatgatattctttgggaaatttcagttggaaaagtgagcgtgtacgtatgggaatttaaactcgttacagttgtatttctggacacatggttggtgtatggtaggcagatgatatgatcctcagattccagtttatggctccagtaatttttttccttctcaaataaggctttcaatgacatccctcctgcttctcggggcctgttccccccggttggatggtgcgttgttacatacatgagcgttgtgtcagaaaaagaatactttgcaggcaagggcagtcggacaagccgccgccctctgcacacgcaaagtgaattcattgcatttagaaaacggatttagaaaacaaagtcgatggaatccggcgagaagccttccggttgctcgtccgagttcacctgaatatcgcttaacagcaaatctggattgatcccaacctgggacaggatcgctatcaaatctctggttaatctctcaatagcgtcggctccaaacagcttcgtgcaatattcaaaggaacccttgatttccccgtcttcatcactcatagacaaggtcaaatcgaatttggagatgctgtgctcctgaacatatggactgaaggacagcgtttctagcttcgcttcctgtgactccgtattttgcagtacaaacatagtgtcaaataatgggttacggcttgcatcccgtgctacatccagcttttccaccaactcttccagtggataatcctgatgctcaaaggcttgcagcgtacgatctctggcttctagcaagtagctgtggaacgtttggttgcccttcggctgatgccggatggctagcgtgttgacgaacattccgatcagtggctccagctcaggcaacaagcgtcctgctactggcgtaccgatgatcaaatcgtcctgaccgctgtatttggacagcagaacggtgtaggcgcttaataacaccatgtacagcgtacttccggtctgtgccgcaattcggtgcagttgctcggatacatttgcgtccactgtaaattcatacatcgcaccctcgaagctgcgaacagcaggtctaggataagcaattggcaaatccagtaccggcaattctccggctaaatgctccagccagaagtgttcccggcgttggtatgactcacgctgcgtctcctgctgctgccatacggcgtagtctttgtactgaatttgcagcggctccaattcctgtccctcgtacagttgtaccagctcctgcacgatattgttagacgatacaccgtctgaaataatatggtgcatgtcgtacatcaggagatggcgctctggtccagtttgaataagacggacacgcagcagtggtgcctggcgaaggtcaaagctgcgtacaaaggactcgatataagcttcggcttcggactccctagcctgcaggtgctctactgcaaactccacttgatcgtaaacccgctgaacgacctcgccttccaccatttcaaaggaagtccgcagcgtttcatggcgggctattaactgacggaacgcatcttccagccgatcggcctgaagcggcccctccacggttaatacacccggcatattgtagctgagatccccaccttccagatggctcaaaatgtacagtcgtttttgagccgaggaaaccgggtagtacgcctgttgcgccgccgcagggatcaccgtataggtgtctgtcccgtgcgttgcgatgagctgggcttgctgctcaatcgtaaagtgttggaacacctcacgcagcgtaatccggctgtccagttcctgatggattttggccaccagcgtcgttgcccgcagggagtgcccacccacgtcaaagaatgagtcggtgactcctacgctggatagcttcaagacatcctgccagatttgggctagcttggcttccagcggcgtccgcggtgcaacgtactccaggcctccttcgagacgtgcttccggtgccggcaacgccttgcggtcgattttcccgttcggtgtcagcgggaaacgatccagttgtaccacatacgtcgggatcatgtaatccggcagcttcggctgcagcgcattgcgcagctccggcaaactcagggactctgaagctatgatgtaggcacacaggtccttgtgcccgtcttcgttttcccatgctgtgaccacggctttctgaatgccatccacggtcagcagctgcgcttccacctcgcccagctcgatccggtaaccccggattttcacctgatggtcgatccggcccaaatactcaatgctgccgtctggcaaccaccgggccaggtcgcccgtccggtacatccggtttgcgtgagtgctgtccgcttgatcggttgctgccgtatcagcgaacggattcaggacgaacttctctgccgtcagctccggcaggttcaggtatcctcgtcccacacctgcacctccgatataaagctcacctgcgatcccgatcggtaccagctgttgctggctgttcaagatgtacacggactggttcgctatcggcgttccgatggataccgtatgctcccctttttccagcagtgcgttcagggcttccacatcttcaatcgtataagcagtcgcatctaccgtggtttcggtcggaccgtacacgttggtaatcaccggacgatacccggaccacttgtgcaggaacacatttaccagctgcacggataatgcttcgccaccgatcaggtaatgcttcacctccggcgcttccgtcacatt
